United States Patent 11,242,544 (MICROBIOMES AND METHODS FOR PRODUCING MEDIUM-CHAIN FATTY ACIDS FROM ORGANIC SUBSTRATES) - sequence listing, part 2

SEQ ID NO: 13 - DNA, 475233 bp, Unknown
  Metagenome-assembled genome
ggaacgcattcaccgcggcattctgatccgcgattactagcaactccatcttctgtaggcgggttcagcctacaatccgaactgagatctgttttggtgggattcgctccgcctcgcggtttcgctgccctctgttcagaccattgtgcacgtgtgtagcccaggccataaggggcatgatgaatttgacgtcgtccccaccttcctcgtattgtctacggcagtcttgtttagagtgcccaactgaatgatgcactaatcacagggttgctccgttgcgggacttaacccaacatctcacgacacgagctgacgacaaccatgcaccacctgtcctctgtccccgaagggaaatcttatctctaagacggtcagaggatgtcaaggcctggtaaggttcttcgcgttgcttcgaattaaaccacatgctccgctgcttgtgcgggtccccgtcaattcctttgagtttcaaccttgcggtcgtactccccaggcggaatacttattgtgttaactgtggcactgacataactgccaacacctagtattcatcgttacggcatggactaccagggtatctaatcctgttcgctccccatgctttcgcacctcagcgtcgtatctgcccacaagccgccttcgccaccggtgttcttcctaatatctacgcatttcaccgctacactaggaattccgctggcctcttcagtactcaagtcttacagtttcaaatgcacgcaccggttgagccggtacctttcacatctgacttataaaaccgcctacgcgccctttacgccagtgattccggacaacgctcgtcccttacgtataccgctgctgctggcagtattagccgggacttcctcattggtaccgtccacttcttcttccccaataacagagctttacgatccgaaaaccttcttcactcacgcggtattgctgcgtcaggttgcccccattggcgcaatattccccactgctcctcccgtaggagtctggaccgtgttctcagttccagtgtggccgttcgccctctcaaccgctacctatcgtcgccttggtgagccgttgcctcaccaaccagctaataggagcgggcccatctttcggcccggagtttttgattatttcttcatgcgaaaaataatgtttgcggctttactcccggtttccgcggctattccgctccgaaaggcaggttgccccacgcgttactcaccgttcgccactgtctgcttcttaaatcaccaggatcataaaaagcttctcgttcgacttgcatgtgttaagcaaccgccagcgttcgtctgagccaggatcaactctcaagtaaaatttactcgaacagcttttagctgttttaagttctatctggttgctttgtttacccacagtctgctctgtgcttcgattaaagcagttctcactgctccggaatctaaaggtttttggtttgtgttttccgtttttatggtactattctctttttctatgacctgctgtcgcttcaagcgacaacttctttattttaccagctctcttcgttcttgtcaagaacttttttgaagttttttaaattttcttttcaaagatttttaaaatccttctgccgtaaattgcgctgaaacccgcttatttacttgctttcgagctgttaagttgtggctgtctctcgcgacaacgatatgtattatacacgcatctttaattcgtgtcaacacttttttgcagatttttttaaattatttttcagtttctttttgaggtcctatttcttcgtaaatcaaccggattctggagcactctccaggatccggtcttggcctctatctattaatgatagaatcgtgattctcttcacaaagaattttctgcatcttgcaaaaacgtcacttttccatcctcgaggtggaatacggccccggccacaacgacttcgtcaaagcaggccgtgcccattgcgtcgagcgcctgtcggacttccgccgctgcgtgttctacattgagacagcacgccttgtacggatcggtttctccgccggcggccttcgcgattttcgcgacaatgtgctcaatgtgctcgccggtctcatcagccaacgccgcaccgaccgcgccgcagccggtgtggccaaggatcagcaccagccgcacgccgagatgatcgaccgcgtactcaatgctgcccatggtttcgcggccgacagtgttgcccgctgttcggatgacgaacaactcgcccgtccccgcgccaaaaaccgcttcgggcacaactcgggaatccgaacaagtcagcaccaccgcgtaaggtgtctgcccgcctgtgagcctcataacgcttgctggcgacaaatcgccttcagcacccgtttcgcgccaagcccggttgccggcctttaatttatttagcgcttctgcgcctgatatgatcgagtccatcattttctctccttttgttattatcgtttagaaagacagggggcctattccaagatagatttcatactagtggcatttgtgctgctaattctaaatgaaaaccatcagtcacgtttattttcatccaaaagcgtttttgtcttctgcgtccgacacttttcacctgtatcaaaaaagaccagaacagcaatgctctggtctttttagctttaaactcagtctaaggtctttaagtattcgtcgatggacgcagcggctttcttgccggcacccatcgcgaggataaccgtcgctgcgcctgaaaccgcgtccccgccggcgaaaatgcccttgcgggaggtcgcgccttcgtcgtcggcgacgatacatttgcgtttgttgacttccaagcccttcgtcgtcgaagagatcagcgggttcggcgaggtgccgagggccatgatgacggtatcgacgtcgatatcgtattcgctgcctgggatttccactggacggcggcggccggattcatcaggttcgccaagttccattttgataacgcggatgcccttgacccaatcgttttcgtctacaaggatttcgaccggattggtcagcaagtggaactggatgccttcttctttagcgtgatgcacttcttcagcacgagccggcagttccgcttcgcttctgcggtaaacgatgtgggtgtccgcaccgaggcgcagcgccgttctcgccgcatccatcgcgacgttgccgccgccaactacgacgaccttcttgcctctgtggatcggggtgtcgtagcccttgaaggccttcatcaagttgttgcgggtcaggtattcattggcggaatagacgccgttggcctgttcgcccggaatgttcatgaagcgcggcagcccggcgccggagccgatgaataccgcgtcgtagccttcttcgtcgagcagttcgtcgatggttacggatttgccgatgacgacgtccgtttcgatcttaacgccgaggcgtttgacgttttcaacttcctttgcgacgaccttttccttcggcagacggaattccggaatcccgtaaaccagaacgccgcccgcttcgtgaagcgcttcgaaaatcgtcacgtcgtggcccttcttggccagttcagacgcgcaggtcagtccggcagggccggcgccgatcacagcgaccttcttgccggtcgaaaagttcggtttttccggcacgatattgtgttcccgtgcccagtccgcgacaaagcgttccagcttgccgatggcgatggcttcgcccttgatacccatgacacacgggccttcgcactgggtttcctgcgggcagacgcggccgcagaccgccggcagcagcgaggattcctgaatcgtcttaaacgcgtcttcaaattggcgttcgctgacgaagtggataaacttcggaatgttaatcgagactgggcagcccccgacgcatctcggttttttacaattcaggcagcgtttcgcttctgccaccgcttcttcttcattgtagccgtatgaaacttcttcaaaattggtagctctgaccttcggatcctgttcgcggatcggaacccgcttcattgctttcgccattattcgtcacctccgcatacgccgcagcccccgtgatgggtgtcgccttcttcgaacgccaatagcgctctgccttcttctgtcttgtactgggcctgacgcttcatcgccagatcgaaatcgaccttgtggccgtcaaattccggtccgtcgacgcaggcgaatttgacttcgtcgccgaccaccagacggcaggcgccgcacatcccagtcccgtcgaccatgatcgggttcatgctgacgatcgtcggaatcccgagcttcttcgtcgtcaggcagcagaatttcatcatgatcatcggcccgatggagacgcagacatcccaggtcttgccttcggccgcgagatcttcgatcactttggtgaccatgccgcttctgccatagctgccgtcatcggtcgtgatgtagagattgccggcgacggctttcatttcatcttcgagaatgaccaaatccttggtcttcgcgccgatgatgacgtcgacgtcgatgccgtgttcgtgcatccatttcacctgggggtaaactggcgcggtgccgaggcccccgccgacgaaaagaatcttcttctgtttcaattcttcaatgggcgttttcaccagttcagacgggttgcccagcgggccgacgacgtccatgaacgcgtcccctgtctgcagttcggccatccggcgggtcccggcgccgaccgtctgggtgacgattgtaaccgtaccggctttccggtcgtagtcacaaatggtcattggcagacgttctcccctttcatcttcgcggacaatcagaaactgcccgggcagacagtgcttggccacccatggcgcttccacatccatgcggacaatgttgtcggccaaatgcttagcctctacgatacgatacatatttcctcctcttttcacaatgtgaatctattattaaacgcagacggtctggccgtctggccgtttaaccgatgccttttaggcgttttggtgcccacgctggagaccggtgaccccgctgcggacaaattcgatgatgccgtagggttcgatcatgttcatgaacgccttagttttcgacggcgtgccggtaatctgcagaatcaggctttccttgctcacgtcgatcacgtgggcgcggaacaaattggagatttccacaatattggaacgggtccggccgtcggcctttaccttgatgaacaccagttctctggcgatggagccttccttcttcagctcggtgaccttgatgacgttgatcagcttgttcagctgcttcttgatctgctcaagggtttgttcgtcggcggtcaccaccatcgtgatgcgcgaaatttcttcgtcctctgtcattccgacagtcaggctgtcgatgttgtagccgcggcgagcgaacagcgcggagatacgcgtcaataccccgaatttattttcaacaatcagcgataaacaatgtttttcttccatagggtggacctcctttaaaactgaatgaagtccggatcaaccgtgcactcgacgagagtcgggcccggctgcttgagcgcttccgtcatgacctgcttcgcttcttcgtcgttggtagcgcggtaggccttgaagccgtaaacctcggccagctccacaaagggcacgttgaaattaatatccgttcccgaataatgatgcttcgcgccgtaattgtcgtgctgctgctggcgcaccatcccgagcttgccgttgttcatcaccaccagcttcaagggcagctgatgctccgcaatgacgccgagttcgcccatcgccatctggaagctgccgtcgccgcagacgccgatgacggttttcggattttctctagagccgaaacacacgccggacgccgctggaatcgcgtagcccatcgtgccgagcccaccggaggtcaaatatttgcggtcgccgcggatctggaagtggagtgccgcccaaacctgattgagcccgacatcggcgacgagggtcgtgtcttctggtgccgtgtcactgagccatctgaaaaagttccgcgggttgacgccgctgagattgggatctaaatcctcgtcccgatgcttgtcgtgttcggcctcgatgtcgtggaccgccgccatccattcgggggcagccgcctgaatgtcgtgttcgagaatttccatcagcacggttttcgcgtcgccgaccaccggaatattcgtgtcgttgacgttcttgccgatttctgccgggtcgatatcgatgtggatcatttccttctgattgagcacctcggtcgacgttccgcggttgctcatccgagcgccgacgcagagcgccatgtcggccatcttcacgatctggtctgtttccggatagccgtggctgccccagatgcccgcgtacagcggatgatcctgagggaacgcgccgatgcccatgaagctcgtcaccaccggcgcctgcatcgcttcagccagacgcaccaattcgtctcgggcgccgcttaaggtcacaccgccgcccgcgtaaatcatcgggcgcttgctctgcttgatctttctgagcacccgtttaatctgtccggtatgcccttcgtaggtcggcttgtaccccggaatattgagggtgtcaatgtgaggcagatggcgcagattttccgtctgaacatctctcgggatgtcgataagcaccgggcccggacggccggttgaggcgatgtaaaacgcttccttcaccacccgcggaatatccttcgggtttttaaccaggtacgagtgcttgacaaagggcagcgtcgcgccgaaaatatccgcttcctggaacgcgtccgtcccgattagatcgcggttgacctgcccggtgattgcgacgatcgggatcgaatccagatacgccgttgcgatgccggtgatcaaattcgtcgctcccgggccggacgtcgccaaacacacgccgaccttgcccgtttctctggcgtaaccgctggcgtaatgcggcgccgcctgttcgttgcgaaccagtatatgttcaatttttgaatcgatcaacgcgtcgtagatcggcagcagtgcccctcccgggtagccgaaaatcatctcgacgccttcttcttccagacatttaaataataattttgaagctaacatcctacctccttcttccctttgacgaacgatagattaaaagccgtcccaacaacggtgtcttcacgtaaatcgcttcgtggggacacatctcctgacagcagtagcagcggatgcattgtttgtattgataccggggaacgtgccctttccccttcttgtcgagggacagcgcctttggatcctgagggcagctgtcgacgcacacgccgcagccgacgcatttgtccccgtcgatgaccggcttgcgggtgatgacgttgcgtacccggctgagtgcgctcaggccgatcatgttttcgtccgccaccggcagccgctcgacgttgaaatcgggattgaccatcccgtgccaatcgtccccgacgtagtcgatctcgtcctcgcgccaatgaccgaggcccatccgttcgccttccacaaccgtcggcagataagacggatcgagcgccacaagccgcgcaaaggtcgcgtccaccgccaccgggtccgacgacagaatcagcacgtgcatcgccaccggatcgccgttgcccgggccgttgccttccatcgccgtgatgccgtccatcacgtagagtcttggcgccaccagcttgttcaaatcgatgagcatcctcgaaaacgcgtgggcctctgggaaccgcgcgtggctcgcgctcttgttgaggccgtagacacagccgaaggtgtttttcaccgcgccggtaagccgggtcagccggtgggtcttcatcttgcagatgctgatgacggcgtcggcctcctgaacgcctgccgcaatttcaaactgcttggtttgttcccccgccgggaaatcgacggtgctgccggcattgaactccgccagcggaatgtgatgagccgcggcgacagcggcgatgcccgaccggtcggcgacattttccggattgccccgccccggcgaatcgccgtaggtcagcctgccgcatcccgcctgttccaacgcgtcgatcacgccctcgaaaactgccggatgggtcgtgcacgccgcctccggcccttttcctcggagcagattgggcttaagcagaatgttttcttccggcgagacgaaggctgcgatgccgccgagaaggtccagccctctcgcgatcccctgccgaacctgttcagggtcgtaggattcacagcggatcacggcgaccttggatggtttttcctgcatgtcgtttcctctgctttccgtcacagcaaatgaatgccgtctttgccgatgcgcagcttgccacgcttctgcaaatggccgatggcccgtttaaaggcgcccttgcttaagccgaattccctgccaatgacagccggcggcgttttgtcgccgtaaggcaggaatccgcccgcagccttgagcttgcgcatcacgaccgcaccgtcggtgttaatcattttgtagccctgcttgtgggggcttaaaatgagccggtgatcgcggttccgcacctgggacacccgcgcccggacgtgggtcgcgatgtgaatatcccggttcatatcctgtctcgggattaagccgtggtattgatagtccacagcgacgaatgcgccgacgtttgggttgatgttgtagacgtagccgtgaacccaatcgccgaccttgtacggcgcgtcggccttcagccgttcgtacaccttcatcgtcgcgcagggccggccggttttgtcgaggtaaagggcgaccaggtattccttgccgatctgcacccgaaccgtctgttcgtggaagggcaggagcagatccttttccagtccccaatcgagaaaggcgccgattttcgtcaccgaaaccactgtgagcggacgcatctggcccatttcgattttgggctgccgggtcgtcgcaatcggtcggtcttccgaatcgaggtagacaaagaccgaaagggcttcacctgcggagaggccgctgccgccttcttttttcggcaggagcaccgtccccgcctccggacgttctggatcggcaagaaaggcgccgattttcgacagatgatccacctgaagggtctgggtctgcccgattttaaagggtaagttagagtgattcgcttccatgctttattttaatccctgttgattctgatactttactggagatcacggatttctttccgattttcgccaattgtactgctgagctggcccagctgctcctgaagcttggacaaaatattgtctgcgtagtgctgggtgccggtgcggatttccttcgcctgctcctgcgccgccttgatgatcgcttcggcctgaacctgcgcctgatgggtcacttcattctggtcgatcatcgccttcatctgcttggacgcgtcttcccgagtccggtccgcctgcttctgagcttcaaacaaaatctgcttcttgttcgcgacaatccgtttggattcttccagctcggccggcagggtttccttaagctcctcgatgatttcgatcgcttcctccgggttgatcatggccttcgacgaaaagggcacggcattgccccggtcgatcagctcttccagctccttgattaacgccattgttttatccattgtgattctgcccctcctgacgttggcggacggcctcgagcaccggctccggcaccagaccatcgaggttgcccccgaaggtcatgagctcccgaatcgccgacgagctgagcacagaataccggttgtctgaaatcaggtacaccgtttcgagctccggcgccagccgtttattgaaatagtccatctggccttcgtattcgaaatccgtcgcgttgcgcaggcctttgatcaccatcgtcgcgccgatctgcttcgcgtaatccgtcagcagcccggcgtaggtatcgatgaccacgtgatcaaaggctgcagtgctttcgcgaagaaggttcagccgttcttctatggaaaaccagcagtgctttttcgggttctttaaaatgcagacgtgcagctcgtccgctacggccgacgcccgccggatgatgtcgatatggcccatcgtcaccggatcgaagctgcccgggtagactgcaattctcaccgcgctacacctccttctcgttttcagacggcgtccagcggtaaaaatcgaccgcggtgatgccgtaggttttatgtttgatttgggtaaaataccccatagttaaaggcattataacagatttttcgtgttcaatcatcaagattccgccggaattcatgatttttttatctgaaatctggtgcgccaattcgaccggcgcttccgtcatgcggtaaggcgggtccatgaagaccaagtccgcccgcacaccggctgctgccagccgatcgagcccgcggtcggccggcccctcgacgatgtgagcgcggtcggtgtaatgggccttcgcgacgttttttcggatgagctgaatgctcgtccgggcgctgtcgaaaatccacgcccttttgacgccgcggctcagcgcctcgagggccatggcaccggtgccgccgaaacaatcgacaaaaaccgccgcatcccggacgtcccactgaattgcgttaaaaatcgcggccttcaccttgtccgtcgtcggccggacatcctggcccttcggctcgattaatttcatgccgcggcgttcgccgcctgtaattctcatgctgcctcctaattcatcgaaatcttgcccacgccctgatcaaaggcgttggacagggccgacacacagcgcatgtcctccgccttcggcgattgaatcagcgccagagccacatccttggtctcggcgatgagtccgctgtccgccgccgggtccagcgccgaaagactgggcaggccgtgctgccgggtgccgagcacatccccggggccccgcagcctgaaatcggcctcggcaatttcccggccgtcgtgatggttgacgatgaccttcatccgctcgacggttttctcacttaaattgttggacaccaaaaagcagtaggcctgctggccgccacggccgacccggccccgcagctggtgcagctgggacaagccaaagcgttccgcgctcatcacggccatcacagacagattcggcacgtcaatgcccacctcgacaatgctcgtcgccacgagcaggtcgattgcgccggcgttaaaccggtcgatgacggcctgtttgtccgacgcggtcattttcccgtgcagacagcccactcggtacagccccttgtaatactgctgcaccgactggtagacgctctgggtatcccggacgccttccatctcggcggaatcgtcgataaacggacagacgatcaggccctgctgcccctcggccatcagcttagccatgaagcttaaaattttcggcatcgccttctcggtgtagaaataagtcttgaccggcttgcgcccctcgggcatcgtgtcgatcaccgaaatgtccaaatcgccgtaaaggaccagcgccagcgtccgcggaatcggcgtcgcgctcatgacgagcatgtgcggctgctcgcccttttccgcaaaaacgccccgctggtgcacgccgaatcggtgctgttcgtccgtgatcaccatgccgaggttgtagtaatgcacgtccttttggaatagggcgtgggtgccgatgatgacctgcgcttcgccgttttcaatgtgcgccagcgcgttggcccgctccttctccttcatgctgccggtgatcagcgtcacagctatgccgtaaggtgacaaaaaggcgtcgaaatttttcgcatgctgctgtgccagaatttctgtcggcgccatatacgcgcattgatagccgccgagggccatccaataagcgcaggctacggcgacaatggtcttgccgctgcccacatcgccctggaccagccggttcatcaccctgccgctcgtcaggtccgcctcgatttccgacagcacctttttctgcccggatgtcagcgcgaagggcaggccgttttcaaaccgggtgatcgacgccaggtggtagagatgcacgttcgacggctctccggcgacgcggtttttcgcaattccgatgttgatcttcagcgcttcctcaaatttcattcgccgcctgccccgctcgacatctgccgctgtcttcggcagatgcagatcgtacagcatcacgtccgcactttccaaatcgtattttttgcgcagccactccggcaggatttccggcacggcgagggtgtccgattcctttttcgggtgcagaatccgattgacggttttgtgaaccccctcgctgcccagaccgccgattttgccgtagaccggcgtcaaatcgaagaaatcccccggcgcgtccgccagtgtgaattgggggttcacgagcacaggcgtccccttgctcacactgatcttaccgaagaaataataccactggtcttcctcgagccgatctctgagccacggctgattgaagacggtgacccgtccgcaattgccggcgtcgtcctcaatggcgcaatgaaaaagggacaggttccgcctaatatgccggactgtccctttttttgtaatcactgcttcaaccgtcaccggctgatccgtctgttcggtcagcgccgaccgcttggagcggtcgatgtacactctcggagtgtgggcgaggaaatcgccgacggtttcgacgccgtcggcacgaagggccgcttcccgtttcggtccgattccagggaccttccgaatggcatcctctaatttcatctgccctgaactccttattcgacagaaaggatgtagtaatacagcggctgtgcgccttcgctcacctctacatcgcagtcttcgtatttttcttcaatcgcgtcaaccagctgggtcgtgtcttcttccttcaggccgttgccgtaataaatggaaatcaattcgctttctggttccatcaggctgtcgatcagcttggccgtcacgtcgttgacgtccttgccaacggtctgaatcttgccgccggtgatccccatgatgtcacccttgttgatgacctggccgtcgatcttcgtatcccgtaccgcgtaggtgacttcaccagtcttgactgtatccaagacgtccgtcatcgccttttcgttcgcttcgcagtccgcttcggaattgaagctcagcatcgcggtgatgcactgcggaatggttttggacggaatcacgtggacgtccttcttcgacatcgtcgccgcctgattggccgcgaggatgatgttgccgttgttcgggaacaggaagatgtggtccgcgttgatcttgtcgatttcggcggtgaagtcttcggtactcggattcatcgtctgcccgccggagatcacgcgggtcacgccgagctctttaaagatttcggagaggccgtctcccggagagactgccacaaaaccgtatggcaccggatcaccggccggttctgcttccgcttcgctgtcatcgtcggacacgccgagcatttcgcgcatgttgtcgaccttcatgcgcgtcaaagcgcccatggtcagcgccttttcaaaggccttccctgggtggtccgtgtggacgtgcaccttgatcaaatcgtcgtctttaatgacgaggacgcagtcgccaattgtggagaggtaatcccgcagggcgttttcgtcggcgtcctgtgcgtgcttgatgatgaattccgtgcagtagccaaaggtgatgtcctccggcttcatgttggagtcgtcgacaaagcgttcgcggtcggaaatcttcggcttggccgcctgttccaattcttcgccggcaaggcctttcaccgccccttcgacgatgtagatcagcccctgaccgccggagtcgacgacgccggcttccttgagcaccggcagcatgtccggcgtgcgggacaatgcgtcctgcccctgcttgagcacatcagtcaggaacgcgagcatatcggtatattcggtgtagtgcgcctgggcaaattcggacatttcccgggcaaccgtcaaaatcgtcccttccgtcggcttcatgaccgccttgtaggccgtgtccgccgccgctttgataccgtcggccgccgctttgatgtcgagcacctgtttgcccttgttcgctttcgccaggccgcggagcagctgagacagaatgacccccgagttgcctctggctccgaagagcgcgccgctggacgcggtcttcgaaacggcgtagagctcgtcgttcttcagcttgtccaattcccgtatcgaattggcaaaggtcatgctcatgttggtgccggtgtcgccgtccggaaccgggaatacgtttaattcgtcgacattgcttttatagatttcaagattctgggcaccgaactcgaacattttccgcagcatcgtgccgtcaatcttttgaatttccattcgtccctccagaaatttatgctctgacactgacgacattcaccgtcacgcgtttgaccttcatcgaggtctgacgttcgacctgatatttgaccgctgagataatattttcagcgactactgaaattttgatcacctgttccacgatcacgtaaaggtcgatgatcagcttgccgtcgtcgtcgatgaccacgctgacgcccttactcgagcgttcccgtgtcaggagttcgatcagcccgtctgtcccgcgctgatgcgccatcccaaccaatccatagcactgcatcgctgtatcggcagcgatgtcggcaatggcttttctggaaatttcaattcgacccaaatcattttccaatttcaacttcattgtcgtctccttttatattgaaacgtttatttatgcgccttttggacgctattacccaattttaatggtattgaatcgttagatagatttattttaacgcttaaggggcataaagtcaaaataaagtgaaaaacttattgcaaacttttaaaaccctgtgttataatactttactgttaacacagacgattcgaataaggagggttgagaccatggcaaaagaatgctttgtgtgccacaagggtgttgtttccggcaactctgtcgcgcactccaataaacacaataaaagaatgtggaagccaaatctgcagaagatcaaaattgtggtcgacggcacaccgcgccgtgaatatgtctgcacacgctgcctgcgttctggcaaagtcgaacgggcataatcaagacccattcccatattacaaaaataagagccgaaaggctcttttttattttaattcaattttttattcagaaaggacgatgtcgacgaggagccatccggcctcaaaggcgatggtctggggcgccgtcttcgtcacgttgctcaccgtccagcctgaagtccgtcgggtcagcgtggcgtcctctagtggataatcaaagccggcaatcgtgaccgggccggccgtatccgacagcggcagcaggctgactgtctgtccggccggcagactgcacgtaatttttttcggccctttatataaggaaagatcattgtgcgggtcgatcaggtgaatctcaacatcccgttccgcagcgatggtcatcgcgtcgatactgctgagcatgtggtcgagacgggtgccggtcgcgccgtacagataaatgacgtccggatgggcctcgagcgcccgcgtcagcgccagctccgtatcggtctggtccttgcgcaccggatgggtttcagtcggaatccccttcgccttcagccgcttcagcacctccgggtcgatcgaatcaaaatccccgaccagcagatcaggcctcacatcgaggcggtcgaggagttcggaacccttgtcgactccgatgacgagatctggctggatgtccgcaagctgtgtgttgtaaaaatccgtatctgacaaatcgccgccggtaaacacggcggcttttcttttcctattatccatattttttctgctttctcaacgtctcaagcatttgaatgtagtgatcgtagcggtttttagaaatgcggcccgcttcgacgccctcgcgcaccgcgcatcccggctccttttggtggcagcagtcgttaaaccggcactgtcccttgggaaattccgggaaacaatcagcaagctgtttgatttgaacctgtttgctaatgttcagcgctgaaaaccccggtgtgtcgagcagccatccgccctgtggcaacgcgagcaattctacatggcgcgtcgtgtgccgtccccgaccgagttttttgcttaagtccccagtcgccatgactttatctccaagcaaagcgttggtcagcgtcgatttcccgacgccggaggggccagcgaggaaagcggttcggccgtcgatgagcgccgcgagctcagcggccgcctcatcccagcggtccggctgcgacacaatcaccgggtagccggtcttgcgataatccgctgcccgttcgacatccttgggccgcgccagatcctgcttcgtgaacacgagcaccggttcgatatcctgcgcctcacagctgacgagcatttcgtcgatcaaaaagccattgggcgccgggtcgcggaatgccgcggcgacgatgcccacgtccacattagacactggcgggcgcacgagctcgtttttacgcggcagaatatccgacagcgtgtattcaccatcctgactgtcgtccttttcaatctgaacgtagtcgccgaccatcggcgtcagacggcggtgtcttaaaattcctgcgggttttgccgtgtaagctgcgcctgctgagtccacaacggtataaaaaccgccgatcccctttacaatgcgtccggagatcggcgaaattgattgctgatactgcatatttagttgccctgctgttgagacgagctgctgctattgctgttgctattattgttattgctgttgttattgctgttatcgtcagtatcgtcctgatcgtcggtgctctgctgctgtgccggcccggagctgacaacaaagctaaccgatgagcccttcgtcacgctcgacccttcggacggcgattgggagatgacgacgcctttggcgtagctgtcggaattctgctgggtgacggtgccaacgctgaacccattggcttggagacggctttccgcgtcgctctgtgtcaagccgacgatccccggtacggacgacgtattcttccctttcgagacgtacagcacgaccttgccgtctttcgaaatgctcgatccggtgtttggattgaccgcgtacacgatgccggagtcgtaattgtcgttgtattcccgcttaacttctgaaaccgtcaaaccggcgtcttcaatcttggtgacagccgcgctttccgacaagccgaccacgctcggcaccgtcgtggtgctcttgccacggctgatcgtcacgcggatggcccggcctttgacgacctgggaattagccttcggcgtctgggagatgattttacccttggccacgctgtcgctgtacgcgtgcttgctgacttctacggtgaggcccacctgttgacaggctgctgtcgcctggctttccgtcatgccgcttaaatccggaacggtcacgcgctgacgggtcatggcgtaggcgatgattccggctgccgccgcggcaatcagcacaatgatcagcgcgattcggcgtctcttctttttctttctcaaatcgttgatgccggtaatgtcgtcggtcgtcgcgggatcttcttctctgaaaatatccgcggtcgaggcggtttccccgaccggactgatcgacgcgtccagcatgatttgatccaaatcctcgatgagctcgtcgcagttttggtagcggtcctccggcttcttctgacaaagccgcaccaccacgtccgacacactctgcggaatcgttggattgatctgattcggcggggtgatatcttcctggatgtgcttgatggcgatggacacggaattgtcgtcatcaaagggcagctcgccggtcagcagctcgtaatacatgatcccgagggaatacaggtcagagcgagcgtccacaaagccgccccgcgcctgttcaggcgagatgtagtgcaccgatcccatcgtctgattcgtcatcgtaatggtggcgctgctgatcgcccgggcaatgccgaagtccgtcaccttcggcgtcagatccgacgtcagcatgatgttctggggcttgatgtcccggtgaatgatgccgtggtcgtgagcgcatttgagcgcttccgcgatatcgatgatgaaattggtcgcttcttcgtaatctagactgcccttctgggtcaggtactgcttcagtgtgatgccgtcgacgtattccatgacgatgaaatagacgtcgtgatcgacgccgacgtcgtacaccgagacgatgttcgggtccgacaatcccgcggctgcctgggattctctgtcgaatttcttaatgaactgttcgttttccgtgtactcttcccggaggattttcaccgctacgtagcggttcagcttcaggtcctgggctttgtaaacgtaagccatgccgccgcggccgatcaattcgatgatcttgtagcggtcgttgagtatttttccgatcacgtcaatcctccttcatttgaaattctggcttgaaaataatcaaggtgatgttatctgtgccgccgttgtaattcgccagattgacaagcttgcgcgtggcctcttcgatgtcgttttccatcacgatgcggtggatttcctcatcgctgaccatgttgtagagcccgtcggagcagagcagcacctgatcccccggatacaggcggtattcaaacaggtccgccttcaaaacctcatcggttcccaatgcccgggtaatgatgtttttctggggatgatccttggcctctgtcggggtaatgcggccccgatcgatcagcgcctgcaccagcgaatggtccttcgtcaaatgttcgatgccgccggcgttgatgcggtaggcccggctgtcgccgacgtggtaaatcaccattttgtcggcgtggacgatggccatggtcagcgtcgtcgccatgccgagttcctccggctgcatgacgccctcgtggatgatctccttgttgatgtcgttaaaaaaggcgttgacttcctgataatcggtaaaatcctgaatctcgccgatgtgttccttgatgttgtcaatcgcgatctgactcgcgacctccccggaacggtgaccgcccaatccatcggcaaccgcgaacacgtagtagagaatgccgtccttctcgacgtttgccgcgagataggcatcctgattcgattttcgcttcgccccaatgttggtagaataagcacatttcattattgtatcaccttgtttcctgctgcgttctgtggcggagctggccgcaggccgcatcgatattttttccgattcgtcttctgacggtgcagttgatgccgccgtcctggagggttttcgcaaaatcatccacccgccggcttccggcgatgaccccgtccgaaatcgggttgagacgaatcagattgatgtggatgttttgatgccgaaacagacggatcagctcagccgcatcctccggccggtcgttgacgccgtccatcagcgcgtactcaaaggtaatccgccggcccgtctgcttaaaatagcgcgcgcaggcctggagcagttccggcagcgggtagcgcttggcgaccggcatgatgccctcgcggatctgctgcgtcggcgcgtgcagcgatacagccagattgatttccagcttctttgccgccagctcgtccattttggggaccagaccgcaggtcgaaaccgtgatcttccgctgaccgatgccgaagccgttgttggccagctcgataaaggcgagcaggttgtcgaaattggccagcggctcgccgatgcccatcacgacgactcggctcacgcgctcgccggaaacggcctgcgcccaaaagatctggctggcgatttcgccggcactcaaatcgcggacgacaccgcctcgggtcgaggcgcagaaggcacagcccatcgcacagccgacttgactggacacgcacagcgaaagcccgtagcggtaacgcatcaggaccgtctcaatacactccccgtccgcaaagcggatcaagagcttctcggtgccgtcctccggatcgcgctggcgccggaccacttcgccgtgatcgatcaccatggtttcagccatgcgccgcctgagcttttccggcagattggtgcacgcgtcgagggattcggctcccttatcgtacagccactggaacagctgcttgcctctgaatttcggctctcccagatcctgcatcagctgctggcactgatctagattgtagccaaataaattttccatgaaacctctttaaatctgattttggatccaaaaacccagattactcatataaacgtattataacaaaaaaaattatctgaataaagctcataattcattaccaattaaattgagtttttgctacaatgaatttaggaaaaggaggatgtattatgtctcaaatgacttatgtttttgggcatcaaaagccagacacagattcgatctgtgcggcgattgcgtatgcctatctcaagcgggaaacgggttccccggagactgaagcctgtcgattggggccggttaacaaagaaacccagttcgctttggatacctttggtgtggaggcgccgaggctgatcaaaagcgtcaaacctcaagtgagcgatattcatttgaacaatgactcaatggtcaccgaagaaaattcgatccaccacacgatggatttgatcatcgacaaccctggacgttcccttcctgtagtggatgaccagaaaaaactcatcggcattatttccctgccagacatcatgcacgcatattcagaccctttccaggaagacggcctgatgaaggcgaagaccccttaccgcaacattattaaaacactgaacgccagaatcatcggcgatacgcccgagggcgtcgtcaagggctgcttcttcaataattcgcagctcgcgcccgacaccaagctaagtcccgacgacgtggtcctgaccacgcgcaacgactcgtctcgggatatggccttcgccaatggcaacggctgcgtcatcatctccgatgtaccggcggatatggatatgcccattcccgaaagctacaccggcacgacaatgctgactgaaaaatcgacattcgaagtgatccgcctgctcgaacaggtcatgccgatccgccaatacgtcaaccacgataccatggaattttttatgctttctgaaaccctggaggacgtcaagggcaacatgctgtcttcccctcacaaccgtttcccggtggtgaccgatgacggcgtcgtcctggggaccatcaccaaatcctcgctgctcgattatcagcgcaagcgcgtcatcctcgtcgaccacaacgaaaagacccagtccatcgccggactggaagacgcggaaatcgccgaaatcatcgaccatcaccgcgtcgctgaagtccagaccgacgcgccgctttacatgcgggtcgaaccgctgggctgcacctgcaccatcatcacaaaaatgtatcaggaaaaggacgtcccaattccgaaaaaaatagcggggctgctactatcggccatcatttccgacacgctgctgttcaactcgccgacctgcaccgaacaggacaagcaggcggcacaggcgctggcgaaaatcgccgacgtcaacctgcgggaatacggccgttcgatgctgattgccggctccaacttaggagatatgacgccggcgcagatcatcggcaccgaccgcaagatctttacgatgggcgactacaaggtcgaaatctcccagatcaacacgggcgactacaagagcctgttcaacaaattgaaggatctgctcgcccaaatgcaggaaaactgcgaaaaggaaggcgccgacctggccattttgatggtcaccgatatcgtgctcggcggctccgaactgctgatcgccggcaaacagcgccatctggtgcgcgaggccttcgggatcgaagacgaagacatcagccaattcttcccgggtatgttctcgagaaagaaacaggttgtgccgccgctgatgcgcgtcgcatctgaagaataaaatcaactgacccttagaaaggacaaaaggagagcgttatgaacatcactgtttactgcggatcgaaattcggcaatcaggcccgctaccgcaaggacgccgaagcgttgggcacctggatcggccaaaacggccaccgtctgatttacggcggcggctggaccgggctcatgggtgcggtgtccaacgcagccttaaaggccggcggtgaagtgtacgggatcattcccgaatttttgaaggacatcgaactggctcacgacggtctgaccaaaaccgtcaccgtcgaaaccatggcagagcgcaagacgatcatgcgggaagaaggcgactttttcatcgcgctgcccggcggccccgggaccatcgaggaaatcaccgagatcatctccctgcgcaagctgaagcgccacgacaagcccgccgtcttttacaattgcgatcatttctacgattccgcccgcaccctgtaccgcaacatggtcacccagggctttctcgatcaagccacctttgacaccattgtctttgccgacaatctggaggccatttatcgggaagtcgaacgggaaatcgcaaaacgatcccacaaataaatgagcttaaacccaaacgacccacttcttaaaatttaagaagtgggtcgtttttatcatactgatccgctatttcgcgacatctgcgtatgcttttgtcaccgcgaaccgcttctgcgcgtagtcgcagagcggatgaattttcaggccgcgcgcccgcgccgcctcgacgacgcagtccaccagtttcccggcgataccctgaccgctgtaggctggatccacctcggtgtgggtcaaaagccagaggcgcccggaggcactcaccttgcattccccgatcactttttcgccgtccagcgcgactgcccgcatttcctccgggcggaactgaatatctgccattgtgttctcctttgttttcaatccttttgatttttcagaaacgctgcgatccgcttcgcagcgtgtgccgcatccaagcctaaatccgccatcagctcgtccgtcgagccgtgggggacgaattggtcctcgaccgccagcaccagcacgcggctgcccggcttgtgttcagccagccaggccgcggcccgctgtccatatccgccgattttgatgttgtcctctaatgtgatcaccggaccccgcgccgccatttggctgagcatcgccgtgtccatcggtttgatgctgcggacgttgacgagaccgcagtccacatccgcttcggccttcagccgatcgcagatggcagcaccgctttcgcacagatgccccagcgcgaaaagcgccgcgtccttcccttctcttaagatttccgaacgcaggccttcaattggctcctgatggtccgcgaaagccgtcgacgccgatccccggctgtagcgaatggccaccggaccgtcaatgtcgtgaacggcaaaatgcagcatcgccttgagctctgcggcattcttcggctccaacaccgtcatattcggcatctgcgaaaggaaggccgtgtcgaaaatgccttgatgggtttctccgtcgtggccgaccaaaccagcgcggtccaccgcgaaaatcacgtgcagattctgcagacagacgtcctcgagaatttggtcgtaggcccgctggaggaaggtcgaataaatggcgaccaccggaatcatcccctgagacgctagaccgccggcgaaggtcaccgcgtgttcttcctcgatgcccacatcgtaaaagcgtctggggtagcgcataccgaaggcctttaaacccgtgccgtcggccattgccgctgtgatcgcgacaattttttcacaggcgccaccctcttcgacgagggcttgtccgaacacgtccgaccagctgggcttagtcttcggctgcttcagctgacccgtttcaatttcaaagggcccaatcccgtggaatttgtccgggtggcgctccgccggctcgtagccccgtccctttttcgtcaccacgtgaaccagcaccgccttctgcagcttgcgcgcgtccttaaaggtccgcaccatctgcgcaatattggtgccatcaatcggccccaggtaagtaacgccgaaattttcaaagagcatttccggaatcatcatatttttgatgccgtccttcacgctgctcaaatggtcggcaatgggctcgccgattttgggcaggtgagccagccgccgcttgacgtggtccttgagctcggtgtaggacgacgccgtgcgcaggccgctcaaatagacggaaaggccgctcagattccgagagatcgacatttcgttgtcgttgaggacgatgatcacgttgcgcttcatccggcccgcgttgttcagcgcttcgaaaaacatgccgccggtcgacgcgccgtcgccgatgacggcgattaccgcgttgcggtcccccttcaaatcccgggcgcaggccatccccagcgccgccgacacgctgttggaggcgtggccggtgtcaaaggcgtccgtcacgctctcgctgcgcttggggaagccgctgaggccgccgtgctggcgcagggtgtcaaaatcgtcctttcggccggtcaaaattttgtgcacgtaggactgatgccccacgtcgaaaacgatccgatccttcgaaaaatcgaagaccagatgcagcgccatggtcagttcgaccgccccgagattggatgccagatggccgccggtgaccgacaccttctgaatcaaaaagcggcggatctcccaggccagctggtcgtaatccgctgggtcgatccggcggatatcgccgtttgcgttgattctggacaaaaccgacggccgcggacggcgttgacccttattggatttatcgtttaaattgtctgtcacagtattcaaatgtttcatttgcaatttcccgtatttccaagaccgtcggcgacgcgatcacctgatgccctgccatgaccctttcaatgatgtcgtagatgtcgaggaagcggatctcgccgcggcgaaaagccgcgttggcccattcgttggcggcgttgaaggcgcagggcatggagcccccggttttaatcgccgaaaccgccagcggcagccctctgaacgtctcgttgtccggcacgtcgaaatccagagacttcagcgccgtgaaatccagcgcgtccgccggcgacggcagatgatccggccaggtcagcgcgtactgaatcggcacgcgcatgtccgaggtggccagctgtgcgatcaccgaatgatcctcgtattcgaccatcgagtggatgatgctctggggctggatgacgacctgaatgtcatcgggatccacgtcgaagagccaccgcgcttcgatgacctctaaccccttattgaccatcgtcgccgaatcgacggtgaccttcggtcccatctgccaggtcgggtgcgccagggtttctttcaccgtgacgtgtgccaattcctttttgctcatgccgcggaacggtccgccggaagcggtcagcagaattttatggattttggagccagcctttccttggagcgattggaaaatcgccgagtgttccgagtccactggcaggatgttcacgtgatgcttttcggccaaaggcatgatgatatgtccggcggtcacacaggtttctttgttggccagcgcgatgtccttgccggcttcgatcgccgcgacggtcggctcaaccccgatcatgccgacgatggcagtcaccactgtatccgcctccggctgggacgccagctcgatgaggccggccatgccgctcaccacgcggatattggtatccgacaggcgcgttttgagcacgtccgcctgaccttcgtcgtaaaccgcgacgagggacgggccgaattcccgcgcctgcttttcagccaaatcgatggaccggcagcagcccagcgccgtcaccttaaacaaatcgggatgcatccggacgacgtcgagggtctgggttccgatggagccggttgagcctaaaatggccagatgacgtttcatcgcaggatcaccgccgtttctattcgcaaggatttatccatttgatctcctctctcgatgagttgattgctcattttataatttgtttatcattatatcacgtccgccgtcttttaacccattaaacgaaaaaaacccgggatgccccgggtgattctttccgtttatcaatcggcaaagtaatcgatctgcatcgcgtggcgcacttcgtctaaagtcttggctgccacctgttcggccttttcacagttcaccttcagcatatcgcgcacatccggcaggcgctgttcccacgccttgcggcgttcgcggatcgggcgcagccgttcctggagcacgctgttcaagaaacgtttgacctttacgtcgccgaggccgcccttttgatagtgggccttgacttcgtcgaggttcgcgtaatccggccaaaacgctgcgaaatcgtcaggttcgctgaacgcgtctaaataggtaaataccggattgccttcgacctgccccggatcctgcacccgcagatggttcggatcggtgtacatcgacatgactttcttcttgatgtcgtcgggttcgtcggacagatagatgcagttgcccaaggatttgctcatcttttctttgccgtccagccccggcagacgcatgctggcctgattctgcggcagcacgatttccggttcggtcagcgtttcgccgtacaccgtgttaaatttccggacgatttcgcggcattgttcgatcatcggttcctggtcttcgccagccggcaccgtcgtcgcgtggaacgcggtgatgtctgccgcctgactgatcggatagcagaaaaagcccattggaatgctggcttcaaaaccacgctgcttgatttccgccttgaccgtcgggttgcgctgcacgcgggaaacggtcacgagattcatgtagtaaaaggtcagctcggtcagctccggcaccgtcgactgaatgaacagcacggatttttccgggtccaatccaaccgcgaggtaatcaagggcaacctgcatgatgttctggcgcaccttttccggatgttcggcgttgtccgtcagcgcctgagcgtccgcgatcatgatgtaaatatcgtcgaaatcgccggaattctgcagccgcacccgttccctcagggatccgacgtagtggccgacgtgcaggcggccggtcggccggtctccggttaaaataacttttttcatctataagctcctttaaatggattttgattctggtttacatttttgtattatatcatgctgtggaatttggtgcaattctctaaagcacagacaagccgaagtaccatgccctccagcaaaaaacccagccaatcggctgggtttgtgtgttttttacttcaattaattattccgcggccttcggatctggcagcggcccttcgcggtgcatgttaaatttcgtcagatcgtagcgcttcaggttttcggtgatcgtgcgttgatcggcgccttcgatcatcttgtcgcggaccttcatcgctttattggtgtcatcgtgagcgtgggggccgtggctgcagccgccttcgcaggccatcccttcgataaagtcttccttcaggcgtcccttgcccatcatcatcagcgtcgtcttgcaggccttgccgccgctgacgctcttgatcttcatctggtcgacgtcttcgtagccctgttccttcatgtattcgacacaggactgcgccaccccgacgtcggcgtagcgcttgccgtagatcgacgcctgttgataattttcttcgaccggttccagttcgacacctgcggccttcataatcgcgtgaagttcagcaaaagtcagtacgtaatcggcgttgcccggaatcttctgatcgacgacttcggattttttcgcggtacatgggccggcgaaaacagtgatgcaccccggatgttccgccttgatcattctggacagctcgcacatcggcgaaagtgccgtcgaaatgcagtctttgttttccggataatgacgcagaatcatgttgacaaaggccgggcagcaggacgtcgtgcgtttttcgccgttcttaaaggcttcgtaccattccggtgcttctgccgccgtggttaaatcgccgccaaggccgacttcgatgtaatcttcaaagcccacttccttcgccgccttccgccagctggccatggtgatgtccttgccgtactgaccttccacagccggcgcgatcatcagataaaccggcgtattgctcttgagcgccttgatcaccggcacgatcgccgtcttcgtcgagatggcgccgaaggggcaggcgtggatgcactggccgcagcggatacatttttcttcatcgataactgacagcccatcttcgttgtaggtcagcgcgccgaccgggcaggagtttttgcacgggcggaccagatgcgcgatcgcgttgtacgggcaggccttcgcgcacatcccgcattcgcggcatttattcgcgtcgattctcgagcgtttttcaccggggtgaatcgcgccgaaacggcaggcccctaaacacgccttgcccagacagttctggcagttgtcggtgacgatgtaactcgaaatcgggcagtccgcgcaggccggttcgatgacctggatgacgttgccattgtccaccgcgcccggcgctttgccttcagccaggcggatacgctggcggaccacttctctttccttgtagacacagcagcggtagtgcggaatcatccccggaatgatttcttccggcaggttgtcccgttcttcttccaatgtaccttcaaacgtttttttcgcgacgtgatataaaactttatgctttagcgaaataatgcgcccatcattactcaataccgtttcctccttcttttttacatcgaagcggaatgacctctctccttaaggccagcccgctcaaatcagtccttcttttaattgacatttctttaacattattgtatcaaaatgatgtttgaaattaaatgcaaaaataagccgactttttcggcccttataaatgccaattcaacaaaaaattatccttttcttttaattgttttcattatatcacgatttcctatttttgttgaagaaaataaaaaaaacagggcaaaagccctgttcagactgtagacaaacgaggctctgagaaaatactcagagcctcgtttgatttaatatcaagctgcaatttgtagatttataaattgaaatcgaaatataggacgattcggtcccgggtgttttttttctaaataatatttttgctagtttttttagattcatgcatgcgaaagtaagcccactttcattctcatcgggctttaccgtacatttgtgtatatcggaatccatgcgcttccttcgctgttccgaagattctctcgatcgtttcctttctgcggttgtaaatgtccttcattccgatggtgtgtcggatgtcttcgcagatttccatgtaattttcccaaagatgtcggctgacgactttgacgtggtttttgctatgcgtgcactggctgagataaggacagtctttacatattcagaacgcttttgtattccctgaagccttcgcggttggtggttgaatattttaaaatttgattatggggacagatgtaacagtcaaaagcttcatcgtgacgtactcatattttttgaaaaatccctttttcgtcattggtcgttatacgggaaaacgggtttgatgccatcgtctatgagcagcttggcaatcgcaggggttttgtagcctgcgtccgctacaatgatttttggatgattgttttttatcttgtcataaaggcctttaaaggccgactgtctgcagatttccgggaaaacgtcataagctaaatccatccgtttcgatcgcaggcggtttgcgcggtgtaagcgaaaacttgtttgttttccctttgtgaaaccatccgctttccggatcggttgtgctgactttgatttctcgtgtctttcctgataacgtggatgatcgtcgtcatcatcatcttgctgattgtctttatctttcaatggcttttatgatgagcttctctgtccctttgatttcctgcattaattgtgcttcataaaacatcgcttcattttgggcgatcttcttctgtttctttttgttgttggctctcgctttgatatgagtagcatctacaaagatttcactgggatcaatcaacttgtgatggtaacattcaaaggatatgcgcaaagatttgttcaaaaggtctgtgtctttgaaacgccgggtatagttcttgctgaaagtggaaaagtgcggcaccttgtcgtgcatatctaaaccgagaaaccagcggtacgcgacattgacttcaatttcttttatggtttggcgcatacttttgatgccgtaaggtatggataaatggaattttaatcaacacaactggatcgatgcttggacggccctgatctgccgaatacttttcctcaaccatttcatagataaatgaccagtcaatgccctcatcgatcattcgaagaagatgatcttttggactaagtcgtccatacaaaatatttgaatttgatctcgtttcttctcaccgttttgtgtcagcatctttttctcctgcttactgaatgcatggcctgtttctattattgctaattttaccacgtttgtattgcgacaggtgaaaaatgactgactgctataaaaaaacaaagcctagagcgtttccctctagactttgtcgacagtctgaacagggcaaaagccctgttaaattgaggtaaattattcagttgtctgcttaatgattttcggtggaaaccggctgaggattggcctggtcggcttccccggtcagcatttccttgagggtgtgccatccgagcaccgcgcatttgacacgcgccggcatgtgggcgatgtcctgaagggacgccgcttcttcaagctcgtccatttcttcgtcggaaaggtggccttccttgatcattttgaggaaaagatccgcgagacgcagcgcttcttctttcgttttgccgataatcaaatcgaacatcatgtccgcagaggcctgagaaatcgcgcagccgtcgccttcgaaggcgcccttctgaatgatgccgttgtcgtcgacatcgagatggacccagatgtcatcgccgcagctcgggttcaggccttcgcaggtcatattggcgtcttccaactcgtgcttgtgcgccgggtggaggttgtgctccgtcagcacttcattgtaaaaggttcggttattcatcgtatcccatttcctttctgatcatgcccactgcatcggccagacggtcgatttcttccgtcgtgttgtagaaggccaggctggcccgcgtcgtcgacggcaccccgagataatggtgcagcggttcggcgcagtggtggccagcccgcaccgcaatgcggttttccgataaaatcgtcgtgatgtcgtgcggatgcaccccgtcgatcgcgaaggcgataatgccgtggtgattttccggttcgtccgccccgatgatgttcacgtggggaatggccttcaggcggtccatcgcgtaagtagtcaattccagctcgcgggccgcaatctggtcgatgccgatgtcgttcataaagtcgatggccgcagctaagccgacggcgccgccgacgttgacggtccccgcttcaaagcggtggggcacttcggtccaaacgatgcggtccgtcgtgacgatatcgatggtttcgccgccggtcataaacggcggcatcttgttcagccattcgctcttgccgtacagcacgccgatgcccatcggcgcgtacatcttgtgcccggaaaaggcgaagaaatcgcagtccatcgccgcgacgtcgattttcgaatggggcacgctctgagccccgtcgacgacgataatcgtgccttgttcgtggcagatcttcgcaaagtccgcgatcggcagaatccgtcctaatacattggacatttccgtgacggcgacgatttttgtcttcggcgtcagcgctgctttaaaagcgtcgacgctgatgctgccgtccttttcacagtttaagtaatgcaccttggcgccggtctgttccgcgagcatccgccaaggcagcatattagagtggtgttccatgatcccgacgaggatttcatccccttcgccgattttcaaataacggcccatgctgtaagccacgaggttcaagctttcgctggcattgcgcgtgaagatgatgtcttccttcttcggcgcgttgatgaaatccgccaccttctgtctggcgttttcgtaagcgtccgttgccgcgacgctcaaatcgtagagtccgcggaacggattggcgttttcagtctggtaataatgggtgaccgcgtcgagcacccgctgcggcttctgcaccgttgccgagttgtcgaggtaggccagatcggtctgattcagaatcggaaattccttccgaaccgccgctacatcaattgttgattttgccattccattcacctcattcttttcccgcgcgctgatgcgcttcgatgtaggcctgcacgtcttcgcggacggcctgatccggaatcaaacggctcgccgcctccaatttcgacttggcaatcaattcgtagatgtcgtcggcgttcatcccacggctttccatatagaacatcagctcgtcgtccagcttgccgatcgtcgcgccgtgattcccttcgacgtcttcttccgcgcagagaatcagcggaatcgtcttgttgaccacggtgtcatccatcagcatcacatcttccttttcgttgccgacactgccggccgcaccgtatttgaaatcgatggtgcctcggaataatttttcggcccgatctctcaaaacgccggcggagttgatggcgctttcggtcttcttgccgtgatggagagcgatgtagttggtgtccaacagatcttcgttctgcaccagataagcgacgtcggccttgaagctcgagcggtcgcctttcaggtccgcctggcaccccacgtaggtgtccgccgcgtccatcaccagatggaccacttcaaaccgggcgtcatcttcgagtacggcgccgacatcgttgaaaatgcgctggcctgcgccgcctcggtgaatctgcaccagcgtcaccgccgaccccttcgcgaggtgcagcttggtcgaaaagcctgcggtgccggccgcattgtctgactggcctgcgaagtccatgataatcgtcagcgcgctgtctgcggcaatgtcaaagcgtgtggctgacgccgtcgtggcgccgccttttaaggtgtaggtcagcttcagcggttcttcaatgtgctggcccgcttcggtgtgatacgccgccggttctgcggtctgaatccaccggtcgtaatccgggcccatcccgccgccgatcggcgcgaggtccgcgccttcagcgagagctgccggcttgaccgtttccgcttcaagggtgccgctctgtgtatcgactgccacgtgggcgtcgttcatcttcagccagttccaggtctgccccggcaggcggttgacgactaaatttgttgcttgttcctgtgcgctcatggtcatcaccctatcgttcctttcatttccaaacggatcaaattgttcatttcaacggcgtattccagcggcagttccttggacacgttgtcggcgaaaccgctgacgatcatcgcccgagcgtcttcttcggagatgccgcgggacatcagatagaagaccgcttcgtcactgattcggccgatcttcgcttcgtggccgacatcggcgtcttgtgtccggacgtccatcgccggaatggtatctgatctcgaaatgtcgtcgagcatcagcgatgcgcagctcaccgacgatttcgcgcctttcgccttgttgttgaccacaacggatgagcggtaggtggaaatcccgccgtccttcgaaatggatttggcggagacgaccgacgtcgtgttcggcgcattgtgaaccaccttcatcccggtgtcgaggttctggcccttgccggcgaaggtgatgccggtgtattccatctgtgcgccggcgccgttcaaaatcgtcatcgggtacagataggagacgtgggatccgaaggatccggagacccattccatcttgccaccttcttcgatcttggcccgcttggtgttcaggttgtacatgttcttcgaccagttttcaatggttgaatagcgcagtctcgcatttttgccgacgaagagttcgacggctccggcgtggagattggccacgttgtacttcggcgcggagcacccttcgatgaagtgaaggtctgccccttcgtcgacgatgatcagcgtgtgttcaaactgtccggcgcctggcgcgttgagtctgaaataggactgcagaggaatttcaaccgagacgcccttcggcacgtagacgaaggaaccgccggaccagaccgccccgtggagggctgcaaatttatgatcgtgcggcgtgatcaggtgcatgaagtgttctttaatcatgtccgcgtattcgccgtgaagggcggattcgatgtcagtgtagacaaccccttgttccgcgacttccttgcggacgttgtggtacaccagctcggagtcgtactgagcgccgacaccagctaaggatttccgttccgcctgaggaatgccgagacgttcaaaggtgtccttgatgtccttcggcacgtcttcccaattggcgctcattttggtcttcggccgcacgtaggtgacgatgtcgtccatgttcagcccgtcgatcggcggcccccattggcccattcccttctggttgaaaatttccagggacttcagccgaagatcccgcatccatttgggatcgttcttttcttccgaaatctgttcgacaatttcaggggtcagcccgctgtcgaccttataaaaatctttgtcgttttcgtcgtaccggaaatcgtaaagcgaccgatcgacgtcttcgacgtatgttttttctttgctcatcagccgtcctccgatttattctgctgccttggcttcgtatttttcgtagccatcccgattgatttcgtcgaccagtgacgcgtcgccgccgccgaccacctggccattcacgagcacgtgagtgcggtcgacctttaaggagctcaaaataccggtgttgtgcgtgataatgagcagcgcgccgtcttcctgtttctggtattcttcgacgcccttggaaaccgtgcggaccgcgtcgacgtccagaccggagtccgtttcgtcgaggatcgccagcttcggcttgagcatcagcagctgcagaatttcagcctttttcttttcgccgccggaaaagccgacgttcagatcgcggtcgacgtagctcggatccatgtcgagaatttcgcattccttttcgagctgctttctgaagttccagaggcggacccgttcaccagtgcgctgttcgacggcgttgcggatgaaattgcccagggtaatgcccggcacttccagcgggttctggaaggacaggaacaggccggccttcgcgcgctgatccgccgtcatgtccagcagatcgctgccgtcgaacaggacgctgccgcctgtgacgtcgtagcgcgggttgcccatcagggcgtaacccagtgtcgatttccctgcaccgttcggccccatcaacacgtgggtttcaccggtcgcgatatccaaatcgacctggtgcagaatttctttatcttcaacattaactgtcagttgacgaactttaagtaatgaatttgccatgataatttacctccaacttaatatccaagtgatttactcggaatacaatcgtaagtatattactttttattcagcccgtcaacttttttctgattttcctgaaaattttcactcgatgcgctgaaaatgcaaaaaatccccgaacccagatgggttcagggactcgcatttaagccttcagcctgtcttgcagcgccttaacgataatcttcagcgccttaacgcgggcgtattttttatcacaggactcgagaatgtgccagggcgcaaaggccgtgctggtcttttcgatcatttcgtcgacggcagtttcgtactgcggccacttgtctcggttgcgccagtcttcgtcggtgattttccactgcttgtccggcgtcgcctcccgctccttgaagcgggccagctgcgtatcaggatcaatctgcagccagaacttgatgatcacggcgccccattgattcaggctgtactcgaattcgttgatttcgttgtaggcccgctgccagtcgttttccgagcagaagccctccagccgttcgaccatcacccggccgtaccacgtccggtcgaaaatcgcaaaatcgccggccttcggcagcttttccacaaagcgccagaggtaatgccggttcttttcgtggggctccggcgacgcgatcgggtgcacggtgtagcccctcgggtccagcgcctcggtcacccttttgatgttgccgcctttccccgctgcgtcccagccctcgtagccgatgatcaccggaatctttttgcggtgcatccggttctgcagatcgcttaattcccgctgatactttttgagcagcttgcggtattccgatgcttccagcgtcttatccgctaaatctacgtcggccagcttcggcatcggcgtcagcgcgaagcggttctgcagaatcggcacggctgtccctttgttttgaagggccgtgtcgatcccctgggtgataaaccgaaggacctgcagctccgtccatttctcgtcttccccggcgtcgacgatgacccacggtgcgtaggactgattcgtccggctcaaataattgtcgtacagcctttcaaattcacggtaatgcttgttttcgtccaaatcatcccggtccacccgccatttggtattcttgtcagcctctaagcgtttaatgcgctttttctgttccttccgcccgagctggaaaaagaacttgaggatcaaggtgccgttgtcgtggagcgagcgctccatcgtgttgatttcgtcgatggtctgctgaaaggccgcgctgtccagacggccgctgaaggcgccgtcggtcacttcctccatcatgtagggcacgaaaaacgtgaatttgccgttttccggaatgtccagcaggtagcggcggataaaggggtaggccttttcctccttcgtgggcttgtcaaaggacttcaccttaaaaaaccgcggatcgatgtccttgatcacccgggacagcaccgtcccctttccggcggcgccccacccttcaaaaatcaccataaccggcagcttggccgccgcgatgcgcagctggtccttgcccaggcgtttttccagtgccttgcgttcggcgtttaggctttcatcgtccggacggtgcgccggtacaaattcctttaacacaatgatccctcccttattcttagatggtttaagtgtatcacggcgcctttaatcctaaataaaagcaaagctgaatccgataaccatcacgttaagctttcggcacaaaaaaagaatcacagaggcatctgcatatctctgtgattctttatttatttacgctttattttattattttaccatcagccaacttctgacccggccggcatatcgccgtccaccgtcagcacacggagtgccccgtccttttcagcggagagaatcatcccgttagagtcgacccctctgagcttgatgggcttcaagttcgtgcaggcgatgacctttttgccgaccagctcttccggcttgtaccatttggcgatgccggaaacgatctggcgtttttcgtcgccaaagtccagctggaacaccaaaagtttgtccgcgtccggatgcttttcgcaggataaaacttctgcgacgcgcattttgaccttgccgaaatcgtcgatcgtgatgacccccggcgtctgcggttcagctttttgtttcgcctttttcgctttctgtgccttggccttctgagccttttccttttcggcccgttccttttcgtactgtttcacgtcaattctcgggtacagcggcgcgcatttcttcacttgcgtcccggccggatactggccaaaggtctggatgctgtcccaggtttgaaggtctggcgtgaggttcaaaatcgcgctcatcttttccgccgtttccgggatggccggcgcaatcagcaccgacacgatgcgcagggtttccgtcaagttgtacagcacagccgcgaggcggtccttctggctgtcgtccttgccgagcacccagggttcggtttcgtcgatgtatttattggcgcggccgatgagcttccaaatcgcctgaagggcgcggctgaagtccagcttgtccatatatgcggcgtattcgtcgatggcgtccttcgcggtctgcttcagatcgtcgtcgtgatcgccggccagctgagtttccggaatcacgccgccgaaatacttcacggtcatcgcaatggttcgggacaacaggttgcccaggtcgttggccaaatcggaattgatattggcgaccagcaggtcttcgttgtaaaccccgtcggagccgtacttcatttccttgagcacgtgatagcgcagcggatcgaccccgtatttttccgcgagctcaaccggatcgacgacgttgcccacggatttggacatcttgccgcccttgagcagaatccagccgtggccgtaaacggtcttcggcagcggcagatccagcgccatcagcatgatcggccagtaaatcgtatggaaacggatgatgtccttcccgaccaggtggaggtccgccggccagtacttgtccatcagctgcggcttgtcgtttaagtagcccagcgccgtgatgtagttgctcagcgcgtcgatccagacgtaaacgacgtgtcccggatcgaaatccaccggaatcccccagttgaaagaggtccggctgacgcacagatcctgcagtcccggcttgatgaagttgttgatcatttcgttcttccgggattcaggctgaatgaagcccggatgatcttcgatgtactgaagcagccgatccgcgtatttgctcattttgaagaaataggcttcttcgtgagccttttcgactggacggccgcagtccgggcatttcccgtctaccagctgggtttccgtccagaaggattcgcacggcgtgcagtaccagccttcataggtgcctttgtagatgtcaccctgttcgtagaagcgcttgaagattttctgcacgctcttgacgtgttcttcgtcggtggtgcggatgaactgggaatagttgatgttcatcagcttccacaaatccttaatcttcgcaaccgttttgtcgacgtaggccttcggcgtcacgccggcagcttccgcgagcttctgaatcttctgtccgtgttcgtcggtcccggtcagcatgtacgcgtcgtagccctgctgctttttgaagcgggtcagcgtatccgctgcgacggtcgtataggtgtgcccgatgtgcagatcaccgctcgggtaataaatcggtgtcgtcacgtaaaaggtttttttcgattctggcataaaatcattcctctctgatcaaaagcggagtccgcttttgtttcctgatatcgtttctgattctattataatttatcccatttaaatgttcaataggccggcgtcacgacggcgaatcgccgtcgattttgaccattttgtagacctcccgcttcgagatgccccggtccttcgcgacagccttcatcgcgtccttttcccgcatgccttgatttaagtaatgggccatgtgttcggcaatcggcccttccgacaggcgggctgcggcgtcatccgccaccattgccgattcgccggccccgtcaatgaccaggacgaattcccctttcggcgggtgttcggtgaaataatcgagctgtcccgccaccgtgtcccgcctggtctgttcgtagcgcttcgttatttcccgggaaatactcatttcccgatcaggaaattgcgccgccattttggacagggttttcagcaggcgatggggcgtttcgtaaatcacgaccggccacggcgatttttcaatcgccgtcaagccttcttgaatcgactgattcgattttcccagaaaaccgtaaaacacgaaatgctggcagttgatgcccgatagcgcgacagccgtcaccgacgccgtcggtccgggcaccgcggtcaccgggatgcccgcgtcctgacaggcgcggatcaaaatccgccccgggtctgagagcacgggcatccccgcgtcggagaccagggcgatgtgggcaccggcctgcattttctcgacgagctccccggtcacagccttttcgttgaatttatggtaagccgtcatcggcgtgtgaatatcaaaatggttgagaagcttgagcgtgttgcgggtgtcctccgccgcgatcagatccgcttcctcgagggtcctcacgccccgaacggaaaaatcctcgagattgccgatcggtgttccaacgattgacagtggcatgtgcgctccttttcgaatcaaaattataagccgttttaaaacggcacgttcgccgcagcgggcgccggctcatccgggtactgcttgtcgtccgcccaatccatgaagcgggtgtattccggacgccaggtcaggttgatgcggccggtcgggccgttacgctgtttggcgacgtccagctcggccatgtacgggttgccgttttccttgtcgtaatagtattcgcggtacaaaaaaagaacgacgtcggcgtcctgttcgatggaaccggattctctcaggtccgcaagcagcggatggtggtccggtcttccgtccggcgcacggctcagctgcgacaggcagatgattgggcagtccagttctctggccagcgccttaagcccacgggagatttccgacacttcgttctgtctgttttccgaacggccgcggccgctcatcagctgcaggtagtcgatgaccaccaggtcgagccccttttcggccttcatccgccgggtcttggctcgaatatcggccaaggtctggccgccggtgtcgtcgatccagattttcgtgccgtagagccgcgccgaggcgtcgccgaggatctgccattcctcgtcgctcagcgtccccttgcggaccttggacaggtcgatgagcccttcggaacacagcatacgctggagcagctgcgtccgggacatttcgagactgaaaatggcgaccgtcgcgttttcgtgaatcgccgcgtactgggcgaggttcagcgcgaaggcggtcttccccatggacggacgcgccgcgacgtaaatcaagtccgaattctgaagaccggaggtcttgaagtccagctcggagaatccggtggccagccccgtcagctcgccctcagcctcgcggaccttttcgatgtgatccagcgtttcgttgacgacatcctgcacgctcgtgaaatcgccggtgatctgtccttccgcgaccttgaagattttctcttcggctttttcgaccacgtccgacacgttttcgaactcgccgtagcagtcgtcgatgatgctcgacgacgcctcgacgagacggcggatcaatgcctgatcctgaacgatgatgcagtaatgctcgaagttggcaaacatcggcatcgcattttgaagctcggccagataaaccgggccgccgatcttttccatcagattcagattggccaggcgctcggtcagcgtgaccaaatcgatcgggatgccttcctcccgcattttcagcatgttttcgtagatcagccggtttcgggctgaaaagaagtcctcgggccgaaggtgttcctcggccgtcatcagctgttcggaattgacgatgagcccgcccagaacagaggcctccgcctccaggttgtggggcagctctttaggttttacagcaggcattgcattaggggcgcttatttttcagtgacgatgaccgtcagcttgccgatgacgccaggcgcggttttaattttgaccgtgaaatgaccgacgttgcggatggcttccggcatgtcgattttgcgcttatcgaccacgaggccgaggtcagcttccaggtgttcggcgatatttttattggtcacagagccgaacagcacgccgtcatccgcagcccgttccttgatcaccaactgggattcgtccagcttctttgcgagatcaatggccgcctgacgcgcttcttcgcgctgtttggccagttcagcctggtgagccttggccttttcgatgttttcctttgtgcccttaacggccagtccctttttgatcagaaaattgttgccgtagccgctcttgacattgacgacttcgccttctttacccacatttgctacatcttttaataatactactttcatgattctgttttcccttctttataggattctatcgcggcgatcagctttttcctggcttcctgcagatcgtcgcagtcggttaactgagcgccggccatcgtcaaatggccgccgccgccgagtttttctaatatcagctgaacattcacctcacccattgaacgggcgctgatgcaaatcccttcatcgcttttcagcaggataaaggacgcggtgatcccgcggatgttgagcagctcgtctgccgcctgggccgcgatcagcttgccgttggcgttgtgattttcgtacagcgagatcgcaatggagttgtcgtaaaattcggcgttggtcaccgcttccgtgcgcgccgaataggtttcaatatcgttctgaagcagggtcttggcgatgaccgtatcggcacccttgcgcttcagataggacgccgcctcgaaggtgcgcacaccagttttggacatgaacatcttcgtatccatgcagatcccggccatcagcgcattggcttcggtcttgcccatgatgtcctttttgttgaaatattggagcagctcgcagaccagctcgcaggccgacgatgcgtaggcttcaatgtacgagaacaccgacgccttgatcgcggtgcccgacggccggtgatggtcgatgagcacgctgttcttgacctgatccaccagctccggcatctcgacgtagttcttgttctgggtgtcgacgacgatgagcagtgtaccttcttcgatatagttttccgcttcctgcggcttgatgaagcactcggtataattggcgtccttgctcaaataatccatgagcgagcggatgctgacattgatttccttgagcacgaatttcgcctcgcggttcaatgcccggcaggccccgatcagcccgatcgccgagccgacgcagtccatatccggcatctgatgccccatgatgacgacgttgcgcgcttccacaatctgctcctgcagcgcctgcgccttgactcgggccttcaccttcgtgcgcttttccttcgcttcggtttcgccgccgtaataaatattgtggtcgtctttccgaacgacgcactggtcgccgccgcgggccagcgcgatgtccagcgccgagcgggagccttcttccgcttcgggcagcgtcgaatgctcttctgaatcttcaatcccgatagacagcgacacggcaccgccttccttgctgagctcgcggacttcgtcgagcacccggaaatggtcggcttccattttttcgaggtcgtcgtgggaaaagaccatcaggtaatggctgttttcaaatttctgaagcacgacgccattgtgctgcgcccagcggttcagcaccacgtcgatctgcgcaaaaagctccgttcggcactgcggcgaaaggctttcgcttaaatcctcgtagttgtcgatttggatatacccaagaattgtgcggctgtgatggtaatgggcctcgctgtttttaatctgggtaatgtcaaacagatgaaacaaaagcttgcgcttatcggctctgaaaaactcggtaatgctcatcaggtaggcgtggtcttcgtaattgagctcgtggaacgtcccgtcgcccttgacctttttcgggtcaatcccgatgatctgcgcgaaattcgtgccggttttgctggtctgtttgccaaactggcgcacaaacagccgattggtcatcaacacccggccgtcatccgacgtaatcgcgatggcgacgggcatttcgtacatccgatcgtgggtgattttcgagaccttgcgctcgatcagctttttggtcgacaccgtcttcttgatccgctggtgttcgatgatctgcgcgccgatgacgacggcaaaagtcaggccgatgatcactgcgccgatgacaaaatggtcctcacagacgtaaaggccggtcaccacaccgatgaccgcaagcaatgtattggctgtaaatattttattcatgattaccgtctcctgccgctgtctctcagcacgatgaccagacgcatattcgtgtagacgtccacaatcccgatcaatgacaaaaacatcgcactggacggaatgatcagcagcacaatacagatcagaaccttccggcccatgctttccttcggcagacgccgattgaagagccagtataaaaaggacagccccatcatcgaaaagcccagatcgactaaattgttcagcgtcgtgacgtaaatgttgccagagcctgcggtaaactgtgcgatcagcagcacgatcaacaggatcaacagaaaattccgcaggggtttggacatcatccagtggctgatcggccgaaggggctgcgcggccggacgggtccggctgacggtcttgtcgcaggcgatgaccaaaatccatgccgcaaaaaagggcaggatcaaaaagaacgacggcagggcctgcttagtctggtcgattaggctgtcgatcgcggactgcacctgcgccatctggcttttcgtaaagatatccgtgttctgatacgaagccgtcagatttttagcataagcctcaattccctttgccagcaccccgatgaacgccgtgtggtgcacgatttgatagacgatcatgccgccgatgatcgacagaaaaaccgcggcgtaggcggcgatcatccgctgcttcccgctcatttccttttcgtacatccaggacagaccgatgccggtcagcgccagataacacgtacaggcgaaaatcatgacgggattgcgcgtcaggatcatcacaatcggtgcgacgaccgtcggcagaatcgttttcttgaacccttcccggcggcccagatccacccataaaatcgggataaacagatacaggaagatcaagatcggtattctctgaaataaacagggaatgatcccggcgatcgcgccgtaaaggatgggttcccaaattgatttagttttcataaaagcctctattcaattatactgttgtcgtttttcttatgctgtcttttttcgtaatgagatattatagcatagccctgtgtatttttcattaactcctcgggttataatcggattatctattgcgcgttatgttaaaatatgcgtaaagaatttgaattctagttttcggaggtcaacatgattcgttatcacattctcgtatcgggccgcgtgcagggggtcggcttccgctacaccgcctctcacctggccagtctctacaacttgaccgggtgggtccgcaactgctacgacggcagcgtcgaaatggaagtccaaggcgatcccggcaatatcgatttttttatccaaaaactgaaaaccgagtcgcggtggatccgcatccgttctctcgaaaaaaaacagattcccctcgaatccggtgagaccgtctttcacgtcagatattaatccaaatgattaagaaaaacgaactaaataaacaatgaaattaggcgttaaaataaaaaacagaaggaattgttccttctgttttttaatggcttaaaatgcttattaaaagttgtctgattgatatggcagcaatgcgaggttgcgagcgcggttgacagcctgggtaattttacgctgatgctttgcgcaggcgccggttgcgcgtctcggtaagattttgcctctttcagaaacgtattttctcaaagtagcaacgtctttgtaatcgacctttaaatcttcgttttcgcagaactcgcaaacttttcttcttcttctgaatggtcttggcatattatttctccttattaatggagcttagaacggtacgtcgtcgtcgtctgccagcagatggaaatcttcatcgatatcgtcattgccgtcaagggacacgctgttattgttgctgggctgggaattgttcatcggcgcgccggtatcgttgcggctgccgataaagtcaaattcttcgagaacgacctctgtcacgtaacgcttcgacccgtcattcgcagtgtaattccgagtctgaaggcggccagagatggcaatctggcggcccttgcgcaggtattggctgatgatttcaccctgtttgccccacgcggtaacgttaaagaaatccgcggtcggctgaccgtcccgtttgaagcggcgatcgaccgcaatggcaaatgaacacacagaagtgccgtttgtcgtggtccgcagttccggatctcgagctaaacgcccaactaaaataaccttattcatcgctccgtttcctttcctaatttatcaaaaacaattagtcttcaatcgcaacgatcatatcgcggatgatattgtcgttgatcaagtaacgatggttcaattcgtcgagaactgacggttcagccttgaatgtaaccagaacgtaatacccttcggtatatttgttcgcgattttgtaagcgagtttacgcttgccccattcatcgacaccatctacttcaccagctgtttcaataacagatttgacgttattgataatggcgtccatcgcttctttttccatatccggattcaaaacaaatactgtttcgtaagccttcatggtttcacctccttatggtctaaatttggcacagttttggcctgcccttcagcaggagtacacctttcaaataaatgaaagcacaccctctgtgcaaggatacatactgtgcgtattatatcagactcccgtctgaggaatcaagatttttctgtaaaacttatagaatttttttgagcattttttcaaatttctgccgaggcagcgtgacgacgcggccgcaccccgtgcatttgaggcggatgtccatgccgaggcggatcacctcccatcggttttcaccgcaggggtgccccttcttcatttcgaccacactgccgacctcatactgcctgtttgccatcgcttccgccttccttttcttccacgacccagacggtgttcttcggaatggcgacgccggccttttccatcgcctggtaaatcgcctggcgcatcgtgacttcagcgctcagcgaatgcagggcgtcggagaacacgaagagccgcagcgtcgcgtaggagccgtccatatccgtcatgcccagcacctttggccgaaccgggaagagctccttgtcgtcgttgtacacaatgtcgcagaccttgttggcgatcttcgtcacgtcgacgacgctggtgctgccgtccaccttgatgtccacgcttttgcggtagtagccccgcgagcggttgaccagatggttgatttcgccgttgcgcacgatgtacaggctgccgtcgtcctgacgaaccgaggtcatcattgtcgaaatgtcttcgatgatgccgctgtgtccgccgtcgagctcgatgtaatcgccgacgaagaattgttcctgcatgatgatgaaaataccggaaatcacgtcctcaacgatgcgcttcgcgccaaagccgacggcaaccgtgccgacgccggcgactgtaatcagcgctgaaatgttgatgaagtaagacaggataaccaagatgccgacaatcatgatcgtcgtgttgaccaccgacttcgtcagcttcgcaatggtcgtgctgcgcttttcgtcctcccgcgtgttggtcagcgggcttttcctcgtgagcttcagcgtacgcttgatgatggctgtcaaaacctttgacgcgatccacatgaccagaatggtcagcgcgacgctgatgaccttgttcacaatcacgtccgtgttgatggagccgacaaaatgtgtccagactctgccgaaataagtttgatcgatctcgttcattttgtttcctttaatatgaccctttctcttttaaataaaaaatgcagcgtgggctgcattttttaattcgcattatttctttttccgtctgctgatatccttttgatcggtactgacccatttggggccgtcggatttttccgtcggcttcgatttttctgagcgttccgattttcttttctgctgctgtgcttcacgctgctttttgcgttcctcgcggagcaccttatcgatcatttcatcggtaatcggtgagaaggcttcggtttcgatgaccgctggcgattccacatcgctcaacgggtcgcctgcgtcaggacgtctgcgccgtgtcttggccttcggtgcagccggtttcggctgagccttttgcggttcttctgtttcgccggcttcggccttttcctgttgttcgagcatgtacttgtcttcgagggccttgcgcttgcggtccttcgcttcgcttacctttctggactgtgccccgaaggcgtagcccacagcctgcgccgctgcgatcacaccgatgcagatgaacatgaaggcgatgaacggcacgcggctgcccagccatacagacagtacaccgaagggcaggaacaaatacaatgtcggcgaaacgacaaaggtaaaggcgttccaaaccttcaggaagcggatgccgggatggcccttcaaaatgatgaccgtcgtcagcaccgccatgatcaccgtcggcaacagcgagtagagcagatatttgccgaacacctggttgtcgtcgtcgtccgtagacgatttaaaggctgcgtaggtgaaatagatccagaacccgacgataacaaccagctcgatcaccccgtaagtcatgttgtagctgccattcgatttgacgccggcgtcgagaatccccttaaagatcaagatgagcagcaggttcaaaatattggcgatcagcgccgtcgacagtgaattcagccgcctccttaatcgtattcctttattcatattgcctccttatttgagcaaatccagtatccgattcaattcatccgttgaggaataatcgatggtgatctttccgctcccctttttgttttttggggtcagtgtaacggacgtgcccaaatgatttcttaattgatcttcaacgtcgatcaagtaaggatccttgggcttcttttcctttttctgccgaggatttttaagccggcgcacctgatcttccatttcacggaccgaccaattccgctcaacggccttttgtgccagcgatgccattgtctctgcatcgtccagccctaggagcgcccgggcgtgtccgccgctgagctgattgttcagcaccatcttccgcaccgaaactggcagcttgagcagccgcattacattggtcacggccgcccggcttttgccgatgcggatgccgatttcgccctgcgttaaattgtagtgcttcgcgagctgttcaaaggccattgcctcttcaatcggattgagatcctcgcgctgtacgttttcgatcagcgcgatttcgaccacttcccggtcggacatatccttgacaacgaccggcaccgtatcgaggccagccagtgtcgccgcgcgccagcgccgttcgccggcgatgatcgtataagcgccctgctcctgcttgacaaccaagggctgcagcacgccgtgttctttaattgatgccgccagctcttccagggcccgctggtcaaaatgttttctcggctgatcccgattgggccgaatcttgccgattggcagctcgacaatcagctgaccgttctgatgggagttcgattcggactgcgcttcttcgagacccccgttttcatcgaaatggatatcgtcggagatcaatgcggccaagcccttacctaaaccgttgtggtgtttcttacttgacatgttccctcccgataaattccttcgcaagttccgcgtacgcaatggcgcctttagagttcggcgcgttttcgaaaatcgtctcaccgaagctcggcgcttcagccagtcggatgtttctcgggatcttcgtgcggtaaactttatctttaaagtaagacttgacttctccgacgacctgcacggctaaatttgtccgggagtcgtacatcgtcatcaaaacgccttcgatatcgagtttgggattcaagcctttcttaacgaggctgatcgtcgaaatcagctggccgaccccttccagtgcgtagtattcgcattgaatggggatcagcacggaatccgacgctgtcagtgcgttgatggtcaaaaggcccaatgacggcggacagtcgataaagacgtagtcgtaatactcgagaaccggatcgagcaccttgcgcagccgagtttcccgctgagacatgtgcgccagctcgatttccgatccggctaagtcgatgttggagggcagcaggttgagccggtcgtatccagtggtcaatatgacttctctaagatcctgaccgttgatcagcgcgtcgtagatgctcttgtcgagatcgttcttttcgataccgaaaccgctggtcgtgttaccctgagggtcgatgtcgacggtcaaaacgcggtacccgtctatactcagcgccgctgtcagattcatacacgtcgtcgtcttcccgacgcctcccttttggttgaatattgaaataacttttgctcttgacattggctttcctttccagtggatgatccgccgatccgattatttggggatcgtgatcgtcacaacaattttgtcttctttttctgtctccttgtacttggcgtcctgcttggtccgctgtacttccttaaaagcggtcttgatcgtgttcaaataaatctgcgcgttgatgaaggacttgactctggcctttttccccggtgtgatcttttcgtcgtaattgttgaccagcacctcgtttcggattttctccacgagcctttccgtctttttgacattcaaatcccgccgcttgacctggtcgatgacttcaagctgaatgtctttgtccggcaccttgagcagtgcccgggcgtggcgttccgaaatcccggcctttttgactgcttcgatgacctcttcgtccatcttgatcaatctcagcttgttcgcgacaaaggattgagattttccgatcagcttggccacctgttcttgggtcatatggtaatacttaatcagttgctgatagctctcggcttcctcgaaataattcaaatcctcgcgctggacgttttcgatgatcgccaagacggccgaatcctggtcgttgatcttcacctcaatcgccggaacggttttgagcttggcaagctttgacgcgcgcagccgtctttcgccggataccagctcgtaaagattgttgttcagctttcgcacctgaatcggctggatcaccccataggtcttgatcgattcagccaattcctttaagtgttcctcgtcgaaaacctgtctcggttgattgggattcggaatgatctgatcgaccggcacctctaaaatgcggctgccaggttctttcttgcgcccctttaataaatcttttttcttttttctcatacacttagctcctgatgtttcacgtgaaacatcgcactccgacaatcaagttaaaggctttttgacaattcttccgtaatttctcgggtatttcttcggagtgctgccgattttgtcacattgaattataacatgaaacgtcgtgtttttcagtattaaattctgcgtggtgcggattgatcccaatcccaataggcttgggccctgccccgcttcggcaatttcggcctccgcctgctgtcccttccaggcataaaaggttccgccgaccttgagaaagggcgcacagagctcgtcaagaatgttgaacgccgccacggctcgggcgcagaccgcatcgaattgttctctatacttggggtctttcccgtaatcttcggcacggccgacgagaaagctgacgttctttaaaccgatggcgttcacaatttgttcgacggctttcatcttcttgcctgtgctgtccagcagcgtaaaatgcttttccggatgacaaatggccagcggtacgcctggaatgccgccccctgaaccgacgtcgagaatggcgtcggcgtcttccttcagcgggcaggtgatcgcgtccaataaatgtttttcaataaaatctcgatcgtcgacgattcgggtcaaattgacgtgagcgttggtcgccttcatttcgttcatgaacgcgtaaagcaattggagcttgtcctcgctgatcgcaatcggcgactccgaaacgaaaatcttcttaaaattatcgtaagcttgatccatcattttttaaagagctctctgtgattttccaaataaacgtgcagaactgcaatatcggcagggttgacgccagaaatccgggaggcctgtccaatggacatcggccggaccgatttgagcttttcaacggcctcgagtctgagtccctgaatgtcggtgtaatcaatcccttcgggaatgcgtttttcttcgagcttcttgaactgaacaacctggcggtcctgcttttgaatgtagccttcgtacttcaattggatttctacttcttcccgaacctgtctcgaaagcgccggccgttccggatcgatcggcttcaaagcgtcataggtcagctccggccgtttcaacagctgcgccatcggcagacccgaggtgagcggcgtcgtaccgagctcggtcagcactgcgttgaccctttcagacggggaaaccgtcgtcgacttcaggcgttccttttccgcttcaatggctgatttcttgtttaagaagtgggcgtagcgttcgtccgagatcaaaccaacccgccgtccaatgggcgtaagtctcaaatccgcattgtcctgacgaagcagcagccggtattccgcccgagacgtcatcatccgataaggctcgttggcgtcttcgttgataatgtcgtcaatgagcacgccgatatacgcctgagagcggtcgagaatcatcggctctgcgtgttccagataaagcccagcgttgatgccggcgacgattccctgcgccccagcttcctcgtagcccgaggtcccattgatctgaccggcgaaaaacaagccgtggatatccttgctttccaatgtggccttcagggccgtcgggtggatgcagtcgtactcgatggcgtaggccgagcgcatgaactgcacgtgttccatgcccggcaccgtccggtacagcgcgatctgcacttcctccggcagacaggacgacatcccctgcacgtaaacctcgcgggtgtgcaggccttccggttccataaacatctggtggtgatccttgtcggcaaaccgcaccaccttcgtttcgatggacgggcagtagcgcggccccacgccgacgacgtctccagtcactaatggactgcgatccaaattgtcgcggatgattttgtgggtcgcttcgttggtgtaggtcaggtaacagtcgatctggtcgatgtcgatggattccgtttcaaaggagaagggcgtaatttcctcgtctcccttctgcaccttcatcttggaatagtcgagggttttttcgtcaacgcgggccggggtcccggtcttaaaccgctgcaggttaaacccggcctcgcgaagactgtccgacaaaaagcgcgcaggaaacatcccgttgggaccaccgtcgtactggacctcgcccatgaagattttgccgttgaggtacgtcccagtgcagacgacgcaggtctggcaggcgtaggtcgcgccggtgcgcacctgcaccccggtgattttgtgatcctcaataatgagctttgtcgcttcctgctggcgcagggtcaaattcggcgtgttctcaatgacttccttcatgcggaattgataggcctttttatccgcctgagcgcgaagcgaatgcaccgctgggcccttcccggtgttgagcattttacattggatcatcgtcgcgtcgatattcttccccatttcgccgccgagagcgtcaatttcccggacgagatggcccttgcctgtgccaccaatagacgggttgcacggcatcatcgcgacggaatccaaattgatggccagcagcagcgtcttgtggcccttgcgcgctgtggccagagcggcttcgcacccagcgtggcccgcaccgatgacgatggtttcataactttcagcttgatatgccatatgtttttcctttcgtgtttattttccgagacagaagttcgcaaaaatctgatcgataatgtcgtctccaagagactgaccggtgattttccgcaaattgtccagcgcgtccttcaaatcgatggcgacgatatcgaccgacatgcccatcgccatactttcaagggcactttccaaattctggcggacctgtttcaaaagcgaaatgtgccggacgttagagacgatcgggtcgtccttgcgcacgaccgaatccgaaccgacagccatctcgaccattttttgctttaaggtctgaagcccttcctcactcttgaccgacagcacgatttggttgtcgctcaaatgatccttcagcgatgcctgatcgtcttcatcgatcagatccgacttattatatatatgtagaactttttttccttcgagtaaagacatccacttttgatcgccattggatgtttcacgtgaaacatcttcgatgtaaagcacgagctcagcctggttcaccatctgtttggcgcgttccacacccatcttttcaatgacgtcgtcggtttcgcggatgcccgcggtgtcgatgatgtgaaagggcacgccgccgatgttgagataatcctcgatggtatcccgcgtcgtgccgggaatattcgtcaccaacgccttttcttcgtgaagcagcttgttcatcagtgacgacttgccgacattgggctcgccgagaatcaccgtatcgatgccgtcgcggacgaccttcccgaccttagcagactgaagcagatcgtcaatttcgtcgatcatgtggtgaatattttgatccagctcgttttctgtgacttcctcgacatcgtactcggggtagtcgagggccgcgtcgatataagtcaaaagatggagcagctcgtcgtcgatcccttggtattttttggaaaggcccccggaaagctgattcagcgaataggaaacgccggcttccgttttggcgtcgatcacgtccatgaccgcctccgcctgggacagatcgatgcgcccgttgacaaaggcgcgctgggtaaattcgcctggatctgccagacgcgcgccggcatcaatcacagcctgaagcaccatgccgacgacgacatttccgccgtggcagttaatttcaacgatgtcctcgcgggtgtaggttttcggcgcccgcatcaccgtgagcatcacctcgtcgatgactgcaccgtcccctccgagcacatgtccgtagtgaatcgtatgggatggaaaggacgtaacagattttccggaaggcgacacgaaaacgcgatcggccacctgaagggactcggcgcccgacagccgcacgatgccaatgccgccggtgcccactggcgttgagatcgccgcgatcacatcatcgcttaatacattgttcataatctttcccctttatataataaaaaaagtgaaagcagtcggaaatgtgcagcggcacatctccatcacgaactgctttcaccagtttgtatggacgtgttattcctgatcgttctctttcagatctatgacgacatagcggtaaggatcttgtccttcgctgtaggtatagacccggccgtcatcctggagtgtcgcatgaatgatgcggcgttctcccggattcatcggttcaagtgagaacttccgatgactgcgggcgaccttattggccattttgtgggccagattttcaagcgtctgctgacgtttttcacggtagtgttcggtattgatgctgatgcggatgtgatgatccgtctgcttgttgacagccaagctggtcagatactgaatggcgtcgagggtctgtcccctgcggccaatcagcagccccatcttgtcgccagacaattcgacttttaggacatcgtcttcggtttcgtaggcagtgtcgatggtcacatccaaatccatcgcgttgaacatgtcggacaagaatgtcgacgccatcgcctgaatcttttcagattcatcttccacataagcttccgcctgaacctccggatcgaaggtttccttcagcgtcgcttcgacgatggcttcctttttcccgaaaataccgataaaaccgctttctggttcctgaacgaccttgatgtcgacctgatctctttcagccgacagcgtttcaagggccttctgaaccgcttcgtctatcgtttttcctttttcagtaattgtttgactcattcactatgctccatcaatttaacttgtccggctttttggttctttcgtcactgtggggaatcttcgtcaccacgcggcgcttggaagccggcttcgtcttgggtctgttcatcttgctggatttctgggtggatctgccgaattgcgcgttcatcgcctgctggcggatttcagccgaagccttcagcttatcgcgtttttcacgcttatccttttcttcctgttccttgacgcggcgttccgcttcttcgatcggcacaagcttaaccggtctgcgcatcacgatgaactgctggatgaaagtgtagacactctgcgtcacccagtacaagctgaccccagccggcatcttaagtgcgaaccagccgatcatcagcggcataatgatcatcatgaccttctgagaggttgccgtcgtcgggtccgcgttggaataatccgttgtgaacttctgggtcaggaatgtgaccaccacaacgacgatcggcaggatgtagtacggatcgggtttccccagattcggaatccagtaaaaggattgatgcagcgctgacaaattgccggacgtaaaaacgtatttctgaggattctgcagtgcgccgaaaagaccccagatgatcggcagctgaatcagcaaaggcaggcagccggacattggattgaccttgtaaagcttgtagagcttcatggtctccatattcagcttttcaggattgttcttgtattttttctgaagtttttgaacctcaggtgtgatggcctgcatttccttcatcgaatttgtctgcttgatgttaagcggcagaatgatggtcttgacaatgacggtgaacaaaattacggcgtacccataatccccgacgagtcggaagatctggtacaagacccagccgaatccttgatataaaaaatgcattgagtaatattttctccctggagtgtttgattttgaattggtgatgaccgttaaggcaccggatcgtatcctcccggattaaagggatggcatctcaaaatccgtttgagtccgagcagcccgcccttgaagggcccgtacttggcaatggcctcgtagcaataggccgaacaggtcggataaaatcggcagtgcctcggaaacagcggcgaaatgacccgctgatatccccggatcagaatcaagcaaatcttctgaagcccacggctcagaaaattcaacaatttcttcatgatttttccagctttgttttgtaaaacaaatgttttaacgaacggtcgagatcgcggtagggatcctctgcgcatcgctttttcgcgacgatgatcagatcgtacccctgctggatccgttccagctcattctgataagaagctctgattcttctcttgactttattgcggacaacggcgcgcttcgacactttcttgctaacaataatacccagacgattggtacttttccgatttttcaaataataaaattgaaaatgccgattgccgaatcgctgcccgtcgtgaaagacgcgatcaaaattcttcgaatttttcagagaagtcattttcacaactctcaactccaaatcaaattataaaaaagaccgtctgtgaaacggtcagcagtatttatgcagataatttagaacgacccttttgtcttcttctttttaatacaaggcgtccattctttgtggacattctttttctgaatccgtgttctttctttctctgtctgtttttaggctgaaatgtctgtttcatttcatgctcctctctatttctctacattagataaattgaatacaaaaagaccaaattaaaaattcccatattacctgaagattatattatgaccggtccggctctgtcaagtgatttgtttaaaatttgacgcctgccgaactgtggaaagcttgaatgcacaatgggattttgctataatgtatgcacattatcaacagtttacacagtgaattatccacaattttatgataattgtggataattctgaggataagtgtggaaaaaccgtcataattctaaataatcaacacggtacactgggggaaattttatccacagcgtgttaaaagtgattgctatctcacgcttatccacaacctcatatcgaaaaacggagaaaaatgtggaagaatctataaacgaaatatgggaaaaagcgctcagctccattgaagaggaaatgccatttgtcagcttcaccacttggtttgaacccctcaaacctgtggctatccgcggcaataaattttatcttcaggtcccaaattccagtaaatttaacaaatcggttctcgaaaaccggcacaaggacttgatcagcaacgccctgtcctttgcgatgaacaaaaaaaatattgaagcctgctttatatttgatgaaagcgaaatcgacgaattggaagacagcgccgaatccgacaagccgaataaatccaaatcggtggagacaccgccgattaacaacagctccggcatcaatcccaagtacacctttgaacgcttcgtcatcggcgaaaacaaccgcttcgcccacgcggcctgcgtcgccgtcgcagaagccccgtcggaacagtacaacccgctgtttatctacggcggcgtcggtctcggcaaaacccacttgatgcaggccatcggcaattacatcatgacctacaccccggaaaagaaggtagtgtatgtgtcctgcgaaaccttcaccaacgaattcatcgacgcgattcagaacaagagcaacacgtcctttagaaatcgctaccgcaatgtcgatatcctgctcatcgacgatatccagtttttgtccggcaaggaaggaacccaggaagaattcttccatacctttaacgcgctgcacgacgaagacaagcagatcgtcatcagctcagaccggccgccgcgggaaattccgaagctggccgaacggctgcgcagccgattcgaaatgggcttgatcaccgatatttccgcgccaaactttgaaacccgaatggcgattttgagaaaaaaagccgaaacttataaagaagaaatcccagacgacgtcctcagctttatcgccaacaacatccattccaacatccgtgaactggaaggcgcgctgaccaccgtcgtcgcctactccaagctgcacggcgaaaagatttccctcgatttcgcgaaggaatccctggccgatctgttcgtctcaaagcagcacgaaatcaacgccgactacatcaaggaaatcaccgccaagtacttcaacaccaccgttgaagacatgaacagcaagaagcggacgaaggccgtcacgacgccgcgccaggtcgccatgtacctgtgtcgagaaatgacctcgatgtctctgcccgccatcggcgaagctttcggcggacgcgaccactcgacagtcattcacggctgtcagaaaatcagcgaaaatatcgagaaaaacaccgacttcaaaaatctggtgctgcggatccaaagcgaaatcaaaggcgaataatccccaagctgatgacagttttccacagcctttacacatgtggacacacagatttgattgacgtcattgggcgtcattctggggaaaaatcagttatccacagcttaaacaggttctatcattattattactaaaataaattaatatttatacaatgcaacccaaacaaggagcacactatgaaattcgattgttctaaagccgatctcgtccacgccctggcgatcgcatccaagggcgtcgcccgcaaaaccacgatgccgattctcgaaggcgtattaatggaagcgaccgatcaaaaaatcgtgctgacctccaccaatctggaaatcagtgtcaaaacgacactgcccgcccacatcgaacaggacggcgccatcattctgcagtccaactttctttcggacttggtccgcagactttcaggagatgacatctactttgaaagcgccggcaaggacacgttaaaaatgacgtgtcagctttcgacctacacgatcaagggcatgtcgccggaagacttcccggccttcccggaaatcatcgatgattacaccttctcgatcaaggccgaaaccctctacgacctgatccgcgggacgattttctccgttgccctgaaggaaaacattccggtgctcacgggcctgaagctcgagctggaggacgaccgcatcacagtcgtagccctcgacggctatcggctggcgctgcgtcgcggcaagctctcccaaccgatcaaccagccagtctcgatcatcgtgccgggcaagagcatgaccgagcttgaaaaaatgctttccggcgtcgacgacgacatccaggtgaatctgtcaaaatcgcagattttcttcacgatcggcgacacgcagttcacctcccgcctgctcgaaggggaattcatcaactaccagcacatcattccgaaggacaccaacacggaaatcacgctgagccgcaaggaactgctcgacagtaccgaacgcgccgcgctgctcgcccgggaaggcaaaaacaatttaatcaagctggacattggcatcgacgagctgacgctgacctccaacgcggacatcggtgaagtgcacgaagtcatcccgattcagaaaaccggcgacgacctgcgcatcgccttcaactcgaaatttatcatcgacgcgctgcgcgccatctccgaggacaccatcacgatccgcctgaccaatcccgtcgggccggcgctgatcgtcggcgacgacgaaagcttcatcacgctgattctgccagtccgcgtgtccgacgatatgtaaagccaaagggcttataattatagagaagcgattcaattaactttgaaataaaataccaaaaaaataaactgaaaaaaccgagagaatttgcatgaaagcctttgaaagcgcgtgcaaattctctttttatttgatataataaggcccagccctttttatgacgatttgagagcgaaaaaagcatttttcagcccgataaaaaagttttccaagaaaaaaagggtgtaagttataaatcttgaaattaaggataaaaaagaagtttacgatgaaaaccattcagatttattccaaattcattaaattggaccagctgttgaaattcgccggtgtcgccgagagcggttccgtcgcgaaggcgatgattttagacgaaatggtcacggtcaacggcgaggtcgttacagcccggggcaagaaaatctacccgggggatcaagtcgaagtggaaggactcggcgaggcccttgaggtcacggccgaagacacgccatgatcgtcaagcggctgacgcttcgccatttccgcaactaccgggacgaaacctttgagctgtcgccgcgcatcaacgtgatcaccggcgccaatgcccagggcaagaccaacatgctcgagggcttgtttctgctctcccgcggctattcccaccggacgaaccacaccgccgatctgatgatgcagcacgatgcgggtctcaacggctttgcagtcgaggcggaggccgaaaccaagggcattcaccatcggctcgcccttcaggtcaaggacggccacaagacgtgggtcgtggacggccattcgagccggcgccagcgggacgtgcacaagctgctgcacaccattctcttcgagcccgacgatctgcgcatcgtcaaggccggtccggcgcgccgccgtcaattcatcgacgaggaaatcagcggttacctgcccggttatctgccggtgctcaaaaattacaaaaaggcgctgtctcagcgcaacgccctgctcaaggagatcaggcgttcgccgtcgatggcggtgcttttagagggctgggacgagcagctcgtcgaaaacggcgccaagctcgtcgtctaccgcctggcctatttgaaacggctcaacgagacggccaaagcgcttcacgcttccctgtctgataaccgggaaaagctgagcctgagctattcgagcaatttaatcgctgaagcggcggatcaggccgcgattcaaaagcgatttgccgaaaaattgaaggccggccgagacgaggatattgccaagggctcgaccgtctgcggcccccacgtcgacgatctgctgatcgcgatcgacggaatggaggcgcggaagtttgcgtcccaggggcagcagcgcaccgcggccatcgcgctgaagctttcacagattgacatttaccaaaagatgaccggcgactggcccatcgtgctcctcgacgacattttgtcggagctggacgaccggcgtcaggagaaaatcctcgagatcctcggtcagacccaggcgctgatcacctgtacagacagccggtttgcagaccggtatccggaggagatgaagcgcatcgtgactgtgaaaaacggccggcagattgaagggtaaatgaaaaatacagaataaggaaccatttcgcgaagacgcgatttaagatttacattacaggagggactatgtctgaaacgacaacgacaacacatgaatacggcgcggaccaaatccaggttttggaaggactggaagccgttaagagacggccggggatgtacatcggcagcaccggcaagcagggccttcaccatttggtctacgaagtcgtcgacaactcgatcgacgaagcgctggcgggctattgcgataaaatcgtcgtcaccattggcgacggcgacatcatcaccgtcaccgacgacggccgcggcatcccgaccggcatcaaccacaaggaaggcaaaaccggcgtcgagctggcactgaccgtgctgcacgccggcggtaaattcggcggcggaggctacaaggtttcaggggggctccacggcgtcggcgtctcggtcgtcaacgcgctgtccgaatggctgacggttgaagtcaaacagaacaagaaaatttaccgccagaccttcgaacacggcaacaagacctcggagctcgaggtcatcggcaatacgaaccgcaccggcacgaagatcagcttcaagccggacgccgacatcttcgacgaaacggaatacgactacgacgtcctcgaacaccggctgcgcgagctggccttcttgaacaaaggcgtttcgatcacattgaccgacgaacgcccgggccaggaacagagtcacgaataccactacgaaggcgggatcaagtcctacatcgagtacatgaaccgcaacaaggaagtgctctacgaccagatcacctactacgaaaagtcgatggaaaactacgaggtggaaatcgcctttcagtacacccgcggctatcaggaaaacatctacgcctacgcgaacaacatctttacccctgaagggggcacacacctcaacggcttcaagagcgcgctgacccggacgatcaacaactacgcccggaaggccaacttcctaaagcagaacgacaagaacctctccggcgacgacatccgcgaaggcttgaccgcgatcatcagcgtcaagcttctggaaccgcagttcgaaggtcagacgaagaccaagctcggcaacccggaagtgaagggcatcgtcgaaaccatcgtcagcagcgagcttgacgccttcctcgaagaaaatccgaaaatcgccgaagccattgtgcagaagaacatctcggcgtcccacgccagaatggcggcgaagcgcgcccgggaaatgacccggcgcaagagcgcactggaaagcacgtccctgccgggcaagctggcggactgccgcgaaaaggatccgtcgaaatccgaaatcttcctcgtcgaaggggactccgccggcggttcggcgaaggtcggccgaaactccgaaatccaggcgattctgccgctgcgcgggaaaatcctcaacgtcgaaaaggcgcgcctcgaccggatgctcaactccgacacgatccgcgggatgatcaccgcctttggcacgggcatcggcgaagatttcgacatcaacaaggcgcgttaccacaaaatcgtcatcatgaccgatgccgacgtcgacggcgcccacatccgcacgctgctgctcaccttcttctaccgctacatgcgcgggctcatcgaaaacggctacgtctacatcgcccagccgccgctgtacaaggtcagctggggcaagcacgtcgagtacgcctacgatgacgccgatctcgaccgccgtctcgaaggccgcgaccgcagccgcattaccctgcagcgctacaaaggactcggtgaaatggacgcggaacagctttgggaaacgacgatgaaccccgaaacgcgcacgatgctgcgggtcggcatcgaagacgcgacctacgccgatgaaatctttacgatgctgatgggcgacaaggtccagccgcgaaaggaattcatcgaacgcaacgcgaagaaagtcaagaatttggatatttaagcaaggatagaaaagatagagtatggacaataacgaaaacaatcaaatgacaccagtggcgaagaacctgcgagacgtcaaaatcgaagacgaaatgaagaactgctacatcgattacgcgatgagcgtcatcatcgggcgggctcttcctgacgtcagagacggtctcaaaccggtccaccgccgcatcctttacgcgatgtaccaaatgggtatgacgccggacaagcccttcagaaaatcggcgcgtatcgtcggggaagttctggggaaataccacccccacggcgactcctcggtttacgacgcgatggtccgcatggcgcaggacttctctacccgctacctgacggttaacggccaagggaacttcggctccatcgacggcgacggcgccgccgccatgcgttacaccgaagcgaagatgaccaaggtcggcgtcgaaatgctccgagacatcaacaaggacaccgtcgacttcatcgacaacttcgacggctcggaacaggaaccgtcggtgctgccggcgcgtttcccccaccttttggccaacggctctcaggggatcgccgtcgggatggcgacgaacattccgccgcacaacctcggcgaaatctgtgacgggaccatcgcctacatcgacaacccggacatcaccgtcgacgagctgatgcacacgatcaaggggccggacttcccgaccgccggggtcattctcggcaagagcggcatccgcgacgcctacagcaccggccgcggccgcatcaaggtgcgctccaaggtcgacattcagcagaccaagcggggcaagcagcagatcatcgtctccgaactgccctatatggtcaacaaggcgaagctgattcagaaaatcgcggagctcgtcaaggacaagaccgtcgaaggcatcacggacatccgcgacgaaacggacctgaagcacggcatccgcatcgtcatcgacttgaagcgggacaccaacgcgacgatcatcttgaaccagctgtacaagcacacccagctccaggacacctacggcgtgatcatgctggcgctggtggacggtcagccgaaggttttgaacctgaagcagatcctctactattacgtcgaacaccagaaggaagtggtggtccgccggacgaaattcgacctgaagaaggccgaagcccgggctcacattttggaaggctaccggatcgctctcgacaacatcgacgcggtcatcaaaatcatccgcgaatcccacgacgcgaaaatcgcgaaggcccgcttgatggacaatttcacgctgaccgatatccaggcccaggccattttggacatgcgtctgcagcgcctgaccggtctcgaacgcgaaaaaatcgaagaagaatacgcggcgctgacgaagaagattgccgaataccgagcgatcctcgccgacgaaagtctcgttctcggcatcatcaaggatcagctggtcgaactcaaggaacagtacggtgacgcgcgccgcacctccttcgacgtcgacatcgacgatttcgacatggaagacttgatcaaggaagaagaagttgtggtcacgatgacccacatcggctacgtcaagcgcatcccggccgacacttaccgctcacagcggcgcggcggcaagggcatctcggcgctttcgacccgggaaaacgactttatcgagcacctgttcacctgctcgtcccacgacgatctgctcttcttcacgaacaagggcaagtactacaatttgaaggcctacgaaatccccgaaggcggccgcaccgctagagggacggcgatcgtcaacatcctcgatctggacagcgacgaaaacattacgacgatgattcagatcaaggatttcgaagaaccgaacaagtacctgacgatggccacgaagatggggctgatcaagaagacgccgctgtccgattactcgtcgagccggagaaacggcatcaacggcatcaagctcaaggaaggcgacgagctcatcaacgtgcgcatcgccgacgacaccgaagacgtggtgatgggcacccacgaagggtacgcgatccgcttccacgtcaaggacgtccgccccaccggacgcacctcgatgggcgtccgcggcatcgcgctgcggcctgacgacgcggtagtcggcatggacatcttgtctgaagactgcaaggtgctctgtgtcgctgaaaagggctacggcaagcgcacttccggcgatgaataccgcattcagaaccgcggcggtaagggcgtgcagacctacaagtgctcgaagaagacgggcaagctcgtcggctttaacgtcatcgaagacggtggcgaaatcatgatgatcaacaacgaaggcgtcgtgatcaagctcaagaccgacgacatcacccagatcggccgatcgacccagggcacgcgcctgatgcgcctgaagggcgacgaacgcatcgcgacgatctgcaaggtgcagaacgaagagcccgcagacgatgacgacgacgcggcagacgacacccaatccgaaaacaagggtgcgtcggaagaacaggtcaacatgctgtctgacagcgaaaaataaaacaaaaaggaacacgaaccatgcaaacacttatttccatttcgatgctcagcgcggatttcacccgcttaggcgaacatttgaaggaagcggaagcggccggcgccgactggctgcacgtggacatcatggacggccattttgtgccgaacatcaccatggggccggatcaggtggcgcagctcagaaaatctgtcgatctgccctttgacgtccatttgatgatcacccacccgctggactacatcgaacgcttcgcgaaggccggcgccgacacgattaccgtccacgtcgaatgcgacgacgataccgacgcctgcctcgatttaatcgaaaagctcggctgccatccggcagtggtcatctctccggaaacgccggtggacgcggtgaagccttacctcgaccgcgtcgacatggtgctggtcatgggggttcacccgggattcggcggtcagtcctacattccggaaaccaccgaacggctcaaggccatccgcggtatgatcgacgcctccggccgggacatccgtctggaagtggacggcggggtcaatttcgacaccctgccggaaatccttgaagccggcgccgacaccatcgtctccggctcctgcctgttcaagggcgacattcaggcgaatattgaaaagtttaaacaattgttttaaggggattaaacgtattggagcggtctgctgtggcaggccgcttttttgctgcaataaatgaagtgaaagaacgaggtgaaagaacgggttttggatgatttttgctgttttacggttccctcacccctctttaatggcgtaaaataaaaacaaaatttctaaaaggcggtggcagtgggatgcggaagggcgagatgaaaaatacagcgatggtgattttggcggggtgtctgtggggcgtgatttcgattttcgtgcggcagctcaacgccctggggatcacggcgatggaatgcgtggcgattcggacgacgatcaccgcgctcattttgtgcgtctttctgctcgcgcgggatccgagacagcttcgcgtccgtgcgcgggatctgccgctatttgccgcgtctgggctcggcagcgtgctctttttctcctattcgtatttcaaagcgatcgacgttttcggcggcgccgcgatgccggcactgctcctctacacggcgccggtctttgtgatgctcttttcagggccgctttttcacgaaaagtggacgaaacaaaaggccgccgttctcgtcctgacgtttaccgggctcgttttggtgaccggtgccttcaacggcctgtcggccattccggtcaccggcgtcctgtttgggatgggcgcggcggtcggctacgccctgtactcgattttcgggaagctgatcggcctgcggggctattcgccggccgtttcgaccttttacaccttcgtctttgccagcgccggcgcggtgccgctgtcgggcatcctcgccgattggccgagactgatgtgtccggccggtgtcggtgccgccctcggcatcgctttaatcagcacgaccctgcccttcttcttctacacccggggactgatgggcctcgaggcgggccgggcgtcggtcctggcgtcgtccgaaccgattacggcggtgcttgtgggcccgctcgtgtttcacgagcccttcacgatcgcgaaaattttgggaacggtgctggttttgtccggtatcgtcttgatcaattgcacgccaaagctcaggcaaagaccgccgtattaaaaaaacccgatggatttccatcgggttgcgcgcggctgcgctgaggtttacacgctttacttcgggaagaaaaagggccgccgttttttctttttccgccagctgcggtacacgctgtagagggtgccgccgccgagaatcagggcgccgaggtagccaaagaaggccagcgccgggatgccgagaatctgcggcttcatgtcggtgattgcgagaaagctcgatgcgagcagcagcgccgcggtgatgacggccagcacgagccggttgaccattttgcccagctgcttgatcggctcctcgctgccgacgatttccagattgaatttggagtgccccttcagcgcctctttggagagattgtttaaattctccggcagctccagcgtgtgggtgccggcgctgatgaggctgcgggtcagctttttcgccgtcaccttcaggtcgagatcctgaaggcttggctcgaggatgtgctgctgcatgacgctgacaatgctggcgctcgggtccagcttggcgacgacgctttcaatggtcatgacgccgcgcaccagcatcgtcaccccctggggcatttggatgtggttgacgttgcagatgtggagcagatcctggagaaattccgacaggctcatttcgccgatgttgacgctgccgtattcatccatcaaatcggacaaatcggcgtagaggcgggtgtggtcgatcttgcccgtgtgatcgcccaggctgaggacgacggttttgatcgcgctgatgtccttggccgcgacagcggagatggcttcgcggaacagctcgcagtccctgcggctcagggtgcccatcatcccgaggtcgatccagccgattttgccgtcgtgaatgcggatgttccccggatggggatcggcctggaagaaggcgtcgtcgacaatttgcttgatgtaattttcgacgagcttgaccgcgatttcctgaaggtcgtagccctcctcgacgaggcggtcggtttcgtcgatgtcgatgccgcccatgtaggacatcatcagcacgttggacgtggtgtagtgcttgaaaatagtcggacagtcgacgtagcggatatcggaattgttgtgggcgaagatttcggcgttgtgcccttcgttcataaaatccatttcctgacgggcggtcgccgccacctcggagagcaccattttaaagtcgatgacgtcgccggtgacgccggtgcgctgcagcagcgtcgtcagctggttgaggatcgacaggtcgattttcatcgtttcctggacacctggccgctgcaccttgacgacgaccggggtaccgtccagcagcacggcgcggtgaacctgggcgatggacgcggagcccaggggctcgtggtcgatgcgggcgaagatccgccgcagcggctggtggtacgccgattccaagacgtccgcgatggttttaaagggcagcggggccacgtcggtgcgcagtttggccagctcctgacaataggcctcgggcagcacgtcctggcgcatggacagaatttgaccgactttaacaaaaaccgggccaagttcttcgacaatggcccggaatttttcgggggtgatcccctctcttatgttgtacttagataaaatgccgaggatctcccgcacgcgtctgcggcggtagcccctcggcagttttttttcgttacgcattaccgttgtttattctgttttggtgtctgcgtcttcgacgtccgcttcttctacgtccgcgtcatccgcttcggccttcgccaatttttccttcagcgcttccaattcttcgtcggacatgttgtcgacggccttcagcacgtcgtccaagctcgtctttttcttgaatttttctttggtggcgtctaccttctgcttgacgctgtgcttcagttcttcgttgacgaccttcccctgttcgacggtcagttcgcccttttctacacagtagttcacaacctgttcggctttttcagcggtgaccgctgccgcaccgacaccggctaaaatgatttttttgaattcttctccaaaattaatggccataatgcgacctccttgttctttaaatcaatacaggtatcttacgacgaaaagtttaaaaataatttaagtgaatttactcatttcgtgccgcgaaattgcgcaggtaatgccgttccaatgccaaaagtttgcgcttgatttcgacgccgccggcgtacccggttaaaaggccgctggtcgcgatgacccgatgacacgggatgatgatgttcagcgggttcttgttgttcgcccgccctacggctctcggcgcggttggattgttgatcgcttcggcgatatccttgtaggatttgatttctccgtagggaatttgacgaagtaccttccacacctttttctgaaaagccgttccccgcgcgttaaaggataaatcgaaggtttcccgtttgccgtcgaaatattcctggagttgttttttcgtttcgtccagaatcggacgggtttccgtttcgggaatatcctgattttttacccattggacccgcagcagcacatcttctgtggattccaaaagcagcaatccaaatgggggtttaaaataactgatgtaatgttcactcatttcctttcctcctcaggaaaaaactatatgtctaatttatataatatacaatttacaatgaaatggcaagcgatttcaacatttaattagattaaagacaacaattaagtgaaaaatacgataaaattttgtaaaaaaatgtaaatgaaataaatagttaaataaaatgatataaaacaatatgacctgaatttttgttttaagaaaagttgcatcgaattattgggttactggaaaagaagaaaaaacgcttacataaaaaggtagacgttcacaacgtaagatgataaaattaaaaagagaaatttaagtaaaaatcaaagaattgaatagtcggccctatgttgctgagaactacaaattcaaaaaaggaggaaaggtgttttcgctaaggtaaacacgacacatggaaagatgaagaggaagaattattcaaaaaatgtatttttatgtgcattgacctgtttgttggtcttgtgcatgatgtcgttcaatgtgtttgcggcggattacaacacagccgccagcacaccaagctggcagcacagcaagtcaaaaaccgcaacgaatctcgacaaagcttatacctcggaggtaaccttatcgctgccgtcatcagaggaacagctgacaacagaggtgtgttttgtattggataagtccagtttttcagacacgcaggaaccggcgctgaagctgctcagtgagctgaaagacgcgatcagcgccagcggcgcaaaagttcaggtcgatatcgtcgaattcaaccgtaccgcgcacgatcacggctcttacgatctggccacgcagtacgatgaaattaaagaggcgtttaaaaagcagaattcaggcggcacgaacatgcacgccgggcttttgatggcgcagcaggtgctcgccagaaatacatccattccggacagccggaagtatatggtgctggtctccgacggcgactcttacctgtattgcaagaatggcgattacaacaaagcgtattccagatcctatattccggtagacagtgcgggcgctacggcctacggcggctattacgacgaaagctggtacaatccaagtgccggatatgaggataaaaaatccggaaagaagaatgtaaaaaggccgacgaccagttcccaaagcgactgggaagcctacctgaaggatgtggaagcccggaatcaggaaagtggtggcgacgcttacgattttgaatggaaatattatgacaattcatggagtgctaagtcgccggatcaggtcgcggcggatggatttaaaacccagccggcggtaccgcgctccgcgtcgaacctggatatgggatttttgaatgccgcttccgcctaccataccctggccgcgaaataccactgctatgcgatggctgcgccgagctggaatacagcggatggcggacactccgcatttatgaattatctggacaacggcgcaaagacggatttcgaaagtatcaagaacgaaatcctctattacctcggctccggaagtacggttgaagactatatggggtacacggatgactataactttgatctgaaagacccagaccaaatggtcatcacggttgatcaatcgagtggcggcgcggcaaagacctatcaggcggttaagctcggcgaaaatcattacggttttggtccgaaattagatagcggaaaatacagctgcgaggttacctatacaccgggcgaaaagaaggatgacgaacatatcgtatggacgattaacacaaatgtcacgaatttcaatcgcgtcagattgacgtacaaggttcagttgatgaatccgaagactgctgtcggaacctacggcgaatacgatcaaaacggttcgcagggtaagtccggattgtacacgaacaaccgtgcagttttgaatccagttgcgtccgacggcaccaaaggcgcgtcagaggattttgcgaaaccgagcgtcagttacacggttaaggcgcctgacgaacagaaagtgatgccaaatacgccgaaaaaggcttcggttaagacgtctaataagcccaagaccggcgattcgacgaacaccacgatgtggattctgatcatggcagcggcggttgctgtacttggcggcgtggcagcgcatcaaagtatgttgaacaaaaaagaacattaataagtaaaaaatcagcaaaaaagccattcgggctcccctctcgggggccggatggctttatttatggcgaaaaaaaaacagacgctgatgcgtctgtttaatcacacccggtttaggatgttttgatcaatggcgggggtagcaggattcgaacctgcgcgtgatggagtcagagtccattgccttaccgcttggcgatacccctgtgtcaaatacgcatatcattataagcgatactgacttacattgtcaagcggaaatgacaagaaaattacgaaatttttacggcgcctttattggtgggccatgcccttcttgatcatgcggatatcggtgccgacgaagtgcagcgccttgaaatggccgatcattcgagacgcgaggcgggtgttgtaccgggtttgaatctgtttaggcgacagattcgaggaaatcagcatcgggccgtcccccaaaatccggtcgttgataatctgaaagagctggtcgtcggaaaaggccgtctggtactcggcgccgagatcgtcgatgatcagcaggtcgcaatcggacaggctgtcggacaaggtgcggtcattgccgtcccgcaccgcctcgcggaccaggttgatcaggtgttcggcggtgatgtagatcacgttttttcctttttcgattaaagcgttggccacgcagttggacaaaaaggttttgccgagtcccggcgcgccgtaaaagagataattgtcgtgctgagcctcgaaatcggcgcagtaattcatcatcagctgtttcatcgccgccatgtagcgtctcgggctcggaccgtgctcgggcttgtcgtccgtgtagtacttgagctcgaaggtgtcgaaattttcaaggcgggcccgtggacttaaatcgaagcgggaaaaggccgcgtcggtcagggcctgcttcaggcagtggcagaccgcccgcccttggtaccccgtgtcgtggcagtcgggacagaggtagtgaatttcgaagtccgcggcggtgaggtggtgcgcctgcatgatttcagcgcggcgcgtattcagctcggcgagcttcttgtgataattgggcagggcgtcgggatcgccggccagccgcgcctgaacctgcctagcgccggctgcgttgcgttcattttctacagccttgagcgccggcacccggtcgtaaatgtccgcgatgcgcttgttttcaaaatagaggtggcgttttcggctgttgagaaaatcctcaatgatcgtctctggatttaagttcttcttgttcatcaatcaaactccataaagcttgtgtatcctggtcggcgagggcgtcgattaaatcctcgcgctggcgggtatctgcgtcggctgccggctgagctggccctttggcgccggcgttcttgcggaaatcctcggcctcctggcggacagcgtcgagggtcgtcatgccggcgtcgtgccaacgggtcagaatgccgtccacgtagttcacgctgggcttggtcgtccggcggagcgcctctttgacaatttccggcttaaaatgataggtgtcgaaccatttgtcgatggtttcccgctctgtctgcatcgggctgcggttctgtccgatggctttgagtacgccgtaatacagcctctggcgggttcgggattcggcgatgtacacgtcggcgtcctctggcgtgatgacgccggcgtcctgccagctgtcggcgaccttgttcatgtagcggaccgcctgactctgggtgaaatgatcccctttggcggtgatgtttttcagcgaatactcagtcagcaggatgacggtttcgggttcaaaatggtaatctgtcaaatattctgaaagctgctgcatcgtcgagaccgacaaggtggcgctgaacatcttttcgatgattttgaacatctcctggattttggcttcctgttcgtttttcggcgcggtgtcctcggcgttggccggtgcgtcgggctgcgggtagttgtccaggatgcgcgccggaatgctgaaatagtgcacctcggcccggccgctgtcgttgtagcggaccgagagaatcccttgatcctgccagtaggcccaggccttgcgcacgtccccctctgtgatctgcagctcctcggacaacagctcgttgtcgatgggcatcgatgcgcttgagaagcagtgcttgagtccgtagaggtataccttgacgtagtcgccgttggccggaggcatgtagatgttgatgaaggcgttctccaccggcgtgatgccgtaattttcgttgccgctgtcgaagacaaacttcgttgagtgccgcttatccattttccgttttcctccgcccatccttaattttttgactattatatcacagcttaaacaaaaagaaatccgttcaaaaaagttgataatttaaaacattatgatataatatcagaagtttaaaatgggaaaaaagcgaatgtgaagcgcatcgctgtacagattgttgtattttagttttgaacaaagggagcgggtttgaattacccgcttttttgcgatatagtgagagattccataaaggatataaatttgagaggattggatacgatggataaatttatcattgaaggcggttatccgttaaaaggcgaagtccagatcaccggcgcgaaaaacgcggtgctggggttaattcccgctgctctgctgagccgcaacgtcgtgacgatcgacaacgtcccgagaattgacgacgtccgcaaaatggtcgacattttaagccgaatcggcgcgaaggtcgactggcaggacgacgtgctcaccatcgattcccgagatgagctgtcctacgactgtgccccttatcaggacgaaatcggcgaaatgcgcgcgtcctactatctgctcggcgcattgctcggccgctacggcaacgcgattgtcccgctgcccggcggctgcaacatcggcgaccgcccgattgaccagcacatcaaggggtttgaagccctcggcgccgacgtggtcatcgaacacggctgtgtcaaaatgcacgccgaccatctccacgcggcggatatttacatggacgtcgtgtcggtgggcgcgacgatcaacgtgatgctcgcggcggttttcgccgaaggccgcacggtcatcgaaaacgccgcaaaggaaccccatatcgtcgatgtggccaacttcctcaataaaatgggcgccaacatcaagggcgccggcacggataccctccgcattcacggcgtgcaggaactccacgcctgttcttattcggtggtgcccgaccagattacagccgggacctacatgatggccgcagcggccaccaacggcaatgtgctcgtcaagggtgtcattcccaagcacatggaaagtgtcaccgccaagctcaaggaaatgggcgcggacgtcgtgaacgtcaacggcgacagccttcaggtcagccacaagggccgcctgaaacgctgccacgtgaagaccctgccctacccgggctttccgaccgaccttcagcagccgatggcggttttgatgtccatcgccgaaggcaacagccgtctccacgaaagcatttttgaaaaccggttcaaatacgtggacgagctcagaaaaatgggggcacacatttcgatcaatggccggacagccatgattgaaggcgtgccggagctgtcaggcaccaaaatcgccgcgaccgatctgcgcgcaggcgccgcgatggtcatcgccgccctggtggccaagggccgctcggaaatcacgggcttgaaattcatcgatcggggttacgaaaatctcgaagaaaatttcagaaatctcggtgcccacatcgaacgggtcaccgtgaaaagtcatttagacaactaatcttaagcaatactttacgccccattctggggcttttgttttttagagtcattttaaggattaccgattaagataaaaaacgttagaggcatttaattatgaaattttgtagtctgtacagcgggtcatcgggcaactgcctgtttgtgtcccacggcgatacccggcttctcgtcgacgcgggcctttcgggtaagaagattgaacagggcctgatgtccatcgacgagctgccggcacagatcgacggcattttgattacccacgagcaccgcgaccacattcacggtgccggggtgttgtcccgccggtacgatctgccgatttacgccaacgcggccacctgggaagcgatggcgccggatatcggcaaaatcgccgggcacaatatccgcatgttcgtgactggcgtcccctttgctattggcgatttgggcgtcgacaccttcggtatttcccacgacgcggccgacccggtgggcttcacctttgacagcggcgcccacactgtcggcattgccaccgacaccggtatcgtttcgccggaaatcgcgcaggcgctggccggacgggatctggtggtgctcgaaagcaaccacgacgctgggatgctcgaaaccgggccctacccttacgcgctgaagcaccgcatcgccagtaagctgggacatttgtccaacgataccgccggcgaaatggcggtcgatctcgcggaaagcggcgtgaagcagatcgtgctggctcatttgagccacgaaaacaatctgccgattctcgcctaccagacgacacaaaatttctttaaacaggcaggcatctcagaaaaggatactcgggtcgccgtggccagacgccacgagcgctccagcgtcttcgatttgggataatcggtttaagaaaaaacacaaggagttttgaaatgacgaagcagcgaaaagatatcgaagaatccatccactccactccggcatttcaaaatgatctttttcccgagatcaatgaaaaaacgaccagccttccggaaaaagaagaggcggacagccgccagtccagatttggaaatcacagccgctcctggtggttcatgatggatacggtgattgtcggactggcgctggtcatcgtgctgttcacggtttactgccatcaggggatgaaaagcatcgccgtttccgaagaggcggccgaagcggcgggtgcagcgcgcctggatcaggcggccagcagtttagacggggccgtcctgaacgtgacttccggcgcctcatccggcacgggctttgcggtgaccacagatgggatgatcatgaccgcggcgcacctgatcaccacgaccggcgcggttcaggtcactgataagaaaaagaagacttattctgcgaaggtgatctggtcggacgccgatttggatctggcgctgatcaaggcctccgggggccattttaaaccggccgtgctgtccgacgacgaccagttctacaagggcgaagtggtgatgcagctcgggcgcagcggccacacctacgcgacgaaaaaggcgtcgattctcaatcctgacgccaacgtcctcgcgtccgacggcagcggctacgcggttcgggatttgattcagatcgacggggacagcgcagcgggcacgccaatctgcgacagcgatgggcagatcgtcgggatgaccgtgaagacggacgcggcaggcacttacgcgctgccggcctattccctcgcgacggtgctcgatcaggtgatcatgaccgggacttacgaaccccgcaccatcggcattaccggtgaaagcgcggatcaattcaagctgcgtaccgggaagaccgcgtccttcgacaacggcgtcgcggtgctgacgatagcgccgggatcgggcgcagaaaaggcaggcgtcgcagtgggcgacgtcatcacctcggtagaaggcaagtcggtgaacaacccgcgggaaatggcagcggtattggccgacatgacgccgggcagcaagacgacgctgacggtgcaccgcgccggcgccaaagctggcagtgccgacgaacaggttgaggtcgaggtatccgcggttcgttaaatgaaacgggtgcgttcaaatcataaaaaatgcttaaggctaagccaattcttttttagaatggttctaattaacattgacgggattcccggattgcgataagatagagctgttctcaattgagagaaggagagcatattcatcaatcacatttgaatcatcaaaggaggttttttaaatggcagattttttaagatgcagagctgaagaattaaagggcacaaaaaccgaaaagaatttacaggatgcctttgcgggtgaatcccaggcacgtaataaatacacctatttcgcaagcaaagcgaagagcgacggctacgttcagatttctgaactgttcaccgaaaccgcgaacaacgaaaaagaacacgctaaaatgtggtacaagatcctctacggcgtcggcgacaccccggataacctgcagtctgcagcagacggtgaagcttacgaatggaccgaaatgtacccgagaatggcgaaggaagctgaagaagaaggcttcgacgatatcgcccgtctgttccggatggtggcggacatcgaaaaacaccacgaagaacgttacaagaagctgcttaagaacatcaacgacggcgtcgtgttctcaagagacggcgatcagatttggcagtgcggcaactgcggccacatcgtggtcggcccgaaggcaccagaagtctgcccggtctgcgcacatccacagagctacttcagaatccaggctttgaattactaagatttaagtctcgtactcaaaacagcgcttcggcgctgtttttatttttgccattttttatgtatacaattgattttatttaaggtacaataaccgtaaacgttttttggtatcttaataaaaaatttagaaagttgtactaaatgaacgaaattgattgaagagaggagcggattatgaaattcaagcaatggaaatggcttttcgcggtatttctcattgcgggcgctgtttttctgatgaaaccgcagacggcctttgcggcggaagtggacgaccacgcggccaacgcacagacgcccacggcggcggttaccgagacagtccctaacaccactgcggcgaatcaggccagtaccgaggctgtcacgcagaatcctaaaagtgtgacccaaggggacacctcttcggattcggcaaaatcaacagatgtgacatcatcgatgcagccggcagaaaaaacgcaggccgcggaaactggggacacatcgaaacccgcacagcaggatcagactgcatctgccacacagccaacagcgccgaaatacgtcaagacggtcgaagacggcacctacgtcatcgcgtcacatcaaaacggcttcaaggtgatcgacgtttcgggcggcagcgcgcagagcgaagccaatattcagctttacgacgccaatgggaccaacgcgcagaagttcgacgtcaaatgggtggcgtccgacgacgaagacggaggctattacctgatcgtcaacaagggctccggcaaggtcgtcgatatttgcggcggtgctgatgccgacggcacgaatatctggcagtacgacgaaaacggcacagacgcccagaaatgggaaattcttcccgccggagacggcgcctactacattttggctaaaaagaacggcaaggtgattgacgtacagtacgccagcatgcaaaacggcaccaatatctggctgtacagccaaaacggcacgaacgctcaaaaatttaacttcttgaaatcgggtgagaatgtttcgattgaggacggcgtctacacaatcgtctcgaagctcgacgaccagaaggtgctcgatattagcggcggttcgatgggctccggcgccaatctgcagctgtacgaaaacaacggcacaaacgctcagaaatttatcatcaccaaaactggggatacctaccgaatcacctcgctaaactccggcatgacgctggatatcgcgggcggttcgatacaatccggcaccaatgtgcgccagtacttcaacaacaacacggcggcgcagcgctggtttttgcggaacaccggtgacggtacctgctattttgcagcgggcaacaacggcgccaatgtgctggacgtcagcggcgccgaaacggccgacggcaccaacctttgggtttacgcggccaatggctcagatgcgcagaaattttatctgaaggctgtcgcctacaatcccattacaggcgagttcatcttcaaaaacgcgaataacccatcagcggttttggatattgcgggcggctctcggaagatgcaggccaatctcgagctttacagcttcaacgatacctgtgcgcagaaatttacgattgtggatcttggcaacgggtttgtcaaaattcgaaatgaaaaatctcgccacatgctcgatgcggccggcggcggaacggcaaatggcaccaatgtgcagcagtattgcgacaacggcacgatggcgcagagatggatcgttcatcaaaacgcggacggcagcttttccttcatcaacgccaacagcagcctggttttggatgcggctggtggcaataccggcaacggcaccaacatccagctgtacagcttcaataattcaaatgcgcagaaattcgttctggcttcaacgaccggtacggattacgcagacatagattacagcgttgaagtgtatttggacgcgatggattggaaggcgcagggctacgccagcagcaccggctacgcgatcctcgtcgactgctcgcgccacctcgtttcgatttacaaggggtatcagaaccattggacgcgcatccagcgctattcctgcggtgacggtgcggccagaacgccgacgaaaaagggcgtgttcacggtgggcatcaaggaaaggtatttcggcagcagctcctaccggtgctggtacgcgacgcagttcagcggcaattatcttttccactccgttctgtattatccggcatctacgccgtcaagaatattagatggcacactgggaaggggcgtctcccacggctgtgtgcggcttgcactcgaaaacgccaaatggatttacgacaatatcccgagaaatacgcgggtcgtcgtgtacggttaatacaataaatttggattttgcaacagcgcttcggcgctgtttttttatctaaaattttttgaaatcttgtggtgaatcggctaagatagacccatgaaaacagaacacacgaaaatattattctttgatgtggacggcaccctggtcaattttcacaaggtgctgcccgactccgcggcgcgggcgctgagggcggcccagcgcgccggccacaagctggtgctctgcaccgggcgcagcgaggcggaggtctacccctttttgatggatttcggcttcgacggctacattttcggctccggctcccacgtgatcgcggacggacgggaaatcggccgccacgtcttcggcgccgagcggatgcagcgggtcatggcgatgctgaaccgcggcaacgtgccgatgttgattcaaatggcccacgtcggcattatctcgcccaacgcgctggaatccttccggcgctaccgcctgtttcaggtgagtgaaagcgaatcggtttacgacgtcatttccagggctatcggcaaggttaaagtcgatgtggcccgggggctttacgccgaccattatcccgacgccgacatggtcgtctacaccggggcgccctttacccgggacgcattcgaagcctggctcgcgccggtgaacctccgggtgacggccagcagcctggaaccggacgacgcgagcgccggcgaaatcacccggattggcgtcgacaagggcaccgccatcgacgagctcatcgcggccgtcggtgcggaccggtcggacaccatcgccttcggcgacggccccaacgatctcgagatgctcgacaccgccgggaccagtgtggtcatgggcaacggcgtccccgaggccaaggccctcgccgatttcgtcaccaacgacatcgacgacgacggcatcgccaaggcgatggtgcgcctcgggctgattccgtcggatttttagagggacgggacgatgaaaaaagaagatctgattctcgtcatcgacatgcagaacgtctaccgcgagggccaggcatgggcctgccgggatttcgacggcgcggcggcgcggacgctgcgcgttgccgaagccgcggaccgcgaaggcgtgcctctgatggtgacggcctttctgccgccggcggcccccaaaggggattggcgggattacaacgaaaagtacgcggcgatcaacgccgacccgtggctcaacgccttggccgacgaaatcgcgcccctggccgaaacccatccttactgccccaaatcgacctacaacgccctcgaccacccgaacgtccgggcggcggccctgcgggcgcgggaccggggcggccgcgtcgtcctcaccggcgtggtcgccgaatgctgtgtgctgtggaccgcctgcgcggctatcgacctcggctgccacgtgctttacctgaccgacgcggtgtcggggctggaccgcccgaaggaggcggcgtcggagctggtgctctccggcctcgcgccccttcaatgcgagctgatgaccacagcggattatttggcggaaacttaagtatcggtaaagctgaaataggttaagtcccatggtttgttaaatatggcttggaagtttgacccggtcaagtatttgtgatataaacatagacgattaccaattgttttataaaacttaaactcatttatacaaacagaaaggacttaatcaatttatgaaatgtgaagcacaggacgtgccggatcctctagagacggcagatttaaacgcggaagttttcagtgacaccgttcacgaaatttgtgatttcaacgaattctacacggtgtacatggggatgctcaacgacggctacctggattcgggattttcgatcaccgaatgccggacgctgtttgagcttcagaagcgggacggctgccggctgaatgagctggccgacgcgatgtacgtcgatcagggctacatgagccggatcatcaagcgtttccgcaaaaagggtctcgtgtccaaggaaccctgcgaagaggacggccgggcctattccctgcggctgaccgacaagggccagtgtgtcgtcgaagagctttcttcgatgatggacagccgggtcagctcccagatcgagggcctgagcaccgacgactgcaaaaagttgaaatcggcgatgggcatgatcacccatctgctctcccccagtttggcggaagcctaaaccgcggcaatgaattgacagatctcgaggagactcggggtctgttttttatttgtgcttctttggattaaaggaaaggaggcccctatgcctgctcacaaatgtcaatgcgcctacaccgatcaacgccgtttctgcatttcccacatccgcctgttcgagcggctgccgatggcgcttcagggccagctcgtcgcccggtcggtgcactccgtccatccccggggcagcgccctggtccgggagggtgaccccatcgattcggtgctgatcattcagcggggcaaggtcaagatcgccagcaccgacgcctcgggcgaggaacacattctcgacgtcctccacgacggccaggccatttggcacggcattttcttaaaggatcacgtctaccattacgacgtgatctgcctcgagccggtgaccctctgcgagatcccccgggacgcgctgaccgaggtgctcgagcgccatcccgagacggtggtccatttgatcgagatgctttccaccgagctcgacgaggccgaaaaaaaggtcatcatcctgtcgattcgggacccgcgccggcgcatcggccagtttctgctctaccgggacgcccgctgcctcgaccgggacgtggagctcaagctcgaggacatcgcctcgtcggtgaacctccgggtcgagaccgtcagccgtcatctgacccagctggagcgggacggctacatcaagcggatgggccgcggaaagctccgggtgctggatcggcaggcgctgtccgcctacgtcgaaaacgaatgagcgtcgattgaaaatttttgaaaatctctcagaaccagaaaaaaatttgaacaaaaaaataaaatttcgctttttatttgatttgaatcaaagaacgaagcccaagatggtgttacattaggggtgtcttaaagatgagacaccccaacaagtgcttgtctttcagacaggcacttatttttttagatggtttacgatacacacgatgaaggaggcggtgacatggcagaggtacaaggcaggattcattccatcgagaccttcgggtcggtggacgggccggggattcggttcgtgattttcgtgcagggctgtgcgatgcggtgccgcttctgccacaacgccgacacctgggattgcggcgccgggacgctgcgcacgccggagaatttgatcgcccaggccaagcgctaccggccctattggggcggtggcggcggcatcaccgtctcgggcggcgagccgctgctgcagatcgattttctgctggcgctgttcaagctggccaaggctgagggcatccacaccgccatcgacacggcgggccagccctttaccgatcacggcccctggtacgacaagttcgtcgcgctgatggggctgaccgatctggtgatcgccgacatcaagacgatggacccggaccaccacaaatggctcaccggcgtgcccaacgccaacatccaccagatgctcaggaccgtttcggatatgggcgtgccgctgtggattcggcaggtgctggtgcccggcatcaccgacgaccccgaagggctcaaggcggagcgggccttcatcgacagcttaaagaccgtcgaaaaggtcgaggtgctcccctaccacacgatgggcgcttacaaatgggaagccctcgggctgacctaccccctcgacgggatcgacccgccgacaccggaacaggtgcaggcggctgaggcgatcctcgtccccggaaaagcacaggcttagaagccggcggcactgccgccgatgacaatatgcaatcattaaagataaaaataaatggttttggttttgtaagattttaatacaaaggagaatgacaatggcaaacgcatggcgcaattttaacggcgatttgtggaaagaagacatcgacgtccgggatttcattcagaagaattacaccccctacgacggtgacgaatccttcctggaagggccgaccgacgcgacgaccgaactctggaatcaggtgcaggctctgcagaaggaagaacgggccaagggcggcgttctcgactgcgaaaccgaagtggtctccgggctgacggcttacggcccgggctacatcggcaaggacaccaaggatcttgaaaaaatcgtcggcctccagacggacaaaccgctgaaacgggccttcatgccctacggcggctacaaaatggccaaggaagccgcggaaacctacggctatcagatcaatccgaaatacgatcagatctttaacgaatatcacaagacccacaaccaggcggtctttgacgcctacaccccggaaatgcggcgcgcccgccacgctcacattgtcaccgggctgccggatacctacggccgcggccgcatcgtcggcgactaccgccgcgtggcgctgtacggcgtggactatttgatcgaaaagaaggaagcagacaagctgaactgcggtgacggcacgatgaccgacgatgtggtccgcctccgcgaagaaattaccgaccagatcaacgccctcaagggcctgaaggctatggctcagatctacggctacgacatttcgaagccggcggtcaacgcccacgaagcggtccagtggctgtacttcggctacctcggcgcgatcaagacccagaacggcgcggcgatgtccgtcggccgtatctccacctttcttgacatctacatcgaccgcgacttaaaagaaggcaccttgaccgaaaaggaagcccaggaactcatcgaccacttggtcatgaagtttagaatggtcaaattcgcgcggatcccgagctacaacgaactcttctccggcgacccggtttgggcgacgctggaaatggccggcaccggtctcgacggccgctcgatggtcacgaagaacgacttccgtttcctccacaccctggaaaacatgggaccggcaccggaaccgaacctgaccgtgctctactccccacgtctgccggaagccttcaagcattacgcctccaagatttccatcaagacgtccgccatccagtacgaaaatgacgacgtgatgaaacccttctggggcgacgactacagcatctgctgctgcgtctccgcgactcagaccgggaaggaaatgcagttcttcggcgcccgcgccaacctggccaaggccctgctctacgcgatcaacggcggcaaggacgaaaaattcaagaacaaggacggctctccgatgcaggtcggcccggaatacgcgccgatcacttccgacgtcctcgactacgacgaagtggcccacaaatacgaccagatgctcgactggctggccgggctgtacgtcaatattctgaatctgatccagtacatgcacgataaatattactacgaagcggaagaaatggcgctgatcgacactgacgtgcgccgcaccttcgccaccggcattgcgggcttctcccacgtcgtcgactccctgtcggcgatcaagtacgcgaaggtcacggcgatccgcgacgactacggcgtcaccaccgacttcaagatcgaaggggacttcccgcgctacggcaacgacgacccgaaggcggacgacatcgcggtcaagctgctccatgccttcttagacaagatcaagaagcatcacacctaccgcaactccgaaccgacgacgtcgatcctgacgatcacctccaacgtcgtgtacggcaaggccaccggcgcactgccggacggccgcccagctttcaccccgttcgcacctggggctaacccggcttacggcgctgaagaaaacggcctgctggcgtcgctgaactccgtcgccaaggtgccgtacaagtacgccctcgacggcatctccaacacccagacgatccatccggacgccttgggccacgacgacgccgaacgcaagggcaaactggtcaacgtgctcgacggctacttcagccagggcgcccaccacctgaacgtcaacgtcttcggtgtggacaagctgaaggacgcaatggcccacccggaaaaaccggaatacgcgaacttcacgatccgcgtcagcggctacgcggtgaaattcatcgacctgacccgcgaacagcagctcgacgtcatcgcccgcaacgcccatcaggtgctctaagggccgaatatgaacccctccatatccataaagagagaacacacgtatcaacgggacggcttgcagccgccccgttttttcgttataatcaaaaaaatttatatattaaagcataaaatttttacggacaccatccgtcatcaatcgcagcatgattgatgataaggatggtgtcaattaaggaggtcgacagtggcaagggaatattggaagccggcgaatctgctctacccgattccggcggtgttggtgagcgcggtggacgcagcgggccggcccaacgtgatgaccgccgcctgggcggggaccgtgtgctcggacccggtgatggtgtcggtgtccatacggaagtcgcgctacacccacgagctgatcagccgctccggggagttcgtcatttcgctgacgacggagcgcctggctcgggcggcggattactgcggcgtgaagtcgggccgggacgtggacaagttcgcggcgatgcacctccacccgagcccgtcgcgaaaggtcgcggcgccgggcatcgccgagagcccggtgtgtctcgagtgcagggtgacccaggtactggagctcggctctcacgatatgtttgtcgccgaggtggtgtccaccgacgtggacccgcagtatctggatgagcgcggccgcttcgatctggaccgggcccatttgatcgcctattcccacggcgggtactttgccctcggcggctgcctcggccgcttcggctactcggtgcgcaaggcgaagccccaatccaagaagggcggcagatccagggcgcacagcgcggcggccgccaaagatcaaagccgtccgtcccgccgccctcatcaccacaacagcggcacaaaggctaagggcggtaagggtgcagcgcggaaaaagcacccgggcaaagtgcgcagacgcaagcggacttatccccactgatgtccacttttccacaatttttaaaggtgtcattttttagagcgctgcttaaatgttttttgtgggaagagttgaagaaattttaaagaaaatacagtgaataattgtattttaaataaagatccaaaaaaatatgacacctttattgtcaaataagggtgtcatatttttatgtttgattgttcggtttattactccgccatcgcgagcatctggcacacgagggtgaagctgtggcggatggccatcggcaaaaactcgtcgtaggtcaaggtcggcgcgtccttgtcggcgttgtcagaaatcgcgcggatgatgacaaagggcacgtcgttcagcgcggccgcctgagcgatggccgccccttccatttccaccgcagccggcttaaaggtattctggatcgcgtccgcccggggaccgccggcgataaactggtcgccgctggcgatgcgcccgacgctgaaatgggcgccgtccatttcgtcccggcaggcttcgtaggcccgcgacgccaaatcgatcagcgacgtcgccgccttgaaatcccactccggcagatccggaatttcccccggggcaaacccgcggaccgtcacgtcgaaatcgtgctgtaccgcgtcggtggagacgaccagatccccctggtggatgtcctcagccgtcgtcccggcgacgccgacgttgatcagcgcgtcaatcgggaaatgggagcacagcgcctgggcgcagaccgcggcgttcaccttcccgaccccgcactgcacgaggaccaccgactggccgcagagggtcccctcggtgaaggtcaagcccgagatgaccgaggtctcacggatgtccatcgcttcgcggaagggcgccatttcctcttccatcgggcagatcagcccgaacagcggcatcgtcttggcgtcgctttggatcgccttgtgcatgcccttgaaaaacccaacgcccgcgccaatcgccgcgccggcgccgagggcaatgccgccaatcacttttgctggattctttttcattggtttctccttaaatacagatcaagtttgggttaggccttaggcagggccttgtccttgtattgtatataaaacacagaataaacgcaaacgagggggcggctgccccctcgtgcttgtgccgtagctggtatcaataccctctgaaatcgtcggtgacgatgcggtccgccgtgacgccgaggccggtcagcgtgtcggcaaaggccttgttcatccccggcgagccggcgatcaaatattcagcgccgctgccgtgcgccttcgcgtaggcgtcgaccccgccggtgaaatcgtcccggttcgagatcagctgcaggtccacattgggtagcgtgcttcggacttcgtcccagaacgggccgtaggcgaattcgccgcggtcgtcggagtagagcaccgtcacttttttggacgtgtcgtggcgggcggccatatccttgagcagcgagcggatcggcgtgatgccgatgcccccggcgatgaccagggcgcggtctgtcgtgtcgtggaaggtgtagctgccgagggcattcgcgacgagcatcacgtccccgggcttgacgcggttgagcagaatatccttgaagtcggaatggggctcagcgatgcgcgtcgtgaacatcaaaaagccgtctgccggcgcggacgcgatcgtgaacacccgtccgggcttttcgtcgggactaacggtgtaatcctgaaagcgccacagcgcgtgctggcccgccgtccaggtgtagccgtccggaatctcgaggataaaactgtaggtgtctgaggtttccttcacaatttgcgaaatcgcagctggataaagtttcatcgtaaaaccctcctgttttttgatctcattataaaaaagaatccttaataaacagctataacagaaattgcggaaaatttaaaaagatatggtaaaatagaaacatctttaaaattcagaaaaaccatgactaaaaagaaaaaacagaaaggagacccatggacatcaggcattacgaagaaatgggcgccgaggatctgcgcttcgcgattctcatcgacggcgacaacatttcagccaaatacatcgaaggcattttgaacgaaatggccaattacggtgtcgcgacctacaagcggatctacggcgactggacgagcccgggcgcggccaaatggcgcgacgagctcctctccaaatccatcacgccgattcagcagttcgccaacgtcaccgggaagaacgccaccgactccgccctgatcatcgacgcgatggacatcctgtacggcggtatggtcgacgggttctgcatcgtgtccagcgattccgacttcacccggctggccagccgcctccgggaatcgggaatgcgggtcatcggcatgggcgaggacaaaaccccccgctccttcagaaacgcctgcaccaaattcatcagccttgaaaacatcctggacacctacgaacaggaaatcgacgagccggcggcgaggtcgggccgaagcgccgacaaggccgagccccacaccgcgcggaaggccgtcgagaacacaatcgccaacatcatcaccgagaacgccaataagggcaaggccaccggcctcggcgaggtgggcagccggctcaacaacaaatacccggatttcgacgtccgggactacggctactcgctgctgtctaaatttttagaggaatccagccggttcaccgtgaacaagaccggccgctcccagaccgtcgccctcgccgaaggcgatggcaccaccgagcgacaggtgacggcctatatcgtcgggaaggtgaagagcgccggccggaacggcatcgagctgggctacctcggcaacctcgtccacaccaacttcccgagattcagctggaaggacaagggctattccaaattctcgaaattcgtccagcacatccgccccgtcgacatcgtcgacgacagccacggcagccgggcggtcatccgcaaagcgagaggagataaaaaatgaaaatcgtaaagaaaaccgtccgcaccacggcccacacccagatgctcgacatcaccaacaccgtcgctgaagccgtcagagactcgggcgtcaccgacgggatcgccgtcgtctggatcccccacaccaccgcggcggtaacggtcaacgaaaacaccgaccccaacgtgtgcctggatatttcccgggaaataaacaaaatcgtgccctgggaggacggctaccgccatctggaaggcaactcggcggcccacctcaaatcgtcgctgttcggcgtctcccagacgattctcgtcgaagacggcgcattggtgctgggcacgtggcaggacgtgtacttcacggaattcgacggcccgcggacccgccaggtctggatcaaggtcatcgaaggctgattcataagaaagagagactatgcagaatatcgatttatctaaagtgaaaaagggcgacagcctgctggggtatttgttcatcaaatcccagaccgtcaaaacctcggccaacgggagccgctacttcaacatgacgctgaccgaccgcggcttcaacggcatgaacgccaaaatgtgggacgtcaagcccgtcgacgaggacgagtttaccgaaggcaatctggtcaaggtcaaggccaaggttcaggaatacaacaacaatttgcagatcatcgtcaaccggatgcggctgaccaacgagggggatgacgtcgacatcaacgactttgtggaatccgccccggccgacatccaggggatgtacaacgacttgattgacacgatcaacagcttcgaaaacaaggatttgaagctgctggtcgggacgatgatccaggacaagcgggacgcgctgatgtacttcccggcggccaaacggatgcaccacgcctacaagggcgggctgctctaccacacctggtcgatgctccgggacgccaaggccctggcgccgctctaccccttcctcgacgctgagctgctctacgccggcgtcatgctccacgacctcggcaagtccgtcgaaatgctgtcggaccagaacgggtcggtgtcggattactctaaggaagggaagctcctcggccacatcatcaccggcgtcgtcgccatcgacgagtacggcagaaagctcggcaccgatcccgagctggtgcttcagctcaagcacatggtgctgtcacaccactacgaacccgagtacggctcgccgacgaagccgatgttcgccgaagcggaaatgctgcactatctggacgtcatcgacgcccggatgaacacgatggaaaagattcaggccaacaccaagcccggcggcttctctgaaaaggtctggggcctcgagggcatccaggtgtaccgccggccggacgacaaggcatgatccggaccgtcgtctggatcgacgccttagacgaagcgcttgatccaattgaagaggcccggctgacgctgctgctcgagcgcctcggcagggccggcatcgacgtcgcccgctgggacgcgctgagcgtccccgaggggctgacggttgagacagtgccggcgctggtcatcgacggcgaggtgaaatgcgccgggcgtcacccgagcgcggaagaatggcggcagtggattgattttgacgcgctgccccgcagctgcggctgtgcggcgggcggctgtgccggctgcccgggacgggcggtgtgtcacggagcgtaaagaaaaaagcgtaaaacaaaaatggacattcaagtatacaggacagaacgaaaacgcatgcggcacggcgtgcgggcttacgcggcctacctgctggagaccgtgtacaagtgcagcgcgcccattgaaatcggcccatttggcaagccagaaatcgcccagaccggcggcgcgccgttgtatttcaacggcgccgactccggggattgggtgatctgcgcctttgcggaccggcccatcggcgtcgacctcgagcgggtccgcaccgataggcgggtcctcagtgtggccagacggatgtttgggaaggttgaggcggccgccctggagcagatgccgattcggcggcgcagccgcgtcttcgccgaggcgtgggctaagcgggaggccgtgatgaagtggaccggccgcggcttcaacctgccgatggccgagattcagatcgacggcgaacggccctccggcccggacctgcccgacgacctcgccctgttcgcgattcccggcttcgacagccggcggtacgcggcgtggctctgcggccaatataaagaaaaaccccggatcacgctgatccgggattaaataaagggtccaattatttttcgatgacggtgtgctgctgctgcacgctgccgctgtggttcacagaatgggtgaaccattcgaactgggcgacgggattattggaatcggttgtgtaagcggacggattgtgactgcccagcgaccaggccagaaaacagccggagatcagcatcactgcgacgagtacaataatcacgatcttcagtttcattcagcgtctcctttacatcgggtgattcggtataacctttagcattcctttattgtacccaaaaaacagggaaatgtacagaacaaaacagaaaacacacgtaaaaacacataaaattttaagaacaatcaggtgatcacatgacagacaagacccaaacaggcgaaacggcgcagatggcggaggtctacgttcgggaaatggcgaaattctacaaggtgctcggggacgaaacccggctgagaattttgtacgccctgtcccagaaggagcggtgcgtgaccgatttggtcgacatcctgggcatgagccagtcctcggtgtcccaccagctgcgcatcctccgggacaacggccaggtgcgcacccgccgggacggccgcaacatctactactccctcgacgacaagcacgtcctcgacatcttccaggaagccctccagcacatcagccaccgcatggccgagggcaagattccgagaaactaaaaagagcggaccgctttctctcaaattttttaggcttgagagaagcgccgctcttttttgttgacaatgatttagaccttgagctccagaatcgtgttgtacaacagggtcgttttgtaaggcttcagcgtcaggtccttgtggtggtggccggcgaaccactgacgccaggtggcccggtcggcgatcttctggagcatcttcgcgacggtcggtttgcggacgccccggggcgagaagggcttgacgaaaatggccttctgcagcttgtagggcagggtgtgggtgacgatgtagtcggcgtggcggtcgtgggcgtccaggttggccagagcccgtttcagcatcaccttgtcggggatctcctcgggccaccagctcttgccgggaagccgcgtcttgcggtccgcgctgggcgcgccgcccatggccaggatcgtgaaatccccctgggaagcgggaatcgtgtagtagccgccgttctgcaggtagaggggcccgcgccgcccgtccatcgtgtagaccttgtcgccgcaccagtcgaatgtgccgagctcgtggtagatgcggtcgtaattttcgtggttgccgaggcaggtcgcgaactgcaggccgtactgctcgtagagggcccggtacatcgcccggaccgagcgctcccagtcgtcgggcttggtctcgaatatggcgccgaaatcgccgcagacgagcatcagctttttggccgggtcggcggacagggcgccgccctgctggtcgatcagcagctcgatcttctggatgtcgatggagccgtgaatgtcgccggtgatgaagacccggctgtaggcgccgctcatgactgcgcctgccaggccgacagcaccgcggcgtagacgtcggggaagggcacgccggcggcctgagccagctggtccaccgtgtcaaattccgggacgccccggcgttttccgctgcgggtcgtcaccttgaccttcgccgggccccagggcgtgtcgacggtttcgatggttcgggggagcactgagcgggccaccgggaaggaacggatgccgatggtcgtcgtttcggcgaaaatcagcgcctcgagggccgcctgatccgtctgtcggcagagcacggtgagcacggcccccgggcggttctttttcatgaccaccggcgtgactgtggcgtcgagggcgccggcgcttatcagcttcgtgacgattcggccgagaatctctccggtgcagtcgtcgaggttggcttcgagctggacgacgtgttgcgcatcggaggccgaatcaaaagggcgggcaccgccttccggttcgatcaggaagaggcgcaggagattggccgcgtcggtgtaggcgcgtttgccggcgccgaccccggttttcaggatcgtgaagggctggggcagggttttggtcgtcatcaccgcggcggcgatggccgcgcccgtaggggtgatgcgttcgccctggagcccggccaggcgcagcggcaggccgtgggcctcggcgaggttgaccaccgccggcaccggcaccggcatccggccgtgggcgcagcgcacgtggccgacgccctcgttgatgaacgggatgacgacgtcggtaaagccgagctgggtcttcaaattgtcgaagcagaccgccgccgcggtgatgtcgacgatggaatcgacggcgccgacttcgtgaaagtggacgtggtcgatgtcggagccgtgggccttggcttcggccgcagccaggtggtcaaagatggtttcagccagcgcccgggcgccgtcggtcatggtgccgccggccagaatctgtttgacctcggccagggtgcggtgcacgtggccgtgatggtgatcgtgatcgccgtggtcatggctgtgatcgtggtcgtggtcatggtcgtgatgatggccgtgatcatgatggtgatgatcgtcgtcactgccgtagagataagccatatcgtgatcgtgattgtccagcggcgcgtcgagcaccacgtcgaaatcgcaggcatcgatgccggagacggctcggcggccgatttcgatggtgtagccggaaagcggcaggctgtccagcgcctgcatcagcacggcgcggtcggcgccgagatcgagcatcgcgccgacggtcatgtctccggaaatgccagagctgcattcaaagtaaagctgtttcgccataaatgtccctcttttcgtaatagatatcgtttgtactgtaataattttatcaattggtggaaaatggcgcaacttgtttaccttttttaagcataacccaagacgataattgctataataggcgcgtcaatacgacaaaacacagttaaacatcaagaaaggaaaaaaaggggtatcaaatgaaagaggtcaaatcacccagacgcccgatgatcttctactacctgctcgtgctgatcgcgatcatcgcgttcaacgtgctggcagcgccgctgctcaatcagcggcagacgaagacggtcaattacaataccttcatgtcgatgacagagaagaaaaacatcggcgatgtcgaaattcaagatcaacagattattttcaccaataaggacaagacccagacctacaagaccaccaaggtggacgatccgcagctgacggaacggctctacaaggccggcgccaacttcagacagaacgtcagctcgaccagcaacccgatcgtgtccttcctgctcaactgggtcgtgccgatcgtgatcttcatcctgctgggccgctggctcaaccgccggatgatcaaccagatgggcggcggcgccaattcgatgagcttcggcctcggcaagagcaacgccaaggtctacgtgccgtctgaagcggggattcacttctccgacgtggccggcgaagacgaggccaaggaaaacttgtccgaaatcgtcgactacctgcacaattcgaagaaatacgcggccatcggcgcgacgatgcccaagggcgtgctcctcgtgggccctccgggcaccgggaagacgatgctcgccaaggcggtcgccggcgaagccaacgtcccgttcttttcgatctccgggtcggaatttgtcgaaatgttcgtcgggatgggggcctcgaaggttcgcgacctgttccgccaggccaaggaaaaggcgccgtgtatcgtctttatcgacgaaattgacgccatcggtcagaagcgtgccggcggcaaattctccggctccaacgacgaacgggaacagaccctgaaccagctgctcaccgaaatggacggcttcgaagaaaacaacggcgtcgtcattctggcggcgacgaaccgtccggaatccctggacccggcgctgacccgtccgggccgtttcgaccgccgcgtgccggtcaacctgccggacctcaagggccgggaagccattctccaggtccacgcgaagaagatccgcacgatgccgggcatcgactacaatgccatcgcgcggatggccgtcggcgcctccggggcggagctggccaatatcatcaacgaagcggcgctgcgcgcggtccgcggacaccgccaggccgtgaaccaggccgaccttgaagaaagcgtcgaagtggtcatcgccggttaccagaagaagaacgcgatcctctcgccgaaggaaaagaagatcgtcgcctaccacgaaacgggccacgccctcgtggcggcgctccagacccagtcggcaccggttcagaaaatcacgatcatcccgagaacttcgggagccctcggctacaccatgcaggtggaagaaggggaaaagaacctgatgtccaaggaagagctcaccgaaaagatcgtcaccctcaccggcgggcgcgccgcagaagaagtggccatcggctcggtttccaccggcgcctccaatgacatcgaacaggcgacccggatggcccgggcgatgatcacccgctacgggatgagcgacaccttcgacatggtggcgctggaaaccgtcgaaaacgcctacctcggcggcgacacctcgctggcctgctcggcggatacccagaaggttatcgacgaaaaggtcgtcgatctggtcaaggcgtctcatcagaaggccgtcgacctgctccaggccaaccgcaaggtgctcgacgagctggcaatgtatttgtacgacaaggaaaccatcaccggcgacgaattcatgaacttcctcgcgaaataccaaaacgaaggggagctcaccgacgaagccggcctcgcctcgcctgcggaataaacgcgataagcatttagaaaataaataaataaaaaatagaggatctcagctttttacaagccgaggtcctctaatttttggaaaaatttggcggaggccgccgtgcggttgtagtcgtaataggccatgaccttcttggcgtaggccggatcgccgtaggcgttccacccgagcttggccttcatccgcgcactgaagattttggcgttggcctcagagtagccgccgtaatttttctgcgcccattggatgtagttgttgccgaaattgtagccctggagggccagcttcagcttcgaccgctgggacggggaggtgcagtccgccgctttcaggcagtcggcaaagtgctcgacgccgaccttgatcgagtatttcgggtcttggatggcgttgggggcgttgctgtaataggtgttcatcggcgactcgctggcctgcatcgggtcggtgccgtagcccttggtttcctgcatcatgatcgcctcgatgaccgggtcgaaatcggcgatgccgctgcgcgtcgtgaatttgtggatcgtcgcgcggtactggcggacgtggcgcgtggtgcgcttgccctgaagggcgctgttgtcgaggatatattccagcgagccgtactgccagaaggccacaagcccgacgatcaccgcgaggacgatgagcccggcgcggatgcgccggccccgtttcgtcagcggctttcgcttgcgttttgttttttgtttcggctgaaataatttcaaattgaacctctcattctggattccaggctgccctggaacgattcttattctaatcgtgaatgcttaaacttaaaataatcgccaccgcctttaaatttgtggtaggataaagacatgacgcaaacggcgaaaaatacaagaaaaggagggagcgcatttgccgattttagttcaaaatgatttgccggcaaaaaagattctcgaaggggaaaacatttttgtgatggacgaacgccgggcgcacacccaggagattcggccgctcagcatctgtatcctgaatctgatgccgctgaaggaagcgaccgagctggacctgctgcgggtgctgtccaactttccgatccagacgcagatcacgctgatgaagaccgaaacctgggaagcgaagcacacgaaggcctcccatctcaataaattctacgaaaccttttcggatttgaaggaccagtatttcgacgggctgatcatcaccggggccccgattgaaaaaatggattttgaagaggtccaatactggccggaaatggaagccatcttcgaatggtccaagacccacgtgttcacgacgatgcatttgtgctggggggcccaggccgggctgtactaccaccacgggatcaacaaatacatgctgccgaagaagctctcgggggtctaccgccaccgtgtggtgcaccggaagaagatgctgatgcgcggcatggacgactatttttacatgccccattcccgctacaccggcatcgacgaaaaggccgtggccgacaatccagagctctacgtctgtgccgagggcgacgaggtcgggccgacggtgatcctcgcctactcgtctcggcagattttcatcaccgggcattcggaatacgaccggatggagctggacgccgagtacaaacgggacgtgtcccgcggggaacacccggacctgccggtgaactactaccccgacgacgacccgtcgaaggagccgatgctgctgtggcgcgcgacgtccaactgcatctacaccaactggctgaacttcatgtaccaggaaacgccctacgacctgacccagattccgccgatcgaggcggacagctacaccctctgcgacgacgagcagaaataaaaaaacgcattctcgaaaatgcttcgggaatgcgttttttaatgggtgcgaatcggcggttaaaagctctcgtatttgaagtgcatcagcacgtcgtcgaggagccgctcgagggtttcgccgtcgtgaatgtcttcgtcgggcagcttgtggttgatgtcccggatgatcgcgtccagcgtgctgtaatacgcgtcggtgtggggacggccggaggaaagggaaggtttgctcatggaatctcctttatcagcagaattgaggggatcagcgggtgatgtcggcgaaggccgcgccgatgaattcagccagcgccttcgggttgacgccgacctgggtgccgattttgccgccggacacgtagatgcgttccagcgcctcggcggacgcgtcgatcaccgtggcgtagagcttcttcatgccgaccggtgaacagcccccgtggatgtagccggtgttgggtaaaagctccttctggtgaatcatttcgacggatttttcgccggcggcccgggcggcctttttcaggtccagctcctcggcgacagggacgacgaacaccttgaagtcgccggaatgcccgcggcagaccagcgtcttgaagacctcgtccgggttttcgcccattttttcagccacggacaccccgtcgagctggccgtccgacgtgtcgtagtatttgggatcgtaggtcagatgcgcctgttcgaggatccgcatgacattggttttttgtgggtcttttttgtgctttttctttgccatttttgcctcctcgtcatttttgatggccattatatcacagatttattcatattgtgtaaaattttctacgtcggtttcatagctggtattgtataatataatacaagcaggagatgcctacataaggaacacataaggaatagaaataaaaagaaagggggaacccgcatgacggcatcaaagggcgagctcatgttgaaaaaagtgatgatgcggctgccccgcagagaggcctatcacaacatggcgacggggcagtacatgcgcgtcattctcaggctgatgggcagggaggacctggagcctaagctgatgtggcaccacctgtctccctttgactaccacgacatcggcaaggcctttctcgatccggatctgacagaaggacacacgctgtacacgaaggatcaggatcttttgatgatggcccatgtcgattacgggacgggcgtgtttcagcagatcgccgatatcgagcccgacgcgcggatgttctgcaccgcggccgaggaaatcgtgctctaccatcacgaatgcttcgacgggagcggctaccccgacggcctgtcaggctgcgacattccgctgctggctcgggtgtgtgcagtggctaacgtctacacgcggctcagggaaaacgccggcggcctgatgtatcagcgcaccatcaaggaaagcctcgacgcgctgaagcattattccgggacgttttttgacccggacattgtcgagattttcgttaaaggcacgaccgaggagctgatggaaaagcagctggtccaccagctggatatcatcgaatcccatcacttcagtttttaacggttttgcacagacagcaccaaccctgctgtcttttttgttataatagagaaaattgcaggaggaagggcggcaccatgaaaacagaacgaaacggcaggctgatcgtgatagagggcatcgacggcacaggcaaacagacccagtccgagcggctggcccggaccctggccgcgcggcaggtgccggtgcttcgggtgtcctacccgcgctacgacaaggactcgtcggccatggcccggcattatttggccggggatttcggggaggaccccgacgccgtcagcccctacgtcgcgtcgacgttttttgcggcggaccgctacgcctcttatcaagaggaaaccggccccttcctcgccaaaggcggcgtcgtcatcgccgaccgctacaccacgtcgaatctcgtgcaccaggctgggaagatcgcggacgcggcagaacgggacgccttcgtccattggctcgaggattacgaataccggctcctcggcctgccgcggcccgacctcgtgttctttctcgacatgccggaggccgtcagcgagcagctgatggcggaccgggccaacaaaatcaccggtgaagccgaaaaggacattcacgagcgggataccgattatctgaagcgcgcgtcggcctgcgcccgggccctcgccaaggcccgccattggcggatcgtgaactgcctggattcggacgggcagctgcgcacggttgacgacatcggggacgaaatcacagcggtggtgctcgacgccctgaaatcgaaatcggaggcggacgcatgagccgcacgccgattggagacatgctccgtgacaacgccggccgggaccggctgcgcttccacatgcccgggcacaagggccggggccagaaggttttcgccgcggacatcaccgagattcccggcgcggacaaccttcacgatccccaaggggtcatcgctgagagccagcgggtgatcgcgtccctttaccgcgccagggacagccggctgcttgtcggcggcacgacggcgggcattctcgccgcgctgctcgccggcgcgggccccgaagggaaggtgctgattccgaccaacgcccaccgttcggtgtttgcggcgatgcacatcggccggctttccggccatttcatcgatccggattttgagcgcctgccgtggttcgcgaaatcggtcagcgccgcagcggttgagaccgctctcgccagggacccggaaatctgcgggatgattttgacgagcccgacctattacggcacggtcagtgacacggcggctatcgctgaggcgctgcaccgccggggcaaatggctgattgtcgacgaggcccacggcgcccatttggccttttgggacggcgggccccgttccgcgatcgactgcggcgccgacgtcgtcgtctcaagcacccacaagattctcggcgcgccgacgatgggctcggtgctgttgatcggcagcggccgaatcgacggccggcgcatttccgactggctgagccagatcgagtcctcgagcccgagctacttgctgatggccggcatcgaggtcgcggtggccgagggcgcagaaaaaagcagcgcagtgtttgacgccgtcgccgaggcccacgactgggcggccgcgcgctttgccgacccggggcgcaaccttttgctctacgacggcccggccgaagtctacgacaagagcaagtgggtcttcgccgttcgggacgggtcgggccttgaaatcgccgaaaccctgcggcagcgttacggcctgtatttcgagatcgaaacgccggagatgctgctggcgatgaccggcatcggcaccaccgccgaggatctcggcaatttggtcgaggcgatggcccgggttgacgggccggcgccggcgcgtgccactccgccggttcagcttgccgccctgtctgccgggcgctttaaccagcgcgtgcccttctggcgcgcgtcggatctgccgaaaaagtcctgcccgctgacgcaggcggccgggcagatcgccggccagatgctgattccctacccgccgggggtgccggcggtgctgcctggggacgcgctgagcccggacatggtgtcggccctcgagacgctggtccgccagggcgtgccggtgctcggcgtcgaggacgatcagattcaggtgttaacgcaaccccgttaaatcacaaccagtaaaggagagcaggatgtttgaaggaattgtcggacaaagccgggcgcggcagctgttgagccgggccgtggccaccgaacaggtcagccacgcctatttgttcaccgggcccgcgggcatcggcaagggcagcctcgcccggggctttgccaaggccgtgctttgtactgcggcgccggacaaccggccctgcggtttctgcccgtcttgccggcatttcgaatcgggcacccaccccgattacctggtcatcaccccgccggagaacggcgccatcaagatcgaccaggtccgcacgctgatttcggcgatgggcaaccgccccctcgagggcggcggccgggtctgcctgatcgaggacgcggagcggatgacgccggacgcgcagaacgccctgctcaaatccttagaggagccggagcccggcaacgtctttattttgaccgcggacaatccgcgaaagctcctgccgacgatccgctcccgctgtcagcagctgccgctggagccgctgaccgaccgggaaattctcgaggtgctggcggcccacgacatcgacctgacgccggagcagcaggaggacgtgctgcccgctgcgggcggcctgccgggacaggctttggccgtgacgctgtcagacgagggcgagtcgataaaaatcgcattgctcccggtgatttatgatatactgagacacaaccccatgccgattttcgactttgccgaaaaagctggcaaggataaacacaaaagtctcgaagccgccgattggctcacccgaacccttgtggacgcggccgcgcagaaggccggccagccctcgggcggcgccgcgtcacagatcgcggcccagtcggacgccgccgcgctgaccgcgatggccgaggccgccgcggagctgcgcaggcggctggataccaacgcgaacccgcgcctccaatgggaggcggcgctgcttcggattgctgaaatacaggagaatgccaatgaaaattaagatagtcggggtgcggttccgccccgctgcaaaaatttattactttaaggtcggcgagctggacattgcccttcacgatcacgtcgtcgtcgagaccgcccagggcatcgagtacggcgaagtggtcatcggcccccgggacatcgacgaggcggccttcaagcgtgccctcaagccggtgaagcgcctggcgactgaaaaggacgagcggacccacgcccagctgctggataaggaaaaacaggcgcgccaggtctttgaggaacgggcccacgcccaccatttggacatgcatctggttgacgtggaattcacctttgaccaccggaaggcgattttctacttcacggcggacggccgtctggatttcagacagctcgtccgggatttggcctcgaccttccatttgcgcatcgagctgcggcagatcggggtccgggacgaaaccaagatgttccacaccctgggcatctgcggtcggaccacctgctgctcgagctggatgagcgagttccgcccggtctcgatcaagatggccaaggaacagggcctgtcgttgaattcgacgaaaatctccggcgtctgcgggcggctgctctgctgcctgacctacgaggacccgttctaccacgaggtgacccgcaaaatgccgagagtgggcaactgggtgacgacgccggaaggcgaaggccaggtctatcggctcaacgttctcgaggaaaaggtcatcgtcaaaatgcagaccgacgacgatgaaacggaaatcaagtccttcggcatcgacgaggtggtgaaatccggcgacaagcacgtgctggccaacaaccgccgccagcagcaggaaaaggaagaacgccgcaaggaacaccagaagggcgaaaacggcgaagcctcaggcgaggcgaagggcgaagggaacgcgtcgtcccgcggtaaatcccacagaaagcacaccaagagcaaaacgtccaaaaacgggaaggcccagagccgcggcggcgaagacaaggccgcatccaagggcgacggcagcaaggagccccgccatcggaagcgccgccaccgcgccggccgcaagcacaacaaccgccagggcagcagggccaagggcggcgacaagagccgcgaatcccagagcgcgccgaaacgcgagggcggcggccaaagtgaaaactgattttttgtatgataaaaaaatcgaaaagaacttgatttaaaacgcccaaagagtataataaaattgtatcaaagaaagagctgaaaggagacgtatcatggcatatcatatttctgatgactgcattggctgcggcgcatgcgcagatcagtgcccggttgaagcaatttctgaaggcacaccgtatgtgatcgacgaagatacctgcatcgattgcggttcttgcgcagatcagtgcccgatgggcgccattgctccagctgaataatcgaaagatttttaagcacaaaaaaacttcccaaatgcgggaagtttttttattgtctgaaatcaggtcttcgtgatgtcgcagatcgtgaatccaagctttgtcttcaggtaattgaggatcgctttgaccgcagaagtgacgtcggaaatgcggccggtgaaaatcagcgtgccgctgaaacggtcgatgaagccgatgtcgacgtgggcggtcttgcaggcgaggtcccccgcgatgatcgcgatttcgtagggcgtcatactcaaaatgccgatggcggcctgagagtagtcgacggccgggttgagccccagcttctggtaaacgatcgcttccggaccggcgatgatgtgcgccagcgtgacctgtttgccagggacggtttcctgaatgattctcagcttcccatcgttggttttcaacgcgtcgctgtcgtggttttgtgtaatttgattaatatcagccatgaatctgcctcgtttcatagatggattttcgcgcggaataatctattaagaatataacacgatttcattgcggaataaaggcaataatttgcccatcaacgcaattttacagcgcttaaagccgtcaatcgccgcgtcactgggccgacgggcggtgagcgcccatccacgccgcggcccgggtcagcgcgttggcccgcaggtcgtagtagtacagtgggatatcgccggtgtgcagcacaccctccggaaaatagccggcctcgtcgccgacgacgcggaattcgtcggggtctgccgtgcggcagacgacgaccccgcgctcgggatcgacagccgcgtcggcgaagtgcgggcggtcttcaacgccgcagagccgcccgtctttatcccaaagggcgaaatggccgccgtggctctgctcggccgaagcgggcgcgctgtcccagcgccaggtgatcgggttgatgcaggggctgccggggatcagcgtgatgttgcgggccgtgacgcccggcgcctcggtgttgtaggagatgatcacgtcggtgtcgtcgggcccttccgccaatttgaggtggggatcccgggcgagctcgtcgtcgctgatgctgaagccgatgaggtaggcggcgatcagctggttgtggtattcgggatggcggacgaataccgaaccgaggagtattttcgccatcagcgccccctgggagtggccggcgaggatgaacgggcggccgccattgaggtgggtcatgtagtagtcaaaggcggcgacaattgaggcgatggggccgtcgaccatcgtctggcgcagccgcgggctcttcgcggcgcccactaggcagtcgacgttggcctggcggtacatcggcgcgtagacgttgcccactgggaaaaaggccgaggccttgtgctggagatggcgcatcgcgcaggcgcggacctggggatgatccatttcgcagaccggcggttcgccgctgtggtgaaattccgtcgggatgatgtaaaacacgtcgacggcggatacgggttgattcggttttaaaagccaggcgtcgtcctggctgtagtcgggtgtataagcgtgcatagtgacctcgcgtcaataaaatgtggataaacaaaagttatgcttacattttatcacaattccgccgatttggatgttaattgacgtggcattcctgatataatgacaggtaaaatgatgcgaaattaaaggagatatgcgatgaaaaaaggcgacatcgtcgaattgagaatcgatcggatggtgtatccgggaaaaggcgtcggggacattcccaatggcgacggcacgatcccgtgtgcggtcaagggcgcggtgaccggccagatgctgaaggtcaggatcaaaaagaagcgccacggcaaggcggagggccaaacgctggaggtggtgtcggaggcgccggacagcctcgcgccgagatgcccggtgttcggccgatgcggcgggtgcagctaccagacgatgccggcggaggcccagctcgccgtcaaggacggctgggtgatgaatctgctcgcccaggccgggattgacggctttgaacacctgccgcccatcgaaagccccgacgttttcgggtatcggaacaaaatggaattctccttcggcgacagcgagcccggcggtccgctgaccctgggctttcaccagaaggggcatttttacaatattttaaatgccgacgcctgcgcgctggcccacccggatttcgggaccatcgtcgcggcaacccgggatttctttgcggacacgtcttattatcacaagcgcagccacgaggggattctgcgctatctcgtcgtgcgccgggggacggccaccggcgagatcatggtcaacctgatcacctcgacccagggtgacatcgacgaggctggctatctgcagacccttttgggtttacagctggaaggacagatcgcgacggtgattcacagcctcgacgacagcgtcgccgacgtggccaaggcggaatcgatgcgcctgctttacggcggcggcatcatccacgaccggattctcgacgtcgatttcgagatcacgcccttttcctttctccagaccaacacccggggcgccgaggtgctctacaccgcggtgcgcgacgccgtccggaaggggacggccggtacagcgcaaaagcccgtgctctttgacctgtactgcggcgtcgggaccatcggccagatcctctcgcctctcgctgaaaaagtcgtcggcatcgagctgatccccgaagcggtcgaggcggccaaggccaacgccgcggccaacggcctgaccaactgccagttcatcgccggggacgtcaagaccgaggtcggcaggctcgaggcaaaaccggacgtcatcgttctcgacccgccccgggaaggcattcagccgaaggccatgggggatgtgctctcctttgcgccgccggttttcgtctacgtgtcctgcaaggccagctccctcgcccgggatctgccctttttcgtccgcgccgggtacaccgttgagactgtgcagtgcgtcgacatgtttccccagacgccgcacgttgagacggtggtattgatgtcgcggttttaaagctttaggccatttctgatgcttaggaatcgctttttgtcaatattaaaggatagatgatgcatgaattttactgaatggtaaggatactggctaaattccggagtcttgtcgattataatcgacaaaaatagagaatattcgtataatataatcgacggagggataaaaatgaatcacgaggctataaaacaggtgatatatgagcagcatgcgattatacgcagcgctgtgatcaacgagcgcgcgtacacgttcgagccgaatgccaattatattctcactggactgcgccgttcgggcaagtctacactgcttttttccattgtgcaaaagcttattgcggatggtgcagattggaatcagatcgtctatgtcaactttgaggatgagcgtttggtagaatttgagctggcggatttttctgacctggtcgaagtgtccagtgagttaagcgataagacaccttattttttcttggacgaggtgcagtgtgtcgatggctgggagcgttttgctagaaggatggcggatgcaaaggaacacgtttatatcacgggcagcaattcgaaaatgttgagctctgagatggaagcgcgcttgggcggacgctatttatcaaaagtgattatgccctataactttaaagaataccttacagcaagacagattccgtacaacgatgaggcattgtatacttcaaagggaattggaagattgaagaaggcctctgaggaactgatgcatgatggtggttttcctgaatctcttgattttattgacaaaagagtgtacgtcgaaaatgtttatcagaaggtattgcttggcgatattgcgcttaggaacgacattcggaaagttaccggtcttcgcattcttatgaaaaaaattgctgaaactatctgtagcgaaatatcttattcgaagctttaccgcgtggtcaatggaataggtgtcaaaatcagcaaggattctattatttcctacatcgaatatgcaaagcaggcgtatttacttttttcattggaaaattattttgcaaagtttactgagagagaaagtacacccaagtattattttgaggataatgggctgttgaatctttttctaattaataaagatacagcgctcctggaaaatattgtggcggcagccttaaaacggtcatgcagagaagaattttattatctgaaatctgagaagacaagcattgatattgatttttatgtgccggaagaggccaccgctattcaagtggcatacagtattttagatactgcagcgtacgacagggaggttaacaatcttctgaaactcgcagattcttttcctgaagcgaagcgcttatgtatcgttacacttgacgaagaaaaaatgattcaacatcatggcgtgaagattgaagtgataccattgtaccgtttcttgcttgaacgataaggatgcgccgggtacaccgtcgagaccgtgcagtgcgtcgatatgttcccgcagacgccgcacgtggagacggtggctttactaacgagagcgaattgaacaaaatattctggtgctgtgaaacagattgaaaacagatatgaagcagcgctaaagacatggagtggttagatggaaaaattagatctcttatcatataccaaaaccgatgatctgctgaaagattccagacaaattattgatgcagctcaaaagagagcatatcaggctgtcaacgttcttttggtagaacgtaactggctgcttggaaagagaatttctgaagagtttatgactggtgatgggcaggagcgatatggaaaacagattgtcgcggacttgtcaaaggagctgacaaaactatatggaaagggttttgatcgtggatcaatctatagatatatccgtttcttcgagatgtatccagagattgttgccacagcgtggcaacaatctcgtattctctcctggagccattaccgtattctccttcaggtagatgattcagatgcccgcgaatggtatgaaaaagaagcggtcgaacaaaattggtcagtgagaacgctgcagcgtaatgtatcatctcagtattactatcgcatgttgaaaacacaggtgcctgatcaggtagagaaggagatgaaagaactgaccagccaatgccagaataagctggaattcataaagaatccggtgattgccgagttcttgggaatgcaggaggatacttcatatctggagtctgatcttgagcagtgtatcatagacaacttgcagaaattcctgatggaacttggaaaaggatatgcttttgtagcaagacagcagcatatccagacggaaaaggaagattactatatcgatcttgttttctataattatattctgaaatgttttgtcttgatcgacctgaaaacacagaagattacgcatcaggatgtcggacagatggatatgtatgttcgtatgtatgatgaactgaaaaaacagccggatgataatccaacgctcggaattgtgctctgtgcggatacagacgaagatattgcaaaatattctgtgctgcatggcagtgagcagctgttcgcaacaaaatataaactttaccttccgagtgaagaagaactgaaggctgagattcagacacagaaggaactatttgaactgcagcaagatgaacattctgaacggaaagaataaggcaaatcggaatttgacgaggatttgacgtatggtggttatgaatgaattttgcattctatttgatttggcaatggccgttattttctttttgattggattatatttttataaatctgacggaaaagcagcaaatctgctcacgggctataatatgaaatccattgaagagcgtaagaaatatgatgaaaaggaaatgtgtaaagattatggcaaaagaatgatgctgtgggcaattccttttttggctggagctgtcattgatattggctttcccggcaagggaatgctgattgcatgggtaatttgggctgtgatgtttgttttgcttctgatagaaagacataagagagaaggatagatcaggaaattccagtttacaaattagagaaagagcaggtgctcccgttatgatatgctacccctaagtaggacagtaaaatataaaaacctacttgggggtatttctatgtcacgaaaaagcaagattgatccggccgtaaaagtatcggtagttgaaagttatctgcgggttaaataggctgtggtgaagcgcaagacaagccggacctaaaaagctatgcaccttttaaagactgggtcatatttacaaaaacgaaggtcctagtggactgttgaacaaatcgagcaacaagtattattcgaaagagctgaaactggccgctgttaatgcctatctttgcggagaaggctccttaatagaaatagcttttcgtttggcttaagtcagaaactcaactacgtaaaggataaagcgtataatcctcatggagatattcaatcacgcacaagcgaggtggaagctacagtgaaaagctagaaaaacaacgccggaagaacgccttgaaatcgtaaaggattgccttgctagtgataagaattatgtgcatggcactaaaattaatgttcctatcagcaggtacgtaactgggtgctgcgttatgagaagatgggatctgccggtttggaagatcggcgtggccatcgcgccggtacgcaaccttctaggacccctgaaggaattgcggaacaagattgcagaactagaaccaaaaaccgaaatcttcaaatggagaatgatctgttaaaaaagtcagagagttagagaagaaagatcgctctctctgactcgacatttgtacaaatatcaggcgatcaaggaactgtctgaagaaaagcactatcccgtaaagactctgttcatatttaaacctttcacgcagcgctactatcgctggttgaatcatcctgtcagttttagtgagaataatacaagaagattgccgaaaagatcaagtacatccatgagcaacacccggacatgggatatcgacgaatcagagacgaactggacaaaaatcacggtatcgctgtcaatgataaacgaatcctgaggatctgccgcagcgaaaagatccagtctacaatcaaatggaaaccgaagagctgtactaaaaacagcccggatctgctcacattgctaaaaattatcttaaccgaactttcaccagatgcaacctgagaaaatggctgacagatgtgacagagttcaaatatatccatcggtgtagaagtccacaagatatatttaagtgctattctagatctgtatgaccgtagatcgtggctataaaatcagtgaacataatgataatcagcttgtaatgaatacttttgatgaagctgtgactcttgaaccagatgcgcatccgttatttcacagtgacagaggctgtcaatatacgagtagacattttctttaaagcttagaaacatcatatgaacagagcatgtccagagtggcccattgtattgataatgccctatgaaggcttctggggaatcctaaaacgagaaatgtattatgtaaaacactttacttcaaaagcgaatctgtcaaacgcaatagaatcatatatcaactactacaacaaagaacgcatacagaggaaactccaattatacaacctgctatgacacctgaggaatatcatgaaaacttctatgctgcagcataagaataccgccagtcgattgttcgactggcggtacaaaaattgttaattattcagtgtcctcttgacgggtagcacaccattaagcggcgcacctgctctgctttagatataatataactgtatttacaaattagtttattatattatataggttaaatataagggagttcgattttatggctgaacatctaattggggatttgtacgaataaagcggaggcttatatggaaacaaaagtaatagaaaagaacggcgtatcgactgctgtggtttggagtgacgtggtgctgatcaaagatacgcaatcggcgctggacttgatgatgacgatcaaatacgagacggactgcacgaacatcgcgctgaataaagaggccatcgtgaatgatttcttcgtgctcagcaccggcatggctggagaaattctgcaaaagtttatgaattacggcatccgttttgccatttacggggatttctcagggtataccagcaaggcgctgcacgatttcatctacgaaagcaacaacggacacgatttctgctttgtggcagcggaggatgaagcggtagattggctgtgccgataaggccagcttgagaagggcggtgccgtttgcctgatggatcaacctcatatacaatattattaaaaacaagaaggggtgcagcatgactgatacaaacgaaaaactgaatttctcgtgtgactatctggaaggggcgcatgaaagaatcttgaagcgtttatccgaaaccaatctccagaaaatggatgggtacggttatgacccttgttcggaaagtgccagagcgcggatccgcgaggcgtgcagctgtccgaaggcggaagtgcagtttttaatcggcggtacacaggccaacgcggtgatgattgacgccatgctgcaaagctatcagggtgtcatctcagcgagcagcggccacgtcaatgtgcacgaagccggcgcgatcgaggctggaggccacaaagtcctcgcccttccccagcacaatggaaaaattgcggtctctgatctcgaacgttacctgacagatttcgaacaggacagcaaccgggaccacatggtcatgcccgggatggtgtacctgtcgcagccgacggaatacgggacgctgtacacactgcaggagctggaagctattcacgatttatgccacagccatcaggtgaagctttacgtggacggcgcgcgtctggcttacgcgctggcgagcccggccaatgacgtcaccctcctcgacctcgccagactctgcgacgcgttttacatcggcggcacaaaatgcggagcgttgatcggcgaagcggtggtggtgccggaaccggacaccatcccccatctgtttacaatcattaaacagcacggcgcccttctggccaaaggcaggctgacggggatccagtttgacgaactctttcgagatggcctgtacttcacgatcggcaaatcggccgtagactacgcggggcagatccagaaggcgctgactgaaaaaggataccggctgctgtttgaatccccgaccaaccaggtgtatttaatcgtgccggacgacaagctgccggcactgggagaggcagtcgtctattccttctgggaaaaatacgacgaggcccacacggtcatccggctgtccacaagctgggccagtacgcaggaagaggtcgagcgtttgatttcaattttgtaaaattaaagcgattcgtagtggagccgagcagatgcgcccgtcagcggcgcacctgctcgttttttatttctattcatcttgactgccacatcgtacttagaagagaaatgtaaaggataatatgatatacttaatataatcaacaagcggtgtgacacgtttgcagacgactggaggataatacggtggcgcattttattgaattcaaagacgtgacgaagatctacggcacaggtgaagcggaggtccgggcgctggacggcatccgcttctacgtggatgaaggcgaattctgcgtcctgctcggctcttccggtgccgggaagacgacgcttttgaatatgctcggcgggatggatcgggtgacctccggcgagatctggtttgacgggcgggaggtttcggctttttcgaagaaacagctcgtcacctaccgcaggaaggacgtgggcttcgtgtttcagttttacaatctgatcccgaatctcacggcgctggaaaatgtggagatcgccgcgatgctctgtgagcatcccatccccgcggcggaggcgctggacatggtcggtctgtcccaccggcagcatcatttcccggcacagctttccggcggcgaacagcagcgcgtggcgatcgcccgagcgctggcgaagaacccgcggatgctgctctgcgacgagcccaccggcgcgctggattacgcgacgggcaaggcggtgctcaagatcctttacgagctggggagagagcggggtacgacggtgctgatgatcacccacaaccaggcgattgcgccgatggcagaccggattctcaaaatacgcagcggccgaatcgagtccaacgcgctgaatccggacaggcagccggtggacgctatcacgtggtaggcacggacagcggtttgaacaattttggaaggaaatgggcatgaagaatacggcggtccgattagcggcgagaagtgtgcgcacctcgaagggacgctggctggcgctctttctgatcgtgatgctcagcgtcggcttttttgccgggctcaaggtgtgccgcggccagatgtggatggcctgtcagcagtatctaaaggctcaaaatttttacgattaccggctgtacacctccctcggcttcacggacgacgcaatcgacgcgctgcgggatcggatgcggtcaaagggggtcggcgtgcagagcctcgagggcgtgaagtctacagacgccacgggcgcgtacaaggacggaaagggcgccgcgcagagcggcgtgtttctgctgatgtcgatgcccaaaaaggtcaatcagccgtcgctggtggccgggcggatgccgaggtcggacgacgaatgcgtggtcgacgaccgcgctgccggaagcagcatcgtcggccgcaccattaccttttcagacggcagcggagacgccgtatcgggccttaaaaatagaacgtataccgttgtcggcacggtgaactcgccgctgtacctcaatgacgatcgcggctcttccgagcttggcagcggcaagcggacgggcttcgtctatctgccgaaagctgattttacgtctccgcgttacaccgaggtcgacgtgacattgaagcgcacggagaaccaggcggtttacagcgacgcgtatgtgaatacggtgaaggcgaaaaagaacaaaatcaaggcggcgctggcctcggcagctgctgacgattacgaggggctgctgcaaaacatgatgaagcaggcgccgataacgcgggacgcggctgtggcggtggctgtaaatcaaggcatcgacgcgccgtcgaccactgtgctgacccgcgcggaaaacaacgggtacgccagctttaaaaacgacacgtccatcatcgacggcatcgccaacgtctttccggtgttcttcattttgatcgcgctgctcgtctgcgtcaccacgatgacgcgtatggtcgaagaggagcggacgcagatcggcaccctgaaggcgctgggctgctcggatttttccatcacgatgaaatacatgatctacgccggcagtgcagccctgctcggttgggccgttggctttttcggcgggacctggggactgccgaaaattttctggtgggcctaccgcacgctctacgattttgcgccgattccctacgtgttcagcctgccgatggcgctgctcaccctcggggcgtcgctggcggcggtggtcttgagcatttggatttcctgcagaggcgagctcctcagcgcgccggccgtgctgattcggccgaaggccgcgaagcccggcaaacgcatctggatcgaaaaaatccgtccgctgtggcggcgccttccgttcctgcgcaaggtgacgctgcgcaacatgttccgctacaagacgcggatgatcatgatgctgatcggcgtcggctcctgcacgccgaacaaggcgctgctggagcggatcaacgggacggacggcgtcacgggcgtgaccaatctggcggacacgcgggcggacgtcagcagctccgtgtcctgcctgaattacatcatctggcttttggtgctgttctcgggcgcgctgtcgtttatcgtgatcttcaatctgaccaatatcaatctggcggaaagaagccgagagatcgcgacggtcgaggtcctcggcttttacccgaaggagacgcgggcctacgcgctgtgggaaaatctggtcatttccattttggccggcttcatcggcctgcccggcggatggctgttcacccgctttgtgctcagccgggtcctgttggacaatatgacgttcccgtttatcattcacgggatcagctacctgctcgcattgatctgcacggtgatttttgcggcggtcgtcaacctgtttatggggcgcgccatcggacgcatcgacatgtcggaatccctcaaggcggttgagtgaggaaaattgacgaatacagacgggaaaacatatcgtttttgtggcgctttatgcgctgatttagatttggatggtacggatctgtcggatttaatcagagatactttgggattgcctgacttatatgttttcgatggcaatgatcaaccggatcaggaggactgatctgtgtacggcaatatgagaattaaaaaaggaatgaactggtttagttatgtttgaaatggaaaaaacattaattgttgtttataaagacgagatgttagttaatcagctgaaaaaacttgttgagactaaagatgataatgataacggcgaagttgtaggtacgacggacaattcaataaatattgtggcttggaatgaaaaagtttggttggaaaacaagaaagctggaaatattaaatcaaaagtattgtttcttggttcgatcaaaggcacagataaattaattccggttattgatgtgaaatatgacaaacacggcgtaaaatatggatgggcaggaaatcaggctatagtttatgcgaatcccaaagaaatcacgaatagagaaaaatatgtggaatttatcaatgacctttcaaatttacctgttccagatatcgtgaagaacccaaaggattcgaaacttaaaaaagtcgctgaaaatctgccgaaattcaatgtcgcggagacaatcagacaaagagtaaaacaagaaaaagttaaagtgccggaatttttgcaaaaggcaaaaaaggcggtaaaaaaagaagttgaagttgttggagaggcgggttcaaaggcggtaaatgcggctgaggatttgtttagagataaaaatatagttatgaagcagcagttattttatggtgttgtgaatctatacaataatgacctagagcaatttatgaatttgtaggtgatttgaatgagcaatattgaagatgtcagatatggatggaattttatggctaaactcttgggagcagatttgggtggacagactgcatattctgattatgttcaaaatgttgctgataacagtaggattcaattacaaaataataagattcgggaaattaataacgccattgacgaattgacgcaaaatatcagcgcgttaaatgattctcatcctggaattgggccagatcagcttaagggctttgttgctgaggaatggcatgctcagacatttaatattgatgccatttccaaagattctgcaaacagagcatggactttgaaagaaaatggatatgcgagcgttgatatagatacgaactttggcaaacagtatagtctaaaatactcaaattatgcagataaagcagaacaaatgcaggcagcattgaatcgatatacacaccggccaaaataccatggtcaggagagactcattgccgcagaacaagtgcaggatgcaaaggcggcagctagaagaagggcaatcagaaatagtgaaattagaccagatgtgtcacagtctcattcggaaacgggaaaacatctcttaggaaaagtgtctgacggaaaaggcgtcgaatcaaaggaactttctataaaagaatctaaaaccattgcaagggaagtgcgaaaaaagagttttgacgctgagaagcatgggtatgaaaaacagacgccattaaataaagttcaaatcgattatttaaatcaagcaatgaaggcaggattgacggccgcgacgatttctgcgattgtacagcttgttcctgaattgtataaagcgatagattttcttattaagcatggagaaattgatttaaacggaataacgcagtcggggaagaaagttatatcagtgagtgctgaatctttcctacggggatcaatcgcttatgggatcgagatgtcgattcaaaagggcttattaggagaggctgtaaaagcggttacgccaacaattgtcggcgcagcagtaacaattgtgcttggtacaataaaagatagtatttatgtagcggcaggaaagatgtccgaaaaagaaatgggaatgagatttatagattcaatgatcatttcttctggttatcttgccagcatgaaaattggcggcattattgctcaagctttatgtccgcagcttcctggaattggatatgcaattggcagtttgttaggctgttcggttgcggtggtttatagtattggaaagaaaaaattaatatctttctgtgttgacactggttttacatgcttcggattggtcgatcaaaactatcaaatccccgaagaagcgcttaaagaactgggcgtcgagacgatctctattccacatgcagatgttgaaagaacaagggtcaataccatttcgacacaacaatctttggatactgtacagtatgatacgattgatattaaggtgctcaagcgagggatcatcggagttaatcgcgtagggtatgtatgctaagggatttatagaggttaactctaaataattaacatagaaagtgtttgattatttaagctttgcaaatgaataatgagctggatagacgacaaccggcaccctttctcggcatcgatcttcggatcggtgccgctttttgttgttgaatgtctgttttttgagaggatagccacaacgattgacgtgattaaggtggcgaagctccatgaagatgttggaattgctgccgctttgtcagcgtaatgatgcagcaggcaatcacgtcttaatggccgggcgcggtcttattcgcaaagatggtatcggcggctgccaagaagtggtaaaataatgtgtatacaataaaatgtgaaggagatgtcaagcgcgcttgacgcagcctgcaggaaacggaggagtatgaaatgtcagaatattacagcatctatctgccgaactacacgatcggacacggcgtctacgagaaaattccaattgtctgccgcgactacggcatgtcggccgtcatcatcggtgggaaaaccgcgctttccaaagcggaagccaagatccggaaggccgcggaagcaggcggtatgcaaatcacgggaacgctctggtacggcggcgagtgcacctacgaaaatgtggaaaagctggccgcggaaccggccgtgcgccaggcgaaactgctttttgcggtcggcggcggcaaagcgaccgacacgacaaaggcactgggcgaaaaaatcaacaaagctgttttttcgttcccgaccattacgtcaaactgcgcgggatgtacgagcgtcagcatcatgtaccacgaggacgggagctttcttgagccctttttcatcacgcggccgccgatgcacacgttcctcgatctcgatatcatcgcggcggcgccgtggaaatatatgtgggccggcatgggagacacctacgccaagtatttcgaagcgacgatgtcctcccgtggagaggaactcagccactacgtcggcctgggggtcacgatcagccgaatgtgtctcgatccaattctgaagtacgggcgcagggcgctggaagacaataaaaaaggcgtagcctcaaaggaactcgaaaacattgtgctcgcgatcaatgtcacgacggcgctcgtttcgatactcgtcacaaaggacaaaatcattgattacaacaccggcctcgcgcacgcgatcaattacggcttgacctcattcccagaggtcgagcaaaatcacctgcacggcgaaattgtctccttcggcgtgctgatcctgctgctcgttgagagccaagtcaatcccgcatttaaagagcagtacaaggagatggccgcgttctccgcggatgtcggactgcccagatggctggacgatttgggcctaacggacgctgacgaggaccgcgtgatcgactgcgccattaagatgaaggacatcgatcacaatccctatccgattacgcgtgaaatggtgacgaaggctttcgatacactcaaaggggattatagaaaatgaaaaaatcttcagaaaatttcccgggaaataatgatcaaaagccattgaccacccctgcgacgctcattttcggcgtcgcctttgtgtggttcagcacgcacttcgggggcggcttcgcttccggcgcgcagctctacacctacttcattcgatacggcatctggagcctgatcatgccagtggtggccatggcctacaacgcgttctttttctattattgcttccgttacgccagaaaacacgaagtctacgactaccgttcgtacaacgacagcttttatggcagattcgcgccgattttttcgaatctgtttgaattcttgtacatcgtcgtcatgtgcatcgcgcccgcggtcgcctttgcgacaggcggcgctacgctcaacgcggtgaccgggattccgtactatctgtgcacgctgattatcggagtgttcatttttatcgttgccatcttcggcacggaccttgtgcgcagggtttcgaccgtgctttcgatcgtgatcatcgcggggctgctcgcggtgtgcattccgaacatcgtcgtcaatgccgacggcatccgcgcgtccatcaaagccatgaccgcggcgggcggcagcgcttcattcgggcgcgcgctctattcggcatttctctacggcacatttcagctgtgcaacgtcgccgtctttgtgcagcacggcaaatctttcgcgaagcctgaagacgcgaagaaaagcgcgatcctcggctggatcatcaactccgtgctgatgctcctcgtcgtgctcggcatcctgaccgtctacaccgatcccaagatggcttcacagtcggtgcctgcccttttcatggttcaaaaaggggtcggcacggcctttttcacgccgatcatttcaattttgatcatcctcggcgctgtgaccactgccgtcaatatggtcgccgcgatggtgaagcggatcggcaccgcgatcgaaacgccagaggaaaaagcgaaaacggatgcgggcaaaccgattgtaaagaccatgattatttcgctcctgtgctgcgttgccgatttcgggatcgcgcagttcggactgattacgctgatctcaaaggcgtacagctttatcgcctatctggccatcccagtcatcctgattccgtacatcatccatatgattgtgacgcggtttgatacgaaatagaagatggtgtcatagcggatcttgtcactggaggaacgaaaaaagcagtgtcgcccccaaaaaaagaaaaagcagcgcggctcgtctcaacattagagacgaagccgcatctgccaaaataggaaacgcaccaatcggatcatacctgtaatgtgcggaggatgtcctccaataccaatcagaatacaagcatcaatcatttcgaatatgaaaaatacgcgacacaggaggacaaaatgctgcagaaaaatggcaaaaagcttgacagacggaccgcctatacccgcatgatgatccgagaatctctttatcggcttctggaaaagaaacacctctcggaaatcacggtgaaggagctctgcgagggagcggagatcaaccgcgcgaccttttatcggaattacgcggacatctacgatctctacgaaaagctggaggaggagctgacggaaagcgcattcgcggacgggaacattgaagaggacagatacaaactgctcgaagtgatttatgaaaaccagactttttacaaagagttctttttgtcaaggctcgagagccggtatatcaaggcgaccgtctccaagatgtacgatcagatgaaggccctgcttaaggaaagagggacatgggacgagcggacgtttcaaatatcctatcagtacaattattacggcgtcatcggcgtgctgaaggaatggctcaatgccggctgcccggaaaaacccaaggagcttggagacattgtgtacgggatcgtggaaaaacagtatcaatgaagacggcatcgcgttaatttcagacaacacagcaaaaagcgctgtgaggggaagaacccttcacagcgctttaggtttaaccgttatttttcagcctttgcgccggcaaagtagggcagcgcgacgaagcagacgcccccgatgatgttgccgatggtgacggcggtgaggttgtagagccatccgccgaaggagactgcctgtccggccgggtcgagaagcgagacggtcagctgggtcatgttggcaatcgagtgctcaaacccgcaggtgacgaaagcgaagagacaccagaagatcatgatcaacttggcgctttcggacttgcacttaaagccgcaccacacagcgagacagaccaggatgttgcagaggatcccgcggatgacgagctgcaggaatggcgcagacatcttcgcggcagcggcggtggacaaaaataacgcaatgggttctgtgttcaaccccgagtaatggaacagcagcgccagcagggcagagcccgcgaggttgccgaaccagcagatgacgagcagcttgagcgcatctgcgaaggtaatgcgttttttggtcagaccggcggtcatgaccagcgtgttgcctgtaaaaagctctgcgcccgcgatgatcacgaggctcagcgcgatgccgaatgagacccccatgacgaccttcgtcgctggcgcgccgttcaagagcccgccgatgacgttaatcaggaggttgccgaatccgatataggcgcccgcgagcatcgcgtggacaaaatacccgcctgtgcttttctttaaaaagctgacctttgcgttggcggcctttgagaccgcttgataagtttctccgtacatgatttcccccttattgaatatggatgtgatgacgcgtagatattcacgtctatcgtatgtatagggtatcatggaatagggaaaaatgatacaataaaagtataataattttcagaaaccaacaaggagaagcacatgcagttgaagcgcatcgacctagaccttacggtgtgccaggtcccgtcggttaaggacattgatctcgacctcggattttatttcatcggtagaacggcggatgagatttctctggtctgtcaaacggacaagacgccggcacatacgacggcgcgggaggacggctggcgggcgtttcggatcgagggcacgctggacttttcactcatcggcattctgtcgaaaatctcgacgattctcgcggcgcatcacatcgggattttcgcggtcttcacgttcaatacggattacattttggtcaagcaagacaatttcgaccaggcgatggacgtgcttgccgaaagcgggtacgaaatcctttgaggacattttcacgcggcgccggacaaaagctcaatgtcaaatacgcggggcagtctaatcaaaaattaaaggagaaaattgaaatgaacggaacggtacgacttgaaacggaaagactggtgctgcggcagcatgtcatcgaagacgcggatacgttgtacgcgaatttcggcacagacgaaaagatgttcgaatactccgggtggaacccctacgcgacgccggagatggcgagagcaaccgttcagcgttttatcgacagctacgcggatgctcactttttcggctgggcgattgaggcggacaatcagctcgtcgggacggttggcgcttacgattacgatgccgagcaaagctgcatagagatcgggctcagtatcgaccgcgcgcactggggcaagggctacgcgacggaagcagtgcaggccgtgctcgcctacctaaccggcagccagcagatcggcaccgtgacggcgtggtgcgcgtcggacaatatcggttcgaaaaaagcgatggaaaaatgcggcatgcggtgcaccggcatcgagcgcggcgccctgacgattggcggcaagacctttgacaagctcaattacgcttacgaggtggagcagtaaaggatcgggttgattcttctttctttctctttaaaatgatgaaagaaagaaaaagaaagaaaggaaagaatagagcccatgcgtttcaaagatcaagatattgagttcaaacaggaatatgttccagacattaaaatttaaagatcaatagaaagtttttagaggcttcctgctgatattggcagggagccttttttatgtttgaaaatccatctcgatttgcttaacagaagaacaagttttcgatttttatggcataataggttagataagtaaatgatatgaggcgcgtagacaacgcgcttttagagataggagagacgaggatgatcaaagtgcatgtgctgccgatgcacggacactcggcggggatgaccgcggtcaaggtcggcgggcaggagcgctacctgctgattgccggggatgccgggtacggcaggccctcctgggagcggcaggtccttcccggcgtggaatggaatcggaaagagacggcgaaatccttgaagcgccttcgggcgttcgccctcgacccgcactgtgaagcggtactgatgacccacgatagggaagaaaccaaggacgtctttgtactttgacatggatgtaaaaaacagatttgagcgatgggcgcctttattcccgacccgtatttcaatgtctacgggccgacaaaggccttcgagatgtttctgaccgaggcgatgtacggcgggctgaagggaacgggcgtcactgtctcggccctttgcccgggaccgacccaaaccaattgggctgccaacgcgggcaaaagcgattcaaaaatcgcgaaagacccggatgcgttcgcgcagacaggctttatcgggatgcagaagggtcagctgatcatcattccagatgcagattatcgcgcgttccgctatctgatgcggccgctcccggcgaagcttcaggcgcagctcatcgcaaagtggcagcagaagctgattgcccaaggctgagccacagatgattcctacaatacgttaacaaaattcattaccccataacaaaaccccaagccggcgattgggagagcagccggctcgggggtttttgggtattttggggatgaacaaattcagattttatttattattcgtcttctgacatattttctgagctgtctcgtgggctgtcttctgagcggtcctcaggcacgtcttccggaatgtcgttttcgagggttcgaatcaccttggcgggcacaccgctgaccagggagtcgccgaggacgtggcagaaggcccacagccagacgtcatcaaaaaatttgttgaaaaaataagaaaaccaataaaaaagcgcaggtgcgtccattgcggcgcatctgcacggatgcttattcttctgcccggtcgggcaggctgccggtgatttcgaccgccagctggagagcgcggatcagcgcgttcatcgtcttcatgtccggatcgaaataatagtaaattttggtgccttcctttcgcgttttcagaaggccggcgtccttcatgatctggaaatgatgggagatggcgggccgggacagggaggagtgttcggccatgtcgatgacgcgcaccccgctgcagtcgccggttttcatcatggccaggatcaaatgctgccggctttcgtcgcccaacgcggtcagcagcttctggctcttttccaaatcctcggacaggcattggagtttggcctgaaacgatgtgtccctttgactcatagcatccgcctcacgcgtcaaaggtgtggccgctggccagctcgaagtcgcatttgacgatgccgagatccaccttggagaaaaagccgaagccgttcacctttgcggtcagcttgctgccgtcgtagctgatcacaaatttctgctggttcactgcggttggcgcgtacatcgctgctgccatgccccttttaaaccattccggcatttccccggcaactgtacacagctggtcgaccgggcggcttttgtgggcagcgccctgtgtcatcccgtaaccgagggcgatcagaatcacctgcttttctcctttgttgacgacggccttgcttttgccgtgggtcatgccgacccagcagctgttcagccccagccgctgcgcgagcaggacgatcctttcgccgtaatagccggccttttcgtcaagattgggagctttctgaccgacgatggcgagataattgcggacaccggtaaattttccgtaacgcgccatcatcgcgtcgaagcattccggttcatcgaaaaataactgcatgtgcagaccgctctcgcggttgagcttttcgacctccgcggttagttcattgcggatttcctctggaattgggtcgcttttgtattgccgcacgctgtgccgctgtttcatgatttctaaaatatccattttatgcctcctgtagatcagagattgctctgtattgtttaagtgattgaacagagtatagcataatcggcggcgaatggttcgtctgtaaaggaagtcgagatggatgtatggtctgcggataaacacgatattcaagccccttgacgccgttgctataattggaaatgaatgtgtgggtgtcggcagacgggtgatggtgggtcaccgactgcggggctgacgcatcaagacaggaggacagttatgaacccaatggacagacaaatcggaaagcagcagcgtatcagaatgggtatggcaggtggcctcatcctgcttttcgctttaggaatggcgatcgacgaagcggattttctagggagccgccacacttcggccacagcgtatctgcaggtctacagcgcttttctgctgatgctcgtgtacattgtgccctttagcctattgatgcggcggctttgccggcggtacaagctttccggatttgaaatgttgacagcggtcgcctgcggcgcttttattccggcggccttcgccggagaaatcaacgatggtttcaccagcatgatgaagcagctgatgggctcagcctattcggacgcgtggctcggctccgcggagaccgcaattgtggaggaattactaaagctgggtacggcagcgctgcttttgtatctttttcatcggaaatcacggccgtcttatttaatcaccggaatgtgtgtgggtatgggatttcaaatcgaagaggatttctcctacattacggacagtggatttaagcacgtgaacgcggcgtttccagcggcacttgatcggatcgttggtgccctcggttcccactgggcctacaccggtgtgacggcagttgggctttacctgattgtcagcgcatccagtggccgcaataaacggaaggggctgctttggattctcctcgtgatggcgaatcattttttgtacgattcgcccattggatcggtgccccttttcagcgcattgcttgcagccgctgtggttctgccggtaatccttttgctcaaaacagactggagcatgtctgagacagagatggatgcaaagctttcccacagttatgcccagtcaattgccggtgaaggcagaccgatggatgaggtgttcaacgacttgaaaagggatttgaaataattggattccatcattttttcattgcagtatctaaagatttttcgggccacacccatcatcagccatacttttggttatagaaattgagtttgtcgttgtggtatgatttgtaggtacattttatgaaagaaaagagattttcgattgagcaagcaattagataaacaagcaacttacgagctgttcgcgaaggcgccggtgtccaaggccgtgtggaccatggccctgccgaccatcgtgacccagctgatcaatatcatttacaattacgcggacacctggttcgttgggcggacggccaacgcggcgatggtggccgctttgggcatttgctttccgttatttgtcatcatggccgccgtagccaatttgttcggcatcggcggatccagcgtgatctccagggcgatgggcgagaaaaaaatcgagaaggcccgccgtaccttcgccagcgccttctggggcggcatggcggccgcggtgattttcatgctggtgattctgttcttccgcgcgccgatcatccacctggtcggcggcgacgcccacgactttcaatacgtgtccgactacatgttctggacgatggtggtcggcgccattccgacgatcggcaacgtgctgtgtggccatttggtgcgttcgatcggcgcgtcaaaggaggcgggcttcggcatgtccatgggtggggtgttaaacatcgcgctggatccgctgttcatgttcgtgattctgccgtcgggcatggaggtgacaggcgccgcggtcgcgacgatgctctctaacactgcggcgatggtgtatttcatggtctacatccggaaacggcagaaaaaggaaaaggacggcatcgtctacatcggcctgccgaaggcgcagccaggcgattcggttatgtcggaaattctgatcacgggctttccggccgcgctgcagacgaccttcgcgatggtgtccaatatttttgccaatgtcctgatccggccctacggcagcggcgccgtggcgggcatgggcattgccaagaaaatcaacatgatcgccttcaacacctgtatggggatgacaatgggcgtgctgccgctgatcggcttcagctacggcgcccgcgactacacgcggatgcgccagatcatccgctacaccggtacggtcgtgctgctgttcggcgcagcctgcgcggcggtgttcatcacccaggcgccccatctcgtgcgcttctttatcgatgaagacacgtcggtgctgtacggcacccagttcctgcggattatcggctacgcggcgccgctggcggcggtgtcctatttgagcgtcaccatctttcaggcctgcgggcgcaaggggccggcctttgtgctgtccattctccgcaagggcgtgttcgatattccggcgatgttcgtcttccgctcagttctcggcctcggcgccgccggcgtgtgctgggccacacccttcgcggaagtgctcggcgtgatcgtcgcgctgatgctgtacctgcggtttcaaaaaggattgcgccgcttttgagcggatttcagaaggagggaaggcgtcatgacgggatttcctttaattttttcagatttgatcagcatcgcccttgtggtctacgtgtgggtgcgcatccgcgcgaattccgccttggaaccggacgcggtgtgtttgtttcagtgtatcggcgttacactgatcgcgacccttgtggtcgatcacgtctgggagtatttttaccgcatttccgacggctccgctgcgtccaggcaattgctgaacaccatctccagccttgaattctgctgtatcccgatcgcgctgtttttcctgatcttttaccagcggaagcagtgggatgcggcgcgctgcaccgcgctggcggccgacctcacccttttggttttggatcttttgaacattcgtctgcccatttacgcttatatcgatcacgagctttatacggtgatgacaccgggcgcggtatggatttttttgggaacgctgatcctgttcggcttcgtcttgattcatcatttccgcaataccttcaacatggaccgggaagacaaactcctgatcagcttcgttttgatcatcgcagcactgggcgaggcgggctgttatttcaacgttgacgtcgtcgcggtctgggaatgtctggccatcgtctacctgctgctctatttggctctagagcggcttttcgccaaaaccgatcaggtgacgggcctgccgaaccggtacgccttcacgttggcttactttcgggaaacccgcaatccggcgtcggtgctggtgtcggtagatctgaaccatttgaagtatttcaacgaccgctacggccacgacaccggtgaccattatctgcgcgcctttgcccagacggctcagcagcgggttaaggatctcggtcagctttaccgcgtcggcggcgacgagttttgtctggcctcgtctgcggaccccagccgcgtgcaggccgctttcgccgaattgtcccagatggaccaatgcgatccggcctacggcgattttccgatggattttgcctacggccttgcggtccgcaaacccggtgagaccaacggtgcgctttacacccggacggacgccgcgatgtacgtaaacaaacggcaaatggagggcgccgcagggcgggatgaatagaggaataattaaagaaaaacggaaaaaagcagcagctaagcgcctgcgccgaacacaacagcctgagaatcagctgaaaaagctggctctcaggctgttttttgtttattaatttttcttaaggggacgttaacggtggctttaggcgggcttcctatactgggggtgtttaggaggaaagcacaatggatcccatttggaaagtattaaaagcgacgtgtgccgcacacggcgatcggaccgccgtcatcgacggtgacacccgtatgacctggcgcgaggtgaagacctgcgccgagcgggcaggccggtttctcgtcggccacggcgtcaagccgggcgtgccggtggtgctgcgcatgaagaaaagctggcaggccgtctgtctgatgtacggaacggtctacgccggcgggtattacgtgtttgtcgatccggaccagccggaaaaacggctgcaggccatcctgcagacgctgcagagcggcgtcttgattcaggacagcgatgattgggttgacgcggcgcccggccggacctacacggcggcggctgcgctgaagggccaccgcagcctttgccgaagggctgaagcgtcggcggacgatccgctctacgccgtcttcacgtccggctcaaccggcacaccaaagggcgtgctcgtgtcacggggcgcggtggcgcagttcatcgggcatttcgttgagatgagcggaatcgtggccgacgatgtgatcgggaaccaggcgccctttgacttcgacgtctcggtgaaggatttgtacagcgcctgcttgaccggcgcctgtgtcgtgctgattccgaaggtcgattttgcgatgccgaaggcgctgatggactgcctcgtcgacaaccgcgtgacggtattgatctgggcggtttcggccatgtgcatcgtgtcgaccttcaagggcttcgcctatcggacgccgacgaccctcaggctggtgatgttcagcggagaggtcatgccgatgaagcatttgaagatttgggaggacagcctgccccaggccgcgttcatcaacctatacggcccgtcggagatcacctgcaacgcgctgtaccaccgcgtccagggcgacgaagaccggctgccgatcggcgtgccctttgcgggtagacaggtatttctcatcgatgctgacggcgaaatcatcacagaagacgatgtgaccggtgaaatctgcgtcagcggcgaatccatcgggctcgggtatatcggcaggccggatctgactcaaaaggccttccgcacaatacgcggcgcccgggcctattgtaccggcgatttgggctaccgggaaaagggtcagtacttttttgtcggccggtcagacgatcagatcaagctgatgggccaccgcattgaactcggcgaaatcgaaaaggcgatggacgcggaagatgaagtggcgcgcgcctgtgtgacctacgatcccgagaaaaagcggatcaccggctggtataccggcgcgatcgcgcccagacagctgcgcgcggcactgaaggccagcctgccgacttacatgatcccgacgaagcttcggcgcctcgaggcttttccggtcaacagtcacggcaaaatcgaccgccgcaaacttaaggaggccgtatgaaagccttcgaaaccccctattacgttttgcatgaggaccgggtgactgcccgatgtgaggcggtccgccgtctttgggacggggatctctgctacgcgatgaaggccaatccctttctggctgcgcccttcgcggcggcggttcagagaattgaggtctgctcctacggggaatacaagatttgcgtacaggctcatatcgatccccacaaggtgattttttccggggtcgtcaaacaagaagcggagctgcaggaggtgctggaaacctggggcagcgcctgtgtgtacaccgccgaatcagaaaggcagtacaccctgcttgaaaactgggcggaggcccacaagacccgcctgcgggtgctggcgcggctgagcgacggcacccaattcggcatggaccggacggcgattggcgcgctgttccgccatcattcgccgtggattcacctacagggcctccattatttcaccgggacgatgaagcggaagccgtcggtgtacacgaaagagatggcagcgctggcggacgtctgcagctgtattgaagccgagggcggccacatcgacgagatcgagtacgggccgggcatcggtgtggattatttttcggacaaggctccaaaatacaccgaggccgatttttttgaagccttggcggaggcggcgaagcctttgagacagaagtaccgcgtcacgctggagatgggcagagccttggcggcgccgtgcggcgaatacgtgagccgcatcgtcgactgcaaggtcaacggcggcgtcggctacgtgctgatcgacggcggcagccatcatgtccactacgacggcatgatgcggggcatgcacgtgccccatttgcggacgatcccggcgcgcaaaggcgatcaggtctggaccatcgccggctccctgtgctcggtcaatgatattctggccagccaggccaggctgggcgcggtccaaatcggcgactgcctcgtatttgaaaatgcgggcgcctacgcgatggatgaaggtccggcgctgtttctgagccacgaactgccggcggtttacgcggtaaagggtcagagggtccgcgtcctgcgcaggcggatggatacttggccgatgcatgtagatataaaagaagaaaaatagaaagataaaaggaaggttaaaaaatggaagaaaaaatcattaaaatgctggaagaaaatgacgattcaatcgattacgccaatgaaacccacctcatcgacgacggcctgctggattcctttggggtgatcgccctcgtcgccgatctggaagacgccttcgacgtcgaaatcggcaccgccgatttggttccggagaattttaattcggtgaaggcgatcgcggctttgattcagaaacgcgtatgagctatcaatcgcttttttacggcaccctctttctgccggcggtctttgtcctgtacacgctgacgaagcaggcctaccggaaatacgtgctcctcggcgcgagctggctcttttatttcctggcgatgcaccgcgttacctgggttttggtggcgacgtgcgtcggggtgtacggggccgccctttggatcgaccgggcgtcgggcaggcagcggacgatgcggctcgcctgcgcgatcgtgctcctcgccggcgcgctgatccgggtcaaatacgccggatggatcgcggacggcatcgggatgctggccgggcatcacttttcggtgcgggccctcgtcgtgcccctcgggatctcctattacacgctggaagcgatcggctatttgtgtgaggtgtattggcagcatcaagcggccgaccgcgatttcgtccgggtggcgctgtttttgagcttctttccccaaatcatggaaggacccatcgcccgatatcaggacagtgcggcgtcgctgtgcgccggccagcccatcacgggtcagtccttgcgcaacggctgtctgcgcatgctctggggtttcttcaagaagatggccggggcggatcggctgtccctgctggtcacggtcatcttcagccagccgcaccggtttcacggctgggcggctctgctcggcagcgcggcctacgtggcacagctctacctcgagttctctgggatgatcgatgtgacgatggggacggcggaggtgctccagattcatctgccggaaaatttccgtcagccctttttctcccgcagcgcgtctgaattctggcgccggtggcacatcacccttggcacctggctgaagacctacgtgtttttcccggtatcgaccagtcatctcgtcgtcaacgggaatcgtcaggcgcggaaaaaatacggccggcagacggcgaaggtgtggacgtcctttctggccctgacgccggtttggctgttcaacggcttttggcacggggccaaatggcattacattttttacgggctgtattacctggtgattttgatgttagaggtcatactcgagccggccaagaagcggttttattcgaggaccggcttcagccccgatcgcggattgttttcgattctgcgctggctgcgcacgctggcgatcatcgtcgccggggaagtcattttccgtgccgacacggtgacgacggcgttcacaatgatcggaaacgtgttccgcggcccgagccacgtccacgcgctgctcgccgccagccatctcgatctcagcgacgggtttgtcgtcgtgctctgtctggtattggtcacgatcgtggacgtgtgcagagaaaagggcgtccacctttttgcctggtttgatcggcagccgactgccgtgcgctgggccctcagctacagcctgatttttgccctgatctgttttggggcgtacggcgcgggctatcgaaaggttgatatgatttatgcgaaattctaagtggattggatttgtcgccgggctggcggtgctgttggtcctgttctcgctgctgtcggagacggtgtcgacgggcagctctgtcagctacgcggcgagacggcaaaacatcgtgaaggattttaagagtcagaagccgcacaccatcgacgtggtggtgctgggcgacagtgagtcctacacctcagtggacacgatgcggttgtggcacaagcggggcatcaccgcgtacgtgctcggtcagcccgcggcccaggtctcggaaatggccaggatggcggaacagattgcagggcatcaaaagccgaaggtggtgctggtggaaacgaacatgctgttccgcaaggtcagcatggtgaatggggcgcagaaccagttcgggcagaccataggcgaagcctttccgatttttcagaatcacgacttttggaaagccttgtttgtcaagggcagcgggagcagacggtataatggctttcgcgtgctgagccgaacgtttccggatacgaaggtatctggctacatgaagccgacccgccgcacgcaggcgattccggcctttaaccagatgatgatggaccgcattgtacgggcctgccgggacaatggcagccgcgtcattttgtacagcgcgccgagtacgaaaaactactcgatggcgaagcacaacgcgttagaagcctacgcggcaaagctcggcgtcaagtattacgatttcaacacccgcctcggccgcacggaaattgactggagccgcgacacctacgacggcggcgaccatttgaattacaatggggccgaaaaaacgaccgacgcgctgggtgcggtgctggcccgctgcggattgacggatcatcgaggtgacaaaaactaccgcgcctatgcgcagctgtaccgccagtacgcgaaacgggtcaaacggattgacggacggtggaatcgcatttaagatagagctatgatagaagaaaagaaaaagaagatcctcattgctgaggacgacgaagatattgtcgcagtgctggagatgtatctggtcaacagcggctttgagacggtgtcggtctacaacgggctggacgcgttgaatgtgatcgataaaacccacgtcgatctctgcctgatcgacatcatgatgccaaaaatgaacggctttgatttaatccggcggatccgggaagaaagtcaggtgccgattctggtgctctccgccagaaaggaggacagcgacaaaattctcgggctgaacatcggtgcggacgattatatcgtcaaaccctttaatccactggaggtgaccgcccgcatccgcgcggtgctgcggcgggcacagggaagcggagatgcgtcgaaggtggtgcgcgtcagagatttgaccgccgatctttcagagatgagcgtgtaccgaaacggcgaagtccttccgctgacaccgacggaattcaaaattctcgtcatgttcatggaacagcccaatcgggtgttcaccaaagcacagattgcggcctcgctgaacggcacggctctggatactgatgagaacaccatcatggtccacatctcccatttgagagaaaagctcgaggccaatccgaagcagccctcgtatttgatcacggtgagggggctgggctacaagctcaaagggaaagcatgaaaacagaaaagaaccagacactgtttcggatgatcatgggcagagtctttgtcatgcttgggattattgttgccctgaccgcggcgatgcttattgcgatgattacggtcgaggacgctgaaaatatgtggcaccgcgtggaccgcttcattgccgaagcgcagcccaatttgaaagcggcacgttatcaggcgctgtcggacagcaaatggttaaaaaagcaggacacctttgacgtggtggacatgtcgggccatgtgctctacagcagttcgggccgcacgcgaaaatacgggaaggtttatctctcctacattcagccctacgacaaggacgccaattatacgcttttccaaattcaaaacaagggctacctgctcctatacggcaatcaggacgccatccaggaagccacggtgctggaccgcagccgaaatgtccagtacacgaccgcgggccgttcggccgccaagctttcaaaaaagacgatgaagctgctgtccgacaatacggacacgctgtttcaaaaatacgcgtttaccacgtcgaagggcgagaagcggtatctgctcctccacttagacggctcggccctttacgaccagactcagcgggacattcagcgcaccgcgattttgatcgggtacgggctgggcatcatcctcacggttttgatcggcgggtacaccctgacgaaaagcgtcaccaagcccatccagcaattagaggcggggatggcgcagttttctacagggagccggacaccgattgacgagattcagggaccgacagaggtggccagcgcggtccgcaccttcaacaatatgaacgagacgatcgtcaaggcggaggcggacaaccgcaggctcgtggagcagaaacggcgcatgacggccgatctttctcacgacctcaagacgccggtgacggtgattcagggctacctcaacgcgatgcaggaccatctgattcccgaggccgactacccgaaatacctaaagatcatgtcgggcaaaacccaggtgctcagcgatttgatcgatcaaattagcacgtacaacaagctcgaccacccggacgtgaagctgcactttgagcccgaggatatgagcgaatttgtgcgttcctatttcgccggcatctacagcgagatggaagcggccgaacacgagattttcgccgacatcccagaagcgcagctcgcggtggatttggaccacgcgcagatgagccgggtcctggacaatctggtcaacaattcgctgaagcacaccccgtccggcacccatttcttcgcgctgctgcggcaggaggccgatgatgcggtcctcgtggtcggcgacgacgggccggggctttcggaagacctcgcgccgcatattttcgaaccctttatcatgggcgacgcgtcccggactaccggttccggcagcggcctggggctggcgatcgctcattccatcgtcgagaagcatcacggtaccattgcgctggccggggcagatgtggttcgccgggtccaggacaccttcgccgtggcgatcgacaaagggacgttttttgtcatccgcctgccgctgctccaaaaatcgtaacattccaaatcacagcctgagaatcagccgaatgcactgatcctcaggctgtttttgcgtaaaaaagcgatcgttttgtggaacgacatggtgacaaatccaccccattaagttacaatatttaagaaagaatcaagttattgaaaacaatttgaaactattgaaaactattgaaggaagggaatacagtgcagcaaaacaaaaaggggcagatgtccacggtaacgatcattttaatcgttttgatcgtcgcgatgagtgtggcggccatcgccgggatggtggcgtacaattcgattcaagcgaaggaccaggcgaagacgaaaacggcgtcgaaggcggtgagcgcatccaagaaaagcaaatcgtcgaaccagtcgaagaacagccgcaaatccagctcggccgcgtcatccagcagcagcgcttccagccagcagaccgcgccggaattaaatgtccgccaggtcggcacgctgctgtcgctttactattggccggattattttaaagaaaggctcaacgactctgggttttattacggggacgaccagctggagggccagacctatcacgttttttcgggaaatggagacccgacgagcgttttgtattaccagattgacggcgatacgatcacgtacagatacgtggacgtgtccaatgcggactgcgttgcggatgcaccgatcgcgacgaaaaccatctctctcaagcggctggtcaacgattattacaacacctcggccaaacgggcagaggttaacggctacgtggcgaagctgaaaccgctatcggagatccgcagtgaatgacgaagcgcccgcggaagcctgttactaataggaccgaaatacgttttttatgacacgcaaaatgaaacgcaaaaaaatacgtttcattttgcgtttcattttgatacaataaattaggaaatacgtgttttgcgtttcaaggagaccacaaaaatgaaagaaaatcacgcttatgaggttaaagcgcaagtgaacaatacgtttcttaaaacggtcagcgcctttgccaattatggcggcggtaccattcagttttggatcgcggatgatggccaaatcgttggcgtgagcgatcctaaagccgtttgcctggacatcgaaaatcggatcaatgacagtattcggccagtcccgccgtttcaactattcattgatgatcgctcccagatcatcacgctaaaggtcgaagatggtctgtttaagccctattattacaaagcgaaagcgtacaagcggaacgacacggcgacgatagaggtagatcgcgtcgagttgaatcgtctcattttggcaggggaaaatcgctcctttgacgcactcccagccagaaatcaacgcttgtccttttcggtgctggaaaataaaatgaaaggactgctgtcgatcagcgaattgaatcaggatattctgaaaacgatcggtctcgtcgatgtgaatggccagtacaataacgcggccgcactgctcgccgatcataatgattttccgggtattgattgtgcgcgatttggggagacgatcgatatcatccgagatcgtgagacctttgatcgtgaatcgattttgaaacaattcgacgacgcgcttgagctgtaccgaaaatactatcagtacgatgtcattgacggcagcgtgagaaaaaccatccagcagattccggaaaaggcttatcgggaagcgctagccaacgcactggttcaccgcacatgggatacgcgggctcagatccgggtgtcgatgtacgatgaccgcgttgagatcgtgtcaccgggcggactgccggaaggcatgactcaggatgaatatttgcgcggacaggtttctttgctcagaaaccccgtgatcgggaacgtttttttcaggcttcatctcattgaaagtttcggcacaggggttcgacgcatgaatcaagcttacaacggcagcgaaaccaaaccgatatacagcttttctaccaatactattaccgtcacactgcctgttgtgcagacggtcgaacatatgacaccggacgagcggcagctctatcaggttttatctacagtgggaaaatcaagctcagccattgcggcacagtcgggattcagcaaaagaaaaacccttcagctattaaaagcgctgatatatcgaggcattgtcagaaaaataggcaacggcagagggacaaagtacatcgcgcagaaggacgacggattgactgaccattaagacttccaatccccctgtttttctgccttgagcgcatgagttcaaggtgttatactattcatatcaatttaaaattacttgaaatagattaaaaggaaaaaacgatggtatacaataatgtgttagaagcggtcggccacacgccgatgattcggctgaatcggctgaccgaggacggcagtgcggacattctcgtcaaatttgaagcggtgaacgtgggcggttcgatcaagacccggacggcgctcaacatgatcgaggccgcggaaaaagaaggcaagctcacgaaggatacggtaatcgtcgaaccgacctccggcaatcagggcgtgggcctcgcgctggttggcgcggtcaaaggctacaagacggtcatcatcatgcccgactccgtcagcgaagagcggcgcaagctggttcggcattacggtgcggaagtgattttggtccacgatgcgggcgacatcggcgcgtgcatttcggaatgcgccgcgaccgcgatgcgcatggcggcggacgatcctcacgtgttcgtgcctcagcagtttgaaaatgtccacaataccctggcgcacaagcagtacaccggccaggaaattctcgaacaagtggatgggccgatcgacggcttctgctccggcattgggaccggcggcaccatcaccggcgtcggcgaagccctgaaggcggcgaacccggacatcaccatctgggcagcggaaccgaaaaacgccgcgatcctttccggcgggtcggtgggcacccatttgcagatgggcatcggcgacggcgtcatcccgccgattctggatcagcagatttattcggatatctgcatcatttccgacgaagaagccctggccaccgcccaacggctggcccgggaggaagggctgatgtgcgggatctccagcggcaccaacgtcgcggcggccctgcgcctcgccaaaacactcggccccggcaaaaccgtggtgacgatcctgcccgataccgcggaacgctatttttcgacgccgctttttgaagaaccttccatttaaaaaatatcagccgaatgtaactttatagttgtatcttgcggaaatttgtgttacattgatacgcgtcaaagttttttagtttaagttaagcttaattaatgcctcagcagcagtcattctgccgagctgtgggtgtgtacttaatgagtgaagtttttgtattataataagcagcattcatgatagagattatttttatggaggaaaatagtattgaataccagcacaaccggcagcgaggaccgcagccttcagtcgtcggatcaggtcaaagagatcgatcttttggaaattggcagagccatttgggataaattttggtttgttgttttactgacccttataggcgccgctttggcatttggcatcacaaattttctcattcatcccacttaccgctcgagctttaccgtttacgtcaacaaccactcttcgaacagcgaaaatcaagttaacagcctgaacagcggggacactgccgccagccagactctggctcagacctacgcgtcgattctcaaaagccgcccggtcgtcgaagacgcgatggaccgcatcagcatgaacgcggcatacgacgacatcgtcgacgacatcacgacagaagtcgacaccgattcccagctggtgacccttgacgtcacgatgaaaagcgcgaaggaagcgcgcaatttggctcgcgccatcgctcgggtgtcgccgaaatacatcgcgaatatcgtcgaagggagctcgatgaaaatcgtctcgtcgccgattttggcggacaagccttattcaccgagcattccgaaaaacacggccattggcgcgattatcggttttctgctcgctgttgtcatcgtcgtgatccgacatttgagcgacgaccggatcaagagcgtcgaagagctcgaagccaaattcggcttttcagtgatcgggaccatcccgaatttcgacgaagccgcgaacaacaagggcaaaaagaattacggttattattacgcggcctcgaacaagacaaagtagcgagaacggagaaaaaacatggcatttcaatttaaaaaacgtatcaagcgggaaaaggccagcgacaacgccgactggatcctgacagataaatccccgtggccgattcaggaagcctacaaagccctgcggaccaacgtcaccttctcccttccgggagcgggctgcaaggtcatcggggtcaccagtgcctttcgccacgacggcaaatcgaccaatgcggtcaataccgcgatcagcttcagccagatcgacaagaaggtcgcgctgatcgaaggcgatctgcggctgccgaccctgtccaagaagttgggctgccgacaggtgcccggcctgtccgacatgctgatcggggacaaatccttaaaggaatgcacgcggacgatgagcacgcacaaaaatctggcggtcattcccgcaggaaatatcccgccggacccgacctggctgctccagtcggaacagatgactaccttagtcgacggcctgaaaaaccactttgactacatcttcattgacctgccgccgatcacctcggtggccgacgcgctgatcctctcgccgttgatcgacggctatctgctagtggtccgcaataacgtcacggaataccgcgcggtggccgacaccctcgaacagatgcgtatcgccgacgcgaaggtcatcggcttcatttacaacgacgccgaaaccagcggcggcggcaagtattaccgttattacaagtaacaatgaatccaaataatccccttaccttttacgatctccacagtcacttcctgcccgggatggacgacggctgcaagacgccggaagaatctctcgccctgttgaccgagcactatcgtcaagggtgccgaggcgtcgtgtcgacgtcccattattacgcccaggaatccatcgatcactttttgaaacgccgggaacaggcggcggcccgattgctgaaagcgatgaacggccggatgcaggcactgcgccggaaaggccagaaagtcaccgcggacgccctgcagctgccggccctgacctttggcgcggaggtcgcgtaccgggacaccttggttaacgattccgatctcgaaaaactctgcttcggcaagtcccgttacctgctccttgaaatgccctttgaaccctggagcgaacggaccctccgcggcgtcgaggagatcgaaaatctgtggggcatcaaggtgattgtcgcccacatcgaacggtaccgcggctacgcggacgacgattatatcgaggccttgatggacatggacgtgaccgttcagctcaacgccggcaatttcggccggcgcaaaaccgcccgaaacgcgattaagctcattaaaaacggccggatcgacgtctttgcgacggacagccacaacgttgaaaaccgtccgcccaacatgatctgggccattgaagcccttcagaaaaagggtatggacgacaccctcgacgcgattttcgcgaacaacgcgcgcattttcgcggcggctaagggcagataattagaatatttacatatacacggagcaaccgcgaggcggttccccgcggtttaaaggagtgaatttatatcatgtgggaaaaaaagaaatggcgcccgctggcaggtggtgtgtttttggcgcaggtactgcttgaagtgatcgccgttgtcaacatccaccgtctggacatggtgccgacgaaatacctggtcgtgctctacgcagtgctggccgggctgacggcgcttacggcgtttctgttgttcaaaggcaccggtcacggcccgagccacaaacgccgtcaccgccggattgcttcggtcgtgatcgcgctgatcgtcggtatcagctctgtgattgtgacctctttcgcggcggaagcctactcgacggtgaacacggtcaccgcggccagcgataagtacgccgcagtggaaggggtatacgtgctgaagacggaccgtgctgtgaaaattcaagacacgaaggactacaagttcggcgtcatggatggccacaatacgcagacggcggtggacaaaatcagcaacaaggtcaagaaggcgatcaagacgatcccggaaaaatcggcgagcgacagtgcgtccgccctttacagcggcgacgtgcaggcggtgattttgaacgaagcctacgtcgacacactgaccgacacggacaagtacgcagatttccggaaaaagacgcggctgatctacgaagtgccaatcaagaagacgaccatctccaacaaggctgtcgacgtcaccaaggagccattcgtgctctacatctctggttccgacacccgcagcaaggtgctcgacaccagccgcagcgacgtcaacattctgatggtggtcaacccgtcgactaatcagattctgctgttgaatacacctcgtgattattacgtgaagaacccggcaggcaacggcgcttacgacaagctgacccactgtgggctctacggcatcagctgttcggaacaggccttgggttcgctgtacaataccgacgtcaattattacgcccagatcaatttcacgggctttgaaacgctgatcgattcgatcggcggcatcacggtggattcgccccaagcctttacggcgcagggctattccttcaagaaaggcaaaaacaacttaaatggcgcccaggcgctggcctttgcccgggaacgtcacgccttcaccgaaggggataacatgcgcggcgaaaaccagatgcgcgtcatcaaggcggttattgcgaagatcacctccgatggcggcaacacgctgctccactacaagagcatcatggacagcctgtccggcacttttgtgacggacctgacgtccaaagacatcagcaagatggttaaaaagcagctcagcgacggcggcagctggaacgtgcagtcttacgcggtcagcggcaagaccggtatggacacgacctattcgatgccggggacaaaggtctcggttatgtaccaggatacaaacaaggttgtgaagggggcgcgtttgatcgataaggtcaaaaacgacgaaaaactgaccagttcggacgtgaacgaagaaaaactgctcggttcagacacagctcaataaaaaatcacatcaactgctcagggcatgcctgaagatatcgacaatgcggaatggccttgagcagttttagcattcctaatgtgtatcctgatgagatacagcttaacttttaaaatacaatgcgtcggcgccttagcacgcggcagacgatgagagagaataagtgaggaaaagataaacgatggatccgataagtcgaagtcagagaaaattagctcatgatattaaattgcgaacgttgaaaatcgtcaatgtgctgttgatgacggcagcctttgcagtggtgtggatggtctttttgcagagccacatcgcctctccctattacaacaagggcaattggctggtgatctttatctatctgctgctttacgcgattttggggcggacctacgacgccttcttggtttcatacaatcgcatttcggatatgatctacagccagtgcctggcggcgctgattgccgatttctttttgtatattctcacttggcttttagcgaaacatctgccgaatgtgcttttttttctgatggccttcggcgtgcagatcctgatttcgattctatggtccagtctggcccaccggtggtattttaaaacttttccaccgaagcgaacctttgtcgtctgggatatgcgcaaaggcatgacggacttgattcacgaatacggcatgaatcagaaatttaatgtcgtcggcaactgccgggcgtcggaatgtatcgaacatctggactgtttggaagggatggaagccgtatttctgaccggtgtgcacagccacgaccggaatatcatcatcaaatactgtgtcgaacatcatatcgcgtcgtttatgatcccgagaattggcgacgtgatgatgagcggggcgaagcggatgcacatgtttcatctgcccattctgcggctggaacgttatcggccggtaccggaatatttatttctcaagcggctgtttgacattgtcttcgcgctcatcgggttgatcattacgtcgccggtgatgctggtcgtggccattttgattaaaaagtacgacggcggtccggtgttttatcgacagtgccggctgactaaagacgggaaagcctttgatgtgcttaaattccgaagtatgcgcgtcgacgcggaaaaagatggggtcgcgaggctctctactggtgaggctgatccgcggatcacgccgattgggcggtcgatccgcaaagtgcgaatcgatgagctgccgcaattcatcaatattctcaagggcgatatgtctttcgtcggcccgcgcccggaacggccggagattgcaaaacagtacgagaaagagctgccggaatttcggctgcgcctgcaggcaaaatgcggcttaaccggctacgcgcaggtttttggcaaatacaacaccaccccgtacgataaattgcagcttgatttgatgtatattgcccatccaagtcttgcacaagacatgcaaatcatcttcgcgacgataaaaatcctgtttatgaaagaaagcaccgaagggattgaagaaggacagacgacggcaagccaagaaaaagaaatagagaaaaatatttaaaccgattcgttccagaatgtggtaaacggagagagaattattaataaatgttttgatagaagaaagcatatgtcagtgaaaaaggaaaactattcggtcttaatgtccgtttattataaagaacaaccggataatttgcgtcaagcaatggagagtatgggcgcacagaccattccaacgaatgattttgtactggtgtgtgacggcccattgacacctgaacttgacgaaataattgaagaagaacagagaaaattcggagaagttctgaacgtggttcgattatcacagaatggcggtctcggcaatgcgcttaatgcaggccttcaagtgtgtcgaaatgaattagtagcgcgaatggattctgatgatttgagtcggccggatcgctgcgaaaaacagttggcattatttgagcaaaattcagacgtgtgtctttcttctggaacgataaacgaattcgcggagaatccaaaacagccgacgggcaggagagaagtcccaatcacggatgaagagatcagaacctacagccggaaacgcaacccgatgaaccacccttgtgtaatgttcagaaaaagtgcggttgaggactccggaggatacaaagaaacctttcatcttttcgaagattacgatctatgggttaggatgttgatgaaagggtttaaagcggcgaacataccagaagtcttgttagatatgcggacacctccggatatctataaaagacgaggtggaaaacagtatgctaaagatatgctggcctttcaccagtggatgctgagaaagggctggagttcgaagaaggattatcttataggcgcggtgccgcatgcggtggtatgtgtactgccgaataaattacgtaaatatgtttacaaaaggcttaggataaaatgattaagattgcatttgtgattaactacataacaaataatggcccgagcaatgtagttttagatatcataagaaatctaaacaaagaaatatttgatgtttctttgattactctttttgaagaaaatgataaaaatattattgatgatttaaaaagtcatgaagtaaagatctttagttgtaaaacattaagccggttaaagtgcttgctaggacaagataaaacgtttcaaaatattattcaaaaagaacaatttgatattattcattctcatggtcttattccagatttcctttcttcacgtgtaaggattccaacaagaaaggttgcaacacttcacaacaatatgtttgaagattattgtcaaacatatgggaaaataaaggctaaaatacttacaaagattcatcttaaggctctaaagaaaatggattgttgtgtgtgttgttcatcgtccgtttttcaagtaatgaagaaatatctaagtaatgtaacttatatacgtaatgggataaaatctaaaattgcaaatcatactgtgacaagaaaagaattaaatattcctgatgatgccattgtttttattttttcaggagttataaattatagaaaaaacgtggtgtatttaatcgcacagtttgtaaaatatcataaaagaaatgaatatttgataattttaggtgatgggccagacatggagacatgtaaatgtgaggatagtaatgtaatattcgttggattccaggatgatccagtcgccttttataatatttgtaatatctatacgtcggcatctcgcgccgaagggttttctatatctgtactagaagccttgtcttgtggacttggattgtttttatctgatattccttcacatagagaagttgttacagtaggaaaaaaattttatttaggggaaatttttagtattttggatgaaggccaagattttaataagaaattaaaaagacttcgagctaattatcagttgttcaataaaattggaattcaagaatttcaaaaagaacagttatcggatataaccatgacgaataaatatcaagagttatacaaaaagattgtttaaaggaaaaagttgatggaaaaaaaagattttatatctgttttaatgccaacttataatgtggaaaattatgttgaagaagcagtaagaagtatcttaaatcagacttggacgaattttgaaattattgttgttgatgattgttcaactgacgaaactttcaaaatactccagaaattagctagtgaagatgatcgcataaaactttatagaaataaagtgaattctaaaatatgcaagacacttaatagagcgtggtcgtatgcgaaaggaaactttgtcgcgcgaatggatggggatgatgtctctacaccgaatagatttcagaaattgatggattatttgcatacgcataaggattgcgaccttgttggaagtggcatgatcacgattgacgaaaatggaaaagaattatcgcgtcccttattcctaaaaagtgataaatatattaggtattttaacaaatttaaatcttgtattacacatatttggatagcaagaagagaagtatatgaaaaattaaacggatatagggaaattccatatgccgaagattatgattttgttcttcgttgccagagacttggatataaagtagctaatgtagatgcatatgtttatatggttagaattagaaatggaaatactggctctacaaatggtctagctcaatataaggcaaaggactatgtcctaagtttatataaaatagagaggaaagacaatatagataggttttcaaaacaagaatatgaaaataagatttcttgcacacagagggaactaataaaattcaaaaaagctagaagtaatcttgatatcgctatacataataaacgaaataaatacattatgataaagcatactttatttgccatgtttgaaagcgggtatatttttagatatattttcgattcgctgtatgtcagatttggaataaaactagaacaatgtataaataaatgaggatttgtgtaatgcatgcatacttaatcatggcgcataaaaatcaagatcaacttatcagactaataaaacaattagatgataaagataatgatatttttttgcatatagataagaaaagtattgatcagtttaatattatagctttgaaaaaatgttgtacttattcaaatatatatatattacagccaataacagtattctggggaagttcaacagaagtggcttgtgaattagcacttttaagggaagcttcatcaaagaaatgttatgactactatcatctgatttcagggcaggattttccattaaaaagtcaaaaagtaattcatgatttctttaaagaaaatgctggaaaagaatttgttaatttctctggaaagaatgtgacagggtttgggattgaaataagggatcgtgttgattataaatggcatacgaatctttatgatctatttaaatcgaatttatatagaaaaatagttatgcgtttagatgtatatatggttaaactaaaaaagaaattatgtttgaagaaatcacataaaaaatactttcatggcgctaattggtttgatattacgcatgacttagctatagacgttgttaataatgaggataaaattctgaatagatataaagacggtttttgtgtggatgaagtttttcttcaaacgtttattattgatcacggctatttagacagagtatatgattcaaataatgctgagatttctaagtccattaaacgtgaaatagattggaatcggggaaatccgtacacatggagatacagtgatcttaattatttgaaatcatgtagttcttttttcgtgaggaaaatagatgaagatttagatagtcgtttaatcgaaggcatagagcaatttctcaaagaaagttaggaaatatattaaaatgtttttcgctgttatgactataggaataatttgtcctatattaggaattttcctttctattttgtatttttctacttatcgacgacctttcgcatctgcattattatgcgggatatcattttcggcctttttttatggatatattgcggatgttcaaaatgatatttatagacatatgggaaatcttaaatattatcaaaatattaagatttggcaatgttttaatgctgttaaaggcatgaggaaagcgtcaatatatgtatgggatatatggtgttggataatagcccaatttaataatccatatttgatgcaatcatctggagctttattaggatatacaatcatcacttttatcgtatttgattacgcaaaaaaaaataactctagcatgaaagaatggcttcctatccttttaatgttatattgcgttatctcacctgctggcatagttataggaattagaaacagtaatgcattattgttgtgtgcgttatcagcttatttctattatataaaaaaattaaagaatatatattgtatttctattattattatcgcagtatttattcatcattctgttgcactaatattcttgctttggttactagaacctttatatagaaggaagaagaagacagttttaatctttataggactttttttattcctttttaataattatggaagttattttaccgccttgtctagcaaacaatttgttctatccgatttagttacagatttggcatattcagcaaataactatcagaattattatcatctttggtcattcagcaatattattcatgtaatagtaggcttagtatttactattttgttattatttttaacacataaaaatgaaaattgtgaagaattatggaatttttgtttattgattttttttatatcaagtatattaacgattttattaggtgttaatggaactcgttatttaatgcttgccgagatacttttatctataattttattggacgcacaggaaaattcattttttttgaaaaagaataatttcttaacatatacaataccgatgacaggaattgtgttaattattttttatttaaatacgcgagatcttgcgtggggaactgcgtcttttgaatcgttactttacagcggaatagtaggttatttttcaagattatgaaaagaaaaatagatgatttaacaataattattagagagatgattttatgggaaaaatattaactgttagtatagcggcgtataactgtgaaaggtatattgaaaatacattagaatcttttgcaaatcaaaattataatgatacactcgaagtctttattattgatgatggaggtacggataaaacattagaaatatcacaaaaatatgctgataaatatcctgaaatttttattccaattcataaggctaatgctggttggggttctacattaaattatggaattagaaacgcatctggaaaatactttaagcaacttgatggcgatgataaatttcttaaagaaaatattgctgaatttcttaaggttctcaataattgtaatgaagatttaatttacacaccgtttgttttttacgatgagattaaaaagaaaattactgagattaagaaggctggagaagatgtgccaaggaatacaactttagttctagaggattatctttctacattatacattgctatgcataattgtacgtttaaaactgaagtgttaagaaataacaaaattaatataacagagaagtgtttttatactgatattgagtttgtgttaaaagggtgtgttgcatctcaaactgtaagagtattagatatccctatctattggtatagaatatctcgagaaggccaaagtatgagttattctggtattcaaaagcattatcttgaacatcaaaaggtaacatataatttgttggaatattttactaataatattcaaaatggtgaaaaaaggaaatttgttgaaagcaaattattatatttgattgagaatcaatattcaatttatggtattattactccaaataaagagcataaaaaacaactaattgaatttaattcaataattaaatcaaaatatccagaatattataggaaatctaatcctctttcatacatcaaagtattacgtaatacaaaatttataggatattacttagcacatagattaaggttaatatttcacaatatgaaaaatatactttatagacgaaagtgatttataaaaaataacattttatttgacagaaaaagtgacttcgctgaaatagatttattaatttctgcaaaacctttaggtcagattataattagcatgatcagcagctatatgtcgattgctccgtttgaaaaggtcaagtcatcgtcattatcgataataattttaatttgttctcaaaagtaaataaataactggtgttttcttttttacgtctcattataatgggaaaagctaaatatattaaaaaatgtataataaagagagatatatgttggtgatattttcatattatcttaatgtatttcttaaagagggaattgtactcaacatgctgctgctcatgccgattgggatattgctgccggttattttgcagaagcgttttttcttttggccggtacttatcggctttggctgctccttggccattgaactcatgcagtattattttcgatgtgggatgtttgaactcgacgatttgtttaataatacagtgggtgtgtggttcggctatttgatctacggcggtgacgctgatcctgtattttaagcaaaaccggttggatcgtggctaagtggcggcgcgaaaaattggatgaatctgaaggcagttcggccgaacgcacaatcaatctgccataaaaattgtatatattttccgtgaaagggacaattggcgcatacattacgttataatagaatggattagagaaagataactattgatcttgaggaggaaagacatgaatattcttttagccggcggtgccggttatatcggcagtcatacagcattagctttgattgaaagcggccacgacgtcatcatcgtggacaattatgccaactcgtcgccggaagcggtgaaacgggtcgaagaactggcgggcaaatccattgtgcattacgaagcggacgtacaggatcgggacgcgatgatgaaaatcttcaaatccaacgccatcgactgcgtgattcattttgcggggctgaaagccgtcggcgaatcggtcgaaaagccggtgatgtattaccgcaacaatatcgacacaaccttgacccttttggaatgcatggcggaaaccggcgtcagccgtttcgtgttctcgtcatctgcgacggtttacggttcgaagaacccagtgccttacgtcgaaacgatgcccaagggcagctgcaccaatccctacggctggaccaaatcgatgatggaacagattctgcaggacacggtcgtggccaatcccgacatgacgctcgttttgctgcggtacttcaacccgatcggcgcccacgaaagcggccgaatcggcgaagacccgaagggcattcctaacaatctgatgccctacatttctcaggtggccgtcgggaagctggatcacctgacgattttcggcgacgactatgacacgccggacggcacttgccgccgggactacatccacgtggtcgacctggccgaaggccatgtgaaagcagtggaatacgcggaaaatcacaaagggacggaaatcttcaacctgggcaccggcacaccgtactcggttctggacatcgtccacgcctttgaagacgccaacgatttaaagatcccgtacgaaatcgggccgagacgcgcgggcgatttggcggaagttgtcgccaacgcggataaagcgaaagccgtgctgggctggacagccaagcgcgatttgaaagacatgtgccgggattcctggaactggcagaagcaaaacccagacgggtatcggaagtaaataagaaagacaaacaagcggcagctgcagaacaagcggcggtcgctttttcttaaattgcttcatttcatggtaaaatagttaccaataactttgaaagaaacaatagtttgtaaaaaggcaaggcgaaaatgatgtactttaaaaatttaatacaagttggatggaggcatagaaaatagaccttcaggtttgttggccatgaatgagagggcgaaagttattaattcacttctcagcagccaatataataacatagacagatattcttttcctcgactatttattgattatattctaaaatggcatgtcttgttttaaagttagaggtggtcccattgtttggcattacatatgaaatctgggctgatatatgcgaaatgtatttttccgtaaaattaggatcgctcaagtctaatttacaatggtttccttttacaaaaatatcaaacgaagacagagaaaaaattaagagtaaagaattttatgacgcatacataaaaacaggatcatttgttcttttaccatcagtaatgtttcaatcggaaaattttattcaaaaaagtgatggaagttttcgagatgcatctctaatttcaccaattctttatcttgttcttcagtcaataggaaaagagatacatgaccagtatgtaatgcaacgacctaatgtaatttctgcttattatgcgggaaattatgggtttatgcgtgctaaatataagcaagattacgatgccttttttaaagagttaaattattgcagtgacgaatatcaatattttattaaaacagatattaccaatttttttgcaaatattagtatagacagattaataacacaaattgatagaatatgtaattcagataagatcgtgtttacacagacacagttacagctttttaaagaactattgaaatattgcggagatgggaaattcccattaatcgaaaatagtgttgcatcgtcttatttagcaacggtcatttatcttgatgaggtggattctaaactttataaatatatttcagaaaaactgtctgtattttcgtcttttcatatggtacgttatgtggatgatttgtatatattgatttcctcagatcatcctattaataaaattcatgctgcttataatgaaattcggaatgaatattcttcgattttaaaggaatatggattagctttaaatacaaaaaagtgctgcatgaagaaaacaaaggaaattaatgatgaattaaaaaaatctttgtatgatgaatacgttaatggtataaaacacaacatagaagagctttataaaggagaattattaaaatttttaaaagatttgtctgcggaattaacaaatgacagcatagatgtagaaaaatataatgaattaatcgaaaagtatttctcttcagatgacattgaatttacggcgaacgaggttttcaattattatatttatgagaataaaacagagctgcaaataagttcagttaaaacggaaattatcaatttaattaaaaagagcatttcttttatttatttagatccaaagcgtttaacgattatgattatgaaaacgaaaagtgatagggcgatcaaagattttctccgccaattatttaatcgtaatcgagctggaaaatggaattcctatgatacaacaatagccatcgcttatttgattcagagtaagtttcaatatattgatttattggaagtgctatcaaaacaacagcctgatttaaataaatattgtttatataattgtgaaaatagttttcttgcattctttgaaaataagagtaaatgtaaactgcgcaaagcgattgataaagattacagagcgtattatttatattttatgtatttatctgaaaagaaaagagaaaactatttggtcgcttttgcttattttaaaagtttttttgacaggataactgcagatttagcatttaaatataagcctaataagcgagagaaaagaccaaactataacaatttttatcaaaaaaataaaataaaaaagttctattcaaagatagatggcagcgaagaaattattgaaaaggcacacaaattaagaaatactaatccactagctcattcttcagctgagttactcagcaatgagaattcgacaaaagagttaaaacaatgtatcgataatttatctttattaataaataaatatctcgagatgtcttagatgatagaataaaatagaagtcatgcaatacgatattgcaattataaaaaatgaaggttggtgaataatttggacgagataatacctgcttttgaaaccactttgtttgatcctgcttttacagatgcatgtttggaaattgctgaagcaggggtggattcagttgtagataatccattaataaacagcatacctttcgccagtgtcttattaggtgtgggaaaaaccgtgaaaaattttcatgatcgaaatcttctgaaacaaacagcgcagtttattaatgcatttaattgtggaaatatttcagaacaaaaactaaaaaagcatagagaaaaaatcaataaaaacccgaaaaaagctgaagaagaattggggcgcgttctaattttgctggatcgtaatattgaattgaaaaaatcaaagatacttggacatttttatcattcatatgtcaatgaaaatattaattgggatcaattttgcgagttgtcggatgtgaatgaaaaattatttatttctgatatccaattgttacgccaaatttcaaataaggaaataacgcaaactaaccaatgcaaaatgtatcgagtagaaagacttaatgcagtaggattaataaatacagcaacgagttcgataacaatttctgacagaggaggagcgacaaataaaatgatcgaagtgagcgaacttggatcattattttgccaatacggaataaactaaacatcgtgatgttggtatgagaaaaagttcgatataagtgaatgatgtagaaaggccgtcgcgggaagagatgattttgataggatacaaatagttgcgcaaatcggactttaataactgtcagaagcacaattcagacgggtattggaaataaagtcggagaataaacgagcagtcgccatatggcggctgtttttttatgattattcaaaaaatcaaagatttaatgaggaaaaatctcatttaatgattgatatctagaataataatcctttataatggtatctggaggaaaggctgatgttgatacaatttgggtttgaaaattataaatcgttcaaagacgaggcaatactagatctaacggcaacaaagatcaaagaactgagttatcacatacgggaagttggaagggaaaaaattcttccaacagcggtgatttacggcgccaacgccagtggaaaatcgaatgtatatgaggcattagcatggatgtcaacctatataaagaattcttttggatatggcgatgatgatgacaaagcgccgaccccctttcttttagatgaacagagtgccaaagcagacactatgtttgaagcgcattttacgctttctggcgatacgagtggaaaggtttataattacggattttgtgtcggggaaaaggggatttcagaggaatggctaaatacgaaagctaaaacggcaaagacgtcacgaagaatcttttaccggaacggggatgaactggatttgcaggggattccgaaaaaaagccgcgaaaacgtagaaattgcccttgggaaaaaaacactgattgtgtcgctcggagcgatgctcaaaatagaaatatgcgaaaaggttagaaattggtttgcgaacaatttgtttgccgattttggcaatgcggtttctaatttctatttatcaacgaaccttccagatcattttacagacaatcctgtggttcgggatcgagtggttcaatttctatcggattatgacccgcagattaaagcactggaagttaaaaaagtacagacaagtgatgaagaacagaaggactattatcaaattaatgcgcttcaccaaatttacgggtcggatcaaacggttcctttttcgtttcgggatgaatccgctggaacacagaaaatgttctcgctttatccatttttgcagaatgtcttggaaacagggaatgtcttgttcgtcgatgaaatgaatgcgcgtctgcatccactgctcgttcgcgggatcattaatttatttactagttcggaaaccaatcctaatcaggcgcagttaattttcacttcccatgattcgtggctgctttcgagtaaggtgctgagacgagatgaaatctggtttacagaaaaggataaattggggcagtccgatctttacgctttatccgattttgtggatgaaaagggcgataaaattcgaaatgatgaaaacattgaaaagaactatctattgggaaaatatggcgcgattcctgagattcacgccctgcatctcgtttcggagaataaaaaatgagtacaaaacgagcgcgtgacggttctcgaagaaagcgaaggacacattttcgaccattgcgattaaaaaattatttaatcgtaacggatggcgaacaaacagagaaaaactattttgaaggattacgggattatttgccagcggatgcgaaagaaaagattcgacttaaggttgtaaaggcaaagaatgcgaaaaaattaattgaaaaatgtctcgatgaacaggcacagggtgcgcaattttcggaaacgtggttggtttttgatcgagaccgcgttccgaatttcgatcaaatccttaaacaggccagggcggaaggaattgagacagcttggtccaatccttgtattgaagtttggttttcagcttattttgggagtctgctctcaatttcggaatcaaagatatgctgtgaaaagtttgcagatctctacaagaaaaagacagcgcaggagtataaaaaatcaaatcccaatatttacaaaatactgtacgaaaatggcgatgaacagcaggcgattcggcgatcagagaacagaagaagatcacaaaaagccgatgcccggctgtctgatccgtctgatcgagtgggctgcacagaagtggatagactggttaaagcaatacgagaaaatgcaggatagggaaataaaattgtcagtgagcagaacagctgccgcagagatgcggcggctgttttttcaccggaagtgttagattatatgatttgtctatctgctaagacgggttttattctaacaaaatccaatttattagaataagaacgctgttattctaataaatcgagaattattagaatgaggatgatacttgttctaaaacgcgtgcaaggctaaagtttgattttaatttcccatacttttcaattgattgttaaattattatcttgtatgccttgagaaaatggaatataattaaaataaatagtatattttatatcacagcgacgtgagaactttgttcttgcgccgcttttttttggaggtttttatgtatcaccatgtagttccgctttcggattcagttttggccacggtcaaaaacggcgcaatgcaggataccgtgggggatttgtggaaacacgaccgtatccttttaaaaaacggtcatgttattgatcccaaaaataagattgacgatgagcgcgacgtcttgattgaagacggcctgatcaaagaagtggcaaacgagattcatccggatgaaggggatcgcgtcattgattgcggcggcttgttagtcgttccgggattgatcgatatgcaccttcatttgggagatttgtttgaagtgtcgacgaatccgattttctgcgcagctgaagatggagttactttaggactttcgccaggagctgggaatacgtttatggcaccgtctttgttgggcgcagaagttgaccacggggtgcccattaatttgggggtctatctcggtgcagcgaatgtgttggggacacagcttgatacagatgaattgatccagttgtttaaaggtgaactcgacgccgacacgatgtcgtccaaaatgacgagaaacagtattaccaatacgactgcggccctttgcgtcggaatcaaagatcatatgggccattttattatgagcgatgaaaatatcgataggatttttaaaatcacatctgaagcaaaattgatttacatgtcccatacccaagacccggaacatgcggaacgtttggcttcactgtcgaaaggccgtccgcttcacttggcgcacgcgacagcggctggatgcggcacgcacatggatccggctgaaggcatgcagcgcgtattagatttaatcggcggcaatattaccggagaatttgttacgaccatgttaagagctggaggcggcagccgagaaggcttgcaaatgccaaaggcggctcagaaactagcctacgacgcactggaatccggcaaagtcaaaatcctcatttccgatggtcagaaccaggcgactatgaaaggctttggcgatacaagggacgatattccgtgtatcatcgaattggctgaagcgggcatcttgtcgctcagcgatgccgtcgcgtgcatgaccaaaaatccagctgaactcatcgcgaaacgcacagccaacaattggtggacggaaaaagtgggccatttgggcgcaggtgctttgggcaatgtgacagtgatcgaccaggacgataaattggcgacctatacgatcgtaaacggacagatcgtctcctttgaaaatcgggcggtcagaagaaactgtggcgctggcggctgggtttctaaatttggtatggtccgcagaactggtgttggcgaaatcgccatgttttcttacgggaaatgatgatgctaacctatccatctgaagaacagtgcaaaacgcttttgcagacgttggtgcgcaccaatacctgtcagccggagggtaatgaagaggcgctggtcgattggatcgtcgaccagctcccgcaaggtgtgacacattttaaaatccaaaatgccccaaatagagcttcgctcattattaaactggaaggggacgaagacgatggcgggatcgcttttgtcgggcatttagatacggtggcgtgttcagaagcggatggctggaccgatccgccgcacggcgccgtggttaaggatcatacgctttatgggcgcggagcctgcgacatgaagggcggagacgcagccatgctgctgacgttgaaatatttgctcgaaaataaagtgtcattaaagcggccggtgtatttctgctttacttctgatgaggaagcttcaggtctcggcatccagtcggttttatccagcggttacctcaacgcggttgaggcgatgatcgtctgcgagccttcccgcgagcagatcagcaatagcgaaaaaggcgccctttggatacgtgtcgccatcgacggggtatccgcacacgcgtcccgtccgacgctgggtattaatgcagtagaatacgcatcgattttaagtcaaaggattaaagcaaaagtagaggcgaaaccggttcatccgattcttggaccggcgacagcggcagtgaccaagatctccggcggcagtatgaccaatatcattccggctcacgccgaatttgaaatggacattcggacaaatccagatacgtcatccgaagatttggaaagagaaatcgatgagagcatcgaccagcttttggaagaagccgcccaatcgtcagccagtcaagggcagcttagaattactaaagccgtcatcaataatcgtccggccatcgaaaccgacaaagaccattcgctcattcaaacactaaaaaccattggagaaaaaatgggaattgatgcaggtgaaagaggacatttcttttataccgatgcgtctcaatttatcccgcagacacatatcccctttgcgattgcaggccccggtgacgacgccctcgcgcattgcgtcaatgaatccattgatttaagaagtgtccagcgattcacaaaactatacatacattacatcatgcaaacgaactaaaaggactcattatgaaaaaatctgaaacaagaaaatttggctcggttttaggactggtaatcagtcttgcgattgggtttggcctgtatttcgctttaaaagcagttgaagggactaacgcaattttcaattacactaacatcattgatggcatcacgcattcagtgcccaaacaagtggcctggttctttatgaactttaccgaagcgcagttttacgccagcttatttgcgggtattggcctgattgtggggggctttgtggcttggcagctggccaaaaacaatgcaaagtgcaagggttttgaaatttgctacggcagcgcttcgctctttccatgggtctttgcgtcgcaggccatttcactgtgtttggccatttttgtatttcgttacatcaatctgttcagcagcccatctgtcacctggattgccaccttcatttccgtcgttggggcgcctccggccgtcatgctgctttacggtccgagtgtgccagcactcataacttcatctgttttaggcggtctgctttgtccgcctgtggcgacgtggatcagtgcttatattgtgagtccctggaaactgccaggagtggttgccaatgtcaccaccatggccattacagggcttgtcatttgtatgatttgtaaagccctgccctgggtgacagcacagccggtccaatcctaccatcatgatgcagatgaagctgaaaacgtctataccgccacgtggtttataagacgtgttctcgctgaattttcagaagctcctttttacggcaatgaagtggcttcgcttttcctcctgattggtttaattgtgggcgaaatcgtctgtgggaaacatggcgcctatggcagcggccaaattccagcaattttgttaagccagtttatcggcgcggcagtcggcatctttttgtattcaagtaaatttgagaatggaggatggtacgcgacttacgtaccggttgtgagtgtcggcccggcctgcgtgttaatgtttggagccaatattccggttgcggcttttgcgggtgcccttggtggcattcttggaggaccggttgcggaatattttgcggggaaactgccggacggcgtacacgtgaccgttgccaacgttacatctatggcgatttgtaccacgattgtggctacgatcatgaaggtgcttcctttttagctagactccacactggaatcaagcctacctttcaaaatagtgagaggtaggtttttttacttttaaagacttttctttttttgtctttttgtttggcgttcagagagcaggcgtatcacggcaatcagagtaaaacaatcataatcggaaaagttactcttttattccaatttacatttatgcatacagatgtcgttgacaggtttgtttaaattttttaaaataaaaaagaaaaccgtttaatgtagaaggcggaggaaacgatcactgcggggcgcggcgggcgtgaccgcgcgggtcaaatcagatgaggttggtgaacaatgggcagaataggcagaggcgccgtccttttggcgctgatcctcatcctcgtgtccggctgtgccctgggccggggaggcggccggaaaaccgtcgacaaggcggaaatgccggaggcgccggggacacaggtatacacaggaacggacgcggcgatcgacgcgtccaacgccgccaaggggtatgtcatggtccgctacaccggcagcgccgacaaggtgcaggtgcaggtgaccggcccaaagggcacccgcaccccttatccctttgaaaaaggcagctaccacgcagtgcccctctccgaaggggacggcagctacacgatcgtcgtgtacgcccacgtgtcgggcaccagctacgcggtcgccctgtcccagcgcatcgacgtgaagctcaccgacgaattcgggcccttcctttacccgaatcagtacgtggcctacaccaacaattcggcctgcaccgcctacgcgaaaaagctgtcggaccgttcggacgacgacctggactacatcacccgggtcttcaactacgtcacaggccacatcacctacgacaacgacttggcggcgcacattccggtcaactacctgccggacccggacaagaccatgtcctctggcaagggcatctgcctggactacgcggcgctgatgacggcgatgctgcgggcccagggcattccgacgaaattagaggtcgggtacaacgagacggtctaccacgcgtggatctcggtctacctgaaggaaaagggctgggtggacggcatcatccagtttgacggcaagaactggacgctggtggatccgaccctggcggcggaaagcagcaaaaagaaggccggcgcctacatgaaggaccgcagccattacaccgcgatgtatcagtattgaaccggcggaggccggaaggaggcacaaccgtggcggaggagagaaaaacaaccattaagcagctggcagtcgacgaactggcggcctttgcggggcagctgttgctggtcatccattcgggactgccggtgctggacggcctcgaaattatgcgggacgacgcggacaatcccgaggaggcggccattctcgatatgatgctggcggcctaccgcgagacggacagcctgagccaggccatgaccgccgcgggcgtgttcccgccctacatgatcggcatggtgcacaccggagaggtgaccgggaatctcgaccggatcatggcccggctggagcgccattaccagcgagaaggcagcctgcgcaccagcgtcgcgcaggcggtggtctacccggtgatcctgtcggtcatggtcacggcagtcattttgatcctggtgatgcaggtgatgccgatgttcgatcaggtgttcaaggagctgggcacccagatgaccggcctgcccctggtgctggcccggatcggcaccgccctcagcggcgcgggtctggtgctggtcgccgccgtgctggcgctggcggtgattctgctggcggcggcaaaaaccgacggcggctcggattggcttcaggccctggggcgtaggctgccggggatgaaggccatccgccatgccgaagccgccagccgtttagccgcccacatgagcctggtattggccagcgggctgacagcggaagaagggctggatatggcggagacgatcagcggcgatcccgattttgcgcgggcgctggcggactgccgcgggcggatgcgcgggggtgcagacttttcggcggctcttaaacagagcggcatgttctctgggatggacgcccagctgatcgaaatgggcagtcggacgggcacaatggacgaagcgctggccaaggtggccgatctgcttcagcaggagctcgacgcccggatcgacacccggctcgcgcggctggaaccggccctggtcatcatcatgtcggtgatcgtcggcggcctgctgctgtcggtgatggtgccgctgatgcgcatcatgtcggcgctgtaggccgcagatggaacaggagaaaagccaatgaagcgattcacccgaacagcggcgaagcgtcggcccgcagggacagcactgggcgccgcggtgctgtgtgtctgcgcggtgctggcgctgtttctttacgggatgaaccgggtgaaccgcggcagcgttgtgcgccagcaggaagcccttgaggacgcggtcaaccgggacatcacgctgtgctacgcttgggaagggcattacccgaaaagtgtgaagtatttggaagaccattacggcctgacctacgacaagcagaccttcgcggtgaaggtccagctgcggggcgcgaacatccgcccctacgtcgtggtcattcgaagggacggatcggagggcacatgaaaaagcggacattcagcgtcaacgtgatcctgccgattttattgttcggcgccttcgcgctcctcgcgatgggagtggccgtccgctcggtgcgcgcctacaagcaggaggaagcggcggccaaggagaatgaatccgcgcgggtcatctccgcctacatccgccagaaggtgcgccaggccgaccccggcacggtggccatcggccagatcggccgccggcaggccctggtcatcgcccagacggacggcagctggacgacgtacatttatcagtaccgcggccagctgatggaacaggcggtacagcccggcgcggcggcagcccctgagggcggcacggccatcgccgaggcgaagaccttcaagttaaaatgggtgagccccggcctgctgcaggtgacgagcgcggcgctgggcggccggtcggaaacggcggtgatcgcggtgtactgagccgcgggtgaagaaaaaagcgaggaagacaatggacagcctggaaatccgaaggggccggcgcagctggggcccgctgctgatggagcttttgatggcggtgctgattttcgcgctggtcagcgcggcggcggtgatgggctttaccaaggccagggccctgagcacagaggcctcccgggtgtcctgggcggcggaccgggccggcgacatcagcgcggtgttcagccgcgccgattcggtgcagggctttgccgacagcctgatccaggcttacccgaagacggccgcggcggccgacagcaagggccggaccgtgctgactcaggcttacacggcggcgctcgcgcccaccgctcagatgaaaaaggcggcggtgaccgtgaccgtcacggtctggacgaaagacggtacgatgtacggagccatcgtaatccgagatcggcagcggcacaccaaattgtaccgcctgtcgtgccgacggtacatcggcggctgacggtggtaaactagaaaagggaacgcgatgattgagttaaaggcaagggggcaggcggccccgcccgcgcggcggcaggtgatgcccatcggcatcccgctgctgctggcggttttcgtcgcggtgtgtctgatcgtcctcagcacctacgcctacgtgacggctgaggcggaccgcagcagggcggcggatcacgcgcaccggcagacggccgttcaaaacgcggtgaatttggcggagcaggcctgtgcgggattggacgacggcagggcgctgccggacggcgctgattgggacgcgcagaccggcgagctcacggttgcggtgaagaccggcggggtgctgaaggccggtgtccgcgacagcggcggccggcaccgcatcgtctggataaagacggtgccggaaaatagcggcacccaggacgagcagacggtatccggctgggaacagcattaatgggcttacggacggaaggaggaaggtgacatggcagtcgacatcagacagattttagagcgcgcagtggcggcgggcgcctcggacgtatttgtcgtcgccggcatggcggcggccctgcgggtcaacggcgaaattgagacgatggatactggccggctgatgccggcggatacggcccggctgacggcggagatttaccatctggccggggaccggccgatggcggcctacgaggcgtcgggcgacgacgatttttccttcgcgctgccgggcgtgtcccgctttcgggtcagtgcctaccgtcagcggggcacctgcgcggcggtgatccgaatgattcccttcaccctgccggatcccaaggccctcggcatcccggacgccatcgtcgagctgggcgacgcccgggacggcatgatgctggtgaccgggccggcgggcagcggcaaatccacgaccctggcctgcatcatcgaccgcatcaacactcggcgcagcgccaacatcatcaccctcgaggatccgatcgaatacctccaccggcacaaaaagtccatcgtcagccagcgggagatggccgaggattccgagaactacgtcacggcccttcgggcgacgctgcgccagagcccggacgtcattctcctcggagagatgcgggatttcgagacaatttccgtcgcgatgaccgccgcggagaccggccatttcctgctttccacgctgcacaccgtcggcgccgccaacacgatcaaccggatcatcgacgtgttcccggccaaccagcagcgccaggtggcggtgcagctgtcgatggtgctcaacgcggtggtatctcagcagctggtgcccacggtggacggcacggtcgtcccggtatttgaaatgatgcgggtcacaccagccatcaagaacatgattcgagaaaacaaaatcgcgcagatcggcgccgccatccagagcggacgggaaagcggcggcttgaccaatgacggcgggctgttcgacctcgcgaaggcggggcgcatcaccgcggaaaccgccgtgcagtacgccaccgacgcccagaccatgcggcggctgggaatagcgtagaaaggagatcaatatgcacacctacagggccgaatgtttcggccagtttatgttgacagacggagaggtcacgctgacccaagaggaaatgcggtcggaccggctgctcaacctcctctcctttctgatcgtcaaccggaagcggaatccgagcatcgaggaaatcggcaatgccgtctgcggcgaggattcggaacaaagcggggccagcgtgatcaaaaacctcgtgtggcggatgcgcaagctgctgaaaagcaagtggccggacgagcaattcatcctcaccttccgcgggggctacaagctgaacccggaattgaaggtcaccaccgattacgaggaaatggaagatttgattcagcgggcgggacagtccgaagtggtcgaggaaaaggcggccctgctgaatcaggcctttgagacctacaaagggcggtttttggtcggctgcgaaaccgagcgctgggccgcgaacctcgccgtgtattaccaaaacggcgcggtcgcggtcgcaaaacgccttgccgccctgtacgaaagcctcggcgcctacgaagaggtggaacgggtggtccaccgcgcgacggcggaggacgcgctggatgaggccctgtggacgattttgatccgcagctacggggaagccggcaaaatgcagaaggcggaggaaacctttcaccaggtgtccgattcgctgtacaacgcgctgggcatcgggccgtcgcctgagctcagcggcgcctaccagtcggcgctgaaccagatgcacagcgacgtggccggcgtcgagacggtgatgaagcagttcgacgaaaccgacgagcccgccggcgcttttttctgcgagatcggcgtgttcagaaaaatttacaagctcagcgccagacggatcagccggttcggcttcccggtgcacatggcactgatcaccctcgacctgaaagagggcaagaccggcgccgacgccaacgcggtaatcgatcagggcatgacgctgatgaaggactgcatcctgcacacgctgagaaccggggacgtggtggcccgctacagccgcacccaattcgtcgtgctgctgccggcctgccagtacgagaccggcgaggccgccatcaaccgcgtcttcgcccgatttgacaaacacaaggaaagcaagcggtaccgccgttattttaccttgcgggaaatgtcgggaaccgcgaaagcgacggcatttcccgctcataacatggacagcgcgtcggcgctgcgggtctgcgtggacgccgtggaagcgggcggcgatttcagcggccacatcaccggcgtcgcggtgagaacgccggtgcatttcaagagcgcggtcgccttcatccgggcggtcaacaccattctggacgaattggggcggccccaggccaacgccattctgcggactttcaagacgggcaagaacgaggaggcgccgacgagctggcagtacgcgccggcggtctaccattcggccaaagccatccagcaggacaccggagccctgaaaactttggatatcctgtttgtgacccggagcaacaacacctggcaaggcacgctgtacgacgacagcggccaggaagccgccttttccagcgagctggacctggtagcccagatgaaaaaaatgacggatcaaccgcaggcgtaagaccttgttgagaccaaaaccggctaggataggtatagacgtaaacgatcaacaacgggggcagagacagacgtctcggctagtgaatttgctatagagaagaggatattatgaattcgttcatcattgatgtgctggaaactcggaaccagacctggcagggcacggtgacctgggtcggcagcgacgaaaaaaagaagttccgcagcgtgctcgagctggtctcgctgatcgactccgttgtcggcgaagaccggcctgagttcgaggtccacagccagccagacgacgaccagtgagggccggcagcgcacagaacaataaaaaaacaaaaagcagaggctttgcgtcgaatcgtgacgcagcgcctctgcttttttgatgcggttaatcggcggtgtcgacctcggtgtggagggttcggacgcctcggccaagggtccggacggtgacggtcaggcggccacttgccgtcggcagcagggtataggtgtgccggccttcctgcatgatcggcacggaatggccgttttgggacgctgtgaccgagcgcaccggcagcacggcgttgacagtcagggtgtaggccggctggccggtaaaggggctgacgctgtcggccttggtgagggtgcccttgggatttaagaagaggagcgggcccatcacgaggaggacgacggcgaaaacgatgagccaccgaaaggcggcggccttctgcttcagatagacgtcgtaggcgtcgagacaggccagggggacagtgttttccggcaggcgcagccggtcgaggagatcgatcagcatcacctccgcttcgtccccgctcaggcagggccggggccgcttgtcccgcctcggagccgggcggtccggcgcggtgacgtattggaagatccgcatctcgatgtggtgcagggccgcggcggcctccgccggcgtgtggatttggccggcgtcctggacgaacaggacgtagagctttgcgacgcagtcctgaacgaggtaggcgctgcccagagcgcggtagaaatcccggtagatttgatcggcggtgagggcgtagaacgcggcgaaggcgttgctgtcccggttctggatgccgtcgatcagatgctggacgtaggcggcgtttcgtttggcgctcagcgcgtgaaaggggcggaaggggctagacatgggcatcctcctggtcgtccgccgacagggtgtgccgttcatcggcggggttcagccggcggttggccgccgcgatcagcgtcacgatgtcctggcgctgcgccgggtcgttgaaggccgcgccgacggtgtagtggatcggcgggtggccgagctggcggttgtactgggcgattttgtcatcgatgcgcttgagaaaggcggcgatgtccttccgtgataggtcttcggacatggcggcgaagcggctgccgccgttgcgcgccacgaagaaatcgtcgagggcggcgagattgaggatgatggaaaagcgcttcaaggcctcgttgccgccggatcggccgtactgctggttgatggccttgatgttggtgagctcgaaggcgatgcaggcgaaatccggcggcagggtctgcccgtcgaacttgtccagaagggcgtcgatgctgcggcggttcgcgattttcgagaccgggtcggcgttcagcgccttcagcatgttttcgtaggcctgctgctgctcggcgaacagggagaaatctagaaagataaacagaaaggacagggcgagggtgccccacaggagcaggatcacgctgtgacggctgccgccccgcaggatgatgacgaccgcggagagggcggcgatcaccaggaaaagcacaagctgaatggttttgatcgtatcgatttttttcatgagaccgctcctgaaatgggatatttgtcataaaaattaaaaaattttaatttttttaatggcgttgtgacttttgtgagacgggggcccgctatactgaaatcaaacataattgattgaactgtctgccgttttcattcaaccgcgcctgacaaaaggctatccatattatatcacgattgaggggaaatggcacgacggaccgagggcggaaggcccattacaggaggcagaacatgactgaaaaactgcacgatttccaagtggcgtttcacacgccgcccccagagacgccgacggacggtttcgtccgaaagagcagagcgctgcacctcgtcagcggggtgatcgccgcagcggccattgtcgccgcggtcatgtgcttcgtcctcggcgccgccagggtgagcggcaattcgatggccccggcctaccgagacggcacgttcgtctggtttgtgagaggcggcagcaccttcagccgcggcactgtcgtgtcggtcacgatgccgagcggcgaccactacatcaagcgggtggtggctgggcccggggacaccgttgacatcgcggacggcaaattgatcgtcaacggcaagacggtcgacgagccctacgcgagaggccgaaccgaacggcaggcggacggcctgatggtctacccctacaagctgccggcgtccaaatatttcgtcctcggggacaaccgggcacactccgcagattcccgaattttcggaccggtgtccgcggcgcagatccaagggcgcattgtcagcacgaagtaaacgatttctaatcaagatagagagctgcagaaagctcacaggagaggagaaaaaccatgattcaagcctattacaccttttgtcacgagactttgaatatccacatgtacaccattccgctgattgtcgcgggcgccctggcgatcctgttcggactgctgcattggcgcaaacagaaaaaacgtgaagacgaatttgaagacaaaatggaagaaaaataccgcgatgcggataacggcacggcgcaggacggcgccaagcagaacagtgatccgctgttcttttaaccaattgggaggatgagtatgaaatttttgatgcagcacacccaggtcgattttgacatctgggctttgttgacgtttatcgttttggtctgtgccattgtgatcctcatcgtgcgcaagctgaagatgaaggagatcaaggacgacctgcaggatcagattgacgatcaggaccagcgccgtgtccacacgacgcaggacggatagatcataagtgaaaggagaacgcttttatgaagacctttaagaaacagagctacaagaagacgaaaaacgtcagaaaatgggttgcgctgttcctcactttggccatggttgcgaccagcggcctgatcacgacagcgcagaaccttttcggcgcggacgaagacgtctacaacgcagctcaggaacaagcgcagacggttgcggccgacagcgctgcagcaaacagcacggcggcagctccgagcgcttcgaccgacagcgccgaaaacaatgcggcggcggctcagagcaccccgcctcagagcgcggcttctgcttctgaaccggcagcggccacatcgaatgcggcgagcacatcgagcagtcaggcgcaaagtgtgtcggccagcgcgccggcgtcttccgatcagacggcggattcgtccagccagacggttgacgtgccgtcgatcgaagtagacatccctcaggcggaagaagaagctgacaaaaaaccggcacagtctttcagcagaaccgcgggcaacggcgtgaccgttcacgtcagcgcaccggaaggcgccctgccggaaaattccagcatgagcgtctcggcggtttccacgggcaccgcgaaaagcatcgcgaaatcgactgcttccggcgaggtgaaggatgccgtcggcgtcaacatcaccttccataatcaggacggcgcagaaattgaaccggaagccagcgtcagcgtctctatgtcgctgagccatcgcctcgacggcgaccgctttgccgtgtcgcaccagaccgacagcggcaacgtcacagcggtttcggccagcgccagcgccagcggcgcgagcttctccggcagttccttctccatctacgtcatctccggcgtcggcacgtctgaagaaagcccggcggtcgcgacgtatcaattccacgatttgagcggcagtgtcatcgacactcagaaagtcaagacgggcgacaccctgaaaaagccggcctctccagaaaaggatggctacaaatttatcggctgggcgagatcaaaagatgcgaaaaccgcagattttgacggctttggtacggtgacagtgagcgcggtggaaaccgtgaacctgtacccggtcttcaaagaagtgcattacgtcttcttcatggacagcgcaggcagcgatgcgaaagtttctacgaccaaagaaggcatcaacggcgacaccatcgcgacgtccggcgtcaagctcccgctgagctcaacggaaagcgtcaccggatggtacactgacccggcgctgacccatcctgtgggcgattcggtgaccctcggcacggaaaacatcaagctgtatccgaagattgaaaaggggcattacctgtatttcgacgccaagggcggcacctacatcgagccgcagtttgtcaaggcggacggccagacgaaggaaccggccgcgcccaaacgcgctggctacactttcaagggctggtcagcgagcgaaagcgcccaggtggcgacttacacctttggcggcggcctgaccgaagacaccacgatttacgcggtgtgggaagccaagaaagacacccagtacacggtcatttactggtgggaaaacgccaatgacagcgggtattcgtatcacgagtcgacagctaaaaaggggcagtccggcgcgacagtcagcaccagcgcattagccaaaacttatgacggctttaccctgaacacggacaaaacgaaaaaatcagtgacgatcgcaggcgacggttccaccatcgtcaacatttactacgcccgcaacacctattccattcaattctacaaagctgaacggaaaggaacttggtttgtacattatgaatggtctgagctgacagggctccggatcaccgcgaagtacggcgccgatattgccgtcaaatggccgtctgccacctctaagatttgggggacgaagaaaggcgagaatggccagggcgacgcaccttatcaatcggggatcgccaccatgcccctcgacggcggcgcattctattacgtgagccaaaacgggcggatcaccctgaacctcaactattacgttgaagggcttgacggcaagtacaccctggaccacaccgatagttttaaatcgaataatacggaatggtcaacaacagctgaggatcactacgatattgcgggcttcacttatacgaataatgtaaaagatggatcgaaatttgaacaggtcacgccttatacttataaagttgacttcaagtacagccgcaatacctacgacatcaatttcatcaacggcgacaacaaaaggtccgaatcctacaagtacggcgcagatatcagcggcgtcgatttaaaaacagcgccggaacgcccgagcggcgtgccggaaggctataccttcgccggctggtacgacaatgagcttggcgcaggggacccggtcacattgtccggaacgatgccggcaaagaatatcacgctctacgccaaatgggaagcgccggaagtttccgggaaagcctacctcgcgattcacggcggcgattcgatctcgctgaaagttgaatacggcggcacgatcgacgaaggcgcgatgccgacagtggtcgacagcgaaggcaacgtcctccagaacggcagcagccagaaagtcaccgtccccgaaggctacgactggaagggctgggcgacgaagtccggcgacagctacacgctgtacaatttcaacaccaaggtccatggcgacgtcgagctctacccctattacgtcagcaacggcaagtaccaagtccaatacagcgcgggcgacggcaaaggcagcgccagcgacagcaaatggtacgccattgacgccaaggcggatattcaatcggccaagggcatcacggcgccaaccggtaaagtcttcctgtactggcagtctgaaaccggcgacgcttactacccgggcgataaaatcacgatcaccgaagccaacgccaagggcgaccacatcatcaccctgaccgcggtctatggcgacaaaaccgcgacgacgagcctgacttattactccaattatccggacgacgccatgggtaccgacggcagcgccaaggcgcagcagacggccaacggcggcaccaatttggacaacaacacgagactgacagccctgaccctcgcgggcgctaaatttgaagccccgttgaactacaccttcgacggctggcaggacggcgacggcaaagacgtcgcggcgggcgctgaaatccttgtggacaacatcggcgacaacaaactttacgcgaagtggaaaccggtgccgaagatcaagatcaccgtcaagccggcggataaatccaagacctacgacggcaccgcactgaaagccgacagctataccatcaccgacggggctcttgctgacggcgacaccctcaccgtgacttacagcggcagccagaccaatgtcggcaccgccaccagccagatcgcttcgattaaagtcacccgcggcagtgtagacgtcacccgtctgtacgacatcaccaaggccaccggcagtctgactgttaaggcaaaggaagtcaccgtcaaggcggacgacaaaaccaagacctacggcacggcggacccgtccctcaccgtatcagtgagcggcacgatcaatggcgaccgcattacgcacagcatcagccgtgaagacggcgaagcagtcggcacctacaccatcacgccgagcggcgatgaaaatcagggcaactacaaggtgaaatacgaaacgggcaccctgaccatcaccaaggcggccaccatgaccgtcaccgcgagcggctacaccggcgtctacgacggcgaaagccacgcggcaagcgcgagcgcatcggtcaccgacggcacgacgatttattacaaagtcgacggcggcgaatggacgaccgaagcgccgagcatcaagaacgtcggcgaaaagaccgtctcggtcaaggcggaaaatgccaattacgaaaccgcgaccgcgaaggcgacgctgaaagtcaccccgaaggcggtcaccgtcaccgcggacaaccagaccaagaattacggcgaggcggatcctgtgctcacggccaaagtcgaaggcacgctgaacggcgacaaggtggattacaagctcagccgcgaaaaaggcgaaaaggtcggcacctacgccatcacgccggaaggcgacgccgagcagggcaattacaccgtcacctacaaaccgggcaccttaaccatcgtcaaggcgggcaccttgtccgtcacggcgaccggctacacgggtgtctacgacggcgaaagccacgcagtcagcgcgagcgcatcggtcaccgacggcacgacgatctattacaaagtcgacggcggcgactggacgaccgaagcgccgagcatcaaagatgtcgggacgaagaccgtctccgtcaaggcggaaaatgccaattacgaaacggcggaaacctctgcgaccctcaccgtcaccaaacggacggtcatcatcacctcaggcagcgccgaaaaagaatacgatggcaccgccctgaccaacgacaccatcacgatcacaggcgacggcattgtcggtgacgaaatcaagaacatccgggccaccggttcgatcaccgaggttggacacaagttcaacaagattgaatacgacctcacgagcgaacactacaaagacggcaattacagcatcatcctcaaggcggggaccttgaccgtgacgaagaacgcgacagcacagatcgacgtcaccgcacacgacgcgaagaaggcctacgacggcactgccctgactcagagcggctattcgatcaccggcctgccggaaggctttaccgctgaagtcaccaccaagggcagcatcacaaatgtcggcacggcggacaacgcggtcgacaaagtcgtcatcaaaaaagacggcaaggacgtgactgactacttcactcgcatcacgaagaccaagggcaccctgaccgtcaccaagcgggaagtcaccctgacctccgaaagtgcgtccaaagtttacgacggcaccgccctgacgaaaccggacgtcagcatcacgggcagctttgtagacggcgaagtgacgggcatcaaggccaccggttcgatcaccaaggtcggcgaggtcacaaacacgatctcctacacgactcagcccggctttgacgaaaagaattacacgatcaccattaaagaaggcaagctgaaagtcaccaaggttccggcgacaaccgccagcgtcagcgtcacagcagacagcagcagctggacctacgacggcaagacccacagcgacgacggctacaccgcggcaggccttcctgacgattacaaggaaaaaggattcagcgtcacggccacagtcgaaggcacgatcaagaacgccggcacggcggacaacaccgtcaagagcgcggcgatcgtgtacaagggcgaagacgtaaccgatcagttcgaagcgccgatcaccaagaacaacggcaccctgacggtggcaccgagatccgtcacggttgaaagtgcgagcgactctaaagtgttcgacggcaaaccgctgaccaattcgaaagtgaccatcggcggcgacggatttgtagacggtgaagtcaaagtcacagccatcggcagcattactaaggccggctcgaccgcgaacaccatcgaataccagaacctcggcagcttcaacaaagccaattacagcatcaaagaaaccctcggcaccctgacggtgacgaaaaaagccaacgccgtgacgattacggcgaagacggccgacaagccctacgacggcacagcattgacagccggctacgactggactgcgccggaaggctacaccgtcacagctcaaaccgacggcagcatcaccgacgccggcaagaccgcgaacaagatcgcgtcttaccagattctggatgcggacggcaacgacgtcaccgatcaattcgaaggcgtcaccgtaagcgacggtaccttgaaggtcaccaagcgccaggtcaccctgaccagcgccagcgccaccaaggaatacgacggcacagccttgacccgcccagacgtcacagtcggcggagacggcttcgtagacgacgaagtgagcgatatcaaagccaccggcagcattacagaagccggatcggtgaagaactccatcgcctacacgaagggcgacggcttcaaggacagcaactacgacatcacgaagacagaaggcgacttggtcgtcaaagccaatcaaacggccgcgatcgtcgtcaccgccccgacggatagcaagctttacgatggcacggccctgacagccggcgccgcaacggtcacgggcctgccgaaaggcttcagcggcaccgcaaacgccgcaggcaccatcaccgacgcgggcaccgctacggcaaccgtcgatcaggattcggtcaagatcacgaaggacggcgcagacgtgacgcgcaatttcgcgaacatcacgtacaaagaaggcaaactgaccgtcaatccgagaacggttaccctgacctccgacagtgcctcccgcgcctacaacggcgaagcgctgacgcggccagacgttacggtcggcggagacggctttgtctcaggcgaagtctcgaagatcaaagcgatcggcaccatcacggaaatcggccaggtggacaacaccatcacctacacgacgggcggcggtttcaaggccaagaactacaagatcacgaagcacgaaggccaactggcaatcaccgccaacacgacggccatcaccatcaaggcggacgacgccgaaaaggtctacgacgggaaagccctgaccgaaagcggttatacgattaccgggctgccgtcaggatttgaggctcaggtcgtcaccgaaggcagcatcaccaaggctggcaatgcggtcaacaccgtgaagacggcagtcatcaagaaagacggccgaaacgtcaccagccagttctcgggcatcacgctccagaacggcaccctggtcgtcaagccgagaccggttacggttgaaagtgcgagcgacgctaaagtgttcgacggcaaaccgctgaccaattcaaaggtcaccatcggcggccaaggatttgtagacggcgaagtcaaagtcacggcaaccggcagcattaccaaggccggctcgaccgcgaacaccatcgaataccagaacctcggcggcttcgacaagaacaactacagcattgaagaaaccctcggcaccctgacggtgaagaaacacgccaacgccgtgacgattacggcgaaaacgggcgacaaggtctacgacggcacggcactgacagccggctacgactggaccgcgccagacggctacaccgtcatcgcggacaccaagggcagcatcaccgacgccggcaagaccgcgaacaagatcgcgtcttacaagattttggatgcggacggcagcgacgtcaccgatcaatttgaaggggtcgaaatcaacgaaggcaccttaacggttaccaagcgccaggttaccctgacctccgacacggtggaaagagagtacgacggcaccgccctgaccagcccggtcgtcaccatcggcggcgacggctttgtggcaggcgaagtgagcgatatcaaagccaccggcagcatcactgaagccggatcggtgaagaacaccatcgcatacacgaaacagggcaaattcaaagccgacaactacgatatcacgatcaacgaaggcaccctgacgatcaagaagaacacgacagcgcgcatcagcgtcaccgcgccgagcgcctccaaggtttacgacggcacggccctgacagccggtaaagcggtcttctcaggactcccggccggatttgaaggcagcgcggccacagacggcacgatcaccaacgccggtacggcgaaggcgagcgtgaaccgcgtgcgcatcacgaaggacggcagagacgtgaccgatcaattcacaaacgtcacgatcaacaacggcaccctgactgttacgaagcggcctgtcaccctgacctcggcgagctacacccgcgcctacaacggcagtgagctgacccgtccgaacgtcaccgtcggcggcaagggctttgtggatggcgaagtgagcggcctcagagccaccggtgcgatcaccaagaccggatcggttaaaaacaccatcgtctacacgagaaacagcggcttcagagaaagcaattacgacatcacggttaacgaaggcaccctgaccatcactcaggttccggcacagaccgcatcggtcgtcttcacggcggcgagcggcacctggacctacgacggacaggcccacggcacaggcgacttcaccgtcaccggtctcgacaacatgcccgaaggtttcaccggtgaggccagcctccgcggcagcgtcaccaacgtcaaagacggcgtcgtcgcgaaccagttcacccgctacgcggtcatgtacaaaggcgaagacgtcaccgatcaattcgaaagcgtcaccgcccgcgaaggcacactgcagatcacaccgcggccagtcaccctgacctccgaaagcggcacccacgtctacgacggcaaggccttcactaaaccggacgtcaccattggcggccagggatttgtgaaaggcgaagcgactgcgaaggcgacgggctcgatcacgaaggtcggcagcgccgccaacaccatcgaaatccgcggcggcctgaagtacgacgaagccaattacaccattgaaaagcatgaaggcaccttgacggtcaccaagcacgaaggcaccatcgtcatcagcgccgaatcggccacccgcccgtacaacggtaaggccctgacggctggctacacggccaccgcgccggacggctacaccgtcaccgcagatattgaaggcagcatcacgaacgccggcaaagccgcgaacaaggttaaatcttacaagatcttgaacgcggacggcgaagatgtcaccgatcagtttgacgaaaacaagatcaccgtgaacgacgggaccctcgaggtcacgccgaaggcggttaaattgagcagcggcagcgccaagaaggaatacgacggcgcggccctgaccagcccggctgtcaccggcggcgaagactttgtggccggcgaagtgtcgaatctcagagccaccggctcaatcaccgatgtcggcaccactgccaacaccatcgcctacgacacaaacgacagctttaagaaaggcaattaccgcatcgaaatgcaggaaggcgaactggaagttacgaagaacactaccgcagccatccgcgtcaccgcgggcagcgcagacaagacctacgacggcacggccctgacagccggcgcagccaaggtcaccggactgccgacaggcttcagcggcacagcgaaagccaccggcagcatcactgacgccggacgcgcggacgccaccgtcgaccgcagcaccctgaccatcacaaaggacggcaaggatgtgaccgacttcttcgcaaacattgcctacgaaaagggcacgctgcgggttaacccgagagccatcaccctgacctccggcagtgcgagcaaggcttacgaccggacaccgctcaccaacagcgacatgacggtcactggagacggctttgtcaaaggcgaaggcttcagctacatcttcctcggcagccagacggaacgcggcgaaagcccgaacaccttccgctacgaagcgcaaccgggcaccaacgtcgccaattacgacatcacgaccgaatacggtacgttgagagtggatgcgccagtgctctacatcgcgaccatccattatcaggatgcaaacggcaatactttagcaccggattacatcggccagtacatggcgggcgacagcttcaatatcgcttcaccgacccttccgggctacaccgccagacagacctacgtcgtcatggcgagcatgccggaacgcgacgtcgaagtgacagtggtttacgacagaagcaccgtgccggtcacaccggtcaacccggtagtcccaggcacaccgacgacaccagcgagaccggcaacaccagccgtaccagcggcgccgggcatcccgacgaccacgaaccggttcttcacgattccgggcaacgcggcggtaccgggcaccacaccgggcggcgcagcagtcgtcccaggcgataatggcgacaccctccaggatctcgacgacgtgaagacccctaagggcctgcaggaagatctggaagcgtgcaacattctgccattcctgttcatgctgctgacgatgatcgtcgtcatcctctacaccaagatgatgaaggacgaccagcaggaaatcttcgacctcaccgaagaactcgaagacaagaaaagacaataaagccaacggacacccagatgccggcacagcgctgacatcttaagcacagccaaaaggccggccccgattaaaggggccggccttttgccgtggcgtcagttcaaaacaaaaaaccggagccgattgttcggttccggtttttgcgtcagattgctgcgataaagttgggctagcggcgtcgcctgtcgtgggcggtgtagtatttgattttgttgtcgtacatccgcttgtcggcggcgcggatcgtcccttcgatgccctttgaatcgctggtccaggcgaagcccaccgccatgcggaacttcggattgttgtccatcgcgttgaggaaacgcctccgagtgtgggcgaaggtttcctcgcggatcatcggcagcaccacgacaaattcgtcaccgcccatgcggtagacgttgtcccggccgaagtgggaggagagcagcgtcgccgcctggcacaggatgtcgtcgccggcggcgtggccgccgcggtcgttgatctgcttcaggccgttgacgtccgcgaagatgacgccggccgagatgtggttctgttccagctcgtccgttttttcgatcagggcgttgcggttgaagaccccggtcatcgcgtcactgcggctcgccagatccagcgcggcgacgagcttgtggttgatgacctgggcgccgataaaataggacaccgattcgagcacggtgcggatgttgatcatgtcggtctccttgtaattgtcggagccgaggtagccgatgagcctgccccggttgaagaagggcgcgccgatcagacgtttgatgccctggcgcttcaggttttcgtaatcggtcaagtcctccgccttcagatcctcgatgtcggaaatgacgacgcaggagtcgtgttcgaggtagatctcccagccgccgagataatcgtcgtagggcatgtgctgcagcgtgtcgatttccggcgtaatcccctcggcgcaccattcgaaggtgttgctggctgtcacgccgtcggtttcaaggacgtagaggcggtcgcactggatggtctcgcccagcttggccagggcgtggttgatgcggtcgtcgtagggaatgctgctgttcaaaatgctcgaaatttcgatgatcaagtcgtcggtggccttgacgcgctgcgcggtgtgtctttcctcgtcgaccacagcgaaggtgtaggcgaccaggtcctcgccgatgggcgcgacggtaaaagccagccagtgggcggcctctctgctgtaggtattggcgtggaccggcttgccctgggtcaccgcctcgtagcagtaggtgtaccacatcgggtcggcatccgcgaagaccttgtggaaggaacggccgatcagctggtccggtgtgcagccggacaactcgcagtaggccgcgttgacgtaggcgtagaccgcgtcggtggccttggtccgcgcttcgttcattttgacgcggaagacagcgtagggcacgggaatgtcggtgtaaatgtcgggctgataagattgaatagacatgatgtgcttccttaataaatggattgatactttttagattctaaaactaattcgggttaatctagcatttttgttaaatttattgtatcataaatacagattataagatagcatgtaaaccttaccatcgaaataacaatgcaaaatttagcttggcaagatacccgactgatccgcgggaagggttgaagccaaaaaggggggatcgttttgcgtcaagatgaaaacacgggaggcgcacgtccaaagcgcgaatgggattcggtgacgcgcctgctgagcaaaacgtcttttttagaggagatggacgcgttcatcgcgtcggcggaagcagaaggcaccttggacgattacgtcctgatcagcgtcaatatctgcaatttcaaatactacaacattaaatacgggggcaaggccggcgaccgggtcatgttcgacctcgccagccgtctcgccgagggcaaccccgacgggctcaacgggcggtttatcggcgaccgcctggctgcggtgatgcgccagcaggacgccgaggaaaaaatccgcgcgctgcagcaggggttcaaactcaaatacggccccaccggtctgacgaccaaggtcggcattttccggctgacgccggataccgacgcgctgtcggcctgcgagctggccaagctggcctgcgacacgatccggaacaagccggaggatttctgctattacaacgaacagattcggcagaacgcgagagatgtggtctatatcgttcagaatctggaccgagcgatccgcaaagggtggattcaaatttactaccagccgatggtgcggaccatcaacggctgtctctgcggcatcgaggcgctggcgcggtgggtcgatcccaaacgcggggtgatctcgccggcagggttcatcccggtgctggaggacaaccagctgattacccggctggatctctacgtgctggaccaggtctgtcgggggatgcgccaaaaaatggcggaacggtcagagctcgtgccggtttccatcaacctgtcccggctggatttcttgaactgcgacatttttcaagaggtcgaggacagcgtccggcgctacggcatcgccagagatctgctgaacctcgaagtgacggaatcgatggtgatggaggactccaatatcctgaaacgggaaatcaagcgcttccacgacgcgggctacaaaatcttcatggacgatttcggcagcggctattcgtcgctgaacgtgctgcgggattacgaatttgacgaaatcaagctcgacatgatcttcatgcgcaattttgacgaaaaggcggagcgcgtggtcagctcggccgtgtcgatggccaaaggattgggcatcgaggcgctggccgaaggcgtcgagaccaaggcacagtacgagtttctaaaacgcatcggctgcgacaaggtgcaggggtattacatcagtccgccggtgccgctggaccaattcgatgcgctgttcgaaaaaagcgacgccgtcgagccgcgccgcttcaaggcctattacgcgacggtccgccgtgtcaatttcttgacagacaagccgctgcagatcgtcgatttcgacggcaaggcttttcgtgggctttacgccaacgacgaagcccaggcggtttggcagagcctgcattttaagtcgatggatcaggtcgctgccctgctgaacgacgcgggatcgccttactacgcggagggccgggacgtcctgaacaagctgcggctggacgatccgattcggatggaattcgacgtctacggcgtctttttgggcatgcgcctccaccttctggccaaagagggtgaacatcggctgatagccatcgaagtgtccaacctcgggcagaaggatgaggaggatcagggcgacgaaaactacattttccgcctgctttttaccctgtacgacgagatctaccgtatcaatttgaagacccaggagtttatcccggtcaagcccggcgtcaattacatcgaaatgtccgacgaatgggacaagcgaggctggaagttggacttaaaggcgtcggccagaatgttcattcagctggaggatcagagcgactacatcaaattcgcggatccgacgacgatgcgggaaagaatggcgaaggcggatcggggcatcctctccgaaatgttccgctcaaaggggagaaacggcgcctacgtcatgaagctgcacaccattcagccgatgccgggaagcgactgcgtgctctacagcatgcagttcgtgccgaaggttcaggagcagattaaggccaaaacgtggcggcattcgccacaggacgcgccggatttgatccagcaggatgtctggcagaccatgtgccactctcaaaccgtcaatatcttttggaaggacaaggcgcggcgctttgtgaacgtcaacgataaattcctcgagacttacggcttgtcggaccgttcggaaatcgtcggcaagaccgacgaggatatgttctggcacgttgacgacgggccctatcgtaacgacgagctcgaggtgctccaaaagggcaagacggttgtcaatcatcttggcaagtgcatcatccacggcaagctgcacaatatcgtcgcctcgaaggagcccatttaccgagatggcgaaatcgtcgggctgctgggcgggtttgtcccgatcgacgaggtcaccccggaattgtcgggtcaggtccctgacgacgagcaggagtccggcatcgatctgatcgccgtgcagaaaaccttggcggcgtacatggaaggctgggaataccgaaaggaaaaatttgcggcggtgtcggttcaattcgacagctacaagcgggccagacagacctacggcgaggacatcgccgcgcgcatgctgacggcactgagcgaccgcattgtcgatttctgcggaaaccgcacggtcgtcatccgagggttcggcgaacatttcgtgatgctgatgaaatacgaggatagagaaacggtcgaggccttccgcaaagcgtttatcgcccgcagccgcatggtgcgcgagctggccggctacgcggaaaccctcaaccccaccgtcgtcgtctactattccgaggacgcgcgggacatcaccaacatggtggccatggcctttcagaacaagaccgtcgaggtcgaaccctttcaaaattaaaacacggttcaaacgtgctcggcacgctggcgtgccgctcaccacaggggcaggcagcgtgcacacagatcaggagacgccatgttcattaaaacaagacaaaaacgcatttttatcgcggcttttgccgtcgttgtcgtgctgctgctgctgatcgaatcgatgattcaaatccgcagcaaccgcctccagtccaaggaagccgccgaccttttgatcgatcaggcgggcaaaatcattgcgaacaacaaaaaagaagaaaaagccctgaccgaaaccctgaaggaaacctacatcacccgggcggaatccgtcgcctacatcctcgaccaccgaaacggcgccgccacgctggccgatctgaaggagatcgccagccttcaaaaagtggacgaaattcacatttttgacgtctcgggcaccatcgtcgccggcaccgagccgaaatattacggcttaaatttcgattccggggagcagatgcgctactttaagaaaatgctgacggacaagagcttgaagatgtgtcaggacgtgacgccgaacacggcggaaggcaagccgatgatgtacgctatctgctggaacgacaccggcaccaatatgatccaggtcggcatcgagccggtacgcctgctgaacgagctgcgggccaacgaaatttctgaagtggttgccaacatgacgtcctacgaggggacgatgatgattgtgacgacgaagaaggggaagattctcggcgcgacggactcggcactgaaggggaagaccatcagcgccgtcggcatcgacgcggccaaggccaaggtgatgggcggcagttatgtcacgaaggtgaacggcacccttgcctactgcacgatgaaaaccaaaagcggctaccgcattgtggtcgctcaggattggtccaacgccaacaaggacgtgccccagaccctgctgatcatcgcgagctaccttgcctttgccggcatctgcatgctccttctgctcaggcgcatggcccagcgagtcgcggaagagcatcgcgaagcgactaccgacgcgatgaccggctttctcaaccggcgcgcctacgcggaggtggaggcggctcagactgaagatgccgatccgaacctgatgtacgtctacgccgacatcaacggcttgaaggccactaacgataccctcggccataacgccggggacgagctgatcacggcggcggcccgctgtatggcggcaagcttcggcgatttcggcaggctgtaccgggtcggcggcgacgaattcatcgccgtgatagccgttccgacggaacagcgcgggacggtgatggccgattttgcagcgcgggtcggcgcgtggcgtggcagcctcgtcccgtcgctgtccgtgtcctacggcagcgcctctcggcacgaatttccagacgccgcaatcggcgaactgcagcacattgcggagacgcggatgtaccagatgaaacggcagtattacgaggaaagcggcgaagaccgcagaaaaaattgataagtcgaatcaaacgaacaaccaaaggccccgcggcattgccgcgaggcctttggtgtaatagggaaaacagctgatattaatcgacgtcgtagacgccttttcgaatggccgcttcggcctgttccggtgtgccgggctttccgaagtaaaagccttggatcaggtcgcagttcagcgcattcagcaggtcgcgctgggccttcgtttccacgccctcgcagagggcgaccttgccgtcgtcgtgaatcagtgtgatcacgtccttcaggaagggatcgtcctttttggcgctgtggctgtcaaggagggatttgtcgattttcacctcgctgaccggcagccgctgcagcatgctcagggaggagtagccggtgccgaaatcgtccatcatgaaccgcacgcctatttctttggcggccttaaaaaagttctcggcctcctgttccttcttgatgaacaggctttcggtgacctcgaggcggatggcgtcgacgggcaccgcgtacatcacgaggcagcgctttaagaacatcagaaagtcggtgtcgccgagctgcccggccgaaaaattgatcgagaccggcggcggggtgaggtgcttgttgcgccagacacagatctggcggatggtcagctcggttgtgatgcggccgatttgctgaatccaaccgttttcctcggcgatcgggatgaagatgccgggacttaaggcgccgcttttcatgcgggcgagggcttcgaagccggtcagtctgccggtggcggtttcgacctgaggctggtagaccatgcagaacccgttgtgctcgatggcgtccagcacggagagacgggtctgttccgcggcggccgcttcttgtttcatgcgctggctgtagaagatgcaggcgtttttccccttgttcttgcccgcctgcatggccgtttcgcaccagaggagcacgtctttgtaggtgtggcccggttcggagttggcggcggtaatgcaggcacgcagctgaagggtgtccatgccgacggagcgtcggcggctgaagaggttctggatctgatggagcatcgggtcgtcttcctgaagttcggcatccgggaagaagagcatgaaggcgtcaccgctgtaccgggctgccgcgccgccgtgggccgcagccagatcgctgagctcttcggcgatgtttttgagcagcacgtcgccgacggtgtggccgtaaacttcgttgatgtctttgaaattgtcgaggtcggtggtcacgatcgcgtagggctggtcctggaggtcgagctcatccagacgcttactggcggcctgccgggtgtagacggccgtgagggggtcgtgggcgttggcgaagctgagccggttcgtcaattttttcagatgtttttcgttgtgcttgcgaatgcggatgtccagacgggcgccgacaaagatcaacacaaagccggcgagaatgacgaggatcgaatagatgaccgtcttgtaggagccggcgtagtaggattccggcgcgccgaccaggaccgtgtggctcggcaggtcgtcgagatccaaattaaattttttcatcgtcggatagttcgccacgtagaccgaattggaaagggacttggtcacgccgaccttcgcgagctgggtcgtgccgttcagcgttcggctcatcaggcggacggcggcggccgctgtgcttctgtaggacgagacttggccggccaccgcgccgttgctgtagccgcctttgctgttcctgaaaactggcactgccgccgcgttggagacggttcgggtgatttccgcggcggtgtaataattgccgtcttggtcgacgtgggcgctcatcaagaggataatcgtgccctttttgtaggccgagacggcctttcgcaggcttgcgttggtgtagtgttcgaggtccagcgtttcaaaatcgagaccggcgtattgctttttcttggacaggctgttgaaaatttcggcctcggtggtgccgagggcactttcgtcgtggatggcgaccacccgcttggtgccgggcagaagctttttcgccatgtcgagggtggcagcgatgtggctgctttccagataaccggtaatgttcggatttttggccgcggttttacccagcgtttgatcgatcacgccgaaaaagacaacaggcagccccttgaagaaatcgttttgatgattcatcacgtattgcagtgccggatcgccggcagtgatgacgccgcggtaatgggtcgacgcgaggcggcgctgaacggtctggtcgaggatggcgtaatcttccggatcgtcatgcttggctgcgtccatgttgatcacgtcgaattcgatgttgttggcgtcactgactgagagcaggccggtaatttgatcttgataatagctgctggtggggtcgtaggaggcgatgaagaggacgcggtccgtcctttggcgggaggcgtcactgaaggcggcgttgtcgctgtagcgggccgcgccggaaatgttgacagagttttcctcgacggcgcgttcgttggtttgaatctgatgatacagtgcaaccacaagaaaaatcacgccgacgacgataacagtgtagccacaggtcgtgaaaaaacgactccaattgaattttttgcgcagccccattgtgttattccctcacttcgataaatcaagtattagattaagataaaagatatatggcgtgtgccattattatacgcttttcagaaataatttactataaaaaagtgtacaaaattgtaaaattgatcgtaaaaatgaaaataatcatgttaagcgaaaagcaaagaaattatgtaaaaataaaaaaggaagacagctgccatttttaatgtaaattggttagaattgtttgtaatccttataaagtgcatggtatactataaggtaacataacacgcgaaaaaataagatagatgttttttcgtgagaccacaataatcagcgctgagacccaattgggggtcccacagcgcacagaaagatagaaaaaccatgccagcattttattattacacgatatatctgatgcttgaaatcctctgcggcgtgcagaccgcggtgatggccgtcaggatgaacggcaatattggctattcggccgaggtgcgggccttccaccagctgtcgttctgcctgatcgtcgaggtgatcgccgagtgcatgtggcttttgctgacccggcgcaccggggcgggggtgcgcgcgctgctgtacttcagctgcacggcggatctgctctgcattggctacactgtttatttctggtaccgcttcatggacgtccgggtcacgccgcgggcaaagcttcttcggcggccccgcgtcgtcgacgtgttttgggctattcccgtcgcggtgatgacggtgctggacgggctgtccccgatcaccgggatgacctttacgctgtccgccggcggcgtctaccagcgggaaccgtggttcccgcttcacgccctctgctgctttgtctacgcggtgccggtgcttcatttggtcattcagagctggaagcagcaggacatcgatcggcagcgcttcaggatgtacctaattttcccgatccttttggttatcggcggcatccttcaaattgctgttagatgggcacccttttcaacggtcaccttcactttcgggatgtttctgctgttcagctcgctgcagcagcggcggatcaacaccgacgccctgacccggctgaacaaccgggccggcgccaaggcctatttgacgggccggctcgagcgggcggaaagcgagcccttttacctgttcatggccgacgtcgacaaattcaaggagatcaacgaccggtacggccacatcatgggcgacgaggcgctgatcctggtttcggacatgctgcggggtctggccaagcagtaccagagcctgttcatctcccggttcggcggggacgagtttttgttcacgatttcggaaaccgaggtggacccgatgacgctgatccgcgagtattcggaggcgctggcaggcgctatccgcacgtcggggtacggcttccatttcacgatcagcatcggctacgccctggccgaccaaaacgatattaaattagaggccctgatccgcaaggcggacacagggctgtacactgaaaaagaacgcaaagcgcgttaaactaatcaatcaatggagaaaggagaaacggcgttgacgagcacatttcaaaccgaagactaccatagattgtacgatatattgaaggtgggcgtgtgcatggtgtcccaagacggggacgagaccattctttttgccaatcaggccattttggatttttacggctgtgcggatgaaacggcgtttttcgaactgaccggcggacgttttaccggcatgcagctgaatcaggacgcgtccctcgccaaaaccgcgggggatcagcagcatttctcactgcatttctcgtacatgaatgcgcgccgtcacatccgcgaggcggaagccacaatttcccgagcggtgctgcaggatcggccggtttacatcgttcaaatggtcacccggcggatgctgacagaggacaccgcgccggaccggctcaccggtctgctggcgccgaaggcctttttccagaaagcgatggacctgtccaagatgaatttggaccgcggcatctttacggatttttgtccgacctgcttcaacgtcgcgaatttccggggctttaaccggaacaacggcacggcggagggagacaaggccctgagctttatcgcccagaccctgcgccgcgtctttccggatgggcttttcggccacatcaacgccgacaccttctacgcgattttgcccagagcggacttgaccctcaagatcgaggaagcctgcggggaagtcaaccgtttcctcggcggctcgaccagcgtgctgaaggccggtatcgtggtttacgaccagccggcaccgatgtcggagatccgccacagcttcgacatggcgaagatggcctgcgacgaagtgaaaaaagaagacgggcgggactacgtcgtgttccgcaaagccatccaggagcgcatcgaaaagcgcgcctatattctcagcaccttcgaccaggcgctggcggacggccggatcaaaattatctatcagcccgtcgtgcgtctcctttcgggcaaggtctgcagcattaaggcttcccctcactgggaagacccggccgaagggacgatcgaccccgagattttcagaccggtgctggcggacgcccgccttttgggacgtctggacctttttgtcatcgaccgcgtggttcaaatgcagcacgaacggaagcagaacgggctgcggctcacgccgattgccgtcagactctcccgcctcagcttggagatgatgaacccgctggaacacctggagtcggcgatgcaggcctgcgacctgccccggtcctgcgtgctcatcgggctcacagaggacgtgatcaacgacgaagccggcaccaccctccggacgattcggcagtttcaaaaggcgggctacgaaatttggctcgatcggcttggcatggaggatttgtcgaacacagcgctgtacgaaagccggtttaacctgatccaattaggcaagcagtttctcgaccgtttagacgaaaggggccggacaattgtcggcgacatcgtgcggatggccaagcatctcggcgtgcacaccctggtcgacggggtggccacggctgagcaggtcgacttcctgaaatccgtcggctgcgggaaaatcgcggggccttactgcgggaagccggtggtttactcggaactgaccgcggccctcagacagcagggcgttgaaacggaaaacaatctggagcagtccgtttaccgggcggcggaactggtcgacattgcctcagaacgtcccctttgtctgttcctggtggaccacggcgagatccggatgctgacgatgaacaaggcctgcctcgctgaggcggcaaaggccggccttccccgcgaagcggcgtgggcgttcttttttaaagaacggcagcagaccttttcgacccgatttacccaggcggtcgaaaagacctaccacgatgggaagaatttgatccgctttgtggtgaaaaaacaggtgatgcagttgacaaccagccgcatcgccggggttccggatttctgggttggcggcgcggagctcgtccacatcgcgtcgaattatgccaatcgggagcatctccagttcgaccacttggtccacagcgccgcagcgatttccgaccacgtcttttatttggacacggcaaaggaccaaatcgaagtggttgccagcgtcggaccgcgtttcgccgttggtcagaccttccatggcatcgccgggatccttgacgccttctgccggcagtacgtccacgccgacgatcaaaagcgtttcaaggccgcggccgacatagaggcgctgaaacggcgggtgcagcagtccgcgtacgggcgggttgaggtgctttttcgggtgcgccagtccgacggcgcctaccattggattgtctgccgggtggtgctggtcagcgacgacgacgtggacagtctcatgatttacgagtggcaggacgtttgggaaaacctgccggacggcgaggcgcgtttggccaggacgggcgcgaagcattcggagactcggcagggccatctgttcgagtcagtgctgcgctattcggagctgcccttctattggaaggacaccgcgcaccgctacgcgggcgcgagcgaggcctttctcgaattgatcggctcgcgctcggaggcggagctgatcggcaaaacggccgagttctttaattggcacaccaatccgaaagccgcggaacaggcggaacgccgagtcatcctcgaagggaagactgtggcggcagcgcgccggcacgtattagttgggggaagagagctggtgttccgcgttacggaattcccgtattacgatgaggacggcagcaccattgcgggcgttgccggctggattcgccaggagggcggcgccgaggaagcacaccgcgacgaccgaacggggttgatgaacgcggcgggcatcttggcggcaggcttcgcctttgacgatgccctgcgtcagagcggccgaggatacggtgcggtgattcttgtgatccgaaacgctgctgcgcttcgccaaacctttggacaggcttttgtagacaaggcagaaaaagcggtcgccgaccggatcgcagacggcagattgcccagcggcgtggctgcggcccgcatccgcgacggatattttctgattctgggaaaagaccgggccatgctgaagctggagaaatggtcgattcaagtggtggaagacgttcagacgctcaggaaaatcgacggtctgccctgtcagatcgaactggaccgtgcgatcggatcaggcgtcgaagccaagggctttctcaacttgctcgagatcctcatgcggcggggcgaacaatggcgccagtcgaaggacgttcttttcagcgaggtttgggagacagccggcatcaaagcggacgacctcgacgttttgcccgaacctgcattcatcgtcgatccggcaacgcggcagctgctctttgtcaaccaagccatgaaacaaacggcgggcctgccggaggatgcggatttcatcggcagatcctgctttgaactgcggggcaaaacccagccctgtctcggctgtaaaatgcagcgggcggcgaatggccggttcgattcttacgaaaatcagtggcacgacaccatcggccgaaccttcagtgtgaagaacgtgccggtactttggaaagggcgcagtgcgcggctgattctcggcgaaccggtggtgatttctgacaacgaacagacgacgaagaacgccattttagaggccgaacgctggggcaatgcggccattgccatcggtctcggcgaacccgacgccgaggtgggaattgagaaatgcattgcctatatcgcacaaaatctgcacgctgagcggttctttatctttgaagagcgaggaagccgcgaggcgacctgcagctacgagtggaaagaagcggggcgtctgcctttgaagggcgaattgcaaagtgtgttgacgcagaatctcgccgctttgtttaaagcctttgagacgcagaaagtggtgctggctgcggattacgccgcctttcaacgcgaatatccgggcttttcattgccggttgcgaacgttcagaattttgtagccgggcagctgcttcaggccggcaagcccgtgggctttacgctgttgaccaatttggcagccaaaagctttgaaccggccggctacacgctggatacactgacggatttcttcgcagtcatgattcgcatccgcaacaatctcagagaggcggaagagcagggccggcgagaccatatgacgggcgtactgaaccgacggggcttcaagcattacgtcgccgaaagctatttcgtcggaccgcgggtttttttgtcctgcgatatcaacgggctgaagactgtcaacgacacccagggacatgaggccggcgatcagttgatccagaatgcctcggccattctggtccgccacggggaccgcgatcacgtgttccgcatgggcggcgacgaatttctcgtgatccgagaggggatggacgaaggtggtgcacggcagatcgtgcaggcgatcaaaaacgacgcccgccgcgccggcttcaccatttcgattggctacgtggtccacactggccccatcgacgatctcgatacggtgatgcgggacgctgaccgggcgatgtacgcagacaaggggcgcacccacagaaggcggcggacggaccagaaggactgagcgccaaatgcgtaaaatggactagaaatgaaacaatgcaggcatcattaaatgtggagtaaagccatgagtgaacttgaacatttaattcaatgggttgaacacgcacggcacgccgttgcggtttaccagtacgttgacggtaaggtgaagacggtctgtgtctcggacgggctgtttgagatgatgcacagccccgacgagctggacaaggcggccttgatcgcccggtacgccacgaacatgtaccgcaacaccgtccccgaggacgccgcccgggtcgcgtccgaggcgaagcgcttcgcccagcagggcggccggtacgaggtgatctaccgcgaaaaggtgtaccagcgggagacctactcgctgacccactcggtgggcttccactactatctggaggacgggacacgcgtcgcaatagtagtctacacctgtattgacgaggcagtcagcgaacatcaactggcggagcagaaatccgaaaatgccctccgcaattttttggaccacagcaacatcgccattgcgatcgtcagtcaggcagacggcgagctgttgtactgcaaccggccgatgcagcgggcgctcaagccgatcaacaatttcgataccggcatgacgctgccggtgtacgtcaagggctgtgaggatccgaccatgctcaactatctcgcggacatcgagggccggggcaatcagctggcgcacatcggcggtacagatgccgtgcttcgggtgacggcgatggaatgggaggagcaggctgtttacgtcatcgagtccgatccctgggatacgctctaccacaacgcgctcaccggcctgcccaacatgtcctggttccgctaccgcgtgagtgaatgcatgcgtcgaatccgggaaagcggcggcgaagcggttttcatctacatcaatttgtacgggatgcggggctacaattcgaaatttggcttttcagcgggagaccgcattctgaaacggctcgcgaaaacgctgaaacaggtctttgacggcgatttgatctgccacctgtccgaggatcacttcatggtgctgactcaaaacgacaatctggagggcagactgagcaccgcccgcaacgagatccgaaaggctgctcagggaaaattcctcgcattcaaggcagggatttaccttgaccctgtgatggcggcggacgaccaggagcaatacatctccgaggcctacgaccgcgcgcggctcgcctgcgccacgatcaagaaaaacggcagaaaagcctgggcctattttgacggcaaggtggcggacgcgtacgagcatcagctttacattctcgatcatttccagcaggcgatggacgagcggtggatcgaggtctattaccagccggtctatcgggtcgacacccggcagctggtagggtacgaatgtctggcgcggtggcgcgacccggaaagcggcctgatttcgccggctgacttcatcccgattctggaacagcatcatctcatcggcttgttagatgagtacatcctggacaccgtctgccgggaaacggcggcgcggcaagaaaaaggcctgggagatattcccgtctccttcaatatcagccgggatgacttcaattatggagacgtcttccaaaaggtgtgtgacaccacggcgaaatacggcgtcgcgccgcatctgatcaacattgaaatcacagagagcgccttttccgacgagccggattatatcggccagcaggtgaagcgctttcgaaaggtgggcttcagcgtttggatggatgatttcggcagcgaatactcttctctcggtaccctgcaaaagatggacgtagacctgattaaactcgatacccggttcctccaggcctgtgaggaagaagagaaaagcggcggtcaccgcgcggcagacctgctcaaggcggtgattcagctggttaaggccctggggctctccaccctttgcgaaggagtggaaaccgaggcacaaatggcgcttttgagggaatacggctgcgaaaaagctcagggttattttctgggcaggcctcagcccttaaagaaaattaaaatcatatagatgtatggtcaagatgcgttataatagaggacacacggaacaagaattaaagcgggaaggtctgactgtctcaggcggcctctggcagggtctgtcagtcggatacggaacgcgcgcacacgagaggtgtgacaaatgaataagaaaaagaaaaaagcaaaaaagaatcagaaccgcaagaaaaaggaagcgctcctgagaggggcagccgcgacaggtgtcgccctcggcgggacagcggcgttcggccaaggaaacatggtctacgcggcggtgtcgcagtctgaggccggttcgcagctggacagcgttttggaacagacgtcggcgtctgaatcgaaggtcgaatccgtctcggcgtcgacgacggaatccgcggcgccgagcacgagtcagtctcagtcagcagcgtacgctaaaaaggccgtcagcaccgacagtgaagcggttcaggacacggctggcagtgccgcatctgcggccgatgaaacgtccgcctcggcgtccatttccgcggcccagtccgacagtgcggcggattcgatgagccagtccgacagcgcccaggacagcgaagcttcggacgcggcttcagccagcacggctgtatctcaaagcggctcccagtccggctcgagcgccggctcccagtcgcacgccgtgtccgcttcgggcagcacggcggtcagtcagtcggcggtgcagtcggtttcggtgtcggcggcggccagccagtcggtctcgaccgtgaattccgttcaagacgaagcggacaccaagagcctgtcggaagcggccagccagatcacgtctatgagcgtttcaagaaatgatgacagccagaacgcctcagaaagcgattcgctctcggctgcggccagcgaacagcagagccggacccggtccgattcggccagcacgagcgcatcggtctcccagcaccaatcggactcggccattaccagcgcgagcggttctgcctccgcctcgaccagccgggccatgatgaacggctcggtctctgaggaagccagcttatccgcctcagattcggcagaagcgtcggcagcgaccagcgcagtggtgtcggaatcggttcacggctcggaacagctgagtcaggaagtttcgcagtccgtctcggaatccgcgtcggacagcgccagcgcgcgaacgtcggcttcggcttcactttctgcctcggccagccagagcaccgaacacagccggtcggcttctgaaagccagcgggcgtccgtctcgacttcagagtctctgtcgggcagtgccagtgcctcggcctcggcgagcgaggcggcgggcatcgaaagggtcaccaaggtcaaggtcttcgaatacacaaacacgtccaacggcacgatcaccaagatgaccgggacccttgacctcgaaaccggtgtgatccactggacctttgattacgcagcaaaagacgcggatcagatcagatggtcctggtggggaacgaaatctaaaccgaatcagtatcagtactttggtttttatctgaatgtcgttggcggcgccgaagcgccggccaacatcaccgtgaccgacgctggcggcaacatatacacgctggacaacggtggatttgcccaaaacaacgattcttacagccggacacaggttgatccggccaccggcgaaaggaaaaagcagtctctcgggtccaacatcacgaccctcgattacaagggacggtattggggcgacagctactcgacgacggaaaaaatcaacgtcgacgggacagtgacggtcgaatttgacacgtcgctcggcgattacgaagaatggggcaaagccattgccaacgtcgtcgtcagcgtgcaggcgacctccagcaccgaagcgacccattggagcagcgacgcaggcggctacaccattcacccgaccgttgcggaaagcgccagcgggacggaacagaccaaccgcggggtcgtggtcatcacgccggaaggcaattacacccacgaagcccagagcgtcagtgagctggcatcgatgtcccagtcgacagtccagtccgtttcggccaagcagagcgaatcggcgtcaaacaaagccagccaatcggcttcgactcagagcagccagtcggccagccagagcgtcagccgctcagcttctcagagccagagcaccagccgcgcttcggaaagccggagccagtcggtgtcccagagcctttcgaatcaggtgtcccggtcggtgtccttgagccagtcccagtctgtcaagcaatcagagcaggcaagcacttcgcaatcggccagcgtcagcgcgtcacaaagcattgcaagcgacgccagcgcttcggtcagccagtctcaggaagcctccgaatcggccagcgccagcacatcggcatctgaaagcctgtcaacggtacagtcacagtcggaaagcgccgcatcagagtcggcttcgcaaagcggcagtatcgccagtgcgtcgaccagtgccagcaccagcaaatcgaccagcctctcggcgtccgcgtcacacagcgaagacgcagtgtcccaaagtgcgtcagtcagcaatgccacggccagtgaaagcgccagcgtgtcggaacgggattccgaaaacgcctctcagagcggcagtgcgtcgaaatccgcgtcgctcagcgcgtcagaacgcgattcacaaagcacgagcgctagtgaaagtggcagcgaaagcttaagcggtgtcacgagtgaatcggtcagcgccagcgaaagtacgtcggcgtcgcagagcgcgagcgaaagccggtcggcttccttgtcaaacagccaaagcgaaagaacctcactttcgatcagtaccagcacatccgcaagtgattcagcctccgaatcggccagcacgtcgtcttcagaatcgacaagtacttcgatcagcacaagcgaatcggaatcaacttcgagctcagaatccgaaagcgaatcagtcagcacgagcgaatcagaatcgatcagcagctccgaaagcgaaagtagctctgaatccgaaagtgaatccacaagcatcagcgaatcggaatcagaaagcacatcagaatctgaaagcgaatcggtcagcagttctgaaagcgaaagcacatccgaatctgaaagcgaatcagtcagcacgagcgaatccgaatctgaatcgatcagcagttccgaaagcgaaagcacgtcagaatccgaaagcgaatctacaagcatcagtgaatcggaatcagaaagcacatcagaatctgaaagcgaatcagtcagcacgagcgaatcggaatcgacttcgacatccgaatctgaaagcgaatcgacgagcgccagcgaatccgaatccacttcgaactctgaatcggaaagcgaatcgatcagcacgagcgaatccgaatctgaatctacgtctgaatctgaaagtgaatccataagtacgagcgaatccgaatcgacatcaacgtctgaatccgaaagcgaatcaaccagcacgagtgaatcggaatccacgtctgaatccgaaagtgaatccgtaagtacgagcgaatcggaatccacttcgagctctgaatccgaaagcgaatcggtcagcacgagtgaatcggaatctacttcgacatccgaatccgaaagtgaatcagtgagcacgagtgaatctgaatcggaatccacttcaacgtccgaatctgaaagcacatcggtcagcacaagcgaatcagaatcagcatccgaatccgcgtccgaatccgaaagcgaatcgatcagcacaagcgaatcggaatccacttcagcatcagaatccgaaagcgaatcgacaagcacgagcgaatccgaatccacgtccgaatccgaaagtgaatcggcaagcgcgagcgaatcggaatccacttcagcatcagaatccgaaagcgaatcgatcagcacgagtgaatcggaatccgcgtccgaatctgaaagcgaatcagtaagcacaagcgaatcggaatccgcgtccgaatctgaaagtgaatcgacaagcgcgagcgaatccgaatccacttcgagttctgaatccgaaagtgaatcgacgagcgcgagcgaatcggaatcggaatccacgtctgaatctgaaagcgaatcggcaagcataagcgaatcagcatcgacagcgaagtctgaatctgaatcagtgtctacagcgaagtcggaaagcgaatcggcgtctacagctaaattggaatctgaatcagcttcgacgagcgcgagcgcatcagcaagtggctcaaccagtgcaagcaacagtgcttcgacgtcaacgagtgaatcggcttcgacgagcacgagcacctcggttagcacttcaacgagtgtgtccgcaagcaactcaacgagtgcgtcgaacagcgcaagtacaagtgcttcgacgtcaacgagcggatcagcttcaacaagcgccagcacatcggcaggcaactcaacgagtgcatcgaacagcgcaagtacaagcgcttcaacctcaacgagcggatcagcttcgacaagcgccagcacatcggcaagcaactcaacgagtgcgtcgaacagtgcaagtacaagtgtttcggcctcaacgagcggatcagcttcgacaagcgccagcacgtcggcaagcaactcaacgagtgcatcgaacagcgcaagtaccagcgcatcggcctcgacgagtgaatcggcttcgacaagtgcaagcacatcagcaagtgcctcggtcagcggctcagcgtcggcctcacagtcggcgagtgccagcggatcggtcagcgccagcacttcagtgagcacgtcggcgtccgtatcggcgtcggctgcggcgccagttgccgcttcggcggcggttgcaggctcagccgcgtctgcggcaagcgcgagcaccgcttcccagaatacctcgacatcaacgaacttctcggcatcgacgagcgaaagcacgttggcgtcggaagtagacgaaagcacccgcgcaagccagcgggccagctccagcgacagcgcgagcgcggcggccagcgaaagcaaatcggcctcggcctcgacggcggcgtctgaatcagaaacggaaaacagcaacagcgtatccaacagtgtgcgcatgtccactgaagattcactgagcgcctcgtccagtaacaatgtgacgggcagcacggcggtgtccggcagcggcgccagcgcggcaacgaccgcggcttcggccgacggcacagcgtcaggcaacgcggcagcatccgctgaaatcgacaatttggacggtgtcgtaccactgcaggtcatcaaacgatagaggtttaggtgcctaaaaggttctagacagaaaaaaacagtgcggtataataaaatgagcaatgccgttgttggctaatgttggttgttgagattgacattacgtctcagcggattgctcattatttatttggactatcagatgattcagcgggtttcggcggaaaatcggctgggctcagcgaatcgcttcagggaaaggaggaaagccaacagtatggaaatccaaaagacacatgaactgagcaagcgtatcctttttacgatttttgtgctggtggtttatctgacgggcaaaaatatcctcttgtacggcgtttcggccggaggcgggcgtctcatcggggtcacggtccagtcgtcgctgacgatgatgttcagcggcgaccgctatcaacggaccatcatggccctcggcatcatgccctacatcaacgcctcgctgctggtccaggtcatttcggcgctgaaaagcgccaacagccgggcgaaaatatccaagcagaagcaggaccgctggatgttcatcgccgccttggccatcacggtgctgatggccgtcgtccaatcggcggatctgaccttccgtgccagcgcgggcccgctgttctgggtccggctgatcgtgattctcgagatgattggcggggcgatgctgacctatgccctgtgcacagccaacgaaaagcgcgggatcggcgccccgatgccgattatcctgctcaacgtattgacgacgctgattgaaaacctgagcgtccaccactacacccattacccggtgctgattgccatcagcgcggtggtcgtggcgggcacagcgtttttggaaaattcgatcatcaaggtgccgctgcagcgggtctctatccacaacattcacgccgaccagaattacatggcctacaagcgcaatccggtcgggatcatgcccgtcatgttcgcgacggcggcctttatcgtaccccgttacgcggtccggctgctggcctacctgtttccggaaagccagtctttagcggaaatccgccagaacatggtgatgacgcggccgctggggatcggtgtgtacctggtcatcattttcgttttgacgatcggcttttcctttatcatgttgaaccccaaggaaagcgcgcgccagcttcagaaaaacggcgacagcatcgtcgggatttacgcgggaaagaaaacgacgcggtatctggtcggcctcgtgctgaaatggagcgtgatcagcggctgcctgcaggcggggtgtatggcggtgtcgctgatcctatcgctgcagggcgccattccgacagcgttggcgatgattccgtcttccgcgatgattctcgtcagtattgtctgcagtttggtgcaggaaatcggcacgtaccaccgctacgacgcgtatcacttctttatgtgacagacagagcttaaaaggcagaaaaaaggaggactcatgcagtattttattccagcttggtaccagaacggcgactggaaggaaaacgagcaggcctggtaccgcgccagaaccgtgacggaatttgacgacacggtgaagcagatccagctgtttttcagaaagcacgtcgcgccttttgaaatactgctgctgggtttttctccgaatttccgccattttctgcaccgacagggcgtttaccacgcgccctattggtcctgctttgacgcgatgcagggcatcacggaaaaagacattgcgatgttttccttccacgatttgtcgtggccggaggacgtggaatttatctattcgccctttgcggtgatcgtcaaacggggcgacgaaaagtacgcgcagattgagttcgctgaggacggcaatatgttccgcgttgacatgtttaaacatcaggtgcggacgtgcagcaatatttacgacgaccgcgggttcatctcctgtcagatcgtgtaccgaggcggggtgccctaccgggaacagtatttcgacgagacgggcgtatggaaattcgcgcggtttttggacgacggccacgttaccatcaacccggaaagcagctggtacgtcgtgaataccgacggcgaatttgtccacgtcccttacaaaaagccgcgctaccgcaaaatcgacgagatgatcgccgaggtgatgcaggaaaatctgcggcacatatcggcgttcgacggcttcttgatcgcgatgcacccgctgcacgcaggggtgctcgccgaaacgatgcagcatcataaaacagtgctgtcctttttcggacggcggctggacgaatgcggcatcgggaaaatggacaaaaggctgatcgccgaggccgacgtcatcgtcgcggacaagcaggcgacggcccatcagatccgccagcagctgggggatgacggcctcgcgatccgcgtgatcacgccctacgactcccgacaggagttgggcaacagcctgcacctgcaggtgcagaatattctgctggcggtcgaccagatcgccgacgccgatttcgccgagctggttgtgcgcctcgcggactacgtgacccagcgcaatcatcgggccagaatttgtctctttacgcgctcgtcgcgctacaacgagcggggacggctgatgcagaaggcgcgcaatgccctccgggccgcggacagggatccggatttggccagagaggacgaaggcgtgaccgagagccagatcgacatgcagggccgggcgcaggcggtgttttccgtcgcccaatgcgtcgacgaaatgtcggtcagccgaacgctgagagagcagcgcgtcctcgtcgaccttcaggctgtgcccgaccaattcctgcagatttcggccatgagcatcggcctgccgcagatcaccgcccaggagacggactacatcgcggatggccagaacggcattgtgattcacgatgccagcgagctgcccgacgcggtggattattacctgagcagcatcgcacacttcaatcaggcgcagatcgcgtcctacgagctgggcaatcagtttacaacgggtcagctcgtccaatcctggaaggaggttattcagagcattgaacatcagagcactgcagctgggtcccactgatttttcacaccagttcgcgattacgcccgacgcccagtgggcttacgagccggcgctcagctttgaagaccccgagtacgattttgcagtgatcgaccgcatcctgaccgaccaggaagcggtgatcctgtcccgaattgtccgggcgcacagcctattcgtcctcgacagtgtcccgctgtcgaaaaaaatggcgttcatgatgaagagtcggtgcgggagcgttgtggcgcgtcaggatttaaagaacctgctcgaggtgcggctgcccaattttttcgggcgcccctacggggaaaaatttgacccccacaccctggcggtcgcgccgggttttcaagggaaggtgtgctggcacgggttcaccgaggctgtgctcacaggctttttcggcgaccagatgcggcaggccgccttttggcgcggcaacatcccggtggaagcgggacaggcgatcgatttctggctggaatacgaaaaggacgacagcgtgaccatcgagctgcagattgtgcagtttgtcaccggcagcgtctccgccgttcagaagatatggaccttcgacgagaaggcgatgcgccgcccggtgacgatcgacaatcccaaccaggacggcccggtgttcgtttccctcaacgccaagggcaggggcaaactgcgcattgtcgcgctgcacgaccggtattcacggcgcggcgaaggggcctttctgccgaaaagcgagcgcgtggttaccagcagccgggaggaaatttttgcctatttggatcccggcgatttaaagccgccgctgtgcgtgtacttttcggggtacaaaacgatggaaggctttgaaggctaccggatgatgcgcagaatgggtgtcccctttctgctgatcagcgagtcgcggctggagggcggtgccttttatctgggcaccgacgagtacgaacacaagttgcggttcgtcatcgaggcggcgatgcgcaggctgggcttcaatcgggatcaggtcattttttccggcctttcgatgggcaccttcggcgccctgtattacgggacgacgatccggccggcctacatcatcgtcggcaagcccctggtcagcctcggcaacatggccgtggcggagcggctggaccggccgggcggctttccgacgtctttagacgtgctgtggaagcagtacggcagtctggacgccaacgcggtcgaccggatgaaccggcgcttctggacgaaatttgaccggaccgactggtcgggcagaacgttttgcgccgcctacatgatcgaggacgactacgacgcggacgcctacgcccagctgatctcccacgtcagggggcggggcgccaaggtgatcggcaaagggctgcacgggcgtcacaacgacgacacttcgggcgtcgtcaattggttcctccggcagtacagacgggtgctccaggacggatttggcagaaagcaggacgacaatggcgaaacaaaataagcagtggaccgtgtactggaatgaatacaccgcggacacctatctgtacggcaccgagattgaatttattgccccggacgacgtggcctttcaaaacgcgctgatgccgccgggcaccgtcatcaaaacctggtactcgatggtcaattttcaggcgggccgcgtggagccgaccctgccgattatcgacggcgagggccgctatcacgtgtcgacagcgttcgactgcgacgtccccggcggcattttcctgcggctggtatttttagggaaaaacggagatgaagccggcagtctggtcgtcgatcagccggagatgaatttcaggtgtccgctgaaaacctacagttacgaggcccagctgatatgcgctggggctcacgcgtttcattttcattcctttacgatttcagaaagaacggaataaacatgtcagacagacggttgaacaatctagtcaaaaaagtgaaggcctacgccaaacggatgcgcggcttgacagacgaacagcttcaggcggagacgccgaagctgaaggcccagctgaaaaacgggaaaactttggcccagattctgccggaggccttcgcggcgatctgcgaggccgaccggcgggtcctcggcaaattcccctacgacgtgcagattttcggcgccgtcgcgatggaacagggctatctcgccgagatgaacaccggcgagggcaagacgctgacggcgacgctgccgctgtacctgaacgcgttgaccggcaagagcacgatcctcgtaaccgcgaacgaatacctggcctaccgtgacgctgacgaaatgcgcccggtttttaagttcatggggctggaagaacgcgccggcgtgtcccagcggccgggggaatttctgaccaacgaccagaagcgggccaactacaacgccgacattttgtacaccacccacagcgccctggccttcgactacctgttgaacaacctggtgatgcgggcggaggatcggttcctccgcgatttttatttcatcatcatcgacgaggccgattctgtgcttttggacggggcgcagatgccgctggtcatctccggctcgccccgggtccagtccaatttgtaccagatggcggactttttcgtgtccacccttcaggaagaccgggactacgaaaccgaggacaagggcgtctggctgacggaccgaggtgttcagtacgcggaacgctttttcggggtgcagtccttttacgaccacgacaatttcgagctcaaccgccacgtcacgctggcgctgcgggcccacgtcctgttcgagcggcagaacgactacatggtctccgaccaggacgaaatcgtcctgctggacaacagcaccgggcggagcctgccgggcatgaagctcagaggcggcgaacaccaggcgctggagcagaaagaacacgtcaagctctctcaggaacagcgctccgtcgcgtcgatcacctaccagaatctctttctgatgtttccgaaaatgtgcggcatgagcggaactatttccgacgcgaaaagggaactgcggagcgtctaccacaaaaaggtagtgatcgtgccgccccacagaaagctgcagcgcatcgaccggaaggaccggtatttcgtcacggccgaggaacagtaccaggcggcgctggaggaaaccctgcgtcggcaccaaaccggacagccggtgctcatcgttacggccacgattcaggatacgcagattttttctcggatgctggtgaacgagagcgtcccccacagcgtgctcaacgccgacaacgcttactgggaagcggaaatcatcgcggccgcgggcatgcgggacgcggtgacggtgtcgacgggcatggccggccgcggtaccgacatcaagctgcaggacggcgtgcaggagctgggcggactggcggtcatcggcgtcggccggatggaaaacgtcaggctggagcgccaagccagaggccgggccggccggcagggcgaccgcggttcgtcccagtttttcgtttcgctggaggacgaaatcgtctcgacgatgaacggcgaaaagaccgaggattacctggaaggcaaccgccggatttccaagggaaaactcaagcgcctgatcgacggcgcccagaagacgatggaagaacaggggatctcctcgagggaacagtcggtgcgctacgacgaaattctgcgacggcagcgtgaaattttgtacggcgcccgagaccgtctgctcgacaaggccgagatcggaagagaaacgatgcaggccatcgtgcgggacaaccttgagcatttcgtgggcacccatccgaatctgaccgaacgggagctgagccggtacgtcctcgacaacctgacctacgaactgaatccggaagccattgagatcaaaggccaccgcaaaagagatcagcagcgcctgctgaagcgcatggagggctacgccgcccggctttacgatcagaagaccgcctgctttgccagcgaggaccagctgcaggagtacacgagacagtgtatgctgaacgcattggacgacggctgggtcgaagaggtggactacctccagcagctgcagtatgcgatcacgtcccggggcaccgcacagcgcaacccgattttcgagtacagccgcgaggcctaccaatcctttgaagaaatgaaggtgacgatgaagcagaacatcgccagaaattttttcctgggcgatccccaaattggggatgacggccaaatgaagattgtattcccataaggagcattgcgatgatttacaattttaatctcggcattggctgggcctccagcggagtcgagtacgcccagctttaccgcgcgcggatgttccgcggcatcggcgagccggctcggttcgtctttaccgacatgttcccccaggaaaacatcgcgcactacacccgcaacatcggctttgaggacgaagaagtcatctggctgtacaccttcttcaccgattttaaaatcgcgccggtcacctacaccctggcggattttctggcgactctcgccgacagggattacagcgtcagccgcagcggccgcatcgggcggatcgtctttacccaaaaggacaatttctgcacgctctattacacgagcgcggacagcgaccgcctgcaccgcgtggaatacgtgtctgacggctgcttgatccgaaaggactacttcacctacggacggctctattcggaatattacgcgcccctcgacggcaaggcccatttgtacctccgccgttttttcaacaccgacgggtcggtggcctacgaggaaatgatcgatgatgacgacgtgatgtaccgtttccccgaccagctcttttattcgaaggaggcgctggtgggctacatggtccgctgtctgcatctgaaggccgacgacacggtgattgtcgaccggactaccgggattgggcaggccattttgcaaaactgcggtccggcccaaacgggcatcgtcgtccacgcggatcattacagcgccggcagcaccaacgccgacaatgtgctttggaacaattattacgagtacgcctttgacatggcccggcacatcagctttttcgttacgtccaccgacgcccagcggaataagatggcggtgcagttcgctcaatacgtcggccaggtgccgaaaatcgtgacgattccggtgggcagtttagaaaagctcagagaaccggacccccaaaagggccgcaggccctatgcgatcgtcaccgcgtcccgactggccacggaaaagcacatcgattggattattgaggcctgcgttgcggctaaaaaggacgtaccggagctgaccctggacatttacggcgccgggggcgagtacaacgcactgagccaactcatcgaggaaaaggaggctggggcgtacatccggctgatgggccagcacgatatgacggacctgtaccaaaattacgaactctatctgtcgggctcgacgagtgagggcttcggcctcagcctgatggaggcggtcggtgccggcctgccgatgatcggcttcgacgtcccctacgggaatccgaccttcatcgacgacggccgcaacggctatttgattccggtcgacgtccacacgacgattcaagatcacatcgaagggcttcgggaccgggtggtccacttctttaaaacggcagaccgtcaagcctttcagagacggtcctacgccatcgcagaggcgtatttaacagaaaaggtaatgcagagatggaaagacgtgatcaggtaggcaatcgaatagcagatggggttctgctcctcgaccggtacgacgaatcggcggacatgctgaagcagtcctttcgattggcgggctttggcgggccggtcgtcgtcctggctgacgagggctttctgccggcggacgtgctgtcgctgttccgctggttctgcaccgacgtgcccggcgcggcggatccgacgcctgcggacaatcgggcctaccgcttgacccacgcgggctggcgcccgggaaagccccggtatttcaaccagatcgagctgccggattattgggaaatcagcggcaataacggcggcggtgaggtccacgacctgaaccacctgcggggccggattttttacggcggggaagccggtcatcggctggtcagcgaggtggactggctcaacgagcagggcgtcgtccgctgtactgaccattacgaccgctttggcgcgctgtacgcgcggacggtgtttaaccggaagggcgagcgcttctgccggtcctggttcgacggagcgggccgggagcgcgtcgtggaaaacgacgtgacccacgacattttggtcaaccggcgcggcagaactgaacactaccgcaatcggacggctctcgcggtcgcgatgcttcgggagctcggcgcggagggacagcgcattttctacaattcgctgtcgacgccgctgtttgtcagcgagcagcttcaaaaaccagcgggcggcaacgtgctgttctggcaggaagagccgcgggatgacatcccggggaatatgcagatgatcttcgacggcgcgtccaacacggcggccgtctgcgtgcagaatcggaagagcttagaaaagttgacggccctgggggcgccggaagctgtggtgcggccctttggcttcgtctatccctttgagcggatgaaccgccgtcggcgcgacgtactgatttgcacgaattccgatcagatcgaacaattggagacgtttctgacccatttgccgcaaatgactttccacatcgcggccgtgacggaaatgtccagccgtctcttggcctatggtcggcacgccaacgtcagactttacccgatcgttagaaaagaagtcgttgacgaattgttcgaaaaatgtgattattattttgacgtcaaccacggcggtgaaatcctatcgtctgtgaagcgggcctttttaaacaatcagctgattcttggccttgagggaacccttcaccgccgccggtacacgtcaaagatgaactgcttttcggatgcgctgcccctatgccggttggccgagcggctcgcagccgacacagcgctttttgaacaacatctgaacgcacagcgggaggctgcgatgagcgaatctgccggggtttaccggcagttgttttccggcggaagacgtttggatgatacaatttaattgacgaagtcaatgatcaacaattaatggatggagagagtcaatgagcatgaaccgcaattccaatcctttaagggaatatcttttagaaggaccccttgaaccaatattaaacagcatccctggaggtgtgttcgcctttgcgccggagaaggggttcgtgccggtgtttgtcaatcggccttttctcgaaatgatgggagctgaaagcgcggaaatgttgcgcgaaagtgtaaaaggtgattactggcagatgatgcatccggacgacgtggagacggccaaagcggtgtacgcgcgggtcagccgcgtcgtgggggatcaggatcattttgaatgccgccttgtcactcagagcggcaggatccgcctcgtgcgcatcatcgcccaagcacagatcgaccgaaagggccgcctgctgctcgtcaatttcgtcgtcgacttgggcatgcagaacatcctggatgcgaaaagccatatggacgcgcagaccggtttgttaaaaatgcacgcctttttttcgctgatgaccaacgcccgccggcagattgaaagtggcagcgaggaccgtcagctggccgtacttttttttgacgtgatcaattttagacagatcaatttgcattacggcgttgccgccggggatgacttcttgaatgccatcggcaaaatcctgcagatggcctttcccgaatttggaacggcccgtttcggtggcgaccagttcgcggtgctcgtggacaaccgcgatctcgaggagcgggccaaccacgccagaaccatgatctgccagatagcgccgagcagcgtcgactgcagtgtcggggcgtgtgcctgggacgatgccgccatcaacccggaagaagtctgcaatcgggccaagctggcttgcgacgagaaccgcaaacacgtgaacaccttcttctctttttacacccaagaaagcggtaaagccctgaagatagcggaatacgtggcgtcccacgtcgatgaggcggtggagaagggctggattcaggtctattatcagccgattatccgcgctatatcgaatcagatctgcggcatggaagcgttggtgagatggatcgacccgagaaagggctttttatttcccgatgtctttatcaatgtactggaagagacgcagcaaatctggaaattggatctttgcgtcatccgccaagttatcgaaggcattgctgagcgagaaaaacaaggcgcgccggacatccatatctctgtcaatctgtcgcgtgtggatttcttgtgttgtgacattttcggcgaaattgaagcgatgatccaagcatacgacgtctcccgcgggatgctgcacattgaagttacggagagtatcctgacttccagcgaaaccaaaatctttcaagccttggaccggttccgggatgcgggctacgaaatctggattgacgattttgggagcggttattcgacgctgaaccttttaaaggattacgatttcgacgttttgaagctggatatgggctttttgcggaaggatacaccgcgttcccgggagatcgtgtcttcagtcatagccatggataagaaaatcggcggcttgactctggcagaaggagtggaaacagaagaacaagccaatttcctaaaaaaaagtggctgcgacttcctgcaggggtattatttcagcaagcccatgccttatgacaaggctttgcgcaactgtatggaaaagggcgccacggtcgagaacgtcgagcaaaaaccgtattacgatgcggtgcagcaggtcaatttcatgacagacctgcccctgatgctcatgtacggtaaagaagcaagcaaccgaaaacaatagatagaccgccagcactacactattccgaaccaaagaccaaaagataagcattttgagaaaatctaaacttttggattttcctacaatgccgactacggcggaatccctcccactccttatatatttctttctgtatacattgaatttgtatttagtaaaatgcagacaacaccacggatcggcttttggctggacaattccaaccaaacaccgcagcagacagtagaaaccattctgaacgttaggaagccggtatgattgttacatataaggggaagaaaaatttcttttagatacttgttttcctaaaactgatgtgatataataattcaattccagaaaaggagtaaaaaatatgcggcaaggtattcttaaataaaactataatcaaatagtgggaacaaaggattatgatagtcccttttgtaggggcttagttttttgtaccctttgccttatcaattttgacatatcccaaaaacagcatcacaaaaaggtgtatgctgtatgtgtattccgcaacttatatccccagtggtaaaagtattttactgctggggatttttatgccctggggctgtaaagggaggacaatcacatgaaaataataatattggaattcttgcccatgtagacgctggaaagacgacctgacggaagcatgctattgccagcggaccattcagaacggggagcgtcgaaaaagggacaacgaggacggacaccatgttttggagcggcagcgtggattaccattcaagcggcagtcacttccttccagtggcacagatgtaaagtcaacattgtggatacgcccggccacatggattttttggcggaggtgtaccgctctttggctgttttagatggggccatcttggtgatctcgctaaagaggcgtgcaggcccagaccgtatgtccatgcctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgaataagaagcatgggatgcggtcatcgaaaataacgataaattattggaaaagtatatcgcaggagaaccaatcagccgggaaaaacttgtgcgggaggaacagcggggttcaagacgcccctgttcccggtctattatggcagcgccaaaaagggccttggcattcaaccgttgatggatgcggtgacagggctgttccaaccgattggggaacaggggagcgccgccctatgcggcagcgttttcagtggagtatacagattgcggccagcgggctgtctactacggctatacagcggaacgctgcgcctgcgggatacggtggcctggccgggagagaaaagctgaaaatcacagagatgcgtattccatccaaaggggaattgttcggacagacaccgttatccgggtgaaatgttatccttcccagcgacagcgtgaggttaaacgatgtattaggggaccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttctttttgggccgggtgcagttggaggtgtttccgctttgcgcggaaaaatacaagcttgaaacagtggtaaaggaaccaccgtcatttatatggagcggccgctaaagcagccagccaaaccatccatatcgaggtgccgcccaacccgttttgggcatccatcggactgtctgttacaccactcccgcttggctccggtgtacatacgagagcgggtttcgctgggataattgaaccagagttttcaaaacgcgttcagggatggtatccgttacgggctggagcagggctgttcggctggaacgtaacggactgtaagatttgctttgaatacgggctttattacagcggtcagcacgccggcggacttcgctcattggccccgattgattggaacaggcattgaaggaatcagggacgcaactgtggaacttatctctccttcaccctctatgcgccccgggaatatctttccagggcttatcatgatgcacagaatactgtgccaccatcgaaacggtccaggaaaaaaaggatgaagttgtctttatcgggagattcccgcccgctgttacaggcataccgtatgatctggccttttacaccaacgggcagagcgtatgccttacagaactgaaagggtatcaggccgctgtcggcaagccagtcatccagccccgccgtccaaacagccgcctggacaaggtgcgctatatgtttcagaagataatgtaacgtcttgcgcaatgcaagcgttcattgctggctattgcgaaatatcattgataaaatcagtatcagagaggagaaactattttgaaccaggaacagacgaatattacaacaggaaagcaaatacgtcatctgcgaacacaattgggaatgacacaggaagaactagccggggaattgaatgttacccggcaggcactatcgaattgggagagagatgttaatgaacccgatttaaatatgttgaaaaaaatttgctttctttttggagtcaacatggacgattttgcgaaggaggtaataacaaagatggaaacatatgaaaaaaaggagaaacgacaatttaataagtacgatatggcaattggacttttttatggtgttggtatatttcttggcattggtattttctttgttggcggttttatgacaatgtcaggtgcagggtggggagcatcactatttggcggtggctgtttttctcttgtatttggcttgatatgccatgcagttattacattgagaagaaatgacaaatgatgacatatcctgctttctatacttttcggtaataccgagtaaaaaaagccgctgcttttggctttccaatagcggcggcttaatgcaagcggcggcaaagggaaatatcctttgaataccttacagaagaaaagttttgcagcattacaaaaataaaagcctataccattttggaaagaaaagatacataatagtcaagacgacaacaatcagaagttatggagggtaacaatggaatatagtaaggaagatttaatggaagcaaaaaagcaaattttgggagtgggagagaacatgggaacagaggaaagtaaaaaaatctgggaggagaacgcacaattttgggataatgcaatgggtgacgaatctaatgaatttcacagagaggtagtgcgccccaaagtaacggaacttctatctcctaatcctgcggattacattttggatattgcgtgtggcaatggaaattattcttcgtatcttgcacaaagaggtgcttcggttgtcgcttttgattacagcaaaaaaatgatagaattggctaaaagacggcaatcacaatatgcaaaacaaattgaattttgtgtggcggatgcgaccgatagaaaaagtatattagaatgttttaaaaccaacaaagaaattcctatggtaatgatagtaaggcttaagaaggtaaaacgtgatagcttaaaataaattcaagtttgtcgggtaaatagcaaacccagccgagccagtcaacgataaaatgaacgccgcttcgcgccgtcgttgacagccccgcccgtctttgctggtaggcaatcaaggggcgacagcaaggagtactgccgccccgcactattattcagagagggggaatttccatgaccgaagatgaagcctacaaggtgcatatccagtacacattcaatgccttttgcaaggtagtcattcgtcacgcagccatagataaaatcttgaagctgcgccggaggtgggaacgggaagtttcccttgattatctgatgagtgaaaagtttgtccagcttgccgagccggagtagcttgaagaatatctttttaccgcctgcggccagaccgccgttctgtatcatgcggagcttgccgccgcccttgcccttttgccggagcagacgcaggaagaaatttttcgttactatttcctgcgccagccgcagcgagtgatcggcgtacatattggccggacacgcagcacagcggggcggcatatccggcttgccttgcagcggttaaggcggctcatggagggaaatgactatgagtaaacttctcccctatgaaacaatcgtcaaagcccatgagggcgacccggacgcaatcgacaccattctttcccactatgccggatatatccgctactgttccaaagtacacgggaaagtcaacgccgaagttgaggaacatataaagcaacagctcattgccgccctgttcaaatttcgctttgaccgataaacaaagaacaaacactggctgtcattagcggtttcactccagccagtttacaattcatctattcctaaaggaagcaggtcatagtataatagaaccaacgacaaatatacttttaggggagatatagcaatatgaaaagtaataaatacttaactattggcttattaacaggatttattgtcggtggttgcataggtgtgttggcatgggcgtttttgcaaaatctttttgctatttctatttgtgcaggtatcggaatgttgattggaattgttataggtacattgattgattatgaaaaaaataatcatcaagagaaatagaaaaaatgcacaatgccttaaagggaaaacaggaatttattgtgctatccatcatcgggccaacctgacctgaactttcaaaactgaatatccaccgcccatcggcggccagcgaaagcagtaagtctgaaaaagatttgctgcttttttctttatccgtttggcaaaatcgcaaagtcatccgtagtaggtaggtgaagccggaaacaaaaaattttctgcggcggtagccaaatctgcattttctgtatttctaaggcaaaggaaaatttgagaaaattcccggcaagcgggtagctggcggcctttgaaatgtatctttagcggaaagaaagaactgcgggtaaaaatcgccccacgccgtaagatttttgcagaaatccggccaaaacaggcggcagctatacgagtagtaagtgcaaggggaaatctacggcttacttagagcgagtagtaagtgcaaggggaaatctacggcttacttagagcaagtttctaccacggtgccaaaatccgcaattctgcggttttgcccctcgcgggaaacttgttggggagtgccttccccaaaccctgctatgcggcttacgccgcaaaaatatttctgtccggcagacaggaaatgccccgaaaatagctaacagaccagcccattttttgtgataagtgaaaggaggtttacagcccatgccgaagcgatacaacaccccccaccgcagccatgttgtgaaaacccggctgaccgatgaagaatacgccgacttcacagaacggcttgcgccctatggtatcagtcagtccgaatttctccggcaggccatccggcgcactaccatacgccccgtactccatgtgtcgtcagtcaatgacgagctgctctccgctgtcgggaagctcacagccgagtacggcaggattggcggcaatctcaaccagattgcccgcaccctcaacgagtggcatagcccctacccggctatggcaaaggaattgcgggaagcggccgccgaccttgccgccctcaagtatgaagtcctaaagaaagtaggtgacgccgttggcaacactcaagcatttaggctctaagaacgccgactacggagccgccgaacaatacctgctctttgagcatgacgaatttactatgaagcccgtccttgatgaaaacggcaggcttatcccccgtgaggattatcgcttgtccacgctgaactgcggcggcgaggattttgccgttgcgtgtatgcgctccaatctccgctatgagaaaaatcagcggcgggaggatgtgaaaagccaccactatatcatcagctttgacccacgggacgggccggacaacggcctgaccgtagaccgggcgcaggcgttgggggagcaattctgtaaagagcatttccccggccatcaggcccttgtctgcacccacccggacgggcataaccacagcggcaacatccatgtgcatatcgtcattaacagcctgcggatagaggaagtgccgttcctgccctacatggacaggccagcggacacgaaagccgggtgcaagcaccgctgcaccgacgcagccctacgctacttcaagtccgaggtcatggagatgtgccaccgggaaggactttaccaaatcgacctcttgaacggcagcaagaaccgtgtcacagaccgggaatattgggcgcagaaaaagggacaggccgcactggacaagcagaacgcccccatgattgcaggcggtatcacgccccggcagaccaagtttgaaacgaacaaggagaagctgcggcagaccctacggaaagcccttgccaccgctgccagctttgacgagttttcctctctgctgttgcgggagggtgtgaccgtcaaggagagccgggggcggctgtcctacctcacgccagacaggacgaagcctatcaccgcccggaagctgggcggcgactttgaccgcaccgccgtccttgccgttttggagcagaacgcccagaggggcgtaacggttcgctacaccccgcagcaccaagccgccagagccgccgaacagaccgcagccatacccgaatacctacacgccgggaaaggccgcttacagggcgaaaagacagggaaaatcgaccccagacaggacagtgtgcagcggcttgtggacattgagcagaagatggccgagggcaagggcaaaggctatgaacgatgggcgaagatacacaatctgaaacaggccgccaagaccctgaccatctaccaacagtacggcttttcttccccggaacagcttgaagccgccgttgctaccgcctatcaggaaatgcgccagaccagcggcgaactgaaagcactggaaacgaagctgcaagggaaaagggagttgcggcaacaggtacttgcctatgccaagaccaagcccatccgcgaggggctgaaagcgcagaaatccgagaaagcccgcgccgcataccgccaggcaaacgagagcgattttatcatagccgaagccgccgcccggtatttcaaggcacaggggcttaccaagctgcccggccgaaaagcgttgcaggccgagatcgagcagcttatctccgagaaagacggcctgtacaacacctatcacgaacagaagcagcggttcagggagttgcagaccgtcaagcggaacatcgaccagattttgcgccgggaagagccgcaccgcagaaaggagcagagccatgaacgataagccgtcccgcatggactaccgccagcaccaggcagcccgccgccttgtgcatgagtgctgtaactacgacgaggggaactgcctgctgttagacgacggggagccttgcgtgtgcgtccagagcatttcctattccctcatgtgccgctggttccgtgtggctgtcctgccccttgacggggagctggccgcagccctcttgtaccgggggagccggaaacgctgcgcggtctgcggggcggcctttgtccccaaatccaaccgggggaaatactgccccggctgcgccgggtgcatgaagaaacgcaaagccgccgagagaaagcggaaacaaaggcagaaatgtcacgctttagagcctttcaaacccgcataaatcaaggcttttttcgtgggtgtcaaagggtatgcgatacatttatcctttccccccggaaatgccgtcctaatgcgtgacaaagcccaaaaacgacacaacacagagggaggtgatactatcgctgattatatcagggcagacaccacgctgcccgcctatcttccatacccccgtttcctgctgaaaatggagatttcacagaccgccaagctgctgtatgcgcttttattagaccgctccaccctgtcacagaagaacggctggcaggacggcgagggcaggatattcattgtctaccccgttgcggagatagcggaaatgctggacaagggttgtaccgccatcaagggagccttgaaagaactggacgcagccgggcttttagaacgggaacggcggggcttctccgcacccaatcggctttatgtgaaagtgccgcctgtcccagtggtacggttttccgaccaactgatggccggaaaagcgaccctcatacagtcggaaaagcgaccttatgacggtcggaaaaccgaccctatgatggtcggaaaaccgacccctaacaaaactaatataaacaacttaatagagaaccaaacaatgagagcgagtggggagccgcccacagcttatggccgatatgagaatatttttctgtcaaaggacgaatatgacgagttacaggcagaatacccggacaggctggaacggctgattgaggaaatgagccattaccttgccgccagcgggaaagcctaccagaattatgccgccgccttgcacagatgggcggccaatgacaaaaagggagccgtaaaacagggcatccccgactatacctgtatggagggagaaagcttatgacaagtgaaatcaaagatattttggagaacatgacaaccgccgccccggagatggaggactatatcggcgaggacggactgctttactgcggaaagtgccatacgccgaaagaagcctacttcccggagggtaaggagctgtttggccgtgaccgccacccggcagagtgcgactgccagagagccgcccgtgagcagcggcaggccgccgaggaacaccgccgccatgtggaagccgtggaaaatctgaaacagagggcttttgccgactcagccatgcagcaatggacattcgagaacgacaacggcagaaacccgcagaccgggattgcccggcggtatgcggagcattgggaagaaatgcaggccgaaaacatcggctgcctgttctgggggaacgtcggcaacgggaaaagctaccttgcgggctgtatcgcaaacgccctcatggagaaagaagtccccgtatatatgacgaacttcgccgttatcctgggcgacctctctcccggctttacaggccggaatgagtatatttcccgcctttgccgctatccgctgcttatcattgacgacttcggcatggagcgtggcaccgactatggactggaacaggtattccatgtgattgatacccgataccgcagcaacaagccgctgatcgccaccaccaaccgcccgctggacgagttgaaaaagccgacagacacggcccattcccggatttatgaccgactgctgtccatgtgcgtcccgatacgctttactggcgtcaacttccggcaggaaaccgcaaagcggaaaatggaaaccatgaagaaactgctggctgaatgaaaggagtattgcctatggagaatatcaagcagcacgaccaccgtaccacccgccgccccgactgcgtgacggaaatccgcatggggaataccgttcttgtcgtgtccggctttttcaagaaagacaccaccagcaccgccgccgacaagatggcgagggtactggaagcggaagccgctgctacacaaaaaaaggcgatttgacaagctgtaaagaagcagatttatcacttttaccgctgtacagccgcccctgttccgtggtacaatgaaaccacggaatagtggggctggctgtcggaaacggaggattttatgttaagacaagccacccaaaacctcattaccgccctttatccgagattgtcccatgaggacgaattgcaaggcgagagcaattccatttccaaccagaaacggattttggaagcctacgccaagcagaacggctttaccaatctgcgctggtacaccgacgacggctactcaggtgcgaacttccagcggcccggatttcaagccatgcttgcagacattgaagccgggaaagtcggcaccgtcatagtcaaggacatgagcaggctggggcgtaattacttgcaggtgggattttacacggaaatgctgttccctcaaaagggcgtgcgttttatcgctgtcaatgacaacgtggacagcgcaaacggcggcatggacaatgattttacccctctgcggaacttatttaacgaaaggctggtgagagatacgagcaagaaaatcaagcagtaaagaagcaaaaggcatgagggaagcctgttaccagcaagccgtatggctatctcatggacaggacgagaactattcgttgacgaggaaccgcgccggttccagcagattaccagctttgccttgccgggaatggcccgaccaagattgcccgtatgctacgagcagcaaatccccacgccggggacgctggaataccgcaggacgggcagcacccgcgctaccaccccggctatgagtgcaatgggcgacgaacaccgtcgtctcatctcgaaaaccgggagtacacggctgctggtaaaattcaagacggagaagccctctacaaggtcaaacacaggtatgagaacccctgagaagcaggcttttaaccaccatgagccattatgaccggagacaatgggagcggtgcaggagttacgcaagcagcggaaacgcccgaaccgctatgatgaagtggggctgttctcggtatgctgttctgcgccgactgcggccatgttgtatcagcagcggtatcagaacaagaaccgcaagcaggactgttaatctgcggcagctacaagaagcgtacccgtgactgtacggcacactttatccgcaccgaccttttgacggcgggcgtgctttccaattcggcaagtgacggaatacgcccgcaggcatgagagccgctttgtaaagctgctcatccagcagaacgaaatcggcggcaagagaaagaccgccgcagccacgaagcagcttgaacaggcccagacacgcattgccgaagtgaaccgcattatcaagcggctgtatgaggacaatgtaagcggcaaatcagcgacgaggtttcatggagctgtcggcggactatgagcaggagcagcgggaactgaaagaccgggctgcgctttgcaggaggaactttccaagtcgcaggccgccacgtcaacgccgagaaattcatggggattgtggaaagcaccttgcttttgaagaattgacccccaccctcttgcgggaaatgattgagaaaatcgtcgtgcatgagtgcagctatgacgagaacggcacccgcaggcaggacattgagatttattacagctttgtcggcaagatagacttgccggaagcctaacgcctgacctatccgacacagccctaagtgccggataggaacggcaaaattttttacacttctattacttctttatcgcacattagcaaatgctgattgaaaagcagcatcaaactttccgaattctgtacgtgaatgacatcgctatagccttgttcgcggaggacggggttgagacgcaggaagcagtggaagcccgcctgaacgatagccatcatcctgccaatcgggaattgtatcaggctgcccggtacgccattcagacgggtaaagccggcgaattgtactacgcgttccacggacaggaattgttgtgccgctaccgtctgctcagcaagaccgattctcagtatttgtttgtggtcaatgtttttgattacgccaaaaccggcgagcgcctctccgagaaaacgcgtatgctgatgagcctgcgccacttttaccaaacgctcttccatcttgatctgacgaacaatacgatgacgagcattcagtttggcgaggatagcgacggtgggaaaaatcgcgagcccatttttgacgagaacggccggcgctctcttctgttcccggcgatttttgcagcagatcaaaagcgctacgccgcttttatcgatccggctaccctttcgtcgcgggtggcgcaggcccaaagcggcattttggaaagcggctttcgaactgcggatgaccgcggccgcttcacctggatgtcccacaggatcatccgcattcccgggacggctcgcgaacaatttctttatgcgatccgcccgatggacatggccgccgttgaagaagaacaggcgagacagcatcatgacccgtacgcctcgctgatcggctggaatgccgaactggtcaacaagaaaattgccctttgggacgatttgatgctctacatgccggtgccccttttctggaaagaccgggatctccgattcctcggcgccaatcaagccttcctcgattattacggtttcgattcgctgagtcagattctcggcaaaactgacgaagagatgttctggcatctcgacaagggaccgtaccatgaggaagaagtggccatcctgcggaccggtgcgcgctcgagcaacgtgccggggaaatgtatcgcgaagggcgtcgcccgggacatttacgcgaccaaatggcctttgtaccgtgacggggaaattttcggtttaatgggctatttcctggacgacgatatgcgggctgaaatgcgcggcagccacggccacggggacacgatcgatccagtgaccgggctcgaaaatgtggcgagctttaccgctcatttcttcaattatgattccgactatcaattatcccgcagaccttatggcctcattttcgcggctattccggaattgccaaagatcgggaagatcaagggcaagaaggcgttcgaggcggcgctttgcgcctgcgcagacgccatcgtaaagcaggtcggcaacagcggcatcgcggcgcggatcagcgccagccgttttgccattttgtgcgagtacgcgacggcgcaggacatcgaagccctttctcagcgcgtgcaaaacgccatcaacgggattcacaaggtcggcgatatgcggtgcgtcctcgcggccgaaatgcacattctgtacgccgacgagctgcccagttttgaaaaggccttgctgcaggaaacgggagggaagcggcccgatttggattggaagaccgtacgcggcaaagcgctgcgggagcttctggattccgctggagtcgggtgttatatcctgtccattgatcaccgcgtgcagtattggaatgccgaggcggaaaacctccttgggtattcggcgaaagagatgctgggccgagactgttttgaatccaatctggggtgctcgtttacgagcggcattgccgttccagatcatcgctgtccggcaattgtggccctcgcgacgggccagtcgcagaccatgcagatgttcatgcgccgttcggacggcaaggatattttgattcgcaacacgttgattccgttgcaggacgaggccggcaaaaccaacgagcttgtggcgctttttgtgccgctgacggatgcgagctacgacgacgaaatgatccaagacgtttacgaagtggcgacgcgggatccggtcacctgtctgccggggcggaaatatatggatctctgtctgagagaggcgttggaaacctaccgccggaccggcaacattttcgccgtgctctttgcggacgccgacgatttccacggcatcaacaaccgttacggccatcaggtgggcgacgaggtgctgcaggcttttggcgtcgcactcaggcaatacggccgccggatcgaccggttctgccggtggggcggcgacgaatttgtcggacttttgcagttgaaagatcgcggcgaactggcaggcgtggccaaacggttttcccaaatcgcaaaggagatcgatgtgcggtctgacaatcaacgggtccatttccatatctccatcggcatcacagctgtgaaaactgaagacacggcggcaacgattgtcaaccgggccgaccggtatatgtatttatccaagggactgccaggcgatcaggtggtgacggatttgaacgcggcatcggtgaaaggccaaaaaggcacagataaccacgatttagcgcggtttaataaagaataaagaaaatagaggcaaacagacagtgcaggtaaaatccgccggactgtctgttttttcgtttgacaaatctcgggattcctcataaactattaaaacaataagtattaacgccgaagtgaggagaaccagcatgaatagagcggaattggaccaagccattgatgagcggtttatcgcaccgacccggcgcccccgaacaggaaaagtgggcattgaattcgagctgcccattgtcaaccggcggttcgcccgttgaccggcatgggcatcaatccgcgttacgctgtcaaccgcaatgtgccggtagccagcgagcgctaccgcatgctgcttcatcacttgtcgtcttactcaaaatacgaaaagtcaggcacctttccctttcatcaccatccgaattttgggctgttttcctgcgcgagccaggttcagctggacgtggaggagaaggacttgcccgaggttttcaacaccttttcgaagctggagccctataaggcgctgctctttgccaattcggtctggcaggtaaacggccagtcgctgctctgctcccgggattatttctggcgcaacagccttcacgggttcaatccccacaacgtggatatgttcgcggcggatttcgactcggtcgacgacatcgtcgcgtacatccgcagcatgagcctgtactgcgtcgaacgggatggtcagtacattaatttcgcaccgacgccgctggctgattattttgcgtcggaccggatcaagggtgaagtcttcgacggcaccgggtacaagccgatcgtttttcagcccgaagcggccgacctcaaggatctgcgctccttcaaatttgaggatttgaccttccgcggcaccgtggaattcagaagtgtctgcgagcagccggttggcgagatctttgcggccagcgcgctgcacgtcggcctgatggaaaagctccccgagctgaccgaattattggcacaggaccgtacgatttaccacaagggctacacggcggccgagctgcggcagctgttcgtgcaaaaaaatttcccgggaaatattttcgaccgaaaggcggtttctgcgctgatcctcaagattttagaccttgctaaagctggcctggcacagcggggcatggacgaggaagatttcttggcgcccctttacccgagggcggaaaggctggaatcgccggcggtcgagctgctgaacgggctcgcgcatggcgaaacgattgaggattacattgaaaaattcggccggttggattgaatgaaaatatgatttaaaagcgctgtgaaagcgcggcgacttttttgcaaaacagtagcgcgtctgtcaagagaggggatcaaattgatccgtctcgatttacttgacggatgcgcttttttgatagcggcctttgaaaggataagttattcgtccagccgattgatttttcgtccaaaatcgtccataattggacgaaaagggaacgaaattggacgaaaggagggctgctgcatgagaacttttgactacactcagttggcagaacggtcttggcccacagacattgtcaattttgttgctaaaatacacgagtgcaagggcagacaagatttgtttgtccgtcaaaaaccgacggaactggatcggctggtcgaaatagctaaaattcaaagtacagaagcgtcgaataaaattgagggcattgtgacgacgagcacgcgcatgaagcagcttttgccgagaagacaacgccgagaagccgcgacgaggacgagatcgtaggttatcgggatgtactgaataccattcgcgaaaattacgggtacattccaatccgcccatcctatattcttcagctgcatcgtgacctgctgaagaaagctggactttccttcggtggccattttaaaaatgtgcagaatgtgattaacgaaactcgtccggacggaacggttgtgacgcgttttacgccggtcccaccttacgacacgcctgaagcggtcgagcggctgtgccacgcttatgaacaagcggcagcggctgaaaaaatcgacgcgctgattttgattccggtgttcatttgcgacttcctctgtattcatccgtttaatgacggcaacggccggatgagccggctgcttacgcttttgcttttatatcaaaacggctacgatgtcggcaaatatatcagcatcgaaaagcagattgaaaagacgaaagaccgctattatgaagcgcttgcggcggccgacgcaggctggtatgagggtaaaaacgacccgacaccgtttatccgatatacacttcaagtcattttggcctgctacatcgaatttgaagaccgcgttgggttgatggcgaagactggacagcggagcacggcttacgatatcgtcaagcattataccgaggaaaaaattgggaaattcaccagtgcggaagttgttgcgcactgcccgagtgtcagccgttcgtctgtattggcggcgctgaaaaaattggtcgaagcaggcgagattgagaaaaaaggcgctggacgtggtactttttacatccgagcagacagtgaagtagttcgtccagccgatgatttttcgtccaaaatcgtgtagaagttggacgaaagacggcacagttggacgataatttattggagtctgtcgaggcttttcaagctaattcatcgcctgtttttcttgttattttcggaaaatggttgtaagatgaggaaagggaggggaaggtatgaataagatttattttaccattacgggaacctgccacaaatttggacaggaattttttaaacccaatatgaaggtagagctgatcaaagaaccggacaatgaatacgataaagaagcaattcgcgttgaaatggaagggcttggaccagtcggttacgtcgcaaatagttccttcacagttttgggcgaaagtatgagtgccggccggctgtacgataaaattggcgacacagcggaagggacagtgatgtacgttctgccgaaggggattttgtgcgccctcgatcaaaaggatgcgggtgaaaaatagagggatgacggaagtctaattaataaatattttaacgcgcttgaaaataatgtaatgtaaatttacaaaaaataaaatttgtaaagtttttacgcgagatatattgtcatgggataagttgtatgataccgtttaagtatcatttaataatatgcgaggtgacttatgagtaaaatacttcgaattgcaggagacaaggtctatatcggcaaggacaacggtgaaatggtggaagcgaaattgcaggacgtcgtttatgaaaatccgcaggtgggcgatgaagtcgtgatgtacacttccgatacggcgaccctgatcgatcttaagtcgccgaaggcagcgccgcggaaggcggcggctcaggaagcgccaaaaatgtcaatggctgatcgggaaatcgtggaaccggctcggccggcaccagttcagcgtcccgtacagccggtggccccgcagccagcgccggtagcgtacaacgaaaaaagatacaacaaacacgtcttcgtctgggtcttcaccttcctgctcggcgggctcggcatcgaccgcttcgtcagaggacaggtgggcctgggcattttgaagctgatcacctgcggcggcgtcggtatttgggctactgtcgactggattatcggattggtgaaggtttacggcagtgcctatggacaggatgaagaagtggtcttcattgatggaaaatattcgaaatagggcgaaataataaaaagccagatggttggaagagaaaccatctggctttttgtcgtaatgacggaagttatgcctgtttaggctgaaatgaaaaccagtcgtcgccggacaacgctgggcagtttaaaatgaattgggtgtcgttgtcttgatcgctttcggtgtcgttgcccatgctgtcggcgaattcagtgacgaaggccgtgacttggtccttgcccttttgaagggcggccagggcggccggcggcagcgcgaagggcagcgcggggtcgacgtccgacgcgcccttggcggtgcgtttctgcatatgggctagcgcgaagtgggagagcgggttgcgcttcaaatccgcgatcaggtcggcgatggtgcaggttgggcggaacagcagcgcgccgtctttccggcgcttggcgatcaggctcggcagcatccatttgattatcgccagaatcagccgtccgccccgtttggcggacaagtccacaaggggcgtccggccgtctgaagggatcaggttcaaatttttctggatgccgtcggcgccgagaattttgctgaccgacagggtctgggcgtaatcgccagccagcgccatcgccagttcggtgaagatagtggtgtaggcgtcggtgaggccgccctgggccagaaactcccgggtgtgcagcgcccagtcctcgtggggcgtgccgtccagaccggcgaggtggcgctgataaatgtaattcgtgtaatccagaatcgttcgaccgtcggtgacgtcgacccggctcatcgcgccgactgtgcggcgcagcagactgtcccggacgtcggggttgaggctgaaaagcttcggaatcacgtcgtccagcgcgccttcgatgccctgggagttgaccgacacgtggatgccggcctttttcattcggcggtcctgcacgtgcaggcgttcgaccagcagcccgtcgatggcgttcacgattttgctgtggtattccgcttttttgtcggggtgggtcttcaaatatttgaagaatttgcgcaggttgtggaccgcggtggtttccagcatgttcgtgtcgaacccgtattgcttcgcgtaggccgtcatgtcgtgaaccgtctgagctttgccggtttccggattgatgaaggtaccggcatcggtgtggatcagggtgtggacgtcgaaattttcgcggatctggccgtccacttcctttcgggtcacggtgacgatgcgcgccggggacgggtagcagatcagcgaggcggtttcaatgtcgaagaagctgcggcccttttcggtcgtcatcttttggatatcgttggcgtgcatgtgtccggtgaagacgccgtccatcccagcgtcggcgagggctgtcgaaatccgttcgtactcgggaatcaggtaggcgggcatggccttgggctccatcgaaaaatggggcaggaagccgtggtggccgagcccgatgaccgtgtcgccctgggctttcgccgcgcgggtctgctcgagcacccaggcctcgagctcgggggtgaaaatgccggcggtctgattttcgtcgatgccgcggaccgtcgtgtcggcgctgtaacgattggtgtccattacgatgagggtgaaccccggcttcgggcgtacgcagtaggacaggccgcagcccagctttccttccggcggcacgaagcgcttcacctctgcggcgccgaagcgttccggcgcgtagaggtctccaaagatggcgggggtggtgcgcccggcgggcaccgctttgccgtttggcgtattgaaattcgtggcgtccgggttgttgatgtcgtggttgcccggcgcggcgaacacctgggcgccggtgtctcgggcgaactgctcgagaatggccgcgatcgcttcgtggcattcccgttcgccgtccttggtcaggtctccagcgatcatcagcacgtctgggtcctgcgctgccaagcgtttcagcgccgctctcaaaaaggtgttgctttcgttgtacatcttgcggtcgctgttgcggtgctcggtgtagtccggggtgtcggcgatcagcgacggcgccagatagtgcaggtcggccagtacggcgatcctcagggtctgatgacgggtgatggattgattttgatctgtattgttcatggcatcatcttctctttttctattcaatgtatttctgaatgttttttcagcattattttaatcattttttcagatattttcaatcttctgaaagttattttcacgtaaagacggccggaatttaaggctgacggcagcccattaaaaaagcaggccgcaatcttatcgttgcgcctgcctattggagggaggggtcgttaatcggagatgtcaaagtccagctggatgttgacggtgtagccaggacagagggcctgagccttttcgagaatttcccgatacagccctttgcggtcgggggcgtcgtagctgatgatgatgtcgaactgcaccgtcttttccgtcgggtcgaggaagaaaccgtgcatctgcagcacgtcgggatagtcctcgagcagatcgcgcaccgctttttcgatgcggaccgcttcggaattttcggtgttttttgcgtaaaccgaaatgccggcgaggatgacgtgatgctggtcgaagaccgcgttggccacatctcgttccaggctgtccagttcgacagcggtcatcgtgtcgggcacctcgatgtgtacggagccgatctgacggctcgggccgtaactgttgacgatcaagtcgtaggcgccctcgacgccgtcaacctgacagatggtctgcttgatgccctgggcggttttggcgtcgatgcgttcgccgaggatttggctgaccgtatcccggaggatgtcgatcccggccttcacgatgaagacggagatgacggcgccgagccaggcttcgaggctgatgccaaaaatcaggtaaatcgccgcagccgccagtgtcgacacggagatgaccgcgtcgttgagggcgtcgctgccggaagcgatcagcgagtcggatttgacgttttcgccggtccgtttgacgaacagcccgaggaggactttcgcggccacagccaccgcgatgatgattaaggcgatggcggagtagtccggcgtggccgggtggagaattttcttcaccgattcgaccagtgatgaaaccccggcgtagaggacgatcacggcgatgatcatcgcgctcaggtattcgagacggccgtacccgaggggatgctttttgtccggcgccttgccggcgagcttggtgccgataatggtgatcactgaggacagtgcgtcgctcaaattattgacggcgtccatgactacggcaatggaatgggagagtgtgccgacgatcgccttgaagacggccagagcgacgttgaccaggatgccgatgacgctggtgcggacgatcaccttttcacgatttgcgttcatttgattcagtcagcctttctaaaagaagtcaattgtccagaattttgtagaggatgcggtagagggtgtgggcttcgtccggctcgaggggcatgcagcggccgatccgctgcggcacgtcggcgagcttggttttcagcgcccggccgctatcagttaaatagacgacgacgcagcgctcgtcgtcggggtcgcgccggcggtcgacgtagccctgcttttccagtttcttcagcatcggcgtcagcgtcccgttgtcgaggtggagccggctgccgatttcgccgacggtgaggccgtccttttcccagagcaccatgaatgtgatgtattgggtgtaggtcaggccgaggggcttgaggtaaggtgtgtaggcgccgacgattttccgagcggccgcgtagagggggaaacagagctggttgtccagcttcagggcttcgtccggatcgtagggagtcatttcagtcattagatcagcgcttccacagcggcgcgcacggtcttcatgctggtcgtcggttcaaaacggtcgacgacgttgccgtcccggtcgattaagaatttcgtgaaattccatttgatttcggcgttgttcttgtaatccgggtcgatctttttgagcatcgcgctcatcatcaaggccttcgggcccttgccgaatccggcaaagcccttctggctcttcaggtatttgtagaggtccagcgcgttgtcgccgttgacgtcgcttttggtcatctggtcgaactgggtgttgtaatggagggtgcagaattcgtggacttcgtcgtcagtgcctggggtctggccggcgaactggttgcaaggaatgtcgaggatttccaagcccttgtcgtggaaagcttcgtagatttcttccagatccttgtagtggggagtaaagccgcagccggtcgcggtgttgaccactaagaccaccttgcctttgaaatcggacatcggcagttcggaaccgtcgcgtttggttacagaatagttataaaaatcgctcattttaaacctcctacaattgagtttaatttttgaacacgtcatttatatttgaaacaactatattgtatcaaatttaatttgaaagtcaacccttttttaggtttctttaacaaaaagatcgcgatacagattattaagggatttgtaatttcaaaaaagacaggccgtcctgttataataaagagaaaatcaaagcgatagaaaggagaacgcgatgcccttttggaatccgtggcacgggtgcacgaaatgcagcccgggctgcgcccactgctacgtttacaggcgggacgcacaatacgggaaggacgcgtcggtcgtcacgaagacggcggcgttcaatctcccggtgcgccgggaccgcagcggccattacaagctcaagcccggcagcgggacggtgttcacctgcttcacctccgactttttccacccggcggccgatgcgtggcggccggaggcctgggcgatgatgcgggcgcggtcggatttatttttctatttcatcacgaaacggccggagcgcatcgcggcgcacctgcccgatgattggggcggggactgggcaaacgtacatatctgctgcacctgtgaaaatcaggaacaggccgaccggcgtctgccggtttttctcgcgctgcccctgcgccatcgatcgatcatccacgagcccatgctcgaggccattcacatcgaaagctatctggcacaatacgcggacgtcatcgagcgcgtcgcctgcggcggcgaatccgggccgggctcccggctttgcgattacgactggattttgtccacccgggcgcagtgcatacaatacggcgtgccctttcatttccaccagaccgggcggcttttcaaaaaagacggcagaatctaccgcatcaaaaggcgggatcaggaggcgcaggcgtggaaggccggcatcgattttgaagggtaaatggtgctttgcagggaagtgtggatttgtcgaccacgttgtcaacatatccacagtgtcattttttgtataggcgtgaggtgtggaaaaattgatattgataaagagggataaataaaaaatctgccgtccaatttatactgaacggcagatggaaacatttacgcattgagggcattttcagcatccttgtaaatgacaggattaataatatttgtaattttttcagatgcttcagtcaattgtccttctttggaaagaataggggtatccaggacggctttaattgaacaggcgagagcagctgcttctgcgacaacttttttggaagtgggacgataatggcggtagtcatcaccttctatttgaaagatgtgttccattttccaaatgagtggcagaaagtaagcgtcgagtcgggcaagcaattcataaaacatgtaacttcgtcttcggatagcgatgcattgatcagaggcggtattcaaagaagtgacaattttatcggattcagccttatttttcagcgcgttttccaagctttttccggctttgttgtcgactataaatcccatgaccatgagtgctggaccggcaacgagcccaccaagcactgcggtaccaagggccataccgcctccaccagcggccaacgaaccgccgccgaaaaacgcgagtgtggcattcattgaggcagcgccgctcaacgaggaaatcgctgtgccggttgatgcggcggcaaaggtctgagcggcactccaggcgccgaaagcagtcagtgcgccgccggccgttcccgcagctgcaccgccgacgacgtccagcacgagattactgagttcctttaattccttaaaactggtctggtcgatttttaaatttttaatttcatccaaaccgagcgagtctgcgaaatcgacattcttaattttggtaaaggtatcgagaaacgcgtgaatactgttgtttaaaataaatattttttcctgtccgaggttggctaaagattctttaacttccgcacgtttcaaatttagttgatcccgcgcttccttcatctgatcgttggcgtattgattaatggttttggcattagcctgatggttgtacgcttgaatgtccttagtgacgccgacaccggctgtagcaatagcggcagcgataaaaaatactggcagcatgacttcctccttactcgtcagcgatcagctgatgaatcgactgcatgatgatggcttcacgattttccaattctttcacctgaatttgtacttcggcgtatggtcgctgacttttagaaaatcgttttttctcaccttgtatagcgagcagtgtttccatcgcttcgagcatttcctgaagtacagaatcactgatatcccatttacgcattatcgcttcgatgatgcgctgttcggtgtcggagtgaaggccatcgctgtaggaaacgacgatcaagttccatagcagctgacgtgccttgatactctgttcgggtgattcgatatggtcgtgttcaagatcgagaatcactgcttcgtacaccaaatcactataagctttttcgctggcatgggagagaatttcgtcgcctttgctcgtgatgtcagattgtacattttcgaaatgatcaatcatgctttgtccgatggcgttgaattgttctttttcatcatcattgatctggccgtcgctgattatcaaataatagataatttttaaagatgtttcagaagatacgagatttttgagtttattttctttagcttctttcagggcattttttgtatcttctcttgttttcttcaaacgttcattggtttcgcttaaagtggattttcccttttcgaccgctttatttaatttatcggaaattgcaattgcagtttcagactgggccacttttttgatgctgtcgggcatgttttcctttacgcttttcttcgctttttctgccgcaatcttggcgtcttctgcggattctttgagcgtttttttcagccttgaaaaatcaaattttgccattcttttcctccttaaagtttaaagggttcatctgaatccataaggtcatcaaattccagctgattggtaaactgtacgtcgtagtttaaaatgcgttgaatgtctgcattaccttgaatgaatcggtcggcgtcattttctaaaatggctcgatccatgacagcaaagctgtctcgaaaaacggaaatatgcttggaaagatagcggttgacccagtcgttcatctcagctcggtacgcttcgagcatttgaataaaagcgtggctttcgcgttcgagtgcgatgcgttcgtcctgagcggccgcgtattcttcagctgatttttcgacttcacgataagcagccattgctgcgtaaaatgaaatcatgacgccggataaatttatcgaaatgccatgaatttgtgtgttttctttgatcccatgctgaccaagaagattgacagcttgagcggccttatacttgactgcgtcaacttgttgcaaggtggaggcgagattgtcatccccttgagctgcggcgtctacaaagcgtttgacaagcggaatcatgccgctccatttaacgagcgcgacgatcaattcatcgctgtcgatttcctgatgataatattttttgacgacagtaccgatgctttttgcgcaagtcgctaattcaggcttgaaactttcgtcatcaaaaattttttcgtaatggggattatccattttggtggcttgttcccgaagataattaataatcatgttgaacgcattttcggatacgatgccgaataattcttttttggcttgatttttatttgcttcatcgtcactgagcatcatcttgatggcgttaataattttttctaaatattcggattgacataattgtccttgtagatccatgtcaaagaacctccaggttcagaaattaatgttatttttattatagcacatattgtaacgggatacgttatgagtgaacagctgcaagatcaatattgctgtaaacattggacttgtattttagtgtcaacaagtgatagttattgtttgtataaaaccagaaaattctacaaagcatctaaagagtttgaataatcaacgagtttgtcaatatatccacagtgtcattttttcgcgtgccctgcgctgtggatgaattggagtataatagaaacgaaaaaattcagacaacagtaaaggagacgatcatcatgaaatatcattttgcggccgatctgcacactcacaccctcgccagtggacacgcctacggcacgatacgggaaaatgttgaaggcgcgcgggcgacggggattcaggtgcttggcgcgacggagcacgcgccgggtattccggggacggtggacccgttttattaccggaatctcaaggtggtgccgaagcgcattcatggcgtgtcggttctgcacggcagcgaaattaacgtgctcgaggacgggacattgtcgctggcggatgaattcatgaaatttctcgattacgggatcgtcggcatccacacggtctgctaccacgatcaagggcgggataaaaatacggacaatgtgatcgcgtgcatgcgtcatccaaaagtcaaaatcgtgtcccatcccgacgacgaccacacgcccctcgactacgagcggctggtcccggcggctaaaaaatacaacgtcgccctcgaggtcaataacagttccttcaaaaagctggatcaccggatcaactgtctggacaattaccggacgatgctcaagctgtgcatggcacagcgcgtgccgattgttgtggataccgacgctcacgatccgagcgctgtcggccggatggatttggcggcggcctttctcgaatcggtgcagatggacccgagcctgattttgaaccttcggggcaatctcgggaaattgatggcgtttctgcacattgacaacgagatgccctacgatgggaaatgaggcgagcgggggaagcgatgaaatttcagaagggatttgtcaataaaatcttggtcatcgctgtgtatatgaaacaaaaataaacctcaaaagccctttcggcgaagccgaccgccggaagggtatttttctgcaaaaaattatgcggagtcttatgattttactaattttttactgaaagcgttccgagatcgtgagataataaacaaaaacacaaatttgtaaaaacgatggagaaaagcgatggcggagatgatcacaatcaaggcgctgaacaagcgcttcggcgagttgcacgcggtgcaggacctgagctttcaggttgagaccggcgagctgttcgcctttctcggcgtgaacggcgcagggaaaagcacgacgattcacatgatgtgcgggcagctgcccaaggacagcggacaaatcgtcatcggcggggtcgatattgacgacaatgtcgacgcggtgaaagccaaaatcggcgtggtatttcagagctcggtgctcgaccagcggctttccgtgcgggataatctcgaatctcgagccgccctttacggtatcgtcggcagggccttcacccggcgcctcggggaattgaccgagctgttgggatttgggaacctgctcaagcagccggtaggttcgctttcaggcggccagcggcggcgcatcgacatcgcccgggcgctgctccaccagccgcagctgctcatcctcgatgagccgaccaccgggctcgacccgcagacgcgtcagctggtctggcaggtcatcgggcggctgcgccaaaccgaacacatcacggtgttcctgacgacccattatatggaagaggccgccgacgccgatcacgtggtgatcctcgacgccgggaaaatcgtagcggaggggacgcccctcgaactgaagaaccgctacaccggcgactttatcacgctctacggcgcagggcccgagacggccgataccctcggtctgccctgtgagacactgcgggacgggattcggattgccgtgccgaacacggccgcggcggccgcgctgatcgtcaagcacccggagctgttcgtggattttgaggtcacgaagggcaaaatggacgacgtctttctggcggccaccgggaaacaactcaaggaggaccgcacccaatgaaaccgatgttgatactcaccaagcgaaacagcaagctgtattttaaagacaaggggatgtttttcagctcgctgattacgccgatgattctgctcgtgctgtacgcgaccttcctcgcgaaggtgtaccgcgaatccttcactgcgggcctgccggcggggctttccatttcggacaacatcatcgacgggcttgtcggcgggcagctgatttcgtcgctgttggccgtgtcctgcgtaacggtcgccttctgcgccaacatggtcatggtccaggacaaggtcaccggcgccgcccgcgacctgaccatcgccccggtcaagcgctcggtgctgtcattaagctattacctgtccgcactggggacgacgctgctcgtctgcctgagcgcgatgggcgtcggtttgatttacctgacgtcggtcggctggtatctgacggccgcggatgtgctgcacatcgtcggcgacgtcgtgctgctggtgctgttcgggacggccctgtcctcgctcatcaattttttcttgacgacccagggacagatttcggcggtggggacgatcatcagctcggcctacggctttatctgcggcgcctacatgcccatcgcctcgttcagcaagggcttgcggcgcgtgctcacctggctgccgggcacctacggcacggtgctgctcaggcggcacacgatgcggggcgcctttgcggcgctgaaggacaccggcgcgccggcaccctacgtcaaggcgctgagggacagcgtcgactacaatttgtatttttacggcaaggccgtgagtccggggacgatgatcgcggtgctcggtggtgctgctgtcgtgctgatcggcctatacgtgctcatcaacgtgctggatcggcggcggtgaaggttgagccgctttgttttccaaatactttaaaataagtttccccaatttttcgctgttgaccacgtagctggcgtgagattcgccggggaggatcattttccgcgcgtggggaatcatcgccgctatttcgtcggtctctttttgcttgatgaggtcgtgctgccccgcgaggatcagcgtatcggcttggatctggtgcagctcctgatctgtgatgtccggctcgcacagcatcagctgacgcagcgggtctttccggaagcagttgaaaacgcgcagaggcagccggaagaaccaccgcagcccttctggtctccggttggccccgcaggcaatcagcgtggtgacccgccgagtcgcggcggcggcgaggagcccgatgatgccgccatcggaaaagcccacaaaggtcacgcccttcaagtctttcttaagaagaaacagcaccatatcgtccgccatttcccggtagtggaaggtgtttaccgggctgctcatgccgtgccctctggaatcgatcagataacaggtgaaatgtgccttgagcaggcggacggaacggtcaaatatgtggtgatcttcgccgttgccgtgcaccaggagcatcggcgggccctggccgacgacctgataggagaaggtcagtccgttgagatggatcgatttcaagggactcattcctttcgtttctggcgtttatcttgccttgcttttttcttttcagctttctcggcgcgccgcatttcgaggaaagtgcgcacgtagtcgcggaatccgtgggaatccagcacggcaaaggctgcttcatccatccacggggacagatgcttgggccggcagacgatgtaaatattctgccagtacgggttgtatttagccttggcccgctgcaaggatttaaatccgtacatgtagttcatgtggttgtagacgtaatgctctgctcgctcggagaggtctgcatggggatgtgccgttgtgcggtaaaaaggcgcagcgcccaggctgacctgctcggcaccttccgccttcagtttagccatgatgtcgtggaacaaaagctccatgaccccgtgggggcagccttctcggcgccgcatgatgtcgacgatccacgccttccctgaacggtaggggttgagaacattgattccttgaatcacgcccttggcgtccactgcgtagaaatagcgtttgtcgcagggccgctccagcatcagactgccgacggcaaactggaggcgggcggtgtgtttacccttgagccactggtcggtgatttcaataaattgtcgctccacttcgggctctcttttttcccaggggcggtattctttgaccgtcaggcccttgtgcacggcagtgtgccaggaagagcgcactttggcgcatcggccgccgcttatggaccaggtctgcacattgaacacggcctcttctccgctcttgtggaagccgaatccggcgtcttggtaagcttggagatgcttttccatggtcatcaaaaagacgattcggtaccggtgcgcagccgcaaattgtttcagctgcgtcaaaaaggctgaaaaatctgcatcggcacagaccggatcgccgcaaatgaccatagtgtggccggaaacggcgtaactggcgacgccttcgaagccttcggcgaagaaccactgtttgtccggctccagggaaaggtaggccagggaattttcgctgtattttctcaggatgccgcgcacccgtttccactgctgatcgcgaatcttttctttattttcttcttgttgtgtcatgcttttttttccttctcttttttcgtttttatgcactcaattatagcggtcaagtctgaagaatccgaaaagattgacggcctgcgcttttgtttttaacgttcagggaacagggtcaccacggcagtagaacaggaagaacagccgggtcttgagcctggccgatgatgccttcgaggcgttctttgtgcaagatgccgagctctggctcaacgttgggatcaccttttggcagcacgggatcgggatttgtgcgcatgaacctggattgctctgagctacgctggatggcggcatcgcgaggctaaaagcggtgctgaagtggcgggggttcaatggtgctcatttcttcagacacaaaaaagccagttgatatccaaaatcaactgactttattattatttatattccattggactgattaattcaatggcttcgtattcgtcaaactatataacggtacgggataattattacgccattgcccagagccagcaaaaatcaattctttatcaatataatcatcagatgatatatatgaatatttagtcacaacgatctctttcttttctggttcaacaaaaataagatttccttctgttgaactgttacttccgtataatttaaatccattcctgacttctgatatgtctatctcttttgcctttccgtttctatatccatatatttctattgtacttttaatgttttcataataatgatatacaacccagtcttcaataatcaactcaggagtgtcatcaccatcaatatcaaataacgcatatcttcctctggatgctgcatcttttccattatctatgcgtgccttgttaacaatagttctatatgcacctttcgctgcattgaaatttgtctttctaaaagcattatctgttgagcctggggcattcccgtattttggaacaagctgaatttgaatggcttccagacgatatgcataaccttctgtcccggcactttctccatttttagcccatcccatccaaccaaaattctgagcatgaacccgataataaacatcgtattgctctgccatatctccggttaattcaatctgtatcgcttccaatcgcagagattttcctgaagtaccgctcatctgcccagaccgcttccagccattttcccatcctatattttggatatgtgttcggtattggatgccgccatcctgattcaatttaatacaaatcgcttctaatcgtttggattgtccggaggttccggcaacagccccatctgaccgccatccttgccaaccgatattttgaacatgtgtttgatagctaactaaaggttgcctaaaagcattttcggtgggtcccggtgcattcccacctttggccactaactggattcggatggcttcgaggcgataaccatatcctgctgttccggcggcttccccatttttagcccatcccatccagccgaaattctgcgcatgaacacagtaatatacatcgtaatttttttcaagatcacctgttaagcgaatccgtatagcctctaagcgtaaagagcgtccagaagtcccgctcatttctccattctgagtccagctattttcccagccaatattttgaatatgtgtttggtactctacattgcctgacaaatcactttcaactttaatccaaataccttctaaacgcttactttctccagtggttccagagctttcgccattttggcaccattcacctgtgccataatcctgaacatgtgttctataacgaatcgttgcctctgttgcgtaagtcgactttgcatttaccatacataggcataataatatccccagaataaagatcccccaagataaaattcttttctttgccatgtttccttccccccttttaaaattattataaaatgtattttaagcgttatcaagttatttcaatttctttttattatcagataactatcgcaaattgcaataacaagtcgagcattgacagagtcctaagcacataggatggctacattcctcttgattgcccaatcaacacagagcgagcgggcggttgccttgacgggacaggagcatgtgctacttgagctaatgcagctgcgatatagattcgatccgtctcttctttgaaaagcttatccgcgtgcgatatatcaggatcttcctcttgtgcgattattttgattattgtgataacttttgcttttgatcccacttttctgatttttataaaattcttgttattttagacttgactctttatagataatttttttgttgttcaatctttttgatagctgactgatatcagtttaccacggcacacaccggtccagcccggttttcgcccaataggtttggtcggaggcctgcatgtggggcagaatgacgcggcggtaaaaccggaagaacagccgggtcttgagggccggcttgacgcggccctccgtgcccttgattttcgcggcgattttggacacggcgcgttcggtctggcgccgctttttttctgtcatgtgggtgtagcggtccgcgtgggttgcgatgccgaaggtataaactcggccgacgccccagaagaacaggctgtcccgaacgtccttgatggcggatttcatcccggcgccggcggccgtggtgagcacgacagcctgctttttgaacatcgccggctccggccggtgaatgatccaccgccaaccgtaatggtcgagaaaagctttcatctgaccggtgacgtggtagacgtaaacggggcttgcgaaaatcagcacgtcggcggcgtccatcgccgcggtgatcggcgcgagggcttcggcgtgggggcagagggcctcgtccttgtggatgcactgggcgcacccgatacagaaggcgccgaaatcccggggcaggaaaaattctgtcacctcgccgccgagggcgtcggtcagcatgtgggcgatgtggtgcgtggtgcccttgtgggcttgtccattaatgacgacgattttcatcagcttgcctcctttttggggtggggtacaattgcttgacggtgcgcagaaaatgctgcatcgacgagtagaggtcgaggtcgcggttccagaccaggttgatcgtggcaggcgaaatatccgtgactgttaaggggatgagatccggctccacagcggcgaattcctcggacagaaagccagcggccgcgcccgagcggatgtattcgagaatcgtgaacacctggttcgtctggtgcagaatgacgggatagatgttctgggcctggaacagccgccggatgtagcgggtctggccgaaatgatcgggaaacagcacgaggggtacatcccgcagatcagccagttcgatcgatgtccggtccgccagcggcgaggagtcggccacaaacaatttgagccggcttttcttcaacacgtggtaatggtagtgggcgtccggcaggtgattggtgacgcagagaatgaagtcgagctcgtgctggtccagcatgtcgtagagcaccgacgcggtgtcctcgacggtggcgatccggctctcggggtaagccttgagaaaggcggcgtgcagctggggaaaaaccgtgttgccgcacatcggcacgaccccgatgtgcagcgtggactgcagcgccgacagtgcgtgggcctctgcttcaaaggcacggtagtgctccatgaaacgctgggccttttcgtacagcacctcgccgctgcgggtcatcgaaatgttgttgtagtggcgctcgaacagggctgtgccgcactcggcctccagttcccgaatcgacttggacacgccgggctgagacaggtgaagggcctcagcggccttggtgaaattgcagtattggcagacggtgataaattgcagaatttggtttaatgtcatggcgatgctcctttgctccagtatatcataatttttagtttggatgagaaacttcttcgtatttcacaaatcgacgggggcagtctatactgtaaccataaaagaaagagacaacaaaggttcttcggaatatgaattataaaaaccctggagggcacatcatgaaaaaaggttatgaattattgaacgatccatttttgaacaaaggcaccgccttcacagcagacgaacgggaaaaatttggactggtcggcatcctgccgccggtggttcaggacatcgacacccaggcgaaacaggtttatcagaatttggaaaacaagccggacgtcagtgaaaaacgccactatttgatgaatattttcagccgcaaccgcacgctgttctactacgtattcaaacagcacatcgaagaattgatgccgatcgtctacgacccgggcatcgcggaaagcatccgcaattacagcgacttcttcatcacgccgcagaacgccgcctacctcacggcggaccatccggaacagatggccacggcgatccgcaacgccgcggaaggacgcgacatcgaattgatcgtcgtcaccgacgcggaagcgatcctcggcatcggcgactggggcaccaacggcgtcagcatctccgtcggcaagctgatggtctacaccgcggcggccggcatcgacccgtcccgcgtgctgccggttgtgctggacgccggcaccaaccgccagagcctcatcgacgatccgctgtacctcgggctgcgtcaccgccgcgtggacgacgccacctattacgccttcgtcgatcaattcgtcgaatgtgtcgaagggatgttcccgcatctgtatctccactttgaagacttcggcagaggccacgccgcgaagctcttgtccaaatacgtcgaaaaatacccggtgttcaacgacgacatcgaaggtaccggcatcatttccctagctggggctctcggcgcgctgaacatctcgggcgaaaagatgaccgatcaggtttacatgtgcttcggcgccggcacagcgggctgcggcatcgcgaaccggttttatcaggaaatgcaggatcagggcctgagcgcggacgaagcgagaaagcatttctacctcgtcgaccgtcagggcctgcttttcgacgacatggacgacctgacgccggaacagcgtcccttcgccagaagccgcgccgaatttgacaacgccgacgctttgaccaccctggaagcggcggtcaaggcgattcacccgacgattttgatcggcacctccacccagggcggcgccttcacagaagctgtcgtcaaggaaatggcggcccacaccgaacggccgattattttcccgctaagcaacccgacggaacttgcggaagccaaggccgaagacctgatccgctggaccgaaggacgcgccctggtggccaccggggtgccgagcaaaccagtagtgtggaacggcacaacctacgacatcggccaggccaacaacgcactgatttacccggggctcggcctcggggttatcgcctccggcgcgaagctcgtcaccaatcagatgatttcggtcgcggcccactcgatgggcgggatcgtcgatccgtccgtcccaggcgccgcagtgctgccgccggtcgccaaggtcaaccagttctccgacaccgtcgccgctgcggtggctgccgaagcgaaggccgaagggctgaaccgcaacgcctttgacgacgcgcaggcctgtgtgcaggcttacaaatgggaaccggcctacaaggactaagaccgcggagaactaaggaagtaaaaaaatgagccttttgctggaagtgctgaaaagcattttcccgatctttgccatcattgtgatcgggtaccttttacagaaaagtcactggtttcagaaggatttcgcgggcaatatttcgaagctgataaagacaaaaatcaaaaaaatcagcggatgcgcttaataaagcatgtccgctgattttttagtgtgaactttacgcctcaatcttttcgggcacaatcgccaggctgcagacgcagcgccaagctttatttgctatacgtttcgcttatagtgaatataggcaacaagcattggacaatttggcagaaaccaataaaataaaattgttcaatacaacagataaagcgtttgacgaagcagtcgtcaaaaaataaaagggagcgtacacaatggaaaccttaaccttaaataatggcgtcgagatgccgatggccggcatcggcgtgttcatgcagagctcggcggaagcggaatcgtccgtcgaaagcgcgctgagaagcggcgtccgcctggtggacacggccaacggctacatgaatgaaagcgcgacgggccgcggcatcaaaaaaagcggtgtgccgagagatgacatcttcctcgtcaccaagctttggccgacggtttacgaaaaggacgacgcggtcgacgcgacattgaagcgcctcggcactgacaccatcgatttactcttcctccatcagccgacagccaactggcgggccggctaccgtcaaatcgaaaaagccgtgaaggcgggcaaggtccgcgcgatcgggctgtccaatttcccggaagacatgctgcaggaagccatcgacacgatggacatcgcgccgcagatggttcaggtggaagcccacccctatttcccgcagactgaactgaaaaagaagctggccgaaacgggaatggggctgatggcctggtatccgatgggtcacggcgacaaaagcttgatccaggaaccggtgttcacggaactgggcaggaaatacggcaaatccaacgcccagatcattctgcgctggcacatccagagcggcaacgtcgtcattccgggctcgaagaatccggaccacatccgcgacaatttcgacatcttcgattttgagctgaccgacgacgatatggcggccatcgccaaggtcgacaagggcgtgcgctactacaacgcgacgccggaaatcgtcgcatcttacgccaacatggaactgggtccgaatctttaatcagcaggtcacatgagtttacagccaattaaaaagggaaatccacaacggatttcccttttttgatgcctgattaagctggctctgaatctacagaatcgatctcaatgatccgagtctcgccgacggcgcggctgagccggtgggagatggacagcacggttcggcccttggcggagtccttgatcgattgggtcacgcgagcctcggtttcggcgtccagattggcggtgatttcgtcgaggagcaggattttcgggtcggatacgagggcccgggcgatggccaaaagctgcagctgtcccttcgaaaagagctcgggctgcatcggcgtgtcaagaccatcgggcagggcggcaattgtgtcgtcgagcccggcgagacgcagcgcgcggtgcacggcttcgtcgtcgtacgccgggtcgaacagcgtgatttgatcccggaccgtgccggggacgaggtcgatgtgctgggtgacacagccgtagagggcgcggcgatcctcgggcttgagcgccgcggggcaggccccgcccagataaacgcggccggcctggggcgtgtagaggccggtcagcaggcggaacaccgtcgatttgccggaaccggtccggccgacgaaggtgacgtgttcgccggggcggacggaaaaggacaaatccttcaggacgggccgatcggggttgtagccgaaggtcaggtggtcaaaacccgtgacggtgtcgtcggcgggcgccgtcaatgcaggcgcccattcgggttcggcgaggaattcgtcgatatggcgaatcgcggcggcggctgcctggatgttttggatttccatgccgatgttttccagcggcgagaagatctgcccgacgtaggcgatcatcgcgacggcggagccgacagagatgccgaagaaggcgctggcggtccggccccgagcagcggcgatcatcataaaggcgacgaccgcggcctgtacggttaggatcaccggcgagtaaatgctgtcgatcaggttggcgcggtccaccgcgtcgtagcttttttgaatgtagccgtcgtaggtggcttccatgtggcgttcggcgtggaacaggcggatcatccgcaggcatttgagggtttccggcacgtggttgttgacgctcgcgatggcgcggcggttgtccagctgggcggcgccgttgcgtctttggcaccaccgcgtgaacaaaaagagcagcggggtgacggcgaggaccagcagcccgagccccttggagcgggtgaagatgaccgcgagaatcgcgacgagcttcaagctgtcggcgatcatcgagacgacgccgtcgctgtagagcacgtcgatggcgtcgccgtcgttggtgaaaattgaagcggtcaccccgctttggtgggtgtggaaataatcggccggcaggcgggacagctttgcgaagagggcggagcggatgccgtgggtcattttctggccgaagacggtgattgcggtgttttggagtgattcgcagaggtccgcggcgacgatacaggcgaaatagagcagcgccagcgcgaatgggatagcccggcgcgcggcgaggcggttgacgacgcgctcgaggaccagtggcgggatcagcgccgtcaccacggaggcggcgatggcggcacacacgccgatgacgagacgcttgtggtcccggacgacaccgctcagggcctggcggagcagcgtcgtggttttattttttgttttcattttgatcctcctctcctttctgagtctgcttcaggtacagcgcgcggtagctgggctcagccttgagcatcgcgtcgtgggttaaaaaagtggcggtgccgtcgtggaggtagagcacgcggtcgcactcgggaaaatgggcgagccggtgggacatcaaaagcagggtgcgattctgtccgtggcgccggatggacgagaagatttgggtttcagtggcctggtccacggcggcaaagggatcgtcgaggatgacgatggatctggcgtgagcgagggtgcgcgcgagggcgagccgggcctgctgtccgccggagagcatcctgatatgctacccctaagtaggacagtaaaatataaaaacctacttgggggtatttctatgtcacgaaaaagcaagattgatccggccgtaaaagtatcggtagttgaaagttatctgcgaggtgaatggcttgtgtggaagcggcaagacaagccggactaaaaagctatgcacctttaaagactgggtcaatatttacaaaaacgaaggtcctagtggactgttgaacaaatcgagcaacaagtattattcgaaagagctgaaactggccgctttttaatgcctatctttgcggagaaggatccttaatagaaatagctttcgttatggtaagatcagaaactcaactacgtaaatggatagcgtataatacctctgagatattcaatcacgcacaagcggaggtggaagctacatgagaaaagctagaaaaacaacgccgaagaacgccttgaaatcgtaaaggattgccttgctagtgataagaattatggtgcgatggcactaaaatataattgttcctatcagcaggtacgtaactggtgctgcgttatgagaagatgggatctcgccggtttggaagatcgcgtggccatcgcgccggtccgcaaccttctaggacccctgaagaggaattgcggaacaagattgcagaactagaaccaaaaaccgaaatcttcaaatggagaatgatctgttaaaaaaagtcagagatttagagaagaaatcgctctctctgactcgacatttgtacaaatatcaggcgatcaaggaactgtctgaagaaaagcactatcccgtgcaaagactctgttcatatttaaacctttcacgcgccttactatcgctggttgaatcatcctttcagttttgtgagaaatataacaagagattgccgaaaagatcagtacatccatgagcaacacccggacatgggatatcgacgaatcaagacgaactggacaaaaatcacggtatcgctgtcaatgataaacgaatcctgaggatctgccgcagcgaaaagatccagtctacaatcaaatggaaaccgaagagctgtactagaaacagcccggatcctgctcacattgctaaaaattatcttaaccggaactttcacgcagatgcaccgaataaaatggctgacagatgtgacagagttcaaatattacatcggtgtagaagtccacaagatatatttaagtgctattctagatctgtatgaccgtaggatcgtggcttataaaatcagtgaataatgataatcagcttgtaatgaatacttttgatgaagctgtgactcttgaaccagatgcgcatcggttttcacagtgacagaggctgtcaatatacgagtagacaattttctttaaagcttaagaaacatcatataaacagagcatgtccaagtggcccattgtattgataatggccctatggaaggcttctggggaatcctaaacgagaaatgtattatgtaaaacactttacttcaaaagcgaatctgtcaaacgcaatagaatcatatatcaactactacaacaaagaacgcatacaagagaactccaacttatgacacctgaggaatatcatgaaaacttctatgctgcagcataagaataccgccagtcgattgttcgactggcggtacaaaaattgttaattattcagtgtcctcttgacgggtagcacaccatcccgccgccggcacccaccgggctgtctggtgtgcggcccatggcggcgaggtcccggtccatcgcggtgcgcttcagaaaggcgtccgcgtcgacggcgtcgcccagcgcgacgttgtcccgaaagctcgtgctcaacaactcgggctcgtggcccatgtaggtgaaggtctcgagctgttcctccggtgtcagatcggtgagcggctttccgccgacggtgatggctccagtgtagggcgcttcgccgatgagcaccttgccgagcagggatttgcccgacgcgatttctccggtgatgccgatgatttcgccggggcgggcggtgaagctgagatggtgcagaaaatcgggtgcgcggtagccgcaggccacgttgtcgaaggtcagggaggcgggcaccaccgggtggtccatcacggtcaagtcgtcctcgacggcctcgcgcatcaagggctgaatccgctgccaggagaccgaggccttctgcactgagttgaacagtttggccgcgtggctcgctttgacggccagcttcgtgaagcaggcgaggaaggttgtgaacgccgcgatattccaggccgtccagccggtgccggtgacgttgcgggcgccgaaatacaaaatcaggacggcgccgatcatcgcgatcgcgtcgtaaaggggcgtcgtcgcgccttcgtagaggttggcccgggcgctcttcttttcgtaatccgtcagcgcctgttcggcggcggcgttccggtccgcttcccggccgaaaatgcggtaggtgacggcgtggtcgatgcggtccatcgtgacgccgttcagcgccgattcgctctgcttgtaggccgcattggccgcggtgacctgcgtcttgagcttgtccgccgcgaaataggccagcggcgtgaataagcatgagagaatcgtcaagcgccagtcgtaccgagccagcatgacgacgtaggcgaccataacgacgccggtgtcgaaaagctcggtcgtgaatttgcgcatgccttcggtgcaggcgtccacgtcggcgatggccttggtcagcagcgagccgaggctttcgtcggcgagggtgccggcgtcaggatggacgaggctgttgtagagacagcggcgcatgtcccggctgacgttgttggcgaagcgccgcacgctgaagcgcttgaccgcgcgcataacctgtaccccgccgatgaccgcgacgtaccacagcgcgagggtcagcatatcgtgccagacggcgcgatgatgaaaaatgtcgtaaaggcattgggccagccgcccctcgaaatagggaccggccaccatgccgatgttgtagatcagtccggatatggtcacgacgattaaaaccggtacttcggatttaaagtacgagacgatccggcccggctggcggataaaagcactgcgctgcttcaagatgcaacctccaataaattgattaagataaaaataccatagcatatcgacaggggtactgcaatgacaggaggtatcgcaaatctaaacaatatctaaacaaaaaacagagcgctttcgcgctctgctctgaaaattaccggataaaattggtgtggtggtcgtggggcgtgtcgggcagcccttgatgtccgggctgccgttgatttttgaaatctatcgccgctaagcctggtctaaaaaggcttcgatttcggcaatcgcggcgtcgattttgggcatcgcgccggtgtcggagattttggcgtcaggatcgtcggcgggaatggctgtgagcacattccaggccttgcggaagagcttgtcctccggcgcgtcgctggacggtccgccggcgagacagttccgactgaaatgggtggcgccgtcgcggatcggcgtgatccagtaggtctggaaatcggcggccttcgggtccttgtcccgaatgtttttcaacgccgcaagcaaatcatctaaagtgtagaagtagcgcccgagaatgtgcacgccgtttccgtcgccggacggcccctgcgcatccaagatgtctttaaacgtcgtttcgtaacgggcgatcgcccgcagctgctgtaatctgattttttgttgtttcatttcattcacctcaaacgttttctttagaaaagtgtatcacagttttaggcgcctgacaacaggaagcatgattgcggcactgacttttagacagattgcgcgctgtctgggtctttgggctttccgacgacaaaccggtcggtcaaatacaacagcccggggaggacggtcagcaccatgatgagcgaaaggatagtgccgatgccgaggaagtgaccgatttccttgaggaccccgtgggaggacacggccccgaggatcaggccgaccagcgccagcacggtgccggaggtcagcacagagggcagacattccgaaacggtcttgacgacggcgtgctttttgtcacagccgaagctggtgcggttctccttgtagcgcccggtaagataaatcgcgtagtcgaccgtggcgcccagctgaatggaagagatgatcaggtaggcgatgtagaaaatgggcgtgccggtcaggtggggaatcgagaagttgatccagatcgcggtttcgatggtcagcacgagcagggccggcagcaggagactgcgcatcgtgatcagaagaacgatgaagacggcggcaatggcgacgaagttgaccttctgcatgtctgaggtgacggtgtccatcatgtcgtaggtgctgacaccctcgccggccagcagccatttgtccgggtaatatgtttcggcggttttccgaatgcgcttcacgaggttgaaggtctgggtgccctcgtaattggcgcgcacggcgatgaccatccgtctatagtgcttggattccagctggctggtcagcttttcggggagcatctccgtcggcaccgccggcccgaccatcgtcgtcatgtcggtgactgaggtgacgtgatccagcttcttgaccgccttggccagagcccgtacctttgcttcgtcacccttcgggaccatcaggacgtaggtgtccgtcttgccgaagactttttgaatggcggcggtgtcgtcgccgtaggtcgtcccggcgctgaaaatgtggctcgacccgaaataatagctgttttgggtgctcatcacgtaggcgggaatgaccaaaatcgcgaaaacgacgacggcgggcaccccgtcgacggcggcgatcttctttttgtaggccagcgcggttttttcgtcgacacggcgcagcatgacccggcagttgggaatggcggtactaaattcagactgcatggtgtccagcgcgatggtcgaggcggaggatgccggcaggtagtcgttcatgtcgtaatccacgttgaccttcgaccgggcccagaaggacacggcggccagcaccagaaaaatggcgataatgatgtggcggtgtttgacgacgtggcggtaaaagtgttccatttcagcggatttcctttcatcataacaaagataattgacaaatgttcaatactttgcattataatatctgaataacccaccggcaacggacaactccgcagggatgtgcattatttggcatttcccgggaaatgtctaattttaaaaaagagaaaggtcaggtcaatccgagatggacgatttgagagtggtcaaaaccaagcaggcgctgtgcgacgcctttcaggatttgatggaggaacggccctttgaaaaaatcacggtgaacgccctttgcgagcgcgccgcggtcagaagggggacgttttacaaccattttttcgataaatacgattttttcgcctattacacccgcgtgattcagcaggcttttattgaaaattacaagagaaaagaagatgcggctgtgtcctatttcggcacgctgaccgaggagctgctggatttttttaatcagaacgttaaattggtccaccgtgtcgtgcagagcagcgcctacccgacgctgctcaatatcgtatccgacacgatcgagcaggacgtgagacaatgggtgagcgcccacgctcagacggcggcggacgcggacccggcggacaccgccgctttttttaccggcggtatcattcggctggtcgcttcccgggcggggcaccacatcgacgaggcagaaaagcggcagatcgtggccttcgtctgccaaaccgctaagctgttaaagctcaccgagtaaggatcaggccgcggcgtcttccgggatttccccggccagctcgaagcccttcttcgcgaggatgacggcgatgaattcgttgatgatcgccgcggcggcgatggtcccctggacgatgtggacgagatcgggccggtcagccagaccggaatgccttgaaaggcgaagatcaccgcaaaggccgctgacacgacgaggaaggtgccgagggattgggtcagtgtcgtgatgatcagggccttgccgtaggccttgagcttctgccagacgagctccgtgccgagcatgaggccgacggcggcgctgagtacgtcctgcaccagcaggtaccagccgctgtttaaaatgcggttcggcatcagcgcgaggccgtggggcccgaggagcatgccgccgatcagccagccgagaatggccggcatgcggattttggtcatcagccggccgagcacaaaggcgataaaaagcgcggcgatccagcgcagtacgatcatctcaatcctccctttccacgatgccgaacagcatcatctcaatccacttcagaccttctttttcgtgacggtcgatcttttctttgaaattttcgttttggcggccgcgctggcggaaggtcatgtggtagccgttcacgacggcctcgctccacgcgaaggccatctcctcggtgatgcccggacgcagcttgtggcgcgccagcagctttgcgaattcccggcggttcaaagcgtcgaggggtgccttcaattttgcgatttgttcccgcagcgcagccggaggatcgacggcggcctcgaggaaaatccggccctccatgtcgtgggttttgaaaaaatgctgccgcgcggcgtagtaggtgacgccggagtcggccatttcttcttcaatggtctcggccatgtcggcaaagcttttcgcgacgcaggcgaggtagagggcgtccttgtttttgtaattgtggtaaatcagccctttattgatgccggtttcgcagatcgcgttgatgcgtccgccgcggtagcctttttcgccgaattctgcaatcccagcctgtagaattttttcgatcgtcagccgggttttttcttcacgtttcatccgatgccctccttttgtgaacagcttagcataaattgactaaacggttaattttagagaagaaaaatttttgaggcctcaaggtcctgtgataaaataaatagaaaaattgtaaagcgctgataaaaaaggaggttaaacgatgaatctcgcgcaattacttgaaaaatttaacagcggcgcgaccctcggcgaggaccgtgaggcgattgaaaaaatgcgccgttattcccgggaagcgcagaaaatcacgatggccatcaccacggcaggcgccgtcgtgacaaaggacgtgccgaccaacgtcgtggccggcggggttccagccagaattttgaagcgcatcgatgaatagaaagggagagacggctattatgaacgaaaccaaacagaccctcccgggcttttcacattgggccatgttcgccgtcagcctgatgatcatggcctacggcgtggccttttcggtgaaatcggcgctgggcacgtcgccgatctccagcctgccctacgccatcagcctgttcacgccgttcactatcggcaacgtgacgattttcatgcacctggtgctgattgcgctgcagattctgattctgcgtcggaactatcagctcattcagctggtgcagctgccggtcgcaatcgcctttggctttttgacggatttcgcgatgtggacgctgcggggggtatattacacgaattatctcgggcagtggctgctctgcgtcgtcggcattctgctggtcgccttcggggtcagcggcgaggtcgaatccaaggccacggtgctcgccggcgaaggctttatcctggcggtctgcacggccaacccggagattcccttcagccggatgaaggtgatcttcgacgtctccctcgtcgtgctgtcgatcgtggtttcgctgattttcaccggcagaatcggcggggtccgcgaaggcaccgccgccgcgatgatttgcgtcggcctgttgaccagcgtgttcttgaaaccctggcatcgtctggcggtgcgtgtgaatcaggacgtaatgaatcattaatcgtgtttatttatggcataatataaggaaatcacatatcaaagtgcgaggttgattttatgaaaacagttattctaaacggaagtccgagaaagggaaacaccctgacggcgattaacgcgtatattgaaggcgccggagaaggcagcgatattgaagtgattcatgcagacaagctgaacatcagcggctgcaaagggtgcggcgcctgtcaatgtcggaacggctgtgtggccaaagatgatacgaacgcgaccgtcgacaaaatcgtcgcggcggacatgattatctttgctacgccggtatactggtggggcatgacggcgcagctgaagctggtgatcgacaaatgctactgcagaggccacttgctgacaggtaagaaaatcggggtgctggtcgttggcggcgcgcctaccgatcatgttgaatataaattgatcagaaagcagtttgaatgcatggcgcaaatgctgaaatgggatatccggttttacaaagactactgcgcgaacgaaaaagaagatcttgccaagaattctgcggccatcgaagaattgaaacagctcagcgcagcggtcgaataacgtgtagtcgaacaaaatatagtattagccaatgatggatatgttctcagaatctgggatacatatttatgaattaggcggaacacatggatgtcattctgtattgtacagggggcatccattttattttgctgtgtcctcccggaacaccacattgatttcgtttaaacttaaaatgtgataaaatataataacaaattagaatttgtcgaattgattccaagccaacgggtttggacgggtcaatattttgatacagagagcgagaaaaaatgatcacaggcacattaaaaaataaaattgacaatttgtgggaaatattttggacaggcggtctgacgaacccgctggacgtgatcgagcagatgacttatttgatgttcattcacgatctggacgaagcggacgacatccacgcgaaggaaagcaccatgctcggcgtgccgtaccagagtatttttgccgaagaagttcagctcggcagccgcgtggtcgacggccggcagctgaaatggtcggtattccgggattatccgccggaaaagatgtttgcggtggtgcaggagatggtcttcccgtttatcaagaacctgcacgaccagaaggacagcgcgtactccaaatatatgcaggacgcgattttcaagattccgacgccgctgatgctgtcgaagattgtgggaacaatggacgatctttacgcgcaaattaagcagagggaactggaaacgcatcaaaaagagaataaagataatgaaggcgatgatatccgaggtgatgtttacgaatatcttctgtctaaactctccaattcgggtgtaaatggccagttccgcacgccaaggcatattattaaaatgatggtggcattggttgagcccaaaccagatgacgtgatctgcgatccggcttttggcacggctggctttttatttgaaacggcggattacttacgcaaaaattataaagaagatatttattacgataaagccaagaagtatcattacatgaacgagatgtttcacggttacgatatggaccggacgatgctgcgcatcggtgcgatgaacatgatgacccacgggatcgagaacccgtcgatcgaataccgggacagcctgtcggatcaaaacccggatcgggaccaatacacgctgattttggccaatccgccctttaaggggtcgctggattacgatatcgtctcgacagatttgctcaagctgtgcaagacgaagaagacggagctgctttttgttgatttgtttattcagatgctgaaggtcggcgggcgctgcgcgtgcatcgtgccggacggggtgttgttcgggtcgtcgcgggcgcacaaggcgctgcgcaaggagctggtcgaaaatcagcggctggaagcggtgatttcgatgccgtctggggtgttcaagccttacgcgggggtatcgaccgggattttgatttttaccaagacggagcacggcgggacggacgacgtctggttctacgatatgaaggccgatgggctcagcttagacgataaacgcgcgccggtggaagacaatgatattccggatatcatcgaacgcttcaagcaccgcgatcaggaaaagacacgcaagcggacagaacagtccttcatggtgccgaagcaggaaatcgccgacaatgattacgatctttcgattaaccgctacaaggaaattgagtacattccggttgagtatccgccgacggaagaaattctggccgatatccgaaaactggaaaaagaaatttcgagcgatctcgatgagctggaaaaattattgaacgagaaaaattagaggaagaataatggaaacttcaattgtgtattttgatgaaactggtgatgatggctttaacaaaagatctagtgatcattttattttaacgagtttctatatgtctacaaacgtatggaaagataatttttatcttatgagagaacttcgtaaaaaatttaaagcacaatatggatttagaataaaagaagaaatgcacaccaaacaattcttagcgaataaaaatccttattgccagtatccttggtcggaagaaaccagaaaagaaatattgtgtcaatacgcaaaagcaatttcaaaaatggatgctcgctcaattaatgtaattattgataaaaggaatattaaatcggaaaattataaaatattagatagagcattaacctataatttgcaaagaatagaaaatgacagctcaggaaaatggaattaccttgtaattactgatgaaggacgtcttgcaccaatgcgccaaacggctcgtcgacttcagatatataatccaattccatctcattatcaaggaaactattataatcgaccattaaatgggttgatagaagatattttggataaaaactcatcgcaatcgtattttatccaaatttgtgatttcatttcatattttgtgcatcttgattttattgttcgcgttcgagggagagatcttcccggaagagcagcgcgactgattgattataattttgtaaaaaagattttggatatattaaaagatggagatgtgctgaatttaaaagcgaatttgtcaaatgaatatggatttgttatttatccaaaataaaaaacaccacctacatcgcattcgcgggttcagtggttcatatataatatacaataattgatgaaaaaagtcaaataaattaagatttgtggggaaaagatgaaaaaaacattctctgaggttttaacgataaaaaatggaaaaaatcagaagaaagtagaaaatccagaggggaaatatccaatttacggaagtggtggaataatgggatttgcggataattttatttgtgaagcaaacaccgtagtaattggaagaaaaggaaatataaataatccaattttcgtggaagaaccattttggaatgtagatacagcttttggacttgaggctgataagagagttcttttgccaaaatatttgtattatttttgcaaacaccataattttgaacgctataacagaactgtgacaataccaagtttaactaaatcggatttgttaagagtaaaaattgatttaccatcattgagtaaacaacaattaatcattgatcggttaacaaaaatagaagatattttaagcaaaagaagaaaagaattaaaaaatttagatacgttagttaaagcccgatttgtcgagatgtttaatttgagtaattgtgactataaacctcttggagaatgtactgattttgttgactatagaggacatacaccaaaattatcgaacgaaggtacaattcgcatggttaatgctaaatccgtaggaaaaggattttttaagtatatcgatgaatatataacggaagaaacttatgagttatggatgcatcgaggatttggttgtcctggtgatattttatttgtgacagagggacatacattcggtaatacttgcttgattcctgatgatatgaaaaaatttgcattgggacaaagggttattactataaaaggacataatgaaataaaaaacgctttcttatgttcatatatgcaaactaataacttttgggaagatattaatgtttataggacaggaggaactgcacaagggatacgaagtaaagacttggtaaaagttgctgttcctataccaccgattgagcaacaaacagaatttacgaattttgatgatcagatcaacaaatcaaaagctgcgattcagaagtccattgataaaacacagatgctgttcgatagtttgatgcaggaatactttagttaagactcacctggtaaactcctgattaaaaaggagtgttgaccatgatggaagaaaagattgtggcgattgtcaacgaaatggctgaggtattgagtgtagcgcagatgaagaaattacaggagacccttttgcgccatcttgctgaaaatacggctgcacctcaaaatatttcaaacacagaatacgtggcgctgtttttagaggctaaaaccgttgagggctgttcgccgcggaccatcgcttattatcgagcaaccattgcccacctgctggccgccgttcacgcgccggtccgtcagatcacaacggaacaaatccgcgcgtatttggccgactaccctaatcgcaatcaatgctcgaaagtgaccgtcgataacattcggcggaatctttcgagctttttttcgtggctcgaggaagaaaattatattttaaagagcccaatgcggcgcatccataaaatcagaacaaaaaaaccggtgaaaaacatcatcaacgacgaatgcatcgaaaagctgcgcgacggctgtaccgagccccgcgatttagccatgatcgattttctgtattctacagggattcgcgtcggcgagctagtcaatttaaacatccgcgacgtaaatttccagtccagggaatgtgtggttttcggaaaaggcaataaagagcggatcgtttatttcgacgcgaagtcaaaaattcatctccagcattatctggccacgcggcaggacgacaacccggctttgtttgttgcgctcaacgcgccgtacagccggctgaagatcagcggggtggaaattcgtctgcgccggctcggcagaaggctgaacctggagcgcatccatccgcataaattcaggcggaccatggcgacccgcgccatcgacaagggaatgccgattgaacaggtgcaaaggcttctgggacattcgcaaatcgacacgacgatgcagtacgcgatcgtcaatcaatccaatgtaaaatcctctcatcgccggtatattggatagaaggaccgttttatttatcgacgataccgttgatttctgctggttggcttgtccggcagggtcatggtaatcaggccctgtgccaacgcgggttttaaataatgcgcgcggaaagaccgcatggcacgcagaccgacgagatgcatcaattcgacggcgctgtaggtttcccccggttccatgacggaaagcagctttttaagaggggcagtcaggggttcgggcggcgcggtgacttctgtttcaacatctttgaggatttcatcgatccgattcagcataaaggtaataaaaagcgtggactggccttgggcgttgcatgcagcaatggcatcgtagtagccgctttgaaaatttctgatctgactttccaacgggacatattgaaaaatttctttccactgatacaaaagcaccgtctgccaaagtctcgccattcgtccgtttccatcggcgaaaggatgaataaacacaaactcataatgaaaaatgctagaaagaatcagcggatgaattttaccctcggtacgtttcatccattgaaaaaggtcgtccatcagcttgggaaccatatttgcaggaggcgccatgaaaatacaacgatccccatcgaaaacgccgacgccgccatgtcggaaagtgccagattcatttacagtcagatgggtcatgatgccgtgaatttttttcaaatcgtttagcgaataagggtcgatcacagggatctgatcgtaagcttcataggcgttttgaacttcctgaatttctttggcgggccccaaaacggaatgaccgtcaagcacggctttgacttggccgattgatagggaattggcttctatggccagggaagaatgaatagaacggattcgattgtcgcggcgcagctgcggttttgcgctgaggttgtggaaggtttgaatcttgcctgctttttcagcaatttggctgacgaggatcagcatttcatctgtaatttgatacggaggggtatattgggtattcatgttttcctcttttatcatcttaggctttttcttaggctctatcttaggctctattataacggaagaagtcttgaaaaacaattcaaattaagatttcacgctaacaagccatatactttaatgaaaatgagccaaacgttgtattaaagatagtctaaacactgtagtttgaatttgatagaaaaaatttagaggtgaaggcaatgggtgagtttcgtaatgatgcgaggatcgaatccgaggcggaagaaaagaacgaattttacgaggatttgatgaatgggttcaatgaagtgttagctgatctcagaggagaaatccacatcaaacgcgacattgtgacggttgaggcgaaattcgattctgacgagtaatcaatcattaatatttttcttcagcactgcagcgcgtctgcggtgctttttatttggatgtgtcctcccggaacaccacagggtcatgatttcgtttaaacttaaaatgtgataaaatagaaacaaatcaaacgacggcagaatcaagggggaggtggcaacgatgattctggacaagaagcagatgaccgaagaagacatcaagctcaattacatcacgccggctttgaacaacaaggggtggaagaacggcgacaacatcacgatggagacccggatcacggacgggcggatcaacctcaagggcaatctggcctaccgcgaaaagccgaagcgggtggactatctgctttatatcaataagtatcatccgatcgcggtggtcgaggcgaaggacaacacccacacgccgtccttcgggattcagcaggccaagacctacgcgcagatgctcgacctgccctacgcctacagcaccaacggcgatatgtttcacgagttcaattttttgaccggcaaagagcggacctttccgatgaacgcctttccgacggtggagacgatgctggcgcgctacaaagccgagaagcatctaaccgacacggaaaagcggctgatcgatcagccctattactcgagccagaacagttatccgccgcggtactaccagcgcaacgccgtcaaccggaccctcgacgcgatcgctcgggggcaggaccggattctgctcgtgatggccacaggcaccggcaaaacctacacggccttccagattgtgtaccggctgctgagcagcggcatgaagcacaaggtgctctacctcgcggatcggaacaaccttgtcaaccagtcgattgagcaggatttcgccccgctggaaaaggtgacccacaaggtcaattacgcgaaggacaagaagagcacgatcacatcctatcaggtgtatttcgcgctgtaccagcagctcatcggcgatgacgacgccgaacattaccgcgagctgttcgatcaggatttcttcgatttgatcatcgtggacgaatgtcaccgcggttcggccaaggcggacagccggtggcgacggattctcgaatatttttcgggcgcgacccagatcggcatgacggcgacgcccaaggaaaccaaatacgtgtcgaacatcgcctatttcggcgaaccggtttaccagtacagcctgaaggccggcatcgacgacggttttctcgcgccctttaaggtggtcggcgtgacgctaaacatcagcgacggctggcgcccgcgcaaaggccagcgggacaaattcggcaacgtgatcgaggaccgcgtgtataacaacatggattacgactacaacattgtgctcgaggatcggacccgtgaggtggcgggacgcatcaccgcgtatttgaaggcgacggaccggatgcagaagacgatcgtgttctgcccgaccgaggacgcggcggatcgcatgaagaccgccctcgtcaacctgaattcagacatggtgcgggaaaacccggattacgtcgtgcgcatcaccagcagcgacgtctacggcaagagcaagctgaagtatttcacgtcggtgacgagcaagtatccggtgatcgcgacgacctcggagctgctttccaccgggacggactgcaaaatggtcaagctgattgtcatcgacaaaaacgtgaattcgatgacccagtttaagcagatgatcggtcggggcacccgcgtgcgcgaggatcagggcaagctgagcttcgtggtcatggatttcagaggggtggcgaggttgtttgccgaccccgattgggacgggccgatcgaaatcgacgacgacttcgacccgacgcctaagcccgagcctgaaccgaagcccggcccggggccagggcctttgccgggcgatccgatcccctacgtgggcgaggacggctgccaggtcaaggtgctgcaggaggtcgtctcggtttacgacgccgacggcaagctgctgcggcaggaaaacatcatcgactacacccgcaagaatatccgcggagcttacgcggaccttcgcgcctttgtgaacacatggtcgaaggcagaaaagaaggcggtgatcaccgaagccctcgccaagcggggcatcgatctggaacagatcaagcgggaccagggaatggccgatgtggacgatttcgactttatcatccatgtggcctacgacggcaagcccctgacccggcgcgaacgggcggacaacgtgaagaagcgggatttcctgcaccgctacagcggcgtggcccgggaggtcattgaggcgctcctcgacaagtacgccgatgacggcatcgacgaaatcgaaaagacggaaatcctgaagctggatccctttaggaaaatcggcaagccgtcgcggatcgccaagctgttcggcggccgcaaggggtatctgcaggcggtcaaggatttggaaaatgaaatttacagaataggataagcattcgtgagtgatttaggaagttttgtcaaacggctgcgcgacatcatgcgcaacgacgccgggatcaacggcgacgcgcagcgcatcgagcagatcgcgtggctgctgtttttaaaggtgtacgatgcccaagaggaagactgggcctttgacgacgaggattacatgtcgatcattcccgaggactgccgctggcagaattgggcggtggacgacggcaagggcacggcgatgaccggcgacgccttgcttaattttgtgaataaccggctgttcccggcattgaaggggctcgagatcgacgcggacaccgagatcaaaaaggcgattgtgaagtcgacctttgaggacgcgaaccagtacatgaaggatggggtgctgctgcggcaggtggtgaacgtgatcgacgaggtcgatttcggcgattacgaggaaagccacgcctttggcgatatttacgaaagcattctgaaggagctgcagagcgccggctcggctggggaattttacacgccccgggcggtgacggattttatggcagaacggatcaaaccgaaaattggcgagacgatggcggatttcgcctgtggcacgggcgggttcattgtgagctggctcaagcagctggcgccgcaggtccgcacgacggaagacgaaatggcggtgaaccgttcgatctacgggattgaaaagaagcagttcccgtacatgctctgtgtgacgaatatgcttttgcacggggtcgagcggccgcggatcgatcacgacaacgcgctgctgaaggatgtgctggattacacggaaaaggatcagttcgacgtgattttgatgaatccgccctacggcgggtcggaaaaggcgagcgtgaagcaccatttcccagaggacctggcgagctcggaaacggcggacctgttcatgtcggtgatcatgtaccgcttgaagcccggcgggcgcgcggcggtaattctgccggacgggttcctgttcgggacagacaacacgaaggcggcgatcaagaagaagctgctcacggagttcaacctacacacggtggtgcggatgccggggagcgtgttctcaccttacacgtcgatcacgacgaatattttgtttttcgaccggacgggcccgacgaaaaagacgtggttttaccggctcgatatgccggagggctacaagcatttttcgaagacgaagccgatgaaatccgagcatttcgatccggtgcggacctggtgggacgaccggcaggtcatcgaagacgaggacaccgaaacctttaaatcccagtgctacaccgcggcggaaatcgcagcgaacgggtacaacctcgacctctgcggctatccccacgaggaggaagagattctgccgccgctggagctcattcacgaatatcagaaaaagcgggcgagcttgaacgcggaaatcgaccgcgtcctcgacgccattgtggcgaaactgccccacggagacgacgaagatgcgtaagatgacacctcagcagctcaaaaacagcatcctccagatggccatgcagggcaaactcgtcgaacagcgcccggaagaaggcaccggggaagcactgtatcaagagattcaggccgaaaagaaaaaacttatccaagcaggtaagatcaagaaatcgaaaaagctgccggaaattacggaagaagaaattccctttgagattccggaaaggtggaagtgggtgaggttgaacgactgcatggatgttagagacggaacacatgattctcccaaatactatcaaaaaggttttcctcttgtgacgagtaagaatttaaaaaatggaataattgatttctctacttgtaaattaattagtgaagatgattttaatgctataaatgaacggtctaaagtagataaagacgatatattatttgcaatgataggaacagttggaaatccagtgttatatagaggtgacgcaaagtttagtattaaaaacatggcactttttaaacatataggttcttatttaaatatggagtacgtttattggtatttaaatttagcacaagaagatatgaagaaaaaagcctctggtggggttcaaaattttgtatcgttaacctatcttcgaaattatttaatagcattaccaccaaaagttgaacaacgccgcatagtcgccaaactcgaagaaatccagccgcttctcgaccgctacgaaaaggcctacaaccgcctcgaagcctacaaccagaaattccccgaaaatttaaaaaaatcgatcctccagtacgcgatcgaaggcaagctcgtcgaacagcgcccggaagaaggcaccggggaagcattgtatcaggagattcgggtcgaaaagaagaaacttatccaagaaggcaaaatcaaaaaatcgaaaaaactgccggaaattacggaagatgaaataccgtttgagattccgaaaaattggaagtgggctaaatttggagaaattgtagatttttttataggtaaaactccaaaaaggcatgaaagccaatattggcaaaaatcagaattcccttgggtctctatatcggatttaattgatagaggtcatattcagaggacaaaagaaaatataagtagccaggcagcggaaaaagtatttaagaatagattcgctcccaaaggaacgttgttaatgagttttaaattaacaattgggaaagtttcgattcttgatattgatgcctttcataatgaagcaataatttcgatttttccaattatagaaagagataatatttttcgcgattatttgtttgattttttgcccttaataagtgctgaaggaaaaacgaaatcggctattaaagggaaaacattaaattcaaatagtttgaagaatttattagttccgattcctccgttagaggagcaaaaacgcattgttgcgaaggttgaagaactgatgccgcttgttgaaaagtgtggagaagatagaaaagattaatagcataataaggaatgacttacgaattactatgatgattactttacatgattgattttggggtaatgaatgccgaatattgaagatatcgaagataaggttaaacatattattgaagaattaccgtctgaagcgtcagggttagattataaactatatccatatgatataaaacaagataaggtcaatttcctaaaagatattattgcgatgttaaattctgaggctgatatcggagaagataagtttattattatcggtatagaggataaaaataaatacaaaaatggaatagacaaacagacgtggcacgatgataatgaatggcaacatctggtagaaaagatttcttcaaagccattaatttattctggcacagtagattgtgacgacaagacctttggttacttctgcatctctaaagataatacggattatgtttatgaattaaaagacaaagttgaacaaaagtctgaaaacaataaaattaaaattatttctgaaggacaagctttttttagacaaaatagtcaaaatgtcgttctatttgaagaagatcgacgaagattattagagaaagcgtcaatattaaaattaaattatccagatgaagaaagatacgtttccgtattggcacttgtcggatcgtggaatgaacaaagtcaaggagatcttgcattaattaagagtcttttagggacagagtcaaatcgcgatgttaagaacgctatggcgttttgtacgggaaatgaaaaaacatttaggtcaaataataaaatatggcaatgtaaagtacataaagatttattattaaaaagtgcgaaatatattacagttattttattagaaaagttttttgaagaagcaggaaaagtttttttggagaacggttattccaaaaatattcggcgcggtattgcagaatcgatcgcaattttagggaacaatctccaaaattttaaaaatattggtgaaagcattatccagagagagatttatcaatttgaaaataaagtttttagagtaacaaattgggaaacctatgcaacaagtattgccgatgagtttgaatattttggtgatgcagccccaggcgtttttttagaccaactggaaagattatttgaaacaaaagatcaagcattctattcttatttgaaaaactcaaagccgtcattggaaagacagctgagtgaaattttgagcaatttagccaaaattgaagattatttttcgagatcgatgcgaatccttttacgattagcggagataaaagaaagctttttgcaaacattaaccggtattgtctctcctatttttccgcaaacacatgcgcgatggaccgttaggacgggggtttttaagggattagcaaaaatcaacaaagatttgacttggaaagcactaataaaaataattaataatcctaatccatcctttattctaatttcaaaaacacaatatttatcaattagtgctttttcttattctactaagaatgaacgtcttaaatcaatagaaaaatacgtggaaatagcatgtacattaatagacaatcaggtcgatcgtatgtgcgaaatggttgaagcagttaaatacgttcctctaaatacagaagaatacattattgaaaagttgaatgaaaatctagacgaactctctcaaaaagatagagaaaaactgtggaataaattacaagatttactgttatggagtaaaaaacattttgatgaaaatgaggcaccaattaaagaaagactagaaccgataaaaaaactgtcagaacaattagaaaataagctaggatattttgatagcattcgcctttttaatagaaaatggtttcctttactggatggagaaggagaatggaaagatcaggaaaagagatttttcgataaaagagaaattacaattaaaactatttatcgggagggcggattagattcggtaatcgcatttgctaaggatatagaggacaaactgggtgccggccgttacttggcaaaagctattaacgataaagatttaaaagcaaatatcgaaaataatgttggtgaagaaacagatgagttaatagaggggcttgtgccagcggttgaatttaatagattaacaaatgctttgagcgatagttctgatcgcgtaaaagcaaaaatttatgcgtgcttaccaatttcaaatcaaagtatagaaaaagtagtcaaattggatgtggaatcggcgcaaatgtattggaatagagtttttccaagattcgttgaaaatgatatttcactaagtaaatatgcaataaagaattttaatcagtacggacgagcagataaaagtatcgaaattttatctaggctaattgaaaataaagatcaagaagttccgaaacaaatggtaattgatacgttgaaattatttaataaaaaagaaggctcacagtatcaattttttgtcgaaaggcttttattgtggctgcatttacaaaaaaataatgatgatgaaataacatgtattaaaaaaattgaatggaaatatttaagttatataaccggcgaagaagggtgttatcctaaatatttacaacttgaattatctaataatccagagtttttcgtagatttaattcgaaaaaaatatgaaaagacagaaaatgctgattcagaggaaaaactaaaaattcatgttttattaaataactggagaaaagttcctggattgaatagcaatggcttaatcgatattgagtatttaaataattggataataaaagtaagagaactggcgcgcaagattaatttagaagagcaagcgatgcaatgtttaggaagattacttttttattcaccagaggataaaaaaggcctttttattaatcggaagattgcagatattttggaaaataatagggatataagaacaggatatttacaagaaggttatacattttccttttgtggatttaatggagaactcgaaaaagaattcataagaaagataacaaaatatcatagctacgctttgcaggcagatgaagagggatggatcaatcttgccaaagcattaagaaatttagagaactattttataaatgaaaagaataaatgatatataagaagtttatgtaatgttttttatatgcttcgagatgaactagtaaagaaaaagagatatggataaaaaagagcaagaagatttagaaagaattttaataaaatatcaatgtgatcttgaagaggaaaaaaagaaattagaacattatccagtaatacagacaggcaaaacacctaaggagaatatgaatattaatctttttccgcaactctcaactattgataaagatttgcaaattcctttcatctcattaatcggagaattagactgtacgaacgaaatgatcgttgatttttgtgatgcgtggaaaattatgcgggaaaatggagatttagtaaagctgtataatacatattattttacaagatctgtaaaattaggatcatatattattgcagatataagacattatattgatatgagtatagcgataacgtggtatttatggagtggaagaaaaaattcagacattgaaattgatagtataggaaaatacttggctaataaaaaatttaaagaatatgatcaatttaaatcatttatggatttagttaacacgatatctaatacatataaacattcaattcccaatcttcatttaaatattgttggaagagatgagccatgtctatttacccttgcaagtaaaggaaataaagatattttccatcctcaattattgggaatttcgctttctaaattaattttagaatttaatcaatattttcactattcgattgatgagattacaaaaatctcgaatcaatgtaattaaaaaacggttcaaaatagtaaatctagaatgatataggcagtattttgaatttattgagaagcgtgacatgtgaaagccgatttttcaacgaaataatatctatcaaccgaaggcggagaaccgtcttcggttttttggtgggattgtcttgaacgctcaccccatccccagaatttttacgtaatcaggcacagccatcagcggcatctcgagggccgtctgggtttcggcgctgacatcctgccctgaggccatttccgcgccggcggcttcgacggctttcagccattcgttaactttttcctgaacgtccggcttctgcatcttgagaagccggccgcagttgcggtagatttcaagggacggattgcagcaggccatggccgcgcgcagcacctcgaaattcttttctccggggaagccgcagttggccagcacgacgaagcgctgggtcttggcctgggcgtcctctagatcgaaatggccgtggtcttcctgaatggtcgggcacttcaacggcgtcaggcggtcgacgaaattcttcaaatacgctgtcatgttccaggtgtaaaccggcgtgccgaagcagacgatgtccgacgtgttgtaaagctcgagcagatcggccatattgtcgtgctggacgcagagccccggcgtcttgaaccagcaggcgaagcagcctcggcagtggccgatatggcagtcgcgcagataaaccgtttgggtctcggcgccggcggacgcggcgcccttcaaaaatgcgtcggcaatgacctgggtcgcgctgttcggcccggctgggctgccgttaaacacagtgactttcatatttttctcctaatttattttaattcgtttttctaatcctttttatattttctgcgaaaaaaggccgtgatggttgcagtaccagaacaccacaccgtgcccgcgggagaagaaccgcgcctcggcggggccttccgggtagaggcggacgaactcgaaccggccgccgttgagaaaggcgatgaaggtgaggtggtgatccttggtcatcgggtggtcgacggcgacgtgaatttcgtcctcgattttcgtgcacaccgcggtgtgggccgcgtccggcgcctcggcttcgaggggcggcagcgtgacaccgcagcacgagatcatcgccgagcccgtagcgtagagcacattgccgcagatcgggcagacgtaaaggtgggagcgcagcaggttggccgcgcggttggtgttgatgatggcctcgccggagagcagctccggcaccgagacgccgagcacggcggccagcggctcgatcagcgagatgtcggggaagccgcggccggtttcccatttggagatggttttatcgctgaccgcgagcttttcggccagttgagattgagtcagtttttgtttttcgcggagccgccggatcgcggcgccggtgacgtaatgattcataagctatcctcctgtttgatgagttgaggataacacggtttcggcgcgccggcaacctacggagcgtagagctgggggccgctgaaatgaaaggataacaaaaaagggtttatgatttttatacatctgcgaacaaaccgaaacgaaccttaaaatcggtaaagcaaaaggagatacattatatcagcatcagcacaaaccttaaaaacggcctaaatcagtttatccttcaggggagggtaactgacaatttgtgcggaattgtctgaattgaagtcaaaacagaaaaaaagacttgacagatataggtgaattgttaataataattaaataatttatatgggtgtgaggccggtcggcggcttatatttttatcacgaaattagcactcgttaaaaaagattgctaacaaaataatgggtcaatcagcaatggaggttaatatgctgaaactatttaaaaaattttcaggaaaggacatcggcgtggtgctcttcgccctcgcctttacggcctgtgccgtctgggcggatctgacgattccggactacatgtcggatatcacgcggatgatcgagacgtcgggaacgaagatgtctgaaattctttccgtcggtgggaagatgctcatctacgcgctgatcagcttcggctcgacggtggtcgtcgccctctgcgcgtcggcgctgtccaacgggttttccgctaagctgagaagtcagctctttcgaaaggtgcaggacttctcgatggacgaaatcgggcggttctcgacgtccagcctgatcacccgctcgaccaacgacgtcatgcagattcagattttcatcgtgctcggcctgcagatgctgatgcgggcgccgatcatggccgtctgggcgatctgcaaaattgtcggcaagagctggcagtggaccttcgcgaccggcacgaccatcgtcctcgtgctggcggtggtgctgacctgcatcttcatcgcgatgccgaaattcaagaagatgcagtccctgacggaccgcctcaacgaggtgactcgggaaaatctgaccgggctgcgggtcgtccgcgcctacaacgccgaggattatcaggaaaccaaatttgaaaaggccaacaagaatctgacggacaccaacctgttcgcgatgcacacgatggcctttctgctgccgagcatcatggccgggatcaacggcctgaccctgtcgatctactggatcggcgcctacgtcatcgacgccgcccgcctggcgaacaagattacccagttctccaacatggtcgtcttttcccagtacgcgattcaggcggttatggcctttatgatgctcgtcgtgatcttcatgctgatgccccgcgcgtcggtggcggccagccgcatcaacgaagtcctcgacacgccgctgaccattgaagacggcacggcacaggacggcgtcgacggcatgaccggccaaatcgaattcagaaacgtcgatttccgctatcccggcggcgaagaagacgcggttcacgacatttcgttcacggcggaaaaaggggaaaccgtcgcgatcatcggggcgaccggcagcggcaagagctcgatgatcaacctgattccgcggttttacgacaccaccggcggcgaagtgctcgtcgacggccgcaacgtgaaggattattccgaaaaggcgctgcgcaacaagatcggctacatttctcagagcgcggtgctcttcaccgggacggtcagctccaacgtcggctacggcgacaatgggaaggccccggcgacggatgaggaaatccgcgaggcggtgcacactgctcaggctgacgagtttgtcgacaacatgaacggccaatacgacgcctacatcgcccagctcggcggcaacctgtccggcgggcagaaacagcggctgtccatcgcccgcgccatcgcgaagaagccggaaattttgattttcgacgattccttttcggcgctggactacaaaaccgaccgggccctgcgccacgagctcgacgaaaaatgcagcggtgtgacccggatcatcgttgcccagcgcatcggcacgatccgaaacgccgacaaaattctcgtgctcgaggacggtaagctggccggcgtcggcacccacgacgagctgatgcagcactgcgaggtgtatcagcagatcgcgctgtcgcagctttcgaaggaggaattggcatcatgagtgaaacgaacaacaaaacgcgcgtgcgccggccggcaggccgggggccgggccgccgggtgcgcggcgaaaaggcccaggatttcacgggcacctggaaaaaattactggcctattgccagcgggacgcggtgctcttgatcgtcgccctgatctgtattgtcgtcgcgacagtctgcacgctgatcgggccgaacaagctcggcgatttgaccgacgaaatcaccgccggcatccgtccggacacgaaggtgctgaccaccgtgtcgaaaaaaatgacgacgggcatgacggccaatatccagtcggtcactgccgacatcaccgtcaacatgtcgaacacggccgcgattcatcagaacacaaaagcggcgatggcctcgccggacgtgccggctgcggacaagcaggcccttcaggcgatggccacgtcgggctcccgggacttctcaggcttgagcgacgggacccttgacaagctcttcggcgccatcgaaatcgacgggacgaccctgaccggctcggaccaggtcaaaaccctgcaggcgcttcagcagctgaagggcgcgtcgggccaaagcgggtctggcaagaagagcgcggctaagcagatgaagacggccgggaaattcgtcagagccctgcccgacgcgtcggcgaaggtgattttcacgccctttaaagtcaagggcacgacgatctccagctccgatcaggtgaagatgatcaaagtcatgtcgaagatcgacatgcacgacaccgacagcgtcatggatcagctggacaagttgccggcctcggtttacggcctgatcaaaccgtcggtcaacttcgcgaaggtgggatccatcgcgcggttcatcgtgattttgtacgcggcgagcttcgtgatgcaggcgatccagggctggtctctggcgtcggtggctcagcgcctttcgaaaaagatgcgcaccgatgtggacgaaaagatcaaccggctgccgatggcgtggtacaacggccacagcaccggtgacgtcatgtcggtcgtgaccaacgacgtcgacctgatcggccagagcatgaaccagagcctcgggaccttcgtccaggccgtcgtgctcttcatcggcagcttcatcatgatgctgatcaccgacgtgcggatgaccctggccgcggtggccgcctgtctgatcggctttgtgctgatgttcacgatcatgcgccacagccagaagtatttcatcaagcagcagcaggatctgggcgcccttgacggctacatcgaagaaaattacgcggggcacacggtcatcaaggcctacaacggcgaagccaaggccgaatctgaatttgacaccctcaacaagagcctgagacgcagcggcttccgcgcccagtgcctctcggggctgatgcagccgatcatggcctttatcggcaacttcggctacgtcgtcgtctgtattgtcggcggggtgctggcgatcaacggcgacatcgaattcggcgtcatcgtatccttcatgctctacgtccgttatttcacccagcctttggggcagatcgctcaggcgatgcagatgctccagtccgcggcggcggccggcgaacgggtgttccgcttcctcgacgaaacggaaatgcccgacgaaagcgcgaagccggcggtgatcgaagacgtcaaggggactgtcgatttcgaccacgtccgcttccgttacgacggcgcagacgaagacgtcatccacgatttctccgctcacgtgaagcctgggcagaagattgcgattgtcggccccaccggcgccggcaagacgacgatggtcaacctgctgatgcgtttctacgatttagatggcggcgaaatccggattgacggcgagccgacgcagaacctcaagcgcgaggcggtgcacgcccagttctgtatggtgctgcaggacacttggctgttcgagggcactgttcgggaaaatctggtgtacaacacgccggacgtcagccaggataaaatcgacgcggcctgccgcgctgtgggtctcgaccactttgtgcgcagcctgccccagggctacgataccgtgctcgacgataaaacggggctgtcccaggggcagcggcagcagctgaccattgcccgggcgatgatcgccgacaagccgatgctgatcctcgacgaagcgaccagctccgtcgacacgcggaccgagctcaagattcagaacgcgatggacatgctgatgagcgatcgcacctcctttgtcatcgcccaccggctgtcgacaatccgcgacgccgacctgattctggtcatgaatcacggcgacatcatcgaaagcggcacccacgatgagctgctggctcagggcggcttctacgccaatctgtacaacagccagttcgaatcggcgtcgtaaaatttatttcagtcattaaaaaaggacgttctcttgaagtcaagagcgcgtccttttgcgtgtgggatttaagggcagcagcctaaaaaatcgcgcacagcaccagcgtgacgatggccagtccgccctgcttgaacaggatcgacgggctgctggtcaggctgccgtagagggccaccagcacgatggtgcccatcagcagcatgaccgcgattttgcttgcgaaaaccagcgcggccagcagcaccagcacgccgatcagaccgttgtaaatcccctggtttttgaagagggtctgcaccgacgggcgggagagctccgccttgtccatgccgaaaacccgagcagtggtgtccgaggtggtcgcgaaggtttcgaggtagagaatgtagaaaaattcgagggcgaccagaacggacagaattttgatcggtaaaatcatagaaagggcctccttattattagggtgtatttattataatcggcctttaatttagatgaaaaccggtgaaatgtcaaggcggcccggcaagtaaggtgaaccaacgggccgaatagaagcggaatcggtgacgggagcctgcgccccgtacgccaaaaattccgcggcggctgttcgctcacgtttaggcacatcagtatctcaaaatgtatcctttccttattcctgaatccagacgaaggtttcggattctttttttgtaaaaaaataaaaggatgaccggggtggatcatccttttgagattaatttattgcgctgcagaagtttgagccgtggtgtgatcagaagtctgcaccgtgccgtccgaattgatcgagacgccccaggtgcggctgcgcgtgctgattttgtttaacactcgggtgctttcgcttcccgtcagcacccgaggctgaaagtcgttggtggacgaactgctggagatggagcagggcagaaccttggcgccgttcgtcgcggtcagcttgccgttttcaaagtggaaggtcagctggaagatcatcgaatccttgtcagacgggttggtgttgccgccgaaacagaaattgccgagactgtagacgatgtagcgtcccttgtacatctcgatgccctgcaccacgtggggatgggagccgaggacgaggtcggcgccgtggtcgatcgcggatttggcgagagccgtttcgtaggcctccggcatcgcgttgcgttcgatgccccagtggtaatagacgatgatcgcgtcgggcttctgctttttcgcgcgggtgatgagcttggtcagcgtggcctcgctggggtcgtccaggccgttgatgccgatcagtgcgaacttttcgccgcggacccgcagggtagcgacagtgttgtagccgaaatagggaatattggcttggtcgagggccttttgggtgtcggagaagccggtgtcgccgaaatcgtgggagtggttgttggcgatggtcacggcttcgacgctgccgttctttaaaatgtcagtgtactcggcggggcccttaaaggtgaaggttttgaccgcgcggtcggtggaggtggtcagggtgccttcgaggttgacaacggtcaggtcgtcggcgctgaacacatcgcggacgtttttcagaaagtaggcggcgccgcggcgctgatagacgctgttgaagttggtgctgtaccgggagtcgacgccgagggtgcagtcgccggcggcggaaaaggtcacgtcgacagcgggcttggccgcggcggtctttttgtctgccgccttggacgttttggccgctttggacgaggacttcgacggcgccttccggccgaagctgcacccgcccagcgcggcggcgcagaggacacaggataagagaatcacaggtaagatacgacgaatcaatcggtggtgcatggggggtctccttttcaaaaaaatgatatcctttaataactttagatgatatcatttattttaaaaagatgcaatcgttaaacagcgtttcagcgcaaaataaaaaggatgacctgaagcgatcatccttttagaggtacaggtttgcgtttcagccctgcagcattttgtagagcttggccggattcttttcgtatttccagagctttgggttatcttccaattggtcccggacgtggtgcgccgcgaggaagtcctcgatttcggcgttgggccaggccatttcggccttcaggtaatgggagagggcgcggatggccgcgttggatttttcctgggcgaggtagcccttggcgtcggcgtcattcaaatcccagaactgtccgagcacccggatcatgtcggcatcgtcggcattcacctcgagcagacactgaatggtcttcgagagcccttccttgaggccattttcccggccttcttcgaggccctgctggtagccttcgtcgttaaagcggtgatgcagctcttccttgccggagtcgatgccgtcttttacgaattggccgccctttgaagcgaggtcgctgcccttttccaataattttttccatctatcgcttgccatagtcgtgctcctttgcgttgattcgtttttggtttttcacatagtgtagcaggctaatcaaaagaaaggcttaaagttcaattaatgaaaaagcattaaactaaaaaggaatataaattgtggaggcagaattatggacaattttatgcaattagcgaaagaacggtattcggtgcgcaagtacaaggatacgccgatcgaagacgacaagctcgatcaaatcattgaagcgggcatcgtcgcgccgacagcccacaacgaacagccgtggcggtgctacgtgctcaaaagcccggaagcgctgaaaaagatcaacgatctgacgacctgcgccttccacgcaccggtggtgctgatgttcacctacaataaggacgaacagtggaagaatccgctggaagaaggcgtgaccgctggacaggaagacgtcagcatcgtcgccacccacatgatgctcgaagcctgggaattgggcatcggctcctgctgggtcaactatttcccgaatacgaagaccgaagaagccttcaacctgccggacaacgaacgggttgtgctgctcatgccgatgggctacgcgcaggacggcgttcacgcggcacacctgcacaacgaaaaccgctcccgcgacgaactggtgaaggaactctaactgatttttaatgggattgataaaggcatccgctgaagcgggtgtcttttttatttgacttatgtccgaattcgtactataatgtccgaaaacgtacaaaaacacacgcatacatcgaaatggagatacaatggacaatttattcgaaacctacaatcagattatctgcgaaatggacgtggattatcacaacgcggcggtgcggctcggactgtcggacagcgagttcggcattctctacaccctctgcgtcgagggcagcggcaccaatcagagtgtactctacaagaaatccggcattgcccgatcgactgtgaattcggcgattcgcaaaatggagggccggggctggctttatcttgtgcccggggagggccgcaacacccgggtgatgctgaccgagaatggcaaggcggcggtcgcgcagactgtcggccggatcgttgagatcgaaaagcagatcttcggcgcctttacagaggaagaggcgaagctcctcattcggctgaaccgttcctttgaggcacaattgaagcaggctgttgaaaaattgtaaggaggctgcatgccaaaccatcaaattcatttatccgatcatttcacgacgggccggctcctgcgctacgcgctgccgtccatcgggatgatgattttcacctcggtgtacagtgtcgttgacggctttttcgtgtccaacatcgtcggcaagacgtcctttgcggcggtcaatttgattctgccggtgctcgagattctcggtgccctcggctacgtgttcggcaccggcggcagtgccctggtctcgaaggagctgggcgagggcaggcgggaggaggcgagtgaaaccttttcgctgatggtgtgcacgacgatcgtgataggcgttttcgtcgcggtggtcggcacaccgctgctgcgcccgattttgagggcgattggcgccaagggcgcgatgctggaagaggccatggcctacggcacgattttgatgccggcgatgatcatcttcatgctgcaatacatgtttcaggcgtttttcatcacggctgaaaagccgaagctgggcttcgcgatcacggtgatcgccgggctgacgaacatgttcctcgactggctgttcatggcggtcttccactggggcattcggggcgcggccctggcgacggccttggcgcaggtcatcggcggcgcggtgccgatcgtttatttcgcgcgtcccaatacggcagtgctccacctcggacggccccgctttcgttttagcaagatcaagaaggcggcggccaacggcgcatcggaattcatgacgacggtttccctgtccatcgtcagtatctgctacaacgtgcagctgatccgctttgccggtcaggacggcgtcgccgcctacggggtgatcatgtacgtgaacttcatcttcctcgcggtgttcatcggctacgcgaccgggacggcgccgatcgtcggctttcatttcggcgcgggccacaaggacgagctccacggcattttgaagcggagcctgtcgctgatcgctgtgaccgggatcgcgctgacagcggcagctgaagttctggcccggccgctatcgatgattttcgtcagctacgacgcccatctgctcgcgatgacggtccgcggttttcggctttacagcctgtcctacctgctcgcggggtttaacatctacggctcgtccttcttcacagcgctgaacaacgggtttgtctccgccgcgatttccttcctgcgcaccctcgtctttgaaacgggctgcgtgtggctgctgccggcgtttttcgggctgacgggcatctggtttgcgatcatcgtcgcggaggtgctggccctcgcggtcacggctgcctttctgcggaaaaaccgcgcgcggtacggctattgacggccggaggaggaaggcgatttttcataacctgaaaatcaaactttaagctttaagatcgaaagaaaatgtgttatcctgttccgaacttgaaggtttatgtgcgccaagaacattaaacgaaaagaaggaaaatgtatgaaaaatcaggagaatcagaaaaaccaaaacaatcaagaagtccaggaaaacaacagcagcaaattcaaccgtatgacgtcgcggatgctgcagatcaaggccgaaacggcgtccaacgaggaaatcaaggaccggctgctgtccggcggccgggtgaccggaacgaatatggtcgtcatggtctgcgccattttaatcgcgtcggtggggctgaacaccaattccattccagtcattatcggggcgatgctggtctcgccgctgatgggcagcatcctcgcgatcgcctacggcacggtgtccgccgacccggatttgacgcggctccattcggtcggctttgcttttcaaatcattttcagtctgatcgcctcgacgatctatttcatcttgagcccggtcaaggcgccgacccatgagctgctggcccggacgtcaccgtcttttttcgacgtcatcatcgcctccgccgggggcatcgccggcatcgtcggccagacgaacaaggaaaaggccaacaacatcgtgcccggggtggccatcgcgacggcgctgatgccgccgctgtgcacctgcggctacgcgatcgccaacatgaacctgcggatgctcggcggtgtggcctacctgtttttgatcaacgcctacttcatttacgcgtcggcctgtctgtttttgagtctcctcgaaattccgagggtcagagagctgaccccggccgaatggcggagaagtagaatgaaaatggtccgcaacacgatcctcgtgctgctgccctgcattgtccttgcggtgacggtggggctgaagtaaacagcgtgcagtgtccttattaaaagtattaaaggaaaatataagcaaagtcgattatgatagacacataaaaattagattaaacaaacaaacgcagaaaggcggttattgatatgacaagattatccatagaaaacattatcgggcggacgatcatcgactcccggggcaatccaacggtagaggcggaagttcgtctcgcggacggtacggttggccgcggcgcgtcgccgtcgggcgcatccaccggtgaattcgaagcgctggagcttcgggatcaggacccgtccaaatttggcggcaaaggcgtctcgaaggccgtcgccaatgtcaacgacaagatcgcgccggctctggcaggaatggacgcctcagatcaggccggcatcgacaaagcgatgttggagctggacggtacgccggataaatccgccctcggtgccaacgccattctggcggtgtccatcgcggcggctcaggcggcggccaaggcggaaggcgtcccgctgtaccgctacttaggcggcgctaacgggaccgtgctgccggtgccgatgatgaacattttaaacggcggcgcccacgcctccaattcggtggacacccaggaattcatgattatgccggtgggcgcgccgagcttcagcgaagggctgcgccagagcaccgaagtgttccacgccctccagcagcttttgaagagcgaaggacagaccacagcggtcggcgacgaaggcggcttcgcgccgaacctggcctcggatgaagacgcgattcagcacatccttcaggccgtggaaaacgcgggctacaccccgggcgaagattttgtgctcgcgatggacgccgcgtcttcagaatggaaaagcgacaagggcctgggtttctatcaccagccgaaatcggggaaggatttcacctctgatgaattgatcgcccattgggaagatctgcttggaaaatacccgatcgtctccattgaagacggcctcgacgaagaagactgggcgggctggcagcgcatgacggcggccctcggcggcaaggtgcagctggtcggagacgacttgttcgtcaccaacaccgaacgcctcgccaaggggatcgacctcggcgccggcaacgcgattctgatcaagctcaaccagatcggcaccgtgtccgaaaccctggaagccatccgtatggcgggtcgcgctggctaccgcgcggtgatttcccatcgctccggtgaaaccgaagacacgaccatcgctgatttggcggtcgccgtcaacgccggtcagatcaaaaccggcgcgccgtcccggacggaacgggtcgccaagtacaaccagctgcttcgcatcgagtcagatctcggtgccggcgcgatgtacctcggaaagggcgccttcggcttcagaaaataaaacaacatcctcattctttttaacgtcaagccgtctagcgaaattgatttttcgccgggcggttttttgtttatggcgtgacgattttaaaggcgcggaccgcgaaaccgtgatatgataaaaagacaaagttgaacaacaatcaaataatcaaaaagatcagaagggagacgactatgcaatacgattttgaaaccgtgctggaccgacggggaaaggacgcgatggcggtggacgcggtgggctcaaaggccctgaagggtttcagcccgagcacaccgaagccgggcttcgacgtgatcccgatgtgggtggcggacatgaacttcccgacagcccgatccattcaagacgcgatcatcgcgcgggcgaagcacccggccttcggctatttcgcgcccagtgacgcctactaccaggccattatcaactggcacaagcgcaagggcgtggacgatttgaccaaggacgtcatcacctacgaaaacggcgtcctcggcggcatcgtctcgacgctgaaggtgttcgcggcgccgggggacgcggtgctgcttcacagcccgacctacatgggctttaccaactgtgtccggagcaacggcttccatatcgtccacagtccgctgaagcgggacgaagccggcgtctggcggatggatcccgaggatatggataaaaagatcaaagccaacgacattcacgtcgcgattttctgcaaccccttcaacccctgcggccgggtctggagccgggaagagcttgaggcggcgctggcggtgtgcgaggccaacgacgttttcgtgatcgccgacgaaatctggtcggatttattactcaacggccaccgctacacaccggttcagtcggtgaatgcctgggcgaagacccacacggcggccttttacgcgccgagcaagaccttcaacctggccggcctgatcggttcttacagtgtcatttacaacaagacagtgcggcagcgggttcgggcgatcggacaaaaaacgatctacaacgcgatgaacgtcttctccgagcacgcgctgatcggcgcctacagcgacgagggtgcggactggctcagtcagctgctgccggtgctgtccaacaatgtgaacttcgcctgcaactacgtagacgcccattttgacggcgtcacggccttccgctccgaagggacgtacatgctgctgctggactgcacggactggctcgaaaaccacggcatcacccaaaaggaactgcttcagaagggctgggacgtcggcgtcggctggcaggacggccatctgttcgaggcgccgacgtcgatccgcctcaatctggcctcgccgacccaccggatcgcggaagcctttcatcggatggaccgctacgtgttcaacgcctgaggatcgccatgattgtagggatgacctattaccagatcgcctggtactttctcatttactcctttctcggctgggttgtcgaggtggtgtttcacgcggtgcaccaggggaaaatcgtcaaccggggttttttgaacggcccggtctgcccggtgtacggcttcggcgtgctggccgtctttgccgtcgcctggggaatcggccggacggcgccagagcgtctgccggcgtggacgatttttctcgtcggtatggtctttgcgacgctggtcgagctgatcgccggctgggcgctggatcggctgtttcacacccggtggtgggactacagcggcaagccgctgaacgtcggcggctacatctgtccggagtactcgatcatctgggggctggcgatcatgctcgtcgtgcagtacgtccagccgatggtgcgccacacggccaccgacctgattccgccggattacggctggattgtgctggcggtgctgtacagcgtgtacctggccgatttgatcgtgacggttatgatcatcaacggcttcaaccgacggctggccgagctggacgaaatccggacctcgctgcgcaccgtcagcgacaagctgaccgaggatatcggcggcggcgcgatggaagcgacccagcgcgtccaggaagagcaggtgcaggcagctctggcccgggcagaaatgagcgaacgggccgaagccaagaaggcagcggcacaagccgcggtgcgccagcgcagccaggccttaagagctaaggctcagcgcctgcgggcacgcatcatggcgccgaaggttttcggcggacgccggctgatgcgggccttcccgtcgatgcagcatcgggatttcggagaagtgctcgattggctgcgggatgaaatgaacagtgaaaagaaataaaaaacaacccgcttggattgatacaaatccaaacgggttatatttatgtctgcaatgggattttaccctttactgcacagcgccgtctgtcgaagcggggtcatcgaggggttcggtagtggcgtcggacgattgggtgtcgtcaggctgctgcgcgataattgcggcgtaaaattcggcgtcggtctgctggtagtagggcatcacccagaaaatgccgacgagaccgcaggtgatggcagagagaaggaaccatccgatgaaggacagatcgagcacaaaggcgtccattttgtggccgttcatcagcgtctttgagcgtttgagggcggcttcgtacgtcaaattgggatcttctgcaaccaggtagccgaccagccggtactgataagccttgacaatgccgggaacgacgagcagcagagaccagaggaagatgaacaagttgcgcaggaagagcacgaggatgacattgccgtaattgtgagtaaagccgtgggacagggcctgaccgaaatccacgcggtcctgtcggttttccaaggcgtaatgatattgcccgatctccaggggcagaccgacgaaaatgccgagcagggtggtcacgatggccggcctcgcgatgaaggaattgaattggaagatttcatcgagatgggagaaagtgcccccaccggagaaaatgtaggagacgccgctgcccaggaagccggaaatgagggcgaaaatcaaatagccgccgacgagggcccagtagtgggcatgaaagacgtttttggcgtcttgttttaataatttgcgattaatcatagtttttacactcttttctttaaaaataaaaattgccttaataatttattttactaaggcaataatacaataaaaattttacgaaatcaaggaatttgtacagatatttcagggcttaagacttaagaaagcggcgcagttgccccggcgttcgccggcggcccggtgggagaagagcagctttgcgttgcaccgggtgcagacgtcggtgacctgaatgtgctcgggcttgacgccggcattttcgaggacgaggcggttggcctgccagagatcgagctgacagtgcagggcgccgtcacgggtgtggggactcaagagaatctgatcggcctgggcgccgaagcggtctttgaacaccgcggcgacgtcctcggaaatttcgtagcagtcccggcagatggacggcccgaccgcgcagaccagatccgccgggtcggagccgaaatgggtgcgcatcagatcgatggcgttagccgcgatgccggcagcggtgccccgccagccggaatgtacgaggccgaccgcccgatgcaccgggtcgatcaggtagaccggcgtgcagtcggcggtgaagacgccgaggatcagccccggcgtgttggtgaccatgccgtcgacgtccctgccccagcggcggaacagcgttccctcgccgccgtctcgcttgtcgacaacccggacgttgccggtgtggccctgatgggcgcagacgaagtggcgcaggctgcggccgccgccgaaggcgtcggcgatgcgctggtaattggcgtcgacgaccatcggatcgccctcccggtcgtagttgaaattcatggccgcgcagtcgccggagctgacgccgccctcccgcgtcgtgaagacgtgatcgacgcagccggtctgctcgagcatcgggaaggacagcgtgcgcagcggcaggccgccgatcgtttcagttcggtctaagagaaccggacggttcggatcttttcgaatgagttgcatatcatggcgctccttttattaaatgatattgtactttttgagtttgcgttcattgtaccacggcccttgcaaaatgcaaggcggtgcgctatactgggggcgctgtaaaaaaggcaggggagtctgtacgcaggctgagagtagaccaaatggcctagacccttaaacctgatttggatcatgccaacgcagggagcaccgggaacgatgagctttgcaggcgggtccgcctgctttttttgtgcgcggttcatcgggggcaccaccttgaatcgccttagaaaacggaaatgcgaagtgaaaaggagcaatgaatgagaacagcattgacgatcgctggcagtgataccagcggaggcgccggcattcaagccgatttgaaaaccatgaccgtaaacggcgttttcgccatgagcgcggttacggctctgacggctcagaacaccaccggcgtcacggacattatggaagtcaccccgaagtttttaggggaagaactggacgcggtctttatcgatattttccccgatgcggtgaaaatcgggatggtcagctcggccgcgctgatcgaggtcatcgccgaacgcctcgcccactaccaggcggcgcacatcgtcctcgacccggtgatggtcgccacctccggcgcgaagcttttgcgcgatgacgcggcggacacgctgaagcgcgcgctgatgccgctggcggaaatcatcacgccgaacattcccgaagcggaaattctctcggggctcgacatcgcaaccgaagccgacatggaaaaggccggacaggccatcggcgaaaacctcggctgcgcggtcctcgtcaagggcggtcaccaggtcaacgacgccaacgactacctctggcagccggacggcggacagtggttcaccggcaagcgcatcgacaacccgaatactcacggcaccggctgcaccctgtcgtcggcgatcgcggccaacctggccaagggctacgcgctgaacgacgcggtggctcaggcgaaggccttcctctccggcgcgctggcggacggcctcgatctcggcaagggggccgggccgatgaaccacgcctttgacatcaaggacagctacaaggcggtgcggtcatgagcgaacaaaaaaagacgacgagctttcagaacgggctcatctggttcggcgccggggtgtctattgcggaaatcctcacggggacgtatttcgcgcccctgggctttgccaagggccttgcggcgattttaatcggccacatcatcggctgcacgatgttcttcttctccgggctcatcggcggcagaacccggaaaagcgccatggaaagcgtcaagctctccttcggcggccgaggcggcttgatctttgcggccctcaatgtccttcagctcgtgggctggacagcgatcatgatttacgacggcgccggcgccgttggcggcatcttcccgggacatgcgtggatctggtgcctggttatcggcgggctgatcctgctgtggattgccatcggcatcacgaacctcggcccggtgaaccaggtggccatggcggcgctgttcattttgaccatcgtgctgtgcaaagtgatcttcacgaaaggctccgtgtggacggtgccggcgaaatcaggcctgagcttcggcgcggccattgaactcgccgtggcgatgcctttgtcgtggctgcccctgatttccgactacacccgggaagcggacaagcccttcagcgcgaccctgacctcgaccctcgtttacggcggggtgtccacgtggatgtacatcatcggcatgggcgcagcgatcctcaccggcggcggagatatcgcgacgatcatggtcaaggcgggcctcggcatcgcggcgctgatcatcgtcatcctgtccacggtgaccacgaccttcctcgacgcgtggtccgcggggatctcgacggaatccctgtggaagccgggcaccggcaaaaacgtcgccctgatcgcgacggtcatcggcatggtgctggccatgattttccccatggacgacatcaccgatttcctttacctcatcggctcggtgttcgccccgatgatcgcggtgcagatcgccgactacttcattttgaaaaaagccgacagtgccgatcggccgtggaacgtgcgcaatctcgtcgtctgggccattggtttcgtactctatcggctgctgatgaaagtcgatctgcctgtgggcagcactttgccggacatggccgtcacgatggtgattctactcatcgcatcgccgaaaactaaaaaagcataatattgataaataccctgattactgatatccaataatcagggtatttttatgtgttattgctttaagttgaaatatgtagaaatgaatgtacagattgatgccggtagactaataaaaagcatttagaaaaaacagatttttagatagaaaggtgtacctatatctgttaagataagagagttgtaaagacatgaaataaaggagttttggccattcatgaaaaaatacttaaaacttctgcggactcaacattatttaaagaatcttcttgtattcataccaatcttttttaaccagacccttttcagcgggaagttcattaatgcgcttctcgggttttttgctttttgtatgatatcatccgcagtctacattattaacgatatcaaagatgtagagaaagaccgtcatcatccgacaaaacgttttcgtccaattgcaagcggagcagtcaatgttcagaaagctaaaacaattggaatcgtctgcctgattttctctatcatactaacatcgttcacaaaattgtacatcagcattattttcatcatgttgtactttgttctgaatatcctgtacagtggaggacttaagaacaaaccgcttgttgatgttgtcattcttgcatccggattcattctccgcgttatttacggagcgtacctgacaggtgttccgatctccggatggctttacctcacgatttggacaggagccttctatatgggccttggcaaacgaaggaatgaaattgagaagcagaaggaattgggagaaacaagaactgttctaaaatactatacttacggtttccttgataagaatatgtatgtctgtgtcgcacttgccaacgtattttacgccttatgggcagttggacatgatgatcagaggttcctctggtctgcgccaatcttgatgattgttctaatgaagtacagtctcgatattgaaggaaattcagatggagaccctatcgaagtcattcttcatgacaaagtattgatcgctcttatttcggtttttgcagcgtacctattctttattctatatttttgagagaggatttatgtatgaatgtatatgactttgacggaacaatctacgaaggtgacagttccatcgacttttatatgtattgtctgaaaaagcatccaaaaattctgaaagccctgccaacacagatgaaaggctttttactgtacagatttcacaaaattaacaagaccagactcaaagaatactacttttcatttcttagagcattagaaaaaccagagctggatgttgaaaaattctgggatgagaaccggaacaagatcaaaagctggtatttaaagcagaaaaatccattagatgttattatatcggcatctccggagtttctgctgcgtccgatcctgaacatcattggaatatatcatctcattgcatctgatgtagatattcatactggaaaatttagatcggataactgtcacgatgaaataaaaccggtttatttcaaccaacggtatccagatgaacacatagataatttttattcagattcgttatccgatgaacctatggccaggctagctgatgcagcatggttgattcgccatgatcagatcaagaaatggagcattacatgaaaaacttttcaaaatccatctttgccttacttgttatctatatggtattgcctatcactatatttattttggggtggataaaactatggttttcgataccagcagtaatcattattgcatatctgctgttccgtatgtccaaagacaagactattattccagaattaccatcctttagtaaaaaaggaatagaaacgcttattcttgctattttaattattgcactatgggtctatttttccggaattggcaaatttgtttttcagaatgatgatcatctttatcgaaatgcggtattcgagatgctggtgaacaataaatggcctgtcattaaaaattttaatgtggatggcgtcaatacgccatttatgtttgtttattatattggtttttggatgccagcagctcttattggaaaagtattcgggattacagcagggtattgctttcaggcaatctgggcagtcataggtatatggctattttattatctgtgctgcagttatctaaaaaaagtatctctgcttccgcttattatctttattttcttcagcggtcttgatgtaattggaaccgcaattatgactggagcacctgtttctatttttgcaggagaccatcttgaatggtgggaaagtggaatgcagttttcgagtttcaccacgcagcttttctgggtttttaatcaggcgatccctgcttggatattaactatacttgtccttatgcaaaagaaaaacagatacgtcgttttcttacttggggttagtcttattttctgtccactgccattcatcggaattatcccttttgtaatctacgtcatcatgagaaacgcatggcagacaaaagttctaaaagcagcaataacgaacctgtttacagttgaaaatattcttggcggtggaatttgcggaattatcacatatctttacttcaaaacaaattccagtgggcagcatattgtgtttttgccagctgaaataatgggcaagagaggattccttttcagtgtagttctatttatatttcttgaaattggggtttacatcattgccatttataaatatgaaaaaaagaatccactgctttatattacattcctttttctctttacttgcccgcttattcaggtagggtacgggggagactattgcatgcgtgcctgcataccaggagaaatagttttgttccttttggttatgaaaaccatatataaagctagaaaaagtaaagacgtactgattgtcacagcgcttattatcctcttgaccattggcgctattactccaatccatgagatcaacagaacaattcaaaataccagagcaaactataataacaatgttccggtttacgctggaacatatacagaaaaagagcttatgatgggtaatcttggaacaaatttccgcggaaaaataaataatagtttctttgccaaacatctagcgaaataaaaagaaggttgtcatataaaacgatgtggttcctctttattggataactctaaaaaagccgaacgcgaaagcgtccggcttttttggtgtgataaaagatttagatgtttttggcgacttcgaccttggcgatcagactcggcagggtggtttcgaagttcacgccgtaccacggctttttcgggtcttttaaggtgacggcgatggtttcggcggtgtagtccgaagcgatggccatggcgtcgttccaggacaggccgttcatgatgccgccgacgcaggcactggcgaagaggtccccggtgccgtgataggccgcgtcgatccggatgttctggtgggagaggaattctccggtgcgggtgtcgaggcccataaagccggtcatgccgtctttgagggaaaccccggtgaggacagcgatggtcgggccgagcttgccgagtttgtcgaggagggccttgacttcgctttcagacatatcttctttatacggggtgtccgtcatgaagcaggcttcggtgatgttcgggacgatgatgtcggcgtggccgcagaattcagcgttgcgttttgcgtagtcgagatcgaaggctgggtagagggcgccgttgtcggccatgaccgggtcgacgaatttcagcgtcttgtcgtccggggcgaagtcggcgaagattttttcgaccatttcgatttgttcgaaagagccgaggtagccggtgtagatgccgtcaaaggtgatgccctcatcctgccagtgtttagtgatcggcgcgatttgatcgcttaaatcggcgcaggtgaaatttttgaacatcgtgtgggttgagagcacagccgtcggcagaatcgccgtttcgacgcccatggccgatatgaccggcagggcgatcgtcgtcgagcatttgccgaagcaggaaatatcttggatcgaaaggacacgtttcatggtttgcctcctgagtgtttgaatgtcgtaaaatgtgggacgcttgtcaatcccgctggcatttattataatcgatattggaccgaataaaagagtcagtttacgaataatcagaaaggtcagatgcgatgctcacttaccatttcaaaagcgggggtgacccgctgtacattcagctttatcaggatatcaaaagcgacattctctccggcagcctcgcgccgggcgaggcgctgccgggcaagcggccctttgccaaacagctcggcgtctcggtgtccaccgtcgaaaacgcctacggccagctgatggccgaggggtacatcacgtctatgccccggcgggggttttacgtcgccgaggtcaagaccctgccccagacgcccgaggcggtgccggcccggcacgagcctgacccggtgctggcctcactgcacacggtgctgagccagcggcactggttcgccgattttcagagtaaccagaccgacccggcgtccttcccgtttaccctatgggcgaagctgacccgggaggtgctcaacgacgaccaggtggcgctgatgacgaacccgccggcagggggcacgatggcgctgcgcaccgccatcgccgaccacctccgcgatttccgcggcctcgtcgtcgcgccggaacagatcatcgtcggcgccggcaccgaatacctctacacgctgctgattcagctgctcggcttcgaccggatttacgcggtggaatcgccggggtaccggaaaatcctccaggtgtatcaggcccaccgtcttaaaacggcgaagatcgcgctggaccaccaggggctcagacccgatctgctcgaggattccggggcgtcgatcgtgcacatcacgccgagccaccatttcccaaccgggatcacgatgcccatcgcccggcgctacgagatgctcggctgggcaaaccgctcggcagaccggatcatcatcgaggacgattacgacagcgaattccggatgaccgggcggccgctgccgccgctggctgccatcgacatgaccggccgggtcatttatatgaacaccttcaccaagagcctggcctcgacgatccgcgtgtcctacatggtgctgccgccggcgctgactgcggccttttaccggaagctgaggttttacgcctgcaccgtctcgaccttcgagcaggcggcgctgagccgatttatcgccgaggggcattacgaaaagcacatcaaccggatgcgccagacctaccgccggcgacgggacgcgctgatgcgcgcggtggccgacagcccgatggcgaaaatcgcgtcgatcagcgaggaaaacgccgggctgcacttcgtcctaacgctgaagacgaagaagcgggacgccgacatcgtgcgcgacgcggccaagcggggcattcgggtggcgcccctcgaggacgccggcgcccaccgctttctgatcaattactcgtcgattcccgaatcggtgattcccgaggccgtcaggcggctcagcgaggcagtgacggcataaaagcgcttaaagagggcgcagggtcagctcgccagagcggatcagcctttcggtgccgttggccatttggagcctgaggtggccgaaatcgtcgaagccgatcaccgtgccgaccaggggttcaccggcgccggtgagggtgacggcccggccgattaagttggagcggcggcggtagcgctcggcgtagggcgccgggtccttggcctgcccgagggcggtcaggccgtcgatcatcgcggcgagcaggcgggtgcgcagatcgtcgggatcgctgcccttttcggcgtaggcccgcgcggtggtgccggcgatgctgccggcccgctcggcgatctcgtcggggaaaccctcagccggatcaaagaggttgaacccgatgccgacgacgatccaccgcttttggggatcgggatcagcccggccttcggtgaggatgccggcgatttttttcggtccgatcatcaaatcgttgacccatttgattttcggtgtgatgccagcggccttttcgacagcctggaccgagacggcgcaggcccccatggtcacgaaatcggccagggcggggttgtcggcggtccggtagcggaccgagaggtagaggccggagtccttcggggagaaaaaggcgcggcccattcggccccgtccggcgctttgggcgtcggccgcgacgatggcgccgtggggcaggtccggggcggctttcagcacgtcattggtggagccgaggacctccgcccagcggacgcggtccagcacagccgggttgtcgaggtagggaatcagcggcgccgtatcgcgccattggatcttgttcatgagacactccttgtcagtgaatttggttggttttagtatagcacagcgggaaaatcgtggtataatatcaattacaaatcaatatagtatgtaattgacaatttgtggtttaaaaagagaacggcaaagagaaagggaggataatatgcaggcgttgagtgagacgacacagcagaaatacgacaagctcaaggatgagctgaaagccattggatcggtggccgtggccttttcagggggcgtggattcgacattgcttctggcggtggcccacgaggtgctcggggaccaggccgtcggcgtgacgatcgcgtccaatctggtgccgccgagggaattggacgaagcgaagaccttttgcgaaagccgcggcatccgccacatcctctgcccggtggacgccctgaaggtggaacaggtgcgggtcaatccgccggaccgctgctattggtgcaagcacacgaatttctcgaaaattcaagaagtggcgaaggaattagggcttgtggccgtcgctgaaggctccaatgtggacgatcttggcgattaccggccgggtctcaaggcggtggcggagctcaagattgaaagcccgctccgtggcgcgggcttgaccaaggcggaaatccgcgaaatttccaaggcgatgggcctgccgacctgggacaagccgtcctacgcctgcctggcgtcccgttttgcctacgggcacgcgattaccgcggaagggctcagtctggtggaccgggccgaacagtttttgatcgatctcggctttaagtcgatgcgggtgcgcatccacggtgacgaggacccgatcgcgcgcatcgaggtggcgccggagcgctttgaagacctgatcgcccagcgcggcaaaatcgtcccggccttcaaggcaatgggcttccgctacgtgacgatggaccttcagggctaccgggttgggagcatgaacgaaaccctgaaacagtcatgagacaggcgttgatctgcctggcggtcggctacggcttcggctgttttttgagcgccgccttcgcgggacgccgccgcggcgtctcgatctttcaggtcggctcgggcaatccggggatggccaacgcgatgcgctgcttcggctttggcaccggcatggcggtgctggccggggatattctgaagacggtcgcggcctggctggtgacggcgctgcttttcgggcgcacggcggccgtcgccgggttcaccgccctcggggcggtcctcggacacaactttcccttttggcaccggtttaaaggcggcaaaggtgtcgccgtgacctgctccggcgtcgtgctgatgctgccgggctgggggttcgcggcgctgattgccggcgcagcggccgtgatcctgacccattatctctgtatcggggcggtcgtcatcccggccgtgttcatcgctccggcggccctcactgcgggcccagcggcgggctggactgccgccgcgatgacggctctggcagtggcggccaattggaaaagcctggtgaagctggtcaggggcactgaagcgcaggtcgacgtgatcgggctgataggggagaagatcgggaaaaataaaaagagctgacattaaaaaagcagtaccggattttaaaatttaaaatccggtactgcttttttacgcgttcagacagctgtcgacaaaggccagactctttttgagcacgtcctttgcggccggggtgtcggtttcccggtcgaaatcgtggacgtttccggcggcgacaaagcgttcgggattgaattgattgcacagcgcggtgaactcagcgaaggggacgtccgggtcggcgatggcgtgggcggcgaagagcggcgcgggcagcgcggtcacattgcgcagcgagtcgttcaaataaaagaatttgtcccgccccttgtagatcaggcggcgccaggcgccggtttgtctcgcgtagacgtagaggctgtagtgggtggccatcgggccgtcggcgtggacggtctgagggacggcgtcgaaggcgtccttggacacctggggcagcccggcgtaatagggcgacggggtggtgtcccagcggtcggtcagaaagccgtagccgtaataggagaggatgccggccggcggggtggggagatcctcggaagcggcgatcatcagcgcgaggtaggcgccggcggaacgcccccagaggaaatagggcaggctgtccaagccaaagatttccggatactcaatgtagcattttgcagaagcacggacgtcggacaggatggtgtcgaggtcggcggccggtgccagcgggtagtcgaaggcgatgacggcgaggccggcaccggtaaaagcttcgatgtgagctttgggcaggtcctcccgttcgccgtagagcaggccgccgccgtggaagtacaggacggccgcccggaccggcttttcaggattcaagtagaccgtggcttttttggtgtagtcgggatggttcagatcgatgacgcgttgcatggcgcgcactcctttcgtttttaaatttctttattgattctttaattttaagtttgacgtgtggtgtgagtaagatggcggcgcaaagggctgcagaatttaatagtcatcttatatctgatttgtttaaaatgcaaccgtctgaacgaaaaattaaaatccggttgaaaaataatagattttttaaaatttttattaaaatttgcttgcattttttctcagaacgtggcatgatagagctatcaaaagaattgaagttacagatttagttcaaaattaaaaaaggttgaaagagatcgttttcgatcccgagaaagtgaggaatcttttatgggttatttaaacaatcagacgggttaccgcgaatcgcttctggacaatcgttccatcgttaagaaaaacaattacgttgtgctcgaaccagacggactggtcaagaacgtgatcccgggctatgaaaactgcgacaccaccatccttggctgtcctgaaatgggcgcgactttcgcagattacctggtcaccgctcacgaaggcggcaaaaacgcagcaggcatcggcggcgacggcatcgaatccttcttatacgtcatctccggcgcagtgagcgtcaagaacgcagatgaatccgcagatctgaccgaaggcggctacatctacagcccggctgacaagccaatgactttcgaaaacaagggcagcgaagacgcaaagctctacgtttaccgcagacgctacatcccgttggaaggccacagcgcacacaccgttgtcggcaacgccaacgacattgaatacatggattacgaaggcatgaccaacgcgcagagcaaggatctgctgccgtccggcgaagatctgggctttgacatcaacatgcacttcttaagatttgcacctggcgcatcccacggctatctggaaacccatattcagcagcactcgatgtacttcctccagggcaagggcatgtataacctcgacggcgattggatgccgctgcaggccggcgactacgtctttatggattcctatgtcccgcagggctgctacggtgtcggcacagaagactacgtctacatttattccaaagactgcaaccgcgacgtacaactataaacggacttttgacgaagctccgaaatcaatcatttcggagctttaaattgaattaaaatttaaacgattaacacaacttttaatacaaggagattgattatgcgcttatcgagagatgaactgaaatcattgatgaaaaacaaattgatggcggcgggcctgcacgaagacgacgccgataccacagctgaaattttaacctggtcggacgaacggggctaccattcccacggctcagtccgcgttgaatactacagtgaacgcatcgccaagggcggcatcaccgtcgatccgaagatgacctggaaacagaccggtccctgcagcggcatgctggacggggacaacggcatcggatacgtcgtcgccaaacgcgggatggaacacgccatcgaattggcgaaggaaaacggcgtcgccatcgtcggcatgcgccgcctctcccacagcggctccatcggctactacaccgaaatggccgccgaacagggcctggccgcaatctcaatgtgccagtccgacccgatggccgtgccagtcggcggcaccgaaccctattacggcacgaacccgatttctttcgcggcaccgtcggcggacgggcgcaccgtcgttttcgatatggccacgaccgttcaggcctggggcaaaatcctcgacaagcgctcccgcggcgaatccatccctgacacctgggctgttgacgaaaagggcgtgccggtcaccgacccgaacaaggtcaacgcgctgctcccgatcgctggcgccaagggctacggcctgatgatgatggtcgacattttctccggtattctgaccggcgtgcccttcggcggccacgtcagctcgatgtaccacgacctgtcaaagggacgggatctcggccagctgcacatcgtcgtcgatccagaccgcttctgcgggaaggacgccttcctgaaggctgtgagccagtccctcgacgagctccacgccattccgaccgcgccgggctacgatcaggtgtactacccaggcgaacgggcgaacatccgcaaggaaaaagcttacgcgcagggcggcatcgaaatcgtcgacgatatcgttaaatacttaaagagcgacgacattcactacaaccgctacgatcacaagaaccgcttcgctgaataagatcggttctgcttaaatcaataaggagaaatttatgctgaaaacacttgtggaaaagggcagctatcacgactcggtcatgctgatgctcttgaccaatgaattgtcaaaactcgacggcgttaaaaaagttcaggtcatgatggccacgccggccaacaaggacatcttcgctcgggccggtctccagaccgctgaactcgacgacgcgacggccaacgatatggtcatcgtcgcggacatcgaagacgacgccctgctcgaccagatgaaaaccctggccgaagcctttttcgaagatcagtctaccgacagcggcaaggctgaagaccagagcgtccactcctgggaaggcgcgatgcagaagctgccggacgccaacctcgcggtgatctcgatccctggggcctacgccgccctcgaaggggaccgcgcgctggatgaaggcctcaacgtcttcatgttttcggacaacgtcaccctcgaacaggaaacggcgctgaagcagaaggcccacgccaaaggcctctgcgtgatggggccggactgcggcaccggcatcatcgacggcgtgccgatcgcgttcaccaacagcgtcgcgaagggctccatcggcatcatcggcgcgtcgggcaccgggattcaggaattgacctgcatcattgaccgcctcggcgaaggggtcaccaacgccatcggcactggcgggcgcgacctgtcggaagcggtcggcggcatcaccgtcatggacatgatcgacgcgatggaacaggacgacgcggtcaaggttatgatcgtgctctccaagccgccggcaaaagcggtgcgtgaacagattgaaaaccgcttgagtgtctgcaaaaaaccggtcatcaccttattcctcggtgaaaagcctgaacagaacgaagaaaacttctaccactgctacacgctggacgaagcggcccgcctggccgtcgccctggtgcgcggcgaagacgtcgcggacggcagtgtgccggtcgctgtcggcgatgtgtttgacgcagcggatcacaagacgatcaaagcctattactccggcggcaccctggccaacgaagcggcgatgctcatcaaggacgccctggatctgaagattccgccggaaaaggccgaaggctttatgctccagcacgacggccacgtggtcgtcgacctcggtgatgacgtctacacccaaggccatccgcacccgatgatcgacccggctaagcgcatcgaatgtatggaagaagccctcgacgatccgaccaccggcgtcatcctcttcgacgtgatgctgggctatggctcccacgccgatatggccggtgcattaatcccgacgatcaagaatttacaggcgaaggcggaagccgcaggccgcaaaattgtgttcgtctcgaccgtgtgcgggacccgcagagacttccaggattacgacgacaccgtcaagaagctcaaggacgccggcgtcgtcgtctgcgaaaccaacaagctggcctgccaggccgctattcacgccatcggtctcgactttgacgaaccggctaagccgacggtgccgagacgtcagtcagacgccaaggccggcaccccgtccgacaagctgaccgcgatgctgaagagcaaaccgaaggtcatcaacatcgggctcaagagctttgccgacgtctgtgcagacttcggatgcgaaacggttcagtttgactgggcaccgccggccggcggcgaccttgaaatgatttcggtgctcaacttcctgagaagctacgcggcaggcggcgaaaccgtcgacgacatgaaccagaaagtcattgccaaggtcgtcgcggctcagcctgtcttgaaagacaacgtcccggcgatgacggtcatcccggaactgaacacggatcaaaagacgatccttcacgcgggaccgccaatcacttacgacaagatgccgccgacggtgcagggctcctgcatcgggggcgtgctctttgaagaatgggccgacaacgaagaagacgcgcggaagctgctcgaatccggtgaaatccggttcatcccttgccaccacgtgaacgcagtcgggccgatgggcggcatcaccaccgcgcacatgccggtgtgggtcgtcgaaaacgaagccgacggcaaccgcgcttactgcacgatgaacgaaggcatcggtaaggtgctccgcttcggtgcctactctcaggaagtcatcgaccgcctgcgctggatgcgcgacgtcctcggaccgaccctgagccgcgccctgaagacgaaggaaaacggcctggccgtaaatccgatgattgccaaggccatcgcgatgggcgacgaattccatcagcgcaacatcgcggcgtctctggtcttcctgaaggaagtggcgccggccattacggctctcgatatggacgaaaaagacaaggttgacgtgatccagttcctgtcggataccgaccagttcttcttaaacatcatgatggcgacgggcaaagccattatggacggcgcccgcaaggtgcaggaaggcaccgtcgtcacggccatgtgccgcaatggcgtcgacttcggcatccgcatcgccggcatgggcgacacctggttcaccggaccggtcaatacgcctcaggggctgtacttcaccggctacgacggtgaagacgcctgcccggatattggcgactcggccatcacggaaaccgtcggtgtcggcgggatggcgatgatcgcggcgccggctgtcactcggtttgtcggtgcgggcggctacgaagacgccctgcgcacgagcaacacgatggcggaaatcacgatcgcgcacaacccgaattacatcattccgacctggaacttcaagggcgcctgcctcggtctcgacgcgagattggtcgtcgaaaaggacatcacgccggtcatcaacaccgggattgcccacaagattccgggctacggccaaatcggcgccggcacagtccatccgccgatcgaatgcttcaagaaagccattttagcgtacgcaaagaaattaggatacgaaggataagcaatcacaaaaggtgcggcggcgcataccgccgtcaccctttttacggttcaaccatttacaaaacggtatcgaaggagagaggaaatggaacaacaaacagtcgtcatcgccctcgggggcaacgccctcggcaataacgtcgccgagcagaaggcggccgtggcgggaacggccaaggtcatcgtcgacctcgcagccgacggctacgccctcgtcatcacccacggcaatgggccccaggtaggcatgattcaagacgcgatggacgccgcggcggccaacggagacggacaggtgccgctgccctacagcgtcgcgatgagccagggctacatcggcatcgacctgcagaacgcgatcaaagacgaactgctccatcggggaatggataaaaaggtgtcgacgattttatcccaggtggaggtcgatccaaatgatccggcctttgcccatccgtccaagcccatcggcaaattcatgaccgaggctcaggccaaagcgaaagcggctcagggcattgacgtcgtcgaagacgccggccggggctggcgcgaggtcgtggcatctccgaaaccgaagcgcatccgcgagctcttgacgatcaagaccctgctcgcagccggccacattgtcatcacctgcggcggcgggggcatcccggtgatctgcaaagacaggcgcctcgaaggtgtcaacgccgtgatcgacaaggacggcgtcagcgcgctgctggctgaaaagctcgacgccgacgagctggtcatcctgaccgccgtcgaaaaggtggcggtgcatttcggcaagcccgatcaaaaatggctcgacacgctgagcacggctgaggccaaggcctacatggccgccggggaattcgcgcccggctccatgctgccgaaggtcgaggcggcggtgcgtttcgccgaaagcggtccggggcggaaatccctgatcaccctgctcgacaaggcggaggacggcctcgccggcaagaccggcacggtcatcaccgattgagccgtcaaatcttctaaactttaaggtataaaagcaacagattcagtataataggaagcgtaaaggagcaagcatgcatataccagtgaattttctgacgtgggcgatggcgtttctgccgatcgtcgtgctgattgtcctgatggtcaaatgccattggggcgccgcggaggcttcggcggtgggggtggtcatcaccgtcattaccggcttcgtcttttatcgggcgaatatcggtctggtcgcctcggagatggccaagggcgtatgggacgccgtgatcattctgctgatcatctgggcggccattctgctctaccacgtcggcgatgaggctggggcctacggcgtgatccgcgacggcatgcagcggcttctgccaaacgagctgctccagatcctggccatgggctgggtattcgaaagcttccttcagggcatcacgggcttcggcgtgccggtggccgtcggggcaccgctgctcatcggcatcggcgtcggcccggtgtgggctgtcatcatcccgttaatctgccaggcctggggcaacaccttcggcaccctggcggcggcctgggacgccctggccaatttcggcggactgaccgccggcacgcctctgtactggaagacggcgttctgggcggcgctgttcctctggatttgggatgtggccaccgggttcatcgtctgctggttttacggcaaaggcaaagcagtgaaaaaaggctttgcggctgtactcattctctcgacgattcagggcggcggcgaatttctcctgtcccaggtgaacacgacgctgtgctgtttcttcccgtcgctgatttcattggccgcgatctttctgctcggccggatgaaaacctacagcgaaccgtggcgcatcgacgactcgccgatcatgaaccgcaaggccgcgaaaacggaaacagcggcgctgcccaagggcatgaccctggttcacgccttcatcccctacgtgttcctctcggcggtgacgctgattgtcctgctggtgccgccggtgcaccaggccgcctcggcctttaccgtcggcctgtccttcccgaaggaagtcactggctacggctacacgacggcggcggtttcggcgtactcggcctttgcaccgctgtcccacgcgagcttcttcctatttttgtcggcggtggttggcctggtgtattacaagcacaagggctggatccaagccggcggtacgggccgcgtcttttcgggcagcatcgcgatgaccatgccctcgggcattgcggtggtcggcctggtcatcatgtcgaaggtcatgggcggcaccgggcagaccatcgtgctggcggaaggcatctccggcgtgctcggcactgcctacgtcgccttatcgccctttgtcgggctcctcggcacctttatgacggcctcgaacatgagctcgaatatcctgttcggcaatttccagatgacctcggcgaagctgctccacgtcagcccggctctcgtgctcggcgcacagacggccggcgcgtcaatcggcgcggccatcagtccgtcgaagatcatcctcggaacgacgacggcgggcatcctcggcaaagaaggggaagtcctcaaaaaggtgatgccggtcgcgattccggcggcggtggtcgtcggggtattgtcccttatcggtgtgctgctttagaaagaggtcgttatgtcatcattttttaaaacggaggccggacatctgaccctggcctttattgtcattgttatcggcgcctgtatcatccgcgccggtttggcgtcgggcgcatcggcgctcctcggcgtcggcgcagcggcggtgctcgtcgcattgtgcgcggtgccttttagaacctacgttatcaagccgattgctaaaaagcaatccgctgcatccaattccgaacccaatcacaataaggagtaagtcatggataataatcagatcgaaaaatcaacgggccgtatcgcggaaaatctcgaaaccctcaaaacctttacggccacgccggacaacggctgcacccgtctgcccttcacgaaagaagcgcgggacgccgtcgattacttaagacaggtcatggaagacgcgggccttgaagtctgggaagacgccgcgggcaacatcttcggccgtctggctggctcagatcccacgctgccctgcgtgatgagcggctcccactacgactccgtcgtcaacggcggggattacgacggcatcggcggcgtgatttcctccatcgaagtggcccgcctgctcaaggaaagcggcaaaacctttaagcacgattacgtggtcgccggcttctgcgacgaagaagggatgcgcttcggcaccgggtatttcggctccggcgcgatgctcggccaccgcaatccggcctactgcgacaacttcaaagacgcagacggcatcaccatcgccgaagcgatgcgcggctacggcctcgatccggaaaagatcggtgcggcggcctggccggaaggcagcatcggccacatgatcgaagcccacatcgaacagggcccggttctcgacgctgaaaacatcgaaatcggcctggttaccgggatcgtcggcattcagcgctacgtcatcaccgttcacggccgtgccgaccacgccggcaccacgccgatggacatgcgcatcgacgcagtggaagcggcctcaaaggtcatttccaagattccggactgggcgcgtgaaaaagctgacggcactgtcgcgacctgcggcgtcgtccacgtcgaaccctgcggcatgaacatcgtgccggaaagctgcgaattctctgtcgatatccgctcgatgaacaacgacaacatcaacgacatcacccgccggatccgcgccgccctcgaccgcgaaaccaaggccatcggcgcgacctacgacatggacacgaagctcgtcatcgaaccggtcgccctcgacgaagacatgctgaacgtgctcgaagacgactgcaaggcccgcggctattcctacaagcgtctgcccagcggcgccggccacgattctctcgaaatcggccaggtgctgccgacggtcatgctctttgtaccgagcaaagacggccgcagccactgcccggtggaattcagccgctacagcgatttcgccaaggccgccgcgctgatgacgacgctgatcggcaagcttttggacgaataaaccgccaaaatccggcggattatggtaaaatataaaagtattcatttacatccgcagggataaaaagaggaggggcataatttggtcatatcggaaatgaatccagacgcgaaatcgcggaatctgaggctgctcaggcgcgcgctgcgcatgacgcagcagcagttcatggagcagtttctgtccgggccgtccggtaaatcggcgatgagcatcgccacttactccaatctggagcgcaagggcggcaaacggctcaacgaggtgatttcgaaggtcagccggcagctgaatctcgacccgatggtcttctcaatggacccggggcagttcagcgagcaggtcgatcagatgatcgcctcctcgccggaaaagcaggcggttgtcgacggcagcactggtgatatcaccgagctggtcaatcggctgacggtctatttcgcggacgacatcatttccggaaaactcaagaaaggcagccgcatcgaatcggaccgggagctcgcccggaaaatgggcgtcgggcgctcggccgtgcgcgaggccttgaaggtcttgagcgtattggggatgatcgacatccgcccgggtcagggcaccttcatttctcagaaggaatcgaacttcttcacggtgccgctgagctggtcgctgtttttgagccggccccaggtggaggatattcttcaggtgcgcaatctcatcgaagtgggggccgcgcgtctggccgcaacctctcacgacgaagaggctctctcgaagctttacgcgctgtcctacgagatttataacgcctacgatgcaggtgaccacaagcgctttctcgaggccgacgtggcctttcacacgagcgtcgcggcgtgctcaggcaacacggtgatcttctcgatgatcgagacgatccgcaacctgctgaagcgggtgagccagactgggatggttacagacgagcagatgacggcgatttacaccgaacacaaggagatttttggcgcgatcatgtccaaggatcccgacgctgccggcgaagcgatgcgccgccacctcgaacattccctcgaccgttacaattatcagtaacattcatatagtgtcaaaagcaccgaaaacgggtgacagaaataaaaaaattattttgagaattttcgccggaggaggcacacgcttccaccggcgttttttgttgctccgtttaagattgatatggctgatttgtaattgattgtttcgaaggcattttgccttcgcgcgcgcacgcgcgtaagtaattactttattattatttaatttaattttcttttattttatttgtggcgtttttgcatacataaatgccagttatttcatagttaacttttgtttttatatacataaacgccagttatttcgcaattaactctcatttttgcgacaataacccaaagagctaaactattaataaaaataaatcaacaaatcaaatgcgttcaaagcgggatcaaatcgtgtgtgtttagaaaacttaagtgaataataaagaaatgaaaatttctgaaaaagcgttgcaatttggtgggaagtattctaaaatacatttagcactcaatcaaatggattgctaataaatcacgaaaataaaaccaagatacaccattttcagaaagcgaggggttacaattggcaaaaaaggaatttaaagccgaatccaaacggctgctggacctgatggtcaattcgatttacacaaacaaggaaatcttcttaagagagctcatttccaacgccagcgacgccatcgacaagcgttacttcaaggcgagccaggaagggcagaccgggctctccagaaacgactacccgatttacgtcgcccgggatgaagacgcccgcaccctgacgatcactgactgcgggatcggcatgaccgacaccgaaatggaaaacaacctcgggacgatcgcccagtccggcagtctcgatttcaaaaccgaaaacgcgaaggaagacggcaccgacgcccttgacatcatcggccagttcggggtcggcttctactcggccttcatggtcgcgaagaagattcgcgtcgtctccaaggctgaaggcagcgacaaagcctacgcctgggaatctgaaggcgctgacggctacaccatcgaaccggcagaacgggacgacgtcgggacgacgatcaccctgttcctgcgcgacgacaccgacgacgacaaatacagcgactacctgaaggaatggaagctgcgcgacttgatcaagaaatattcggactacatccgctacccgatcatcatgaacgtcacgaaacaggaacctttatctaaggaagaaaaagaagcggccgaagccgatgaaaacggcaagaagccggaattcaaaaccgttcacgaagacgaaaccatcaactcgatggtgccgatttggaagcgcagtaaatccgaagtcaccaccgaagagtacaacgaattctacaaggataaattcgtcgattgggaagatccgcaaaagatcatctcgaccaacgtcgaagggctgctctcctacaacgcgctgctgttcatcccgtcgcgggtgccttacaacttctactccaaggattacaagcgcggcctgcagctgtactcctccggcgttttgatcatggataaatgcgaagacctgctgccggattacttcggctttgtccgcggcctcgtcgactctcaggatatttcactgaatatttctcgggaaatgctccagcaggaccgccaggttaaggccattgccaaccgcctcgaaaagaagatcatctccgaactcaaggacatgatggccaaggaccgcgaaggttacgaaaaattcttcaataacttcggcctgcgcctgaaattcggcatttacgacaatttcggcgccaacaaggacaagctgaaagacctcgtcatgttctacagctccaccgaagacaagctggtcaccttccaggaatacgtcgaccgcatgaaggaagatcagaaatacatttactacgccaccggcgactccatcgacaagatcaaacggatgccgcaaaacgaaatgctgatggacaagggatacgaagtcctgttctgcaccgaagaagtggacgaattcgcgctgaaggtgctgaattcctacaacgacaagccctttaaatccactgcggaagacgacctcggcatcgaaatgtccgacgaagaaaaggcgatccgcgaaaaacagagcaaggcttctgaagggctgctgaacagcatcaaggacgccctggacggcaaggtcgccgacgtcaagctgtcgacccgtctgaagagccatccggtctgcttctccgccggcgaaggcatctccatcgaaatggaaaaggtgctggccgaacagtccaaggccgtgggtcagacgccgactgaagacatgaaggccaagaaggtcctcgaaatcaacggggatcatccggtttttgccgcgatgcgccgggtctacgaagccgacgacaaggacacgttgaaggattacgccgaacttctttacgaccaggccatgctcatcgaaggcatgcccatcgacgatccggtcgacttctccaatcgggtctgccgcctgatgaaataatggatgaaataaattgcaaatcagcgcagatgaacaaaagcaaaagtattgcctttcaattgtaaatcactgaaattaaggcaatgttttcgagaaaagattaaataaaaaaagggattcgcttgacacgaatccctttttcatatttaatatagagtcacaaggtccagattagatattgcgggaaaaaacatccctaggcgtccatatcgagcacgattttcgagttggccttcgcggcgtcctcgaaggttttgacgatctcgacgccgtactggcccagattgtcggtgagcacatcgggatcgaagaaatgaatcgcggtggtcttgcggatgccgacgagtccgtcccacagggcgtcaaggtttttgccgtacgagtccggccagtccattcgatgctgaatgtgaagctgggcgcgctcctttgtaaccatcttccgaccttcaatgttaatctcacgcatcacggcacctcctgtatggctgatttgtgatttcattataaaaaaaatacagattaaagtcaagatatgaccgttttcaatggctataccgcataattctattgaaaatctaatgaaaataataggattatttacaatttgatcttgaaaagggcataccttcgtgatagaatgtgataatgattttgagatgtagtttactaacctatttccctaatataggggctcatctcacacattaactataacataaagttataacaatttaaataagaaaacaatctacatattatatagaagcaacattgatctcccaattgaaagagaaaggaggttcgcgtcgaaaacgcagggtggatcaaggatcaatatcggatcaacagtttggacttatttttaaaatctacaaataattgaaagaagtgagtaaacaaatggcatcatttaaatataatcttgaaaaatttggtatcgaacgtgttgtgggctggttaaccaagaatccggaaaagaacctgccccgtgttatgaactgggttgataaatttgcacacggtgaattcgtcggtcagagaaatgcgatccgcgcagccatcaacgacgaaaaccacccgtatcatccggttgtacagagagtggtccacatggatcccaacgtcctgaagaaagcattcgtcaatttcttcatgaacgccaacctcgtgggctgggacaaacaggaacaggtccgcaacaaatacggctgtaacgcaccttgggccatcctgctcgacccgacatcggcctgcaacctgcactgcaccggctgctgggctgctgaatacggcaacaagctgaacctgtccttcgacgaaatcgacgatatcatcagacagggcaaggaaatcggcgtttacatgtacatctacaccggcggcgaaccgctggtccgcaaggatgacttaatcaagctttgcgaaaaacacaacgactgcatgttcctgtccttcaccaacggcaccctgctcgacgcgcacttcgctgacgaaatcaaacgcgtcggcaacttcatcccagcgatctccctcgaagggtttgaagaagcgacagacgcccgccgtgggaacggcgtttacgacaaggttatcgccgcaactgaacttctgaaggaacgcaacctgcctttcggcttctcctgctgctacaccagacagaacttcgaatccatcacctccgaagaatattacgacaagatgatcgaacttggcgccctcttcgtatggtacttccacttcatgccgaccggcgtgaacgcggtgccagaactgatggttaccccggaacagcgtgttgaaatgcacagaagaatccgcgactacagaaaccgcaaggccctgttcgcaatggacttccagaacgacgcggaatacgtcggcggatgcattgccggaggccgccgctacctgcacattaacgccaacggcgacgtcgacccgtgtgtcttcatccactattctgattccaacatccgcgaaaaatcattgctggatgcgctgcgctcaccgctgttcatggcttatcacgatggccagccgttcaacgaaaacatgcttagaccgtgcccgatgctggaaaatccggaaatcctgccggaaatggtcaagaagaccggcgcacactccactgacctggaatgcccggaaccggttgacgatctcgtcgccaagaccaaggaatacgcaaagaactgggcacctgtcgcacacgacatgtgggacggcagccctgaagaagcccgctacatcgccaaacgcgatcgtctgcgcaaagcttccgaaaaacgccagaaggaattggcggaagatcaggaaactgcataatttaagcattcgacaaacagccgcactgccaaacagtgcggcttttttgcttttttaaacgcaatacataaaggggaaaacaggtgcaaaaacgcaggaaaaggcgccggagccgatcggaccagcgcaaagcgcaacggaaaaaatttgcaaaatcggaagagaatttaagacggcagcaactgatgcgggacgcggtctggccaacggacgaggacgccgcgcatatcgccgcagacgtgttcagaaagaagctcgtcagccagcggctatacacgaaaaagcgccaccgcgaccaggaaatcacgccgcagatcgaatttgacctgcggacctgggccgaaagcgggaaggcgccctacgattactttcatttcaagcacaacacgctgccgatgaagaagctgcgccagcgcttcgccgaggccaatcccgagctcgacggcctgacccgctacgtctcccagcgtgggaattgggtcaacattcctgagcacgtcgaaaaacggctgcacaaaaccctcgatcggggcgaacggctcgcggcgtcgcagatttcgctgagcgagaccatcgatctgctcgaacacaacggccactacccattcatcaagaaccgctcccgggagcgggagctgatcaagaagcagatccccgagcacatcgccgagctcttcccggtggcgcgcagtgtcgagcggcacttcgtgctccacgttgggccgaccaactccggcaagacccacgaggcgatcaccgactgcgaacaggccgaaaccggcgtctacctcgcgccgctgcgcctgctggcgatggaagaggctgagcgcatgaaccgcgacggcgtcccgtgcagcatggtcaccggcgaggaggaacggctgatccccggcgcgatgcacatggcctcgacgatcgaaatgatgtcggaagagcggctctacgacgtcgccgtcatcgacgagtgccagatgatcgccgaccgggaccgcggctgggcctggactcaggccgtgctcggcatcgcggcgaaaaccgtccacgtctgcatggcgccggaggcccaggcgttagttaccgcgctgatcgaggaatgcggcgacacctgggaggtggtgacccatcatcgggcgacgcccctcgaaatggagggcggcggcttcgtcttcccgcgggacgtgcgcgccggagacgcgctggtggtcttttcgagaaaatcggtgctgcaggccgcgtcgattctcgaggatgaggggcggcgcgtctcggtgatttacggcgcgctcccttacgacgcgcgccgggccgagacgatgaaattcctctcgggggaaaccgacgtcgtcgtcgcgaccgacgccatcggcatgggcatgaacctgccgatcaaacgcatcgtctttctcgagaccgacaaattcgacggcatgcgccaccgggatttgaccccggcggaaatcaaacagatcgccggacgcgccgggcgccgaggctttgccgaaaagggactcgtgacgtcgagcttcaaccgcagcctgatcgcggaggggctggccgccggcgtcgaacccctcgaaaaggccagggtgtcgatgccgcgcttcctcgtgaacatggacagccgcctttcccagacgatccaggactggcagggtctgccggacgacgggctctacctcaagaccgatatgacccgcgcctttcacctgtgtgtgtggctcgaggtgaactgcgagctcacgaagaccgatatgctgcgcgcggtgaccattcccttcgacgaaaacgatctgggcatgtgggcactgtggcgccacgcgatgaaaaattacgacaaaggccgcccgattttagacggctttgaacgcgtcgcctaccagcccggcgacggcctcgaccgcctcgagaaaaagtaccggaccctcgatctgatgtattacctccagcgcagcctcggggaaaacgagacctacgccgacgaggaaaagcgcgacattttaggctgcaaggccgaggtggccgacgcgattatccgccggctgaaaaaggccaagcgcgtataccgcaggtgccgcatctgcggcgcgaagctgccgtggaacgatccctattcggtctgtgacgcgtgttatcaagcaggaaaggccggtgcacggcattaatacgtgtttttggacgtcggcccgtctgtgccgtaaatggcgttgatttcggcggaataaacgccgggtgactgatagatcgacaggggcggctcgacgatggcgccggggtggccccgcttgacggcctgcagcaggatctggttggccggcttgtccgggaagggctgcaccccgcggacgcgcttgacctcgagctggtgagcccgcagcaccgcgcagagatcgacgaggcgctcggcccggtgcaccatgaacagccgcccccggtccttgagcagggcctgagccgcagcggccacgtcctccagcgtgcaggtgatttcgtggcgggcgagggccagcgcgcggtcggggttcaccccgcctttacccttgggcatgtagggtggattggtcacgaccacgtcgtaggccccgcggacgagggcggtgcccggctcgtttcggatatccccttcgtggatgtggatcacgccctcgaggtgattcatcgcgacggagcgcgacgccatgtcggccatcgccggttggatctcgacggcgtcgatggattgggtgtgggtgcggccgtagagcagcagcggcagcacgccggtgcccgtgccgatgtcgagggtgcgggtcttgcggtggaccgccggcgcggcgtaccacgcgagcagcaccgaatcgatattgaagcggaaggcgtccgggtcctgaaggatgtaaaggccgtccaggcccaggtcctcgagacgctcgcccggcttttgataagggcgcgcaaaatcagtcgtcatgttgggtctccttctgtgcatttgcaaatgtttaacctgttgataaactgtgataggatttcggcagttttccagaagttgtccacaattctgtggaaaattctggggattggcctgtcaccgccaaaaattcggcggcggtttgttgacaatttttcgacagcctgtggaaaatctgacggcggatggggacaaatagacagatttatccacaaaaagccacagccataaacagacttttccacaggaaagtggcattctggaatttttatacatcttatcatatcaaaaggccgagaacgcaacttttttcggcattttcctttttaaaataagcgctttctgatataatgcaaatagcacggtttataagctatttatcgttttctgtcatgaaataaccggaaaagaaagtgggtggaaccatggatgatcaaaacaatcgcgacaatgaaatgtcgaaaatcgtagaaaaggctgagaatctcaaaacgatgctcgccaagcagaaaagcggcgaggcggaagcgccggccgaacctgaagaaaagacgccagaagcgccggtcggcaatcccgatctcaaggcggcgcacatgcctttccagcacacgcgcacggtggcggaaaagcggagcgccatcgacgcgcagtttgaaagcgccatcgcggacagcaaaaagtccgtcggtcagctgatcgacgaagccgtcgaagccaaggtccaggcggcgcgtcagacccttgcggacgaaaagcaggcttttgaagcgcagatccgcgccgaagccgatgcgaaggtcgccgacgcgaagcgcgcacaggctgacgcggaatcggccctcgaagaccagaaggcccaggcggaagcggctgccgaagacttcaaggcgcagctcgcccagaaggacagcgtcatcgccgacgctaaacgggaaaaagcggaaattgcggcgcaggtcgaagcccagaaaacggaaaaggaagcgctgcgcagccagatcgaagaagcccgccagaacgcggcggattacgacgatgagctcacacagctcagacgggccatcgccgaacgcgacaccaaagtggccgacatcaccgctgaacgggacgacgccctgagagcggccgacggcgcgaagcagcagctgagcgattaccagaagcaggttgaagcggctcaggctgaaccggcatcggattccaccacggatgccggcttgacagctcagccggaagccgaaaagattgcgacagaaaacgaaaccgaaccagccccgacggacgacgacatcaaggctttctttgcgatggatggcggcgaagcggcagacgacaatgacgcgcaggccacatcgatttgggacgaaggggacgaagacgatctctttgaatcggaagaaacggccgaagacgacggcctgttcgaatcggaagaagcggtcgacgacggcgccgaagcagccgaagaaactgaagaagcagaggaattggctgacagcttcgtggtcagccacgaagcctaccgcacgaatccgaaggaagacgtggaactgagcgaagacattccttgggtctcaccgaacaccgcagaagaaatgaagaagcgccgcaaggcgagagccgaactgatgcagcaggccgcggcccgcgaagcccaggcggcagaagcggcccgcagcgcggaatccaaagccaagccggctggcagccgtcaggctgaagaagaacacgacgtcctcgacgtattgagaaacgcaggcgccgaacctgaagaagccccgcaggccgaaacggcggacgcggtccaggatgttcaggctgaagacgcggtcgaaaacctcgacatcagcgcgctgaccgaagacgaagcgcagttcttcgaacaggtcggtcgggaaacggcggaagaaaccgacgaagccgaattgttcgaaaccgaagaaccgctgaacgacgacgaaggcggcctctttgaagacgtcgaaacctacgatcagacggaagatcagccggctgaagatcagagcggcagcattttcgacgacgtgacgaatttggatgacggcgatcaaggcgacgtctttgaaaactctaagggctggagcgatctccagcaggaagcagccgaacaaccggaagccccggcggaacaagctgacgatttcggcagcctgttcgaagaagacgcaactgatctctttgaagaagaagcaccgggtgaagatgccgaagctaaaccggcagaagcagcggaagaagccgccccagcagaaccggcctcggcggaagcgcagctcgaagacttcgacagccttttcgccgacgacagcgcggacgatttgtttgaagaagacgaaccggttgaagacgcccaatttgaagaagaacctgccgaacccgcacaagcggccccggtagaaccagaaccagaagcgccggcagaacctgaagccaaaccggaactgacccaagacgaaatcgaagaaaaggcgcgcatcgcggcgaagaacgaggaaatcgacaaggacatcgccagactcggcgacacccaggtgctcgacaccggcgccatcaacgatttcttcgaaatggccgaaaaggacgacgacgtgccgtcattgttcgacaacccgtcgaccgacgacagcggtgacgatctcttcgaagaagaaacgacggtagaagaaggcgacgacgtcacccagattgtcagcccgagcgaaatcgaagaaaagctcgacgcggacgacgacggcagcccgaagccctatcacgacgattttgacgatctcttcgacgaaggggatcaggatcctttcggcgacgacaacggcaatgaagacgacagccacgccgacaagaagcgcagacggggcctgttccgccggaatcggtaaaacccacttataaaaaacgcgaaagcataaaaataagcacttgtctgaaaatttcagacgagtgcttttttaatagatctaatggatcggttttattcgtagcgcagggcgtcgatcgggttgagcttggcggctttgttggccggataagccccaaaaaacacccctatggccattgaaaagaggacggccacaagaatggacgacagcgtcgggtaaaccgtaatatggacgaaatggccgccggccgcgccgatagcggcgccgacgccgatcccgatcagcccgccgataagacagatgataaccgattcgacgaaaaactgaaagcggatgtcccggttgctggcgccgagggccttgcggatgccgatttctcgggtgcgctcggtgaccgagacgagcatgatgttcatgacgccgatgccgccgacgagcagggagatcccggcgatgagcgcgatgcccagggagagcttagccatctggttgttgatctcgttggcctgcttttcgatgttcatcgtcgtgatcttggcgtcggggttggacgcgtagtaatgccggttgaaccaggttttaatttgccggctcagcgccgcggtatcggcgctttggttcaaggtgacgatgatttcagaattgccggcatcgtcggcgcgcatcagggcgttggcggccgccggcggaaggtagaccgtctcggaagagacggcggtcattgccgagaccatatccttgcccccggtttgatacaacccgaccaccgtgcagcgcacattgccggtatcggtacgcaccgtcatgctctggccgatgggatcctggtggccgaagaccttccgcgccagtttctttgaaatgatcgccaggggccgcgtgccgctggattcggcctcggtgaagcgatggcccgaaacgatgcgcagctgcatgtagttgaggtagccgccgttggcgccggtcagcgacaccttggtctgcttcagatcgtcaacggtgcccgacaggctggctgaggtcgagtaggccacgtcgtcgattttgtcggaaaagctgtgccgaaaggcgtcgatcatgtcctggctgatcatgtctttggtgtcgataccgccgttgtcgctgttcctcggcgtgacgtagacgtcgacgctcttcgtcgccatcgaattgagggcctcgctgaccgagcggctcacggccgagccgatggacgaaatcgcgatgaccgagccgatgccgatgatgatgccgagcatcgtcagcagggaacgcattttgttgctcttcaggctcgtgacggcgaggcggatattttctcgtaaattcatcgcaccgcctccaatattttcgtcgcgtcggggattttgcgcgcggcctttccggcgcgctccccggtgatccgaccgtcctcgatggtgatgatgcgctcggcttcctcagccaggtcgtcgttgtgggtgatcagcacaatggttttgtgctgggtttcgtgaaggtcgtggaaaatatccatgaccatgcgcccggtgtgggagtccagagcgccggtcggctcgtcggcgagaatgatcggcgggtcgttggccatggcccgggcgatggcgacgcgctggcattggcccccggagagctcgttgggcatgtgcgcggcccaggcgcccatttgaacggtctgaagcaaggcgtaggcgcgctgccgccgcgctttttggccgattcgggcgtagagcatcggcagctcgacgttggacagcgccgaagttcggggaatgaggttaaaagactgaaagacgaagccgattttctggttgcggatttgcgacaggcgctgatcggggacttgctcgataggcagcccgtcgaggacgtagcgcccttcggtgggccgatccagcacgccgatgatgttcatcagtgtcgatttgcccgagccggaaggtccgacgatggccgtaaattcgccttcctcgatggtcaggttcaaatcgtcgagcacagtcaattcgttggccgtgccgatgaaatagcgctttgtgatgtgtgccaattggatgagtgccatggcccctccttattccttgacctgctgaccgtcgtggagcgaggctgggttcagcgcgactttcgcgccggcacgcaagccgtcggccgaaatttgaataacggtgtcgttttgcagtcccgtttcgacgttgaccgattcgaccgtgtccggcgtgtctttgtggtgtttaacgacgaagatttcgtatcggccgctttcgtctttggtgaccgcgtcaatgggaaccgtaaagacattctgccgattttcgacggtgatttcctggctggttttcattccgatcttcaagccgtctgtaggatgggaaatgtcgacagtcgcgttaaaagtgggggcagcggcgccggagctgaccgaagctgaaccggaagaggtaagcgcggtggtgtcgctgctgagggcggcgcccgtgtctgcattgcccgttgccaaatctgtgcttgtcggcgcgacgctcgaaatcacgccggtgtagcagcggccgcctgtgccgtcagcagtaatggacacggcctggccggtggagacggcgctgatgtcgttctggtcgatctgcatgacgatctggagattgcccgtattttgaatggtgaagagttccccggacgtggggttgcctttggccgcgccgacgtgggtgatcgtgccggaaatcggcgcagtgacggcgcgggtctggccggtctggctgtcgacgagggtgcagagtcttgcccctcggttgaccgtattgttgagtccgacgtcgacgctttgaatgatgctgccgctgctgtctgcgacgacactgacgtttttgctctggacttggccgtcggccgagacggttttggtcagatcgccgtaagtgattttgcccgtggtgatggttttcagcttcggctggcttttcttgtagagggccgaggcggcgattaaagctgcggccgcaatcaagacgaccgcgagaatgcgctttcggcgttttttccgcatttcgtccgccgccatcgggtctggcgccagggcttcgccgttttcaaaaaccggaccgcttgcgtcgtccggcagggattttcttttaaagggatttttcattgcatcctccttcgattgtattagttaaataatacaacaggaaataatctttgtcaattgaattataccgtgcagtgaattttggacggcgacaaaaaaagagctgccctgaggcagctctggttgaatgatttatcgaatgatgattagtttcacgctttgtcgatggagccgaagacttccattttttccttaaccttggccttgatggcttctgtcccaggcaggagcagttttctcgggtcaaagcccttgccgactttgtccttgccttcttcgatgtatttgcgggtcgcttctgcgaagacgagctggcattcggtgttgacgttgatcttggaaacgccgagcttaatcgcgtgctgcaccatttcgtctggaatgccggtgccgccgtgaagtaccattggcaggtcgccgatttccttctggatgttggcgagtacgtcgaagttcagtcccggccagttttccggataaacgccgtggatgttgccgatgccggctgcgaggaagtcgatgccgagatctgcgatctgtttgcattccttcggatctgcgaattcgccagcgccgatgacgccgtcttcttcgccgccgatggtgccgacttcagcttcgatggacaggcccaaaacgtgagccgctgcgacgagttccttcgttttttcgacgttttcttcgaaaggcaggtgagagccgtcgaacatgattgaggagaaaccggcgttgatgcaggcctttgcgccttcgtaggagccgtggtcgaggtgcagcgcaactggaacggtgatgttcagggattcgatcatcgctttgaccatagccgcgacggttttgaagccggtcatgtatttgccagccccttcggagacggccagaataaccggtgagttgttttcctgcgcggtttcgagaatggccttcgtccattcgaggttgttaatattgaaagcgccgacgccgtaatgtccggctctcgccttaaccaacatatcctttgctgaaactaacatgtgatacctccatatcaagtaaatgtgttatccttattataacggacagcggcgccaataacaatagaattgacgcaaaattatgtaaaaatcagcgaaaacactcaaaattaatcaaattttatcaaaaatgagaacgacacgcaggctgaacagcagactgtgttataatgaaaagacattgaatttgaccaatcgggaggctgcgatgaaaaaagatccgtaccagtcccagcggggctgcttcaagtcccaagcggtgttccccggcgctgaaaagtgggcggcggccacggcgcgatgcgctcagctctatcagcgcgatgaggacatccgcacgcccttcggccgggattacacccgtattctgcactcgtcggcctaccgcaggcttaagtacaagacccaggtgttttttcggccgcgcaacgatcacgtcagcacccggatcgaccacgtgcactacgtcgcgtccatcggccggctcatcgccgactttctcgggctcaacggcgagctcaccgaggccatcgccatcggccacgacctcggacacacgcccttcggccacgacggcgaggcggccctctcggctatcgtccggcgggacgggctcgcgccggccttttggcacgcggccaacggtctgcgcttcgttgacgatttcgaactgctctccggccctgacggcaggcagtacaacctcgatttgacttacgccgttcgggacgggattgtcggccacagcggtccggtgaacgcgccccttttcccgagagaggcggccatcgatttgaagcagttcactcggccggggcagttcaaccccttcacctgggaaggatgcatcatcaaaatcgccgacaacatctcctatttggggcgggacatcgacgacgcggtgctcctcggactgatgaagccggaggaccgtcgggtctacgccgaggttgtcgaccggtacgcccgcgcggccggcgtctcgtccatcgacgtgaacaacgccaacgtcattcacctgatggtgacggatttgtgtctgaactcgacgccggagcggggcatgggcttttccgagccggcgcggacggcgatcggcgaggtcacgcggctcaatcgggagctgatttacttcaacgatcggctcaaggcctacaaggattacggccatcaggtcatcgagacgatttacgcggccctctgccgttacgccgaggagcctggccgccgggattatttcagagagcagttcccgtcgctgacggtcggcttcgagaaatggctcatcgactacatggagggcttccacgacgaaaagcgggcggacaccgtggcctgccactgggtctatacctatcaaaaaggggaggccggcgcggcggagatgaaacgggccgcagtggactacatctctggcatgaccgaccggttcatcgagctgctctaccgggagcaggtggtgttcaagagccagcgcacgccctacgtgtcgctgtaaattaatgaatgaaaacaatagaaattgaaagcgtatagaaaatagaggtgtacaatggaaatcgaacaagtacttcaaaataagaacgtcgtcatcatcggactcgggctcatgggcggggcactggccatggccctcagaaaggaagggccggactggatcggcgccatcgacaccgacagcgaagtgctcgaggaagccctcgaccgcggcgtcatcgatcaaggggaaaacgacgaggaaggtgcggcgcgcatgctcgcccaggcggacttcgtctatttctgcctgtacccgcgcaccgcggtgaatttcttcaaaacccatatgggcaacttcaagcccggcgcggtgatcaccgacatcaccggggtcaagcagattctcgtcgacgaagtgctgccgattctcagagacgacgtcgacttcatcatgggccacccgatggccggaagcgaaaaggaaggcttcggcggcgccgacgaggggattttcctcgggcgcaactacatcctcgtgccgatgccccagaacgaccccgaccacatcaagtggctcaagcgcgtgatctacaacatgggctttaccaacatcgtcgagacgaccccagagggccacgacaagaagatcggcttcacgtcccagctctgccacgtcatcgcctgcgccctgatcgactgtaaagaagaacgtcacctctcggattttgaaggcggcagtttcatggatttgacccggattgcgatgatcaacgcgccgatgtgggcggagctgttcgtcagcaaccgcgacgcgctgttgtctcagatcgatgattttgaaaatagtatgaaaattatgcgggggatgattgaaaattctgatgaaaacggcctgtcggatttgatgtattcggtccgtaaaaagcgcgtaacgatggaaatagaccgcaaaaacaggactttggctattgaaaatcagtttaaacataaagaatctgaataaattcttaaaagaatctcgatgtaacagtttacattaggattatttcaatttacattcttacaacacttgacgtatttttcataacgcgctatactatagtcacatcaaggaaatacattcgattgaagcacacacccggttggatgtatttgatgttcagaacttgctgaatatgcgagaattcagcaaggaatcataatattacccccctctctccaaaggacttcgaactcctccccctatattggttcggagcccttctttttttgcttttttcagcgatcgatgcgcatcccatccaattatcttcaaatcattaaaatacaaaaaataaaaaagcacaacaaaaaaacctgtctgaaaagattcagacaggtttttcagactgtcgacaaagtctagagggaaacgctctaggctttgtttttttatagcagtcagtcatttttcacctgtcgcaatacaaacgtggtaaaatagcaataatagaaacaggccatgcattcaggaagaggagaaaaaagatgctgacaaaaacggtgaaaagaaacgagatcaaattcaatattttgtatggacgacttagttccaaaagatcatcttcttcgaatgatcgatgggccattgactggtcatttatctatgaactggttgaggaaaagtattcggcagatcagggccgtccaagcatcgatccattgtgttgattaaaattccatttatccaatacctttacggcatcaaaagcatggtcagaccatcaaagaaatcgaggtcaatgttgcctatgttggtttcttggattagatatgcacgataaagttccgcatttttccacctttggaagaactacacgcgccgattaaagataccgatcttttcgaagaaatcttcgcacatatcctctcagagctacaaacacaagttgatcgatcccagagaaatcttcgtagatgccacacatgtaaaggcaagagccaataataaaaagaaacaaaagaaaattgccagaaatgagcgatgttttatgaaacgcagttaaaccaagagattcaaagagaccgggaagcccaccacaaaaaaccgttgaaagataaagacgatcaagaagacgatgaacatcacccaggctcaaaaaagacacgggaaatcaaagtaagtacaaccgaccgagagcggctggtttcacaaaggcgaacataaacaagtcttcgcctacgcggttcaaacggcctgcgaccgaaacggaggatcatcggctatgacgtcaacaggaaatctgcacgacagccgaacctttaaaggccttatgacaaagataagagagcataatccggaaatgatagttgcagatgaggttataaaacccctgccattgctaagctgctcatagacgacggtatcaaacccgttttcccgtataaacgaccagacgaaaaagggatttttcaaaaaatatgagtacgtctacgatgaagcttttgactgttacatctgtccccataatcaaattttaaaatattcaaccaccaaccgcgaaggtttcagggaatacaaaagccgttctgaaatatgtaaagactgtcatctaaccagtgcacccatagttaatcatgtcaaagtggtcagccgacacctatgggcacactacatggaaatctgcgaggacatccgacacacaaacggaatgaaagcaatttataatcgcagaaaaaaaccatcgagagaattttcggaactgcgaaaagagcgcatggattccgctacacacaaatgtatggtaaagcccgcatgagaatgaaagtcgggcttactttcgcagcatgaattaaaaaaactagcaaaaatattatttagaaaaaaacaaaacacccgggaccgaatcgtcctatatttcgatttcaatttataaatctacaaattgcagcttgatattaaatcaaatgaggctctgagtattttctcagagcctcgtttgtctacagtctgaaaaaacctgtctgaaaagattcagacaggtttttgtgtgtgagataaattatgcaatccctttgattttcttgacttctgcagtcagagcagggacaacagcgaagaggtcgccgacaacaccgtaatctgcgatgtcgaagattggcgcttcttcatctttgttgatggcgacgatgcagtcagagctgctcatcccagcaacgtgctgaattgcaccggagatcccgcaggcgatgtagagtttcgggccgacggttttaccagtctggccaacctgatgggagtgagcgatccagccagcatcgacagctgcacgtgatgcaccgacaacgccgcctaaaacgtcagctaattcctgtaacggttcatagccttccggtccgccgacaccacggccgccagaaacgatgacgtccgcgccgaccaagtcgaccatttcggaagcgtcttccttcatttctttgattaagcgggttctaatatcttcaggagcaacgtggatgtcttctttgatgacttcgcaggtgcggccttcttcagcttctgtcgccttgaacacgccaggacggacagtaccgagttctggacggtgattcgggcagaggatagtagccatcaggttgccgccgaatgccggacgagtccaagcaatgttgccggtttcgtcgtcgtagccgagttttgtacagtcagcggtcaagccggtctgcagacgggatgacagacgaggtccgacatcgcggccgttgttggttgcgccgatgagcattgcagtcggtgcgtatttggtgatgacttcgtacagtgcgttgacataagcgtctgtggtgaagtgttcgtattcttcgccgtcgatcacgataacctgatctgcgccgtgttcctgaacagccttaacagctgcatcggtgttgtggccgataaccagaccgaccagtttgccgccctgtttttcagccagttcacggccagggtttaacagttccagacccacactctgagcggagccatcaggataagtttcaataaatacccaaagatcctttgttttcggttccatttctgatctcctctcttatattatagtaagccttctttatcgagggcagctgccaggtttgcagcgacttcttctggtgtttcgccagtgatcatttcgccgccagtctttacaggtggtacgaatgtcttcttgacgtttgtcggtgagcccttcaggccgcattttgtgaagtcgatatcgaaatcttcttcgccgagaacgtgaatttcttttttacgagcagccagtttgtctttgatcttcggcagacgcggatcaaatgaaggtttggttgcagtaaccaggcacgggaagctggcgccgaggatttcctggccgtcttctgtttcacgggtaacctggatttcatcgtcggtcatttcagcggttaagccgtaggtaatttgcggaatgccgaggtgttcagccagttccggaccaacctgagcggtatcgccgtcgatagcctgtttgccgcagaagatcacatcgaatttgccttcgatttcttcgatcttcttgattgcgcaagctaaaacgtagctggttgcgagggtatcggatccgccgaatttacggccggaaaccaaataagcttcgtcgccgccgactgccaagcagttcttcagcgcttccttagcctgatctggccccattgatacgacgacgattttgacgtcatctcttgcatccttaatgcgtgcggccatttccagcgcgtacccatcgaaaggattgacaatgctcggcacacctttacgaatcagagtattcgtttccgggtcgatacggatttcggttgtgtcaggcacttgtttaacacacacgagaaaattcatgatattacgttgcctccttaagaataatcaatgtgtatcatctggacaggaacatgtccaaataatttgtgaatattgtaacataaagacaaggcgcccgtaaagggttttaatggcgaattaatgcaaatttaatgcaaaaaattaccaatattttgcacacttgaagaaaaagtaaccgtttataggctatgtcaaatgcgaatcggggattgaccaaaaatcaggttgaaggggagaagggaataagcgtataataaatgaaacaatctaagacaatcaggctgtgtcaatcagcatagttttgagagatagcggggtttaatttaaaatgataaccaatcagataaccgcgcagccgatccgcgtcggcatcggctacgacgtgcacgcttttgaggacggccggccgctgatcctcggcggggtgcacattcccggccacgccggactggcgggccactcggacgccgacgcgctgctgcacgcggtgatggacagtctcctcggggcgctggctctcggcgatatcggtgcccatttcccggacaccgacgaaaagtacgccggagcggacagcatggcgctgaccgatcaggtctggcagctgatcgacgaggccggttataaaatcggcaacgttgacgccatcgttgtcgcccaggcgccgaaaatggcgccccacatcccggcgatgcgggccaacatcgcggcctgcctgcgggcggacgtctcgcagatcagcgtgaaggcgacgacggaggaacatttgggatttaccggaagggaggaaggcatcgcggccaaggccgtcgcgtgcctgattaaaaaatgatcggaattgttgcggccatgcaggaagaagccgacgccttcgcgcgctggatgcaggacaccagcagctttacgaaggccggcgtggatttcgtcaccggaaaaatcggcggcaatgacgtcacgcttgtggcgtcgggcctcggcaaggtcaacgccgcactgtgcacccagattttgattgactgctacggcgccgacccggtcatcagcttcggcgtggccggcggcatcggtgagggtctcgctttcggcgagctcatcgtcagcaccgacgcggcggcctacggcttcgagccggacaagggcggactcaagcccgtggacgtgccctttatgaatgggacggtctactcggcggatccgaagctcgttgcggacgcggtgcaggcggctgaaaagctaaagcttaaataccgcaaaggccgggtgctcaccgacgaccgggtgctggcggattccaagctcaaggcggcgctgcggcagcacttcaaagccgaatgcgtcgagatggaaggcgcggccgtcgcccagacggctcaggccaacggcgtgtcctggctgatcctccgcgggatctccgatttggcggacgaaaacatgcagggcacctacgacaatcattacggaaaagccatcgaggcggccgcggccaccgcggtggccgtgtgtctggttcaagacgcgcagacgggctgcgcaaaaaatcattacattatatagaaagaaaattagaggcaatcatgaaagataacagcgaaatcaaatcgacggcgtcgggctcggcgctggtcggagacgacgaacgggaatttgacgaattgggcatcaaggtgccggtgccggcccaccggccgacctgggcggaaatcagtctggacaacgccgtgctcaatctgcaggaaatcaaaaagcgggtgggcccgggcccgaagatcatcgcagtggtcaaggccgacgcctacggccacggcattgaattcacccagacgattcaagacgagggcgtggacatgatggccgtcgcctttttggacgaagccatcgcgctgcgccagaagggcatcgaccgctgcgacatcatgattctcggcctgacccccaaaaaccagattccggatctggtcgaatgggacatccagccggccgtcgattccctcgaatttgcgcgggccctttcggaatacaacgtgaaaaacggcacggtgacccgcatccacgcgaaggtggacaccgggatgggccgcatcggcttccgctgggacgaagcggtggacgccatcgccgaaatctcagaaatgccgggtatcgagctttacggtatgttcacccactttgcgacggccgacgaagcggacaaatccttcaccgagctgcagatgaagcgctacctggacgtcgtccgcggcctcaaggccaagggcatcgaaattccgctgaagcacgtggaaaattccgcggcaatcatcgacttcagcaagtcggtgttcaacgcggtgcgcccgggcatcattctctacgggctctacccgtcggacgaagtcaagaaagaaaatttgaagctgcgtccggtcatgacctttaaatcgacggtcatgcacctgaagacgatccacgccggggattcctgcggctacggccggaagttcatcgccgacagcgaccggaaaatcgcgacgctggccgtgggctacgccgacggctacacccggatgctctcgggcaaggggacagaagtctatttggacgggcaccgcgcgccggtggtcggcaacatctgcatggaccagtgcaccgtcgacgtgaccgacgtgccgggcgtgaaggtcggcgacgaggtcgagctcttcgggccgcacattccagtagaggaattggccgaaaagctcgggaccatcaattacgaattggtctgcatggtcaacaagcgggtgccgcggctctacaaattcttgggtgacgaacacctcgaggtcgaaatcctcaacgacggcttttacggctcgttctaattagattcggacagagattctggaggagttttcagccgggcgcgcaggtatttgatcgggatgcctttctctgagaacattgcctcgtgctcggtcgggtagtcctcgagggacgggtagcgcggatcttggtgaaggtcccggctgagcgccaggacctcgaagccggcctcctcgaggtagccgagggtcgcctcgaataaatcgtcgtcgtcggttttgaagcgcagccacgccccgggcgcgagaaaagccttgtacttttccagctggcgggtgtgggtcagccgctttttgtgctttttgcgcttgggccacgggttgcagaaattgatgaaaagcccgccgatgcggtcatccgggccgagaatcttttcgatgcgctcgatgtcccaggcggtgagcatcagattttccgggtcggcgccatcgcgttcagcgacgacgttgcgccgcgtgatgccgagcatcgtgtcgatcatgtcgaccgcgaggtaattgttttcgggatgggcggcggacattttcgcgatgaaatgccccttgccgcatcccagctccagatacagcgggtgcgcgggggcggcgaagcgtgtccgccagtgatttttcaaggtccagggctcggcggcgaaaaacgggctggcttccagctcaggccgcgcccacggacggggtcgtatatgcataagggcctctccttttttattttgttaattttgatttgaatgtattttaatggaagacgggatttagagcaagggggaagagagatgaaaggggttcacgattcggaaattacaggtaatccgctgtacagcgcgccgctgatgccgctgatcgcgaaatacgccgtgccgtcgatcatcagcatgctcgtgtcggcagcctacaacatcacagaccaggccttcatcggccacgtcgtcggcctcgtcggcaacgccgcgaccagcgcctcctttccggtggtgacactgacgacggccttcgccctgctcatcggcaacggcagtgccgcggcttacacgatggcggtcggcgcggacaagcgcgacgaggcggcgcgcgtcgtcgggacgggcaccttcatgctgatcctcgctggggcgctcatcttcacggcgatcgtcgggctcaagcagccgatattgatcctctgcggcgcgacgaaaaccgtcatgccctacgccagcgtctacctgaagtacacggcctttggcctgccgatgatgatgtttgccaatgccggcgccagcatcatgcgcgccgacggcagccccaacgcggcgatggccgcctcggtgagcggggcactgctcaacgtactcctcgattacatgttcatgttcgtgctgcacctcggcatccgcggggcggccctggccacagtcatcgggcaggccgtgtcctttctgctctgcgtgagctattacccgcggtttaaatgcattaaattcaagctgtcgtcggtgcagtaccggaccgataccgcggcgcagatcaccaagctcggcaccgcgaacttcatcaatcacatgatcatggtgctggtcaacatcgtgctcaacaaccagctgacccgctacggcgccctttcgccttacggcagcgatattccgctggcggtggccggcgtggtctcgaagctcaacgtcattctcgcggccttcgccgtcgggctggcccagggctgtcagccggtggtcagcttcaacatgggggcaaagaactacccgcgggtcaaggcggcctacatgacggcggtgcgcgccgcggtgatcgtcagctgcatcgccttcgcggccttccagctctttccgcggcagatcgcgggcctgttcagctccggcagcgccgcgtatttcgaattcgccgaaaaatacctgcgcatttacatgttcatgattttcgtctacggggtgcagccgatgacggtgaactatttcgcgaacatcggcagcgtctccaaaggcatcacgctgtccgtcgccagacagggcttcttcctgatgccgctgctggtctttctgcccaggattttcggcatcgacggcgtgctctttgccggaccgatcgccgacgcgctggccttcggcctttcggtggtcctgatgcggcagaatttcagggagctcgaccagatggcggccgaatccgggaaaaccgcttaaattcgcccttgcaattttataaaaaaatgatacaatacaaaatcatagtcaaaggcgttgatgaagacggtgttttgaatcctgtgtcaaacagagaggcggcctgcaagctgaaaagccgccggcacatcagaacgcggatcacttcggagctggcagcctgaacggagtagggcggcccgggaagccgttaaccttaaaatgaagcgggccgcagcgcggccaatgcgggtggttccgcggtaatcatggattatcgtccctttttgaaaaatcaaaaagggactttttttatatttgtattgcatttgaggaggaaatatggcgcgaaagttttctgaattgtccaaggctcctgtgaaggaagtcgaaacccaaatcgcttccaaatgggaagaagaagacatcttaaacaaaacgattgaagcacacgctgacgacagcaattttgtattctttgaagggccgccaacggccaacggcaagccggggatccaccacgtcctcgcccggaccctgaaggattccgtctgcaaataccagacgatgaagggccaccgcgtgctgcgtaaggccggctgggatacccatggcctgcccgtcgaaatcgaagtggaaaaacagctgggcatccacaacaagcccgaaatcgaagactacggcatcgcgaaattcaacaagaaatgccgcgaatccgtcttcacctacgaagcgcagtggcgcgaactgaccaagcgcatgggctatttcatcgatctggatcacccgtacatcaccctcgacaacaattatatcgaaaccgaatggtggattctcgaccagttctacaaaaagggcctaatctacgaaggccacaagattctgccctactgcccgcgctgcggcaccggtctggcgtcccacgaagtcgcccagggctatcaggaaatcaagaccaacaccgtcaccgtcgccttcaagcgcaaggacgcggacgaatacttcctcgtttggacgacgacgccgtggaccctcgccgcgaacatcgccctctgcgtcaatccggaagcggattacatcaaggccaagagccgcggcaccgtattcatctgcgcggaagtcctcgcggacaagctcctcggcgacgattacaaagtcgtcgaacgcatgaagggcaaggacctcgaatacgtcgaatacgaaccgatcatgcctttcgttcgtccgaccagaggcaagggctatttcgtcacctgcgccgattacgtcaccaccgacgacgggaccggggttgtccacatcgcgccggccttcggggaagacgactaccaggtcggccgccgctacaacctgccggtgctccagccggtcggcctcgacggcaaatacacggcgacgccgtggaagggccatttcgtcatggaagaaggcctcgacatcgaaatcatcaaatggctcaaggaacacgacgtcttattcaagaaagaaaaggtcacccacaactacccacactgctggcgctgcaagactccgctggtctattacgcgaagccgagctggtacatcgaaatcaccaagctgaaggatcagctcatcgacaacaacaacggtgtcaaatggttcccgccctttgtcggcgaaaagcgcttcggcaactggctcgaaaacttaaacgactgggcgctgtccagaagccgttattgggggacgccgttaaacatctggcgctgcgacgacccggactgcggctgcaccacctccgtcggcagccggaaggaattggcggaacgcgccatcgaagacatcgacgacaccatcgagctgcaccgcccctacgtcgacgacgtgcacctgacctgtccgaaatgcggcggccgcatgtcccgcgtgcccgacgtcatcgacgtctggttcgattccggctccatgcccttcgcacagcagcattatccctttgaaaacaaggacaaatgggaagatcagttcccggcggacttcatctgcgaagggatcgaccagacccgcggctggttctactcgctgctggccatttcgaccttcctcaccggcaaatcgccgtacaagaacgtgctggtcaacgatttggtcctcgacgccaacggccagaaaatgtccaagagccgcggcaacaccgttaacccctttgaattgttcgacaaatacggcgcggacgcgctgcgctggtatctgatgtacgtcagcccggcctggacgccgacccgcttcgacgaatcgggcctccaggaagtgcgcagcaaattcttcaatacgctgaagaacacctacgccttcttcgctctgtacgccaacaccgacggcatcgacgccgacgccatcgcgacgagcgaattcgacatcgccccggcggaccgcccggtcatcgaccgctggatcttgagcaaatacaaccgattggtcaagaacgtcaccgaagcgatggatcagtacaatcacaacacggtggtccatttgattcagaactttgtcaatgacgatctgtccaactggtacatccgccgcaaccgccgccgcttctggaaatcgggcatggacgacgacaagaaggccgtctaccgcacgacctacgaagtcctcgaagggctgtgccgcctgtgcgcgccgttcgccccgtttatcagcgaagaaatgtacggcgatctgaccggcgccgactccgtccacctggccgcttacccagtcgcggacgaaagcctgatttctgacgacgtcgaaaagccgatggatttggtgcgcgatctggtctccctcggccgctccgccagagaagacgcgaagatcaaggtccgccagccgctgaccaaggtcatcatcgacggcgaatacaagaccgtcctcggcgatctgaccgaactgttgaaggaagagctcaacgtcaagctcgtcgattttgaagacgacctccagtccttcctgaacttcaccgtcaagccgaacttcaaggtcgccggcccgatcctcggctcgaaggtcaagctcctcggcaaggccatggccaccgtcgacgccgcggccctcgtcgccgccacctccgccggcaaggcttatccggtcgaagttgaaggggaaaccatcgacgtgacgccggaaatggtcgacgtgcgcatcgccgcgaaggacggctttgacgtccagaccgacggcgaacacttcgtcattctcgacatgaccctgaccgacacattgatcgccgaagggatcgcccgggaatgcgtctctaaggtacagcagatgcgcaagaaccacgatttcgaagtgaccgaccacatcgtcatcacctacgaagccgacgctgaagcggctcaggccatcgaagccaacgcggacttcattaaaaaagaaaccttggcggaagacctcaaggccggtaccgccgaagaagaacaggatctcaacggccacgccgtgaagctctctgtcgaacgggtataagcttaataaaatcaatcaaatgcaaaaaatccctgagtttttaaagctcagggattttttgatgcatgtctttaagcctgccgttcggcgaggagccaggccatgacgtggacggcctgctggaagccgccggtttgaatcaggttttcgatttcgtccttggacaatagcgcggcgtttaaaaactcggtctcgtcgaggtcctgtcccgagacgcgccggcagtttttggcccggtagatgtgggcgtaattgtcggaaatcgtcgcgtccgacgggatggtcagcaggtggcgccagtcgtccgaggtgtaacccgtctcctcctggagctcccgcttggccgcagcgagggccgcgtcctcggacacgtcgtcggcgtccttggccttttcgatgccgccggccgggaattcagtggtgacttcgccgatgccctggcggtactggcgcacgcagaggaagcgcccggcctcgtccgaggcgacgatgacgacgtagttgcgacggctgtaattgtaatagggcgtaaaaatgctgccgtcgggcatgcggtaggtcaggcggcggaagtcgatccactcgtcctgaacgaggtgttcggttttcagtaactcccatttcaaattgggctgggtgttgggtttattgtgactcatgattctccttttaaaacaaaagccgcccggttgaggcggcaaatggttcgtttaaattcaatttccaattagtttaatttggtcaaaaactgggcggagcgctggcgcaccggtccggcgatgacgcagagcagcaccgcgtacagcgggtagagcacgatgtttttgacgagccgggcggtgaaaatcgccatgaaggcgttgccgtacagcatcgcgagccagaaggtgttgagcagcatgtcgatggcgacggtgacgactgcctgggcgatgagcaccttgaccgtcgacggccgcttgtgcacgatcagcccgaaaatcaggccgacaagggcgtagctgaccgtgaatcccgggaagaacgcgccggccgggtggaccatgtagccgagaatatcggacagggcgccgacggccatcccgaggcctggcccgagcaggatgccggcggccgcgatggccatgctgttaaaccggatctcgagggtattggtaaccgtgattgaaaagaaagacaggatggtggcgagggcgacaaaaagcgccgacgtgacgatccgcctcgtgtgcattgatgacataaaaaacctcctttgcagcaggtccttcgctacaaaggagatcatctcggaagtagcaacgggatgcggaagggacaccgtaagcttatcgcttttcgtccagctgacaactccccgttcagccggcacttgacgcgtccgatcctactctgcttcatcaatttttttctattatatcggtcgtgcctggcgatgacaaggggaaattaaaaaattacaaaaattgattaaaatcgtgaaaaagtgtagtcttataaaaatcaatatgttataatataaacacaattggagatagattgtagtccgcagcgcgtgaatcaattaggagaggattgagcgccggacaagcgtgtacatcgaaagacagtcggtgtaccgcagagggggaacaaagatacggtcagaccgtatcttttttttatgcctgaattgtgataaaatcatcggtggtttttttagaaagcttaacgatttggattacgattaaaaatacgatcaaaaaaagagaggaagtgaacggatggaagcacgatcgaaattgaccgtcggtttgccgcgggcgctgctttaccaccgatacgcggtgctgtggcggacctatttcgacgccctgggcattgacaccgtcgtgtcgggcgagaccaaccgcgccgtcgccgaaaagggcctcgccgccgcgtccgacgagatgtgcctgtcgctgaaggtgtacctcgggcacgtcgaggcgctgatcggccgctgcgaccggatcttcatcccgcggatcgtcgacttcggcatccgccgggtcatgtgcacgacctttgaaggactgcccgacattgcggccaatattttcagagaccggcacatcgatatcttgtcctgcaatatttccgtccagggcgggatcgacgaaaaagacggcatgatccaaatgggcacagacctcgggtattcgaaaaaggccgcgaagcgagcctacaagcgggccctcgcggcccagcgcgccgccgacgaggccgcagccgccgcggcggaccaattgtacaaaagtgacggcctgaagatcgcggtcggcgcccacccctacgtgatggacgacgattattacggcaggccggtgctcgattatttgagcgaaatgggcgtgacggccattccggcctacgcggtggaccgccgggaggcgcggaaggtgaccaagcgcctgagcccgacgatgaaatgggaggtgtcccgagaaatcgccgggtcgctggcgatgcacttagacgacgtcgacgggatcatcctgatgagcgtctacccctgtgcgctggactcgatggtcaacgatatgctggtgcgcaaattcagggacagcggcgtgcccattgtgaacctgacgatggacgcccagagcggcaccgccggacttgaaacccggctggaatccttcatcgacattctctcgatgcggcggacaggaaaggcggcaaagggatgaaagcggacaaaaaggacaagcgcaagatcgcgttcccgatgatcgcccactacaacgacgcggtccggtatttcatcgagcaggggctcgggcagacctacgtcatgcagccggcgatgaccaggcggacgatggccctcggcgaaaagctttcgccggacatggtctgcacgcccttcaagacgattctcggctcgatgatcgaggccctggaggccggcgccgaggtgctgatcatgacgatgggctactgccgcctcggctattacggcgagctggctgaatcgatcctcagggagcagggctacgatttcgactacgtcaatttcgccgagtacacgacgggccggccgaaggattacctgaaggctgtcaaggcgatctgtccccacgtgcgcccggccaaggcgatgggggcgctccgcgccgccctcgacatggtcaaatacatcgacgaggtcgagtgtcagtattacatgaactgcggcttcgagaccgagcccggcagcttcaaggccgcgctgaagcgtttctaccgcgacatgcgcaccgcgaaaacccgcagggacatcgaggcgggctacgaaaactgcctgcagacctttgaacgcctgccgatcgacaagggcccgaacgcgctgaaggtcgggctcatcggcgagtacttcacggtgatggacgccttctccaatctcgacctcgagcaggctctggcggacatgggcgtcgaggtgcaccggtggatgaacgtctcccaccgcaacctcgattaccccggagaaaagaacctccacgtgcgcatcaaggaatactgtcggtacgaaatggggccgacctcgacggccaacatctggaaggcgaagaaatacgctgaggatggcttcgacgggatcatccacgccaagtccgccggctgcacgccggaaatcgagatcatgccggtgatccgcaacatctccgaggactacaaaatcccggtgctgtttttgacctacgatacccagacggccacggcggggctgatgacccggctcgaggccttttacgatatgatagccatgcgaaagaaggtgatacaatgagacaagaagcctacctcggcgtcgacgtcggttccatttccacgaagggcgtcgtcatcgacggggacaaccacatcctggcctcggcctacatctggaccgaaggcgacccgatcggcgcggtcaagcggctgatcgcccagctcgacggccagttcgaccacgaccgtttccagattcgggcgacgggcaccacgggatcggctcgcaagctcgtcggcgcggtgctcggcgcgacggtcgtcaagaacgaaatcacggcccacgccgtcggcacaaccacgttccacccggacgtgcgcacgatcctcgaaatcggcggccaggactcgaaaatcattctgttggaaaacggcatcgcgatcgactacgcgatgaacacactgtgcgcggcggggaccggcgcctttctgtcgtcccagtccaggcgcctcgggattccggtcgaggacatgggcgaggtggcgctgaagtcggcccacccgacccacatcgcggcgcggtgcaccgtcttcgccgagtcggacctggtgcacaagattcaggtcggccacacgaaggaggacatcgtcgccgggctctgccaggctgtcgtcggcaattacctgaacaacgtcggcaagggcaagcgcatccgcgagcccatcgtctttcagggcggcgtgtcgaagaacatcggcgtcgtcaaggcctttgaaaaggccctcggggagccggtcatcgtcgacgaaaacggccacctgatgggcgccatcggcgcggcgattctcgctcggagcggcgaagcccgggcggatttcgactttgacatcgaggacatcgatttcgtgactcgggaggtcatctgcggccgctgtccgaaccgctgcgaaatcatctgcgtctaccgcgacggcaggctcatcgacagctggggcaaccgctgcgaaaacggcgaaatcacggtgcgccaggctcaggagaacagcgcgtaagttttttattactttaatcaaaccaccaaaaaagccggcggataaaaatccgtcggctttattcgtgtctggggttttcaggttattctgcgatttccgtcgaaacgccggtgttgcggtatttgcggcggaaggccgtcggcgtgatgccgacgtttttcttgaagaccttgctgaaataattgggttcgtggtaggacaggtcgagggcgatgttgatgatcggcgtgtccgtgttgatcagcatgtccttggcgatctgaatcttctgctgagtcaggtaagtcacgaaattcatgcccgtttcctttttgaagattttcgagaggtagtaggagctcatgttggcgtactcgccgacctgttccagggaaatgtcgttggcggcgttgcggtcaatgtagttgaggatgtcctcgatggagctcttgcggtccgggttggtcttcatgtggtcgaagattttgccgatgactttcatgatttcgacccgcaggttgtagcggttttggaactggcgggcgaaatgcttgtggccgctggtgcttttcagcggcgagacgatttcgtagccgccgttgtcgtcggcgacagtctgcagttccttcatcaggatctggacttccttctgaatcgagatcaggtcgaagccgtagtggtcgtagagcaggtccagataggtctgcaccgccttgcggcactgggcgtatttcttgtgcaccaccgcgtagatgatttcgctcatcttttcgtcgatgttgctgcgggtgttggcctgcagcccttcgatcgcctgattgatcgcggcgatgagctgttccggccggatcggcttgagcagcaggtcgtcgaccttggccttgatggcctggtgggcaaagtcgaattcgttgaaggcggtgatcaggatgaccttcttttcagggtcggcctttttgacccggcgcagcacctcgatgccgttgatttccgggatgttgatgtccatcaggatgatctgggggtcggtttcctcgatgcccttcagggcgtccttgcccgacgcggcggtgccgacgattttcacgttgggcgcctgaccgttgatgatcatctgcagggctcttctttctaagtgttcgtcttctacaatatatactttatacatactttccctctttctcttttccgttaacttacatggatcccggcagggttttgttgggaatccggatgatcacgtgggtgccctgggcgagccccttgacgtaggtgatgccgtaacccttgccgtagtagtagcgcaggcgcttgttgacgttctgcacgccgatgcccatcccctttttgctttcgtcagtgcggaactcttcgttgagcagggcgtcgattttttcgtcagggatgccgtcgccgtcgtcgatgatgtggatcagcagatcgtgtccgtcggattcggtcttgacggtgatcgtcgacggcaccttgcgcgcctcgacgacgtatttgatgctgttttcaatgaagggctggacgatcatgaacgggcagaaggccgcgttcagcgattcgtcgcagtcgaacacgtaattcaggtggtccccctggcgcaccttctggatgtgcaggaagttgcgcgcgttgttcagctcgtcctcgaggcggacgaagtcgttctcgccggtctgcagtgtgtagcgcagcaggtcggagaaatggtaaaccatttcctgggtttgagtcgcgccctcgagcatagccaagcggccgatggtgttgagcacgttgaagaaaaagtgcgggttgatctgggcctttagagcgcgcaggtcggcatctctgagagccgattccgcctcacttcttcggtggatttccatcatcagctgttcgttggcttttctgagcttttcctgggtcattcgggaagcggacagctccgcgaggtaattggcgatggtgtacatcaactcagcggcggccttgacccgccccagggtcgagtggggcacgtgtttgcgaagctcgagaaattccgggtagtcggagaaatccgtcagacagcccggcacgcccatcggcagctgtgccgcttcttctgggggaatgcggacctggccggcgagaatcgcaccgaggtattcgccgcgcacctgaatcggcacggccatatcgacgaggccgccgtgacaggtgtagattttcggccgctggacgcggttggcgttgcggccgcccatgtcgtcggaattggtgcagtgcttgtaaaattccgggatcgtgcggatcgcggtgcagaagggtgtgaagttgctgtacttcagcaccgggtcaccgttgcggtcgacgaagattgccgcgacgccggtcgcttctgaaaaggcgtcttgaatgcgctggagcagctccatatcgaagacgtcctgaatctcgaggggcgcggcatccgcctcgtcgctcgtcaaagttttcagccgtttcagcggctggtcgtcttctattgtattgtctgtgttgtccggcatgtccggcttcaaattcaatgatttcagcatggctactatcctcaaattgatgtgtgtatttgtgtgtattttttgtttagtctatttgtgtatgcgttatcaatgatgtcacactctcattataacatagttcggccaaatgggataatttttagacattttttggcaaaatcttacttgcttgttaaaaaaattaaaaaaaatacggctgaatctgtgtgatggtgcgccgttactcgtttacaatacaaccagatattgtggtatttaaatttgcacacaacaataacttgattttgaaggccggccgcattataatagctctggagtttttgaaccctgaatactaatttaaaaataaatgattacacaagcatgagagatcacataaggagggcaatatgggtgaagagatgcaggtgatgaacatcatcaagcgcagcggcgaagaggtgcgctacgacaggagcaaaatcgtgaacgccgtgtccaaggcgaacgtcgaggtggacccgatccgccggctcaacccgagccagatcgaggcggtggccgacaacgtggaaaagcagctgcgtcagtacacccacgccgccaacgttgaggacattcaggacctcgtcgaaaccggcatcatggaaatgcgcggctacgaggtggcccaggcctacatgcactaccgcgacaagcgcacggctctgcgccgctccaacacgacggaccgcaaaatcctctcgctgatcaaccggaacaacgaactggtcaaacaggaaaacgccaacaagaacccgacgatcaactcgacccagcgggactacatcgccggggaagtcagccgcgacttgacgcgccgcctctttttgccggaggacatcgtgaaggcccacgaggaagggatcatccacttccacgacgccgattatttcgcgatgcgcgagcacaactgcgatttgatcaacctcgacgacatgctccagaacgggaccgtcatttccggcacgaagatcgacaagcctcacagtttctacacggcctgcaacatcacgacccagattgtcgcccaggtcgcctcgaatcagtacggcggccagagcttttcgctctaccacgtgtcgaaattcgtcgacgtcagccgccagagcctgagagcccgcacccgggccgacctcgaatcggcgggcatcgccgccagcgacgagcaggtcaaccagatcgcggaacgccgactcaagaaggaaatcaaaagcgggatccagacgattcagtaccagctgatcacgctgatgacctgcaacggtcaggcgccttttgtgacgatgttcatgtatttggacgaagcgccggaaggccagcctcgggacgacttggcgctgtgcatcgaggaagtgctcaaccagcgcatccagggcacgaagaacgcccagggcgtctgggtgaccaccaccttcccgaagctgatctacgtcctcgatgaagacaacatcgaaccgggcacgccctactactatttgactgatctgtcggcgcggtgcaccgcgaagcgcatggtgccggactacatctcggccaaggtgatgaaacagcttaaaaacggcaacgtctacacctgcatggggtgccgctccttcctgaccgacgagccgacgatcaccaatcccgacggcagccacaagttttacggccggttcaaccagggcgtcgtgacgatcaacctcgtcgacgtggcctgctcctccggcgggaacgaagacaaattctggcagatcctcgacgaacgcctcgagctctgccaccgggcgctgcgctgccgccacgaacgcctcctcggcacgccctcggatgtcgcgccgattctctggcagcacggggcgctggcccggctgaagcccggcgaaaccatcgacaagctgctcttcggcggctacagcaccatctccctcggctacgcggggctttacgaaatgtgccagtacatgacgggcaaatcccacaccgatccggaggccgaacccttcgcgctggccgtgatgcagcgactcaacgacaagtgtgccaaatggcgggaaaaggaaaacatcgcctactcggtctacgggacgccgatggaatccacaacgtacaagttctccaaatgcctgcagaagcgcttcgggatcatccccggcgtgacggataagaattacatcacgaattcctaccacgtccacgtcaccgagcccatcgacgccttcacgaagctgagctttgaatcagacttccagaagctttcgccggggggcgcgatctcctacgtcgaggtgcccaatatgcaggaaaacattccggcggtgctggccgtgatgcgccacatttacgatcacatcatgtacgcggagctgaacaccaagagcgattactgcgaagtctgcggctacgacggcgaaatcaaggtggtcgaggacgacgccggcaagctcgtttgggaatgcccgaactgcggcaaccgggatttgaacaagatgtcggtggtgcgccgggtctgcggctacctcggcggcgccacgggctttaaccagggccgcacccaggaaatcgccgaacgggtgctccacctctgatggtcatgcattacgccgatgtgcacgcccacgacatcgccaacgggccgggtgtgcgcctctcgctgttcgtctcgggctgcacccaccactgcccggggtgcttcaacgaggtcgcccaggatttcgattacggcaaagtcttttctgaagatgtgcagaaccggctgctggatcagatcgccgcgccctattactcgggagtgaccctcctcggcggggaaccgatggagccggccaaccgggcggcgctcctgcccttcgtgaagcagatccgcgcccgctacccgaagctgtcgatctggtgctactcgggctacacctacgaggcactcgagaaagacgcggcagagatgctcgccctgctcgacgtcctcgtcgacggggagttcgtgcaggatcagaaggacgtgacactgctctaccggggctctgccaaccagcggctcatcgatttgaacaagacccgggccgcgggccgagtcgtcctctgggaccccggcacggtatcgatgtcgcgcctctcgcattagcgtcttttagaggcctgacaaaaatttgggtgagatttttgtcatctcaatggaaatcgcggggattgtgctataatggaaattgatattgggaaatagccagtctgtttccaaacgaggaggtatatctggtatgaaaattgtattgctcgaacccctgggtatcagcgccgacaagctgaaagcactcggcgatgcgatgacagctcagggccacgaatttgtcagctacgacacattggctaaggacgaagcggaacagatcaaacgcatcgacggcgcagacgtcgtgatcatcgcgaatcacccgctgccgggcgcagtcatcgactccgatccgaatctgaagatgatttccgtcgctttcgtcggcatcgaccacgtggacgtcgaagcctgcaagcgccgcggcatccgcatttccaacaccggcggctactgcaacgacgccgttgccgaattggcggttggcctgaccctcgactgcctgcgcaacatcacagcgtgcaacgcggccgttcaggcgggcaagggcaaagccggtctccagggctttgaactggcaggccgtacggtcgggatcgtcggcaccggtgccatcggcatccgcaccgccgaaatcttcaaggccttccactgcaatctgatcggctacagccgcagcgaacgcgacgccgcgaaggccctcggcctcgaatacaaatccttggacgacgtcatggccgaagcggacatcgtctcggtgcacaccccgctgaccccggacaccaagggactcatcggcgctaaacagatcggcgaaatgaagcctggcgcgattttgatcaacaccgctagaggtccggtcgtcgacaccgacgcgctggctgaagcgttgaaggcgaagaagatctacgccgggatcgacgtgtacgaaaaggatccgccattgccggcagatcacccgctgctcggctgcccgaacctggtctgcacgcctcacgtcggcttcgacacgaaggaatccatcgaccgccgcgcggacatggtcttcgaaaacatcaccgcctggatcgacggcaatccgatccgcgtgatgctctaagttttcaattcaatttcatattgagcactgcagcgcagcagaacagccgcgctgctttttttgttttgtcgagcaaatgaccggatttttattttttagaaaacgtataaagcgtgtattttgcggagtacatcgcattttatgctagacttcacttaaaatttaatgtagactgataacattaccaattttataattaaaaatttacgcaggaggtggcagaatgacagcggaacagatacgccgggacgagctgagaggctggctcgacggcattgccgcgttcaacgcgacgcccggcgaagggatcacccgcggggtgtacacccccgaatttgaggacgcgcgccgctacgtgatcggcgagatgaaaaagctcgggctgacggtccgggaggactgtctcggcaacatcttcggggaatacccggggacggacccgaacgcggcgccggtgtggacgggctctcacattgacacggtgcctaacggcggcaagtacgacgggctggccggggtgttcgccggactcgaggcggtcgcggcgatgcgacgcgccggggtgcgcccgaagcggacgatctcggtcaacgtctacgccggcgaggaaatgagccggttcggcgtgtgctgtatcggaagccgcgggctttcgggccgcctctccctcacggatctgaaaaatcacgcggacccgtcggggacaagcctttacgacgcccttaaaaatctgggctacgcgccggaggatttcgatcagaccttcccccacaaggcaccgattcacgcgagtcttgagctgcacatcgagcagaacgacaagctggaaaaagccggggtgccggtcgggatcgtcaccggcatctgcgcgccgaccaatatgatctgcgaggtcgacggcgtccagtcccacgccggaggcacgagcatgaccgaccgccgggacgcctacatggcggcggcggaaatggcgctcctcctcgaagagctggccaacacctcgaccagcgactacattaccgggactatcggcgaaatcacgctgacgccgggggcggccaacgtcattccggggaaggccgtgttcacggtggacatccgctcggtcagcgccgaggacaaggacgagctcgtcgaaaatctgcgggccggcatgcgcgcgatcgccgaacggcggggcgtggacggaacgctgacgccactgaacaacgacgcgccgctgcgctgcgacgcgcatttaagcgcggtgcttcgggaacaggccgacgccctcgacattccccacatggatttgatcagcgggccctaccacgacagcctgatgcttggggatctggcgccggcggcgatggtcttcatcccgtgtgaaaaggggatcagccacgaccgcgcggaaaacattgacgacgacgatctggtcaaggggacggcggtgctcgccgaggctctggccaagatcgcggatgaataaattcttaccaaaaccaggagtatagcgatgagcaagaaaaaacgcattggcattatcggaggggggatttcgggaacggccctgggcttcaacctgagcctttacgacgatgcggacgtgacgctgtttgaaaaggggcgcatcggctgcggcaccacggcgaaatccgccgggacggtctgcctgttcgacgattccctgaacaaccgctactgggacgtccgtctctacggcttcgaaacctatttgaaaatggaacgggaacgcaagggctcggccggcttcgacaagaccggcaccctcgtctgcgcgacctctgaaaaggaagtggaccggatcaaggccgggatcgccctggccgaatccgccggctacaccggggaatacatcaccgacaaggcccggatcaaacagatcctgccgatgctcaacacggacacgatcctcggggcgggctacaccgcggacgacggctatttcgacgggacgatgatctccaacaccttcgctcagaaaatggaagcgaacggcgggaccatcctgcgcggggcggacgtcacggaaatcgtcatcgaaaacggcaccgccaagggcgtcaagaccgctgacggcgaccgctacgacttcgacgtcgttgtcgactgcaccgggccgtggagccgcttcaccggggaaatggccgggctcgacgtgccgatctggcacaccaaggccgaagccttcttcgtcgtgccgccggaaaagcatctggactacgttttcccgattttgaaattcccggccttttacgcgctgcgcgccggcaacaacatcttcatctgcaaatcccacctgtcgatgaacctcgacgacccgatgcacgcgggtcagtgggatccggaccggctgcctgaacgggaaggcaccgacgattatttcatcgatttcctgttccaccagttcgaaaagaacgtgccggggctgaccgacgcggggctgaactcctcgtggctgtcctaccgggcggaaacccgggatttcctgccgatcgtcggggatacgccggtgaaaaattacctgctcgcgacgggctacggcggcaacggcgtcatcgaagcgccggcggtgagccgcgacctggcgaagtacatcatgcggggagaatcgacgctgctgctcgaagagtgggcgttctccagattactgaaagacaaaggggaatgatatgaaaatagcgatttgtgtcaaatacgtgccggtggacagcaaggtccaggttgatccggcgactcacgccctgatccgcaacagcggcgccggcgaaatcaatccgagcgaccgatacgccgtggaaatggcccggcgcctgaagaaagacggcgacaccctcgacgtgttcacgatgggaccggcggacgcggtccgcgcgctgaaggtcgtgctcgccctgggcgcggatcacgcctacctcttaaatgacaaggcctttgccggcagcgacaccctcggcacggcgaaggtgctggcggcggccctgactcagtacggcccctacgacgtcgtcctgatgggcagcgcctctaacgacggcgccaccggacaggtcggcccgatgacggcggaactcctcgggatgcccgacgtgaccgacgcggtggacctgcagatcgacggcggccaagcggcggtttcgaaaaaggccggcgattcgctgttcgccctcaaaacggcgctgccggtgctggtaacggtgcccttcggcgccaacgaaccggagctgccgacgctgagaaatcaagtggcggccaaccagcacgacatcatcgacgtgacggcggcggatttgggcatcgctccggaaaccgtcggtcaggccggggcgctctcgatcgtcaccgacacgatgcaggtggtgcagaagaaacaggccgtgacggtgactggcacggtggacgaaatggcgaacaagctggctggcctggtcgagggccagctgaaggcgctgcagcagggaggtggcgaacatgtctaagaccgcgattttcatttggattcagaagggccgcgcggcggacagcgtggcggaattggcggccgccgcgaaagccctcggcgaacctgccgcgctttacgccttcggggcggacgcgacggaagcgctggccgcggatttggcctacgacggcattgacgcggtgcacatcgtgaacacgccggggctcaccccctgccagaccgacggtctcgccgacgcggcggcgcaggtgatgactgacgacgggcttgcgacggtgctcctcgaagcggaagccgtcggccgggatatcatgtccagagccgcggtgaaggtcggcgccgggatgacctcggactgcacggcgcttaaagtccaggacggcagtatccgccagatcaagccctccttcggcgcgcaggtcatggtcgcctgtgaagtgaagggcacgccacagatcgtcacgatcaaaaagggcagcacggcgccggcggacaagatcgacgggctgccggttgacgtgcgcacgattgaggccgcatcgaagattacctgcggggacgtcacggcgctgccgtcttccgatcatttgaccggggcggacgtggtggtcgtcgccggcaagggcgcgatcgaaagcggccagttcgaagcggtcaaggcttacgccgacaaaatcggcgcggcgctggccgggagccgcccggtggccgaccagggcttcatccccttcgacgaccagatcggcgaatccggcaccgtcattcagccgaagctgtgcatcattttcggggtgtccggggcgattcagttcaccgaggggatcaagggcggcggcaaaattatcgccatcaacaacgaccccaacgcgccgatccgcggctttgccgacgtattcatctgcgcggatatgggcgagctgctcatcgcgatgaacgcgcaggattaaaggcaattcaggcaaacaaaaaatgctgggccgggaggctcagcatttttttgtgcggattataaatatcaagttatttattattttaaaaaatatttagcttttatgttacagtccgagcagttgttttttcttttgatcgaattcttctcgtgtaatgatgtcttcatctaaaagggattttaattctctgagcttgtcggcgactgaattggttattgagatttcttgtgtgtcttccggctgctgattttttgtgattaactctaatttagataaaacattttgtgcagttgtcattgcgttcttgtacaaaatactgttggttttcgtatcggtagtaatcagatgcaaatatacactgggtaaaccatagtttcttacagtaaacttaatctgtaagtctgagcataccgaatgctgtttacgggtggaagctccgacgatagcaccgacaccgccaaaaagcataccgccgacagctgcccgtcctaaaccaccgctggcaatactggagccgttctgaagcaattcgtaatcaacaatttggtcgtaacggaggaccacaaagtgatgcggtctgtatgatacgtgctgatctggagacataatgagcatgctgttattatcgtcaaattgaatctgtatatcgggaacgtatgtcgctttaaaattttctacaacgtcaatattatattctacatcagcattaacagcttcgatttcttttagtgttaagttatcggttgaacgaaaaccgcgatattttataacattttgaaaatatcctttttctttaaagcagggtttacagatatagccatctttgcatttgtattttccagttaatgcgccaatttcttttccacatacaagacaaattttctttgccataatattcactctccccctctgcaatatattttaattataacataaaacatctaaagataatagatggacttaaggcgcaacgatctaggcgaaaccaaatctttcttgaaattagcacagtttcgtgacagaataaactcaaacgacaaggagttgagacgatgttccataaaatcaaagcagtgaatgcgcttccggattacaaattgagtgttcagttcactgagggcgtgacgaaaatttatgatgttaagccgctgtttgacaaatggccggcttttgaggcgctcaagacttcaggcgatttgttcggccaggtgagggtcgatggcggtggatacggtgtaatttggaacgacgatctcgacctgtcctgcgatgagctgtttaaatatggcgcgccaaaaaaataattcaggcaaataaaaaatgctgggccggatggctcagcatttttttgtgcttcgatgaatattaccacttttcagtgtggatcacgtcgtcgttcagggcttcaggatcgtggtcttccggcgcttcgtcgatcgggccgagggcgaggatcgcttcgagacggttgttcaccgggaagccgaggacctcacgggcgtagtcttcagcggacttgccttccacgtccgacgggcgcaggcggatctgcagccagcaggagccgaggccgaggtaagaggccatcaggtgcatctgggtcatcgcgacggcgtcgtcttcgatccaggtgtccgagcggttttcgtcgccgaggacggcgatggcggccttcgcggtggtcagcatcttcgcgccgcccttgcggcagccgacgagcttctgaatcgtttccgggtcgcggatgacgatgaaatcgtaggggtaaatccccttgccggacgggccgaggcggccagccttgagaatcgcgtcgagatcggcgtcagcgatgtcgcggtccgcgtaggcgcgcaccgagcggcgggcgctcatgcatttgagtaaatcgttcatactgttcattcctttcgctttttaatattttccgttgttattttaagtttaggccatttgttttcgattttcaagatggctgacacaagaattttaatacaaaggtcatgccacacagggagtcgatcccggaggaatgcccaatttccttgaatttttcggccatttcggcagcattaaaaatagattgatcgcaagcgaaaaaatttaaaataattttcgacacgtacccctcggcggcgcagttgataaaggcggcggagaggggatgggtccggtcgccgaggtgagtcagctcgcgcaatagaaagggcaccaccgggtgataccaggcaccgatgccgcggaaagcggcaaataccccgcagaggaaatcgtcgccgctgggggtcagccccggcccaagaccggcgagctggcagagggcagcagcgaagccctggccgtctaaggcgagaaaggccgccttggcttttgcgagcgtttcgttcacagcggcagtaaagagatcgccgtcacttttcggcgcgtcggaaaagagcggacggaagcccgcggtgatatcaccgcaatgatcgagaatcgcgtcggcgcggtcggcgtaggtcttggcgagtcccagccccattttcatgccctttatccggtaggcgtttcggtcggtatcggcctccggcgtcaggcgggtcccttcaaccgcggtgtcgtcggttacagtaagggtggcgtgtttcaattgaatggtgccgcggccgacggtgacggcgtccccctgggcggcgccgaggtccgagaggggaaaatcgcagcgcagggtcagcggcgagatgggcgagtccgcaggctgcagcgcgatgagctgtccgtgcaccatcaggttgaccgcaccgtcgtacacggagtggacggtgccggtctgcgggtgcttggcgttgagccagggctcggtgtagtcggtggtggataacaatttgtatttcatggcatcctcgttagattatttttataggcttttctttttatcatatcatgaaaagggtgttataacctgattctttagattttagcataatttatgcagttttaagaaaaaattcttgcatttctgcgggtatgcgtttacaatagatttagaaaattaaaaaacggttgaatactttttaaaaacttcgaaaatattttaacttcaaaagattctgaccggcagttattgacaagctgcccaatgtccgttatagtgtgtgtatacaaaatgaaatactgaaaaggcaagggcgtcagaaggttttacttttggcgcccttttttaaacggataattgaaaagaaatacattttagaaattatcaagtgaaaagcggttaatcaggctgaacgtacagggagtttaaaattaggaggagcacaatgtacgatttatttattaaaaacggcaaactggtcacaccggaaatggtgcaggacggcggcatcgccgtgaaggacggcaagatcgcggcagtgctggcgccgggggtcgacgtcgaagcggaaaaggttatcgacgccggcggcaaatacgttttcccgggggctattgacacccacgcccatttgaacgatccgggctacgaatggcgcgaagattacgaacacgggaccgccgcggcggtgctcggcgggtacacgacggttatcgacatgccgctgcagaacgaaccggcgatgaccaccggcgaactcttcgacattaaagaagcgaaggtttcccaggaagcttactcggattactgcttctggggcgggctgatccccgacaatttcggcgatttggctgatctggacgaaaagggctgcgtcgccttcaaatccttcatcgggccggtgtcgccggactacaagcccttaaactacgggcaggtttacgaagcgatgaacatcatcaaaaagttcggcggccgcgccggcttccactgtgaagatttctcgatgatcaaagaaggcgaagcgaagatgaagcgggaaggccgcctcgactggcagggcttcctcgattccagaaccgtcgccgcggaaatggtcgcgacggacgcggtcatcgaaattgccaaagcgacgggctgcaaggcccacatctgtcacgtgtccagccctgacgtcgcccagaagatcaaggaagcgcagcaggccggctacgacatcacggcggaaacctgcgcccactacttgagcttcaccggccaggacaccatcgacaacggcgagctcttcaaatgcgcgccgccgctgagaagccaggaagaggtggaacgcctctggggctacgtcgtcgacggcaccttctccggcatcgcgtcggaccactcgccctgcgcgccggacgaaaagtacaaggaaatcctcggccagaagatcgaaaacgtgttcgacgtctggggcggtatcagcggcatccagagctgtgtccaggcggccttctccgaaggggtcgtcaagcggggcatctcgccgacggttcttgcgacggcgatggcgaagaatccggccaaggccttcggcatctacggcagaaagggcgacatccgtccgggatttgacgccgatttggtgatcatcgatccagataaagaatgggaagtcaaggcggacgacctgctttacgtcaacaagatttcagcctttgtcggcatgaagggcaagggcctgccggtgtgcacggtggtgcgcggcatggtcatggcggaagacggcaaggtcgtcggcgaaaagggcgcaggcgagctcgtcaagcgcatcaagtaagcacgcagtcaacacacaaagaagaagggaatttacatcatgctgaaagaaaacaagattttgaatccggagctggcgaagaacgtcaacgccgacctgctgccgaccgacgagcggatcatggacccgctgtcctacggcgcgagcttcatgggcggctgcgtctccatcgggacgttctcgatgggggcgagcctcatcggggcgctgaccatcgcccaggccatcatcgcgatgtgcatcggctgcgcggtcatcgccatcgccctggtgctcatcggcaattacggccacaagtacggcgtgccgttcacggtgcaggccagacagagcttcggcttcgccggggtcaagattccgggcttcatgcgcgggattccggccatcgtctggttcggtttccagagctgggtcggcgccggggctatcaactcctgcctgaagatcctcttcggcttcagcaacatgccggtggttttcgcgctgttcacgattctccaggtcgccctggccattaagggcttcaaggaaatcaagtggctggaaaacgtgtcctgcgtgttcatcatcgggattctgatttacatgctctacgtcgtgaacacgaagttcgcgggccagatcggcaacgccttcggccacatcacaggcacctggggcatgccgttctgggcggccacgacgtccttcctcgggatttacgcgacgatgatcgtcaacgcgtcggactacagccgcaacctgaagcacaagaccggaccggtcgcgacgggcagcatctacaccctggcgattctgccggttacgctgttcatgggcctcatcggcctgctcgtcaccgcggcgaccggcaactccgacccggtggtcgtcttctcgacgacgatgaattccaaggtcctgacgattctgaccctggccttcatcgccttcgctcaggtcacgaccaacgtcctcaacaacatcgtcccgccggcttacgtcctcgtcgaatccttcaacatcaaatggtcgtgggcgacgattatcgtcggcgccctttccgtcgtcgtcatgccgtggcgcttggtcaccgcgcagtccgcggcggggctgtccctgttcacgcggttctactccgccttcctcggaccgattttcgcggtcatggtggtggactactacatcctgagaaagaaacaggtcgacgtcaacacgctgtacgacagagacggctcaccttacaagggcgtcaactgggcggcggtcatcgcgatcatcgtcggctcggcggtgtcctgtctggtgatggatttgtcctggtacatttcattgattccgaccggcgtcgtctactatctgctgatgcgctacgccaatttcggcggcattaaccgattcagagccggcacgatttatgacactgaaaaagaagtggcgtaaagtacaccgcggattttaaaattttaatacatgtggagagtaagaggagattatcatgtacgatttactgatcacaaacggcaagctggtcacaccggaccggatctacgacgcgcagatcgcggtgaaggacggcaaattcgcggggttcttcgccccgggggaaacagttgaagcggccaagaccgtggacgccggcggcaatctggtttatccggggatcatcgactgccacgcccacctcaacgaaccgggcttcgaataccgcgaagattttgaaaccggctcccgggcggcggtagcagctggctgcacgacgctgatcgatatgccgctgaacaacgacccgtcgctgatgaacaaggaaattttcgacttaaagatgagcaagatttcccgccattcctacgtggattacggcctctggggcggtctggtcggcgatttcgacgacaagccggactcggtgaagaacaacatggccgatctgctcgatctcgaagcctgcggcgtcgcggcctttaaaggctttacctgccccaacggcccgctcttcccgacggtcaacctcggcaatatccgcaaggccctggaaatcctgaagcccaccggtgcggtctgcggcttccactgcgaagaatacggccaggtgctggaacgggaaaaggaagcgaaggcgaagacgaatcagacccgggaacagaagatccgcgatttcctcgacgcccacgacgtctggacggaatacgtcgcgacgaagaacgtcatcgacatggcccgggcgaccggcgcccgcgtccacatctgccacgtgtcccacccgatggtggcccaggtggtcaaggacgctcagcacgaaggcctgaaggtcacggcggaaacctgcccccactacctcggcttcaccgaagatttcgtgttcgaaaagggcggcccggccaaatgcaccccgccgctgcgcacccaggacgccgtggacggcctctgggattacgtcctcgacgggaccttgtcctgcgtcggcagcgaccactccccggccgcggacgaagaaaaggacaacgcgacgaaggacatttggcacgcctggggcgggctcaactcgatccagtatttcctgccgatgatgttcgacatgaccgtgcatcagaagaagctctcgccgacgctgatcgcgaaggtgatggactacaatccggcgaagatcttcggattctggggccgcaagggcgccttcgaaatcggctttgacgcggacatcgtcatcctcgatccggaaaaaccgtggacctgcgaacaggacaagctgttcaccaaaggccacgtgtcctgctttgacggcttgagcggcaagggcgcgccggtgaagaccttcatccgcgggaacctcgtcgccgaagacggccgctacctcgaaagcgaaaagggcaccggcgaatttatcaaaccgattaaatagaaaggaagcaccagatggcaaaagacaacacaacgaacaacggggcggaagtcaaggaaaacgcctcgctgaagcccctcaaagacgaagagcgcagcatgggctggggctcgtacacgatgctctggctcggcggctgtatctccatcgggacattgaccatggggtcggctcagctcgacaagggcctgaacctgatgcagattttcctcgcggtgctcatcgggacgctggtgctgatcatcggcatctgcttaaatgacgccttcagctacaagacgggcgcgccctacgcggtgcagctcaagagcgcgtacgggaccaagggcagcgtcatcccggtcatgatccgaggcctgcccgccatcgtctggtacgggttccagacctggctcggcggcagcgcgatcaaccagatttccatcgccctgttccactacagcaacgtctggctgttcttcttcgtcttccaggcggttcagatcctgctgtccatcaagggcttccaggggatcaaatgggttgaaaacatcggcggcgtcgtcatcgtcgcggcgatgttctacctactctacatctgcgtctccaagtacagcggcgtgatttacaacaatctcggcacgctgaagccgacctggggcattccgtttatcgcggcgtgtatcgccttcttcggcaattcgacgacggtcatgctcaacgccggagactactcgagggagctgaaaaccgggtattcggcgccgaagcgcggcgcggcttatttcatcgcgatggtgccggcgacggtgctcctcgggatcatcggcgcgatggcgtccaccgcgacaggcatcgccaacccgattaacgctttcgggacgatggtggacaacgtgttcatcaaagtggtcgtgctggccttcatcctgttcgcgcagatgacgacaaacctggcctccaacgtggtgccgccggcatacgcgttcatggatgccttcaagatgaaacacaagaccgcggtcatcctcgttgggattctcgcggtgtgcacctgcccgtggattctgaccaacgacgcctccgccgctggactcgacgtgttcgtcaagatttacacggcgttcttcagcccgattttcgcggtgctcatcgtggattactacatcctgcacaagcgccatttcacggacgcacagctgaatgatctttacgcggaagacagcagccgcagcggcattaactgggcggcgatcatcgcgacggcagtcggcgcggtcatcggcctgctcaacgtcgacttgtccttcctgacggcgacggtgcccaccggcctgatttactacttctgcatgaagaagatgccgtcgtgcaagagcttccgcaagggaacgagcctcgaacgggtcgataccgaataagcataagccattacctaaggataaattaaaaccattgattgcgaaacgctcggcagatgccgggcgtttttttaaacttagtcgcttcgaccgaccaagttagcgaccaagccgcgatcaagtttaaacgctaaaaccgccagactgatttatttcagtccggcggttttgttgagcttggccttgcattttaaaatccgggtgacggaggcgttcaggcgtttttcgctgatggtgccgttctgcacggcggtgagcacggcagagcgggcggcggggaagtccttgggcatcaggagcaggtcgcagccggcctcgatagcggccacggcggcctggccggagtcggtgctctgggtgacggcgcccatctgcagggagtcggtgatgacgacgcccttgtagttcagcctgccccgcaggacgtcggtgaccatttgtttcgacaggcaggccggcgtgtcgtcgccggtgatgctcggcgtggcgatgtggccggccatgatcatcggcgcgtaggcgttcacattgttaaaggggacgagctcggcctgcatcagctggtcgagggtcttgtccgtggcggcggtgccggcgtgggtatcgccggtggtggcgccgtggcccgggaagtgcttgagacaggggatcacgccgtgggcgctcagcgccttcgcttcggccgcgctcatctgtttgacgagctcagcgtcggtgccgaaggaacggcgggcgacgattttgttggccgggttggtgagcacgtcggcgtcgggggcgaagtcgaggttgaagccgagatcgctcaaataggtgccgagggtgttgccgacggctgtggccttggccgggtcgccggtggcgccgacgtcccgcatgtcgccgacgttctggacgccgaaggcgcggttatgggcgacgcgggccacctcgcccccttcctcgtcgacggcgagaaagggcgtcggcaggccgaggtcggcgtaaatctgcttggtgtccgccagcagctttttagtctgggcgggatccttcaggttgtcgtcgaagtagatcaggccgccgggctggtactgcttgacccggtcgcgggtggtgtccccggcggtgacggtggtgaggccggtgagctgatccggcgtgacgacgaagagctggccgaccttttcctcggtggacattttcttcaccttcgcggcgatggcgtcggtgcggtgagggcgggccgccttgaccgggactttactgctctcgcggcgcaggaagataaggccggcgctgagggccacggcagcgatgacggcgatgagaatcagccaaataattggatttgtttgagcgcaccgatcggggcgcttcggtttattgttcatgcttggattttcctttaatgtttcttttttatttattataacaaattaaggcatgatctcaaaatccgcggaaaaatgcgggatggcaccgcgatccttttcatcttaaaaaaatttgcctggcccctttacaaatcccggccaatcgattaaaatcaagacaattcaatgacgagacgagtaagaccagcaaacgcaaagcgaggccgggacggtgcgagccggctgccgaagctgtccgaaaaccacctccgagaggccccaatccggcccggtgattccgttaccatcagatgaagcggtccgcagtcgcggacaagcagggtggaaccgcgtgaacagcgtccctgacaaacccttgtggtgtctgtcggggatttttttattgcccggcggtgccaatgcgaagaaggagaacaaaatggatgacaaagtattgaacgtgtatcgccactcgctggcgcacattttggcgaaggcgatgatcgaactctacggccccgaaacccagtacgcgatcgggccgcagattgacgacggcttctattacgatttcgcgctgccggaaggcaagacggtcacggaagatgatttcaagaccatcgaagacaagatgcgcgaaattttgaagcgcaaggaagactggacccgcaaggaagtctccaaggccgaagccctcgacattttcaagaatcagaaatacaagaccgaattgatcgaagacctgcccgacgacgaagtgatcaccgtgtattacaccggcgacgattacgtcgatctctgccgcgggccgcacgtcgataattcccaggaattgctcagcgcggccttcgaaatccgaagcgcgtcgggcgcgtattggcgcggcgacgaaaaccgcgacaacctgacccgcgtctacgcctacgcctttccggataagaaggccctgaaggcccacaaggccctgatccgcgaagccaaggaacgggatcacaagaagatcggcgcccagctggatctgttcatgttcgacgaaacggcgccgggcatgccctactggctgccccggggctggaagctgttcaacgcgctgctcgatttctggcgcgatgtccacgaagcccatggctaccaggaaatctccgggccggtgctctcgaagaagaagctctgggaaacctcgggccactgggaccactacatggacggcatgttcgtcatcccgggcaaggatgaagaagacccgaatacctacgccctgaagccgatgaactgcccgaacaccatcaaggtctaccagacgaagaagcgctcctacaaagacctgcccctgcgctacgcccaggtcgacaccatccaccgcaaggaaaaatccggcgaactcaacggcctgttccgggtgcagatgttccgccaggatgacgcccacatcttcgtcaccgaagaccagatcgccgacgaaatcttcgacatcatggacgtggccagcgaaatctacacccccttgggcttaacctacaaggcagaactctcgacccgccccgacgactacatgggcgatatcgaagtctggaacaaggcggaagccgacctcaaggccattttggtcaagaaatacggcgaagggaatttcgaaatcaacgaaggggacggcgctttctacggcccgaagatcgacttgaagatgcgcgacgccctcggccgcgaatggcagatggggacgatccagctcgacttccagctgccgctgaacttcaatatgaagtacgccgccggcgacgataccgaaaagcgcccggtgctcattcaccgcgcgattctcggctcctttgaacggttcatcggcatcatcaccgaaaacttcaagggcgatttcccgttctggctctgcccgtaccaggtgggcattgtgccgatccgcgaatcccacaacgcctacgcgaaacacgtcgccgatgtgctcaagcgggccggtgtgcgcgtcgaagccaattattctgacgacaacatgaagacgaagatcaagggcttcaagcattacaaggacccctatatcctgatcctcggcgataaggaagcggccgacggcaccgtctcgatcaacatccgcggcaacaaacagctcaacgacattccgctggatcacttcgtggcgatgtgccggaagatgatcgacgaacacagcttggaattgattgaaaccaaggactgactttcatttgtaagatataaaaatgacgcctgactgaaaagtcgggcgttttttattggaaggagtttaacctagcataatcgaaaaatatgttttaggaaataatcggccgggaaaatcaattaatcggccgggaaattcatataagagaggagaggagaagataggatacgagaggatatgagatgagatgagaggagatacggtcatgccgcttcgcggcatttcaggcgctggcgcgccgcggggcaatcccaaactcaacgcgaagcaacagcttatatcctataaattggcgatgaacggggatttgcgcggttttaagctagaaacgaacggggatttgcgcgaaaggcccgtattatgggcgtttcagcatcacaccccaaacgcctttcatttgagatgaaaatgcgctataatagtagcgtaatcagatgaggtccgtcagcaacatatccataaaaaacaccattaaaaaatgttatttccaagtacggaccgagaggcacatgtttcaattgaagcgtgtgtctctatttttttggggctaaatatgggataaattaatttttccccggaaaaaatgtatttttccggcagaaaaatcgatttttctggcgaaaaattcatataggatatgagaagagaagagaggatagcataggagatgagattccctccccggctggcgccggggcctgccgcgctgccgcgcggggaggggatcccaactcgccctcaatatacactcataatcatatcagctggcggctgatattattcactgctcggacgttcggctcgggcaattttcgcccgtagggtgttgagcaccagccgcttgttggcggaccatttgggcgcgatcaacagctttttcggcgcgtcgccggtgagcctgtgaacgacggtcgattcgggcaggcgcttcaggcagtcgacgaccaaatcggtgtaggcctcgagggtgaacaccgggaaagggtccttcaggtaggcctcgcccatggccgtgcccttgagcacgtggagcagctgcagcttgatacccggcagggtcggcgagagtgttgagagataatcgaccgtctcgagcatcatcgcccgggtctcgccgggcaggccgaggatcacgtgcacaaccgccgggatgccggcgtcggccagccgcctgtaggctgattcgaacacctcgagggggtagccccggtgaaaggcctcggcggtggcctcgtggacagtctgcaggcccagctccacccagacgggcttgacgcggtttaaatccgcaagcatgtcgagcacgggatcgggcaggcagtccgggcgggtgccgaccgcaaggccgacgatttcgggccgggcgatggcttcgcggtagagggcccgcagccgggcgagctcagcgccgcttctgacgtaggtgttggtgtaggactggaagtaggcgatgtagcggcggtcttccggagcgatgcccttcgggaatttcgggtcgaccagggccttggccgcggccagctgttcgcctaggggcgcggggtccgcggcgaaatcgccggagcccccggccgagcagaaggtgcagccgccggtgccgagggtgccgtcccggttggggcaggtgcatcccgaggagagggacaatttgtagaccttggtgtggtagcggcgcttcagcgcctcagataaagttaagattttcatgactcccctgacaattaaaaaaattaaaattttatgggttttgtctattatattccaatgttggcgctttatcaaaataaatgtgtgtgttataatgaccacagtattgtggttttttttggaaaaataaaactggcggcgcaagctgccgggaaaggatgtaataaacatggcagtaactgtactcgtaggcgctcagtttggagacgaaggcaaaggcaagatcatcgattatctctgcgatcagcaggatttgatcgtgcgttttcagggcggcgacaacgccggccacaccgtcgtcaacgacgcgggcaccttcaaatttcatctggtcccgagcgggatcttcaataaaaacggcgaatgtctcgtcggcaccggcaccgtcgtcaatttagacgtcctcgctgaagaaatgcagcaggtcgaagacgcgggcgtctcgacggacaacctgaagatttccggcaaggcccatctgctgatgccctaccatcaggagctcgacgcgctgatggaaagccacggcggtatcggcacgaccaaacgcggcatcggcgtctgctacgcctttaaaatgctgcgcaagaacttaagagcggaagacctcctcgatctggaccgcgcccacgacaagatgctcaattacctcgacgtcgtgaacaaaatgctcgtcgcctacggcggcgacgccgtcaccatcgaacaagtcgacgcgaagcttaaaggctgggccgacaagttcgcggaccgcatcgtcgaaccgatcagctacatccacagctatctggatcaggacaagaacattttgttcgaaggacagctggccgcgatgaaggacatcgaccaggggatttacccctacgtcacctcgtcctgcccgtccggcgcctacgcggcggtcaccggcggcttcccggcgaagaaaatcgacaaggtcatcggcgtcgccaaggccttctcctcagccgtcggcgcaggcccattcccgacggaagacgaagacagcccgcagctggcgatcatccgcggcgacggcaccaaggacgacgacgaattcggcgccagaaccggccgctcccgccgtctgggctggctcgacctgccgatcatccgctacaccaatttggtcaacggctttgacgaattggcgctgtgcaagctcgacaagctggacttcctcgaaagcatcaaggtctgcaccggctacaagctcgacggcaagaagctggattacttcccgaacaccgacgatctggaacgggtcgaaccgatttacgaagaactgccgggctggcagacctcgacgaccggcgtgcgcaagatcgacgacctgccggaaaacgcaaagaactacatcaaattcatcgaagaccaggtgggcgcgccgattcactacgtcggcgtcggcccggaccgcgattctctcgctgtaagataggagtgatgggaccgcttggcgtttagcattgcaagagaaagaggtatctgatgtcatattttaaaaaggataaacgggcctacctgctcctggcggacggctcaatttatcagggctatcattttggctgcgaaggcaccaccatcggcgagatcgtctttaccaccgggatgaccggctaccaggaagtgctgactgatccgtcctactgcgggcagatcgtcatgcagacctacccgttaatcggtaactacggaatcaaccacagcgatatggaaagctcgaagagctgggtcaacggctacatcgtccgagaatggtgcgaagcgccgtcgaacttcagagaagccgggaccattgacgccttcctgaaaaaccaaggcaaggtcggcatctgggatgtggacacccgccagctgacccggaagatccgccgtcagggcacgatgaacggcgccatcaccaccgaggacgtgtacgcccacaaggacgagctgctggaaaagatccgcagctacaaaatcgtcaacccggtgccgaaggtgtccgtctccaagctcgactggtattacgaacgggaaaaccgcgccaaccacgtcgccctgatggatttcggctacaagcacaacattctcgaaaagctgctgcagttcggctgcaacgtgacggtcatgccctgggacgcgacgatcgaagatatccgcgagctcaacccggacggcatcatgctgtccaacggcccgggggacccgacggacaacgtcaaggtcatcgacaacatcaagcggtttatcgattacggcaagccgattttcggcatctgcctcggacatcagctgatggcgctggccaacggcgccaaaaccgaaaaaatgcccttcggccaccgcggcctcaatcagccggtcaaggatttgacccaggaccgggtctacatcacgagtcagaaccatggctacgcggtggtgaacaacacggtggacccgtcggttgggcagatcactcacatcaacatgaacgacggcacctgcgaaggcatcgcctacccggacatccacgccttcacagtccagttccatccggaagcgagcgccggtccgaacgacacccgctatctgtttgaaaaattcaccgatttaatggaaaggggacaggaaggatgcctttaaagaaagaactgaagaaagtactggtcatcggttccggcccgatcattatcggacaggcggcggaatttgactacgccggcacccaggcctgcaaggcgctgcgccaggcggggctggaggtcgtgctcatcaactccaacccggcgacgatcatgaccgacaaggcgatggccgacgaagtttacatcgaaccgctgaccgaggacgtcgtcaagcgggtcatcctgaaggaaaagcccgacggggtgctctcgaccctcggcggccagacgggattgaacctgtcgatggccctggcgcgcagcggcttcctcgaagcacacggcgtcgagctcctcggcgcggacgtggaaaccatcgacaaggccgaagaccgtcaggcctttaaagacacgatgcgccagatcggtgaaccgacgattccgtccaaggtcgtcgaatccgtcgacgacgcaatggatttcgcggcctccatcggctacccggtcatcgtccgcccggcgttcaccctcggcggcaccggcggcggcatcgccgcgaccccgaacgacctgcaccgcatcgcgacccgcgggctgcgcctctcgccgattcaccaggtcttaatcgaacgggacatctccggctggaaggaaatcgaattcgaagtcatgcgggacggcaagggcaacgtcatcaccgtctgctcgatggaaaacttcgacccggtgggcatccacaccggcgactccatcgtcgtcgcgccgtgccagaccttgtccgacaaggaatatcagatgctcagaacctcggcgctgaagattatctcgaccctgaaggtcgaagggggctgcaactgccagttcgcgctgaatcctgacaacttcaactacgcggtcatcgaagtcaatccgcgagtctcccgctcgtcggcgctggcctccaaggccaccggctacccgatcgccaagatcgccagcctcatcgccgtcggcttcagcctcgacgaaatcaccaacgacatcaccggcaagacgccggcctgctttgaaccggtcatcgactacatcgtcgtcaaattcccgagatggcctttcgataaattcgtctacgcgcgccggaccctcggcacccagatgaaggccaccggggaaatcatggccatcggcaacagctttgaacagggcatgatgaaggccatccgctccatcgagctgggcttcgacacgctgtcggtcgaaaaataccgcaaggcctctgacgaagaaatcgtcgaagccctgggccgcaaggacgacgaacgctgcttcgtggtctacgaagcgctgtaccgcggcatcccgatggatcagatccacgcgatcacgatgatcgacatgtggttccttgacaagctgcgccacctggcgatcatggaacgggatttgaccgaaaagggcatcggcgacgaccgcgcggccgaacgcattaccgtcgcgcgccagctgggcttcctcgactcgacgatcgcccggctgacccacctgccctacaacccgaagacctgccacgtcgagctgcctgaagccgtcgaaaagcagatcacaatgccggaatacgcgtccttcaaaatggtcgacacctgcgccggggaattcgacgcggaaacgccgtacttctactcgacccgggacaccgaaaacgaagcggaagaatttttggaagaacacgccagcggcaaaaagcgcatcatggtcttcggctccggcccgatccgcatcggccaggggatcgaatttgactactgcgccgtccactgcgcctgggcgctgcgtgagctcggctacgaagccatcattgtcaacaacaacccggaaacggtctcgaccgacttcgacacctcggatcggctgtactttgaaccgctgacagcggaagacgtccggtccattgtcgaaacggaacagcccgacggtgccatcgtccagttcggcggtcagacggccatcaagctgacccagcacctcgacgaaatcaaggtgccgattctcgggaccgacccgaaatacatcgacgcggcggaagaccgcgagctcttcgacgaatgcctcgaacgctgcggcattccgcgtccgaagggcggcaccgtcttcaaaactgaagaagcggtcgaagaagccaaccgcctcggctacccggtgctcttgagaccttcctacgtcctcggcggacagaacatgatcatcgcccacaccgatgacgacgtccgcgaatacatgggcatcatcacctcccacgaaatcaccaacccggtgctcatcgacaaatacctgatgggcaaggaagtggaagtcgatgcgatctgcgacggcgaaaactacctgattccggggatcatggaacacgtcgaaaaggccggggtccactccggcgactcgatttcggtctacccgccgcacaccctgtccgaaaaggtgcagcagaccatcatcgactacaccggcaagctcgcgaaagagctccacgtcatcgggctgatgaacatccagttcgtcgtgatggacgaaacggtctacgtcatcgaagtcaacccgcgttccagccggaccgttccgtacatttccaaggtcacggacgtgccgatggtcgatatggccacccgtatcatgatgggcgaaaccctgaaggatatgggcatcgaccactcggggctgcacccggtgaaggatcacgtcgcggtcaaggtgccggtcttcagcttctcgaagctcgaagacgtcgatacccagctggggccggaaatgaaatccaccggggaagtcctcggcgtcgcgaagaccttcgaagacgcgatctacaagggcttcgtcgccagagccggcagcgacatcgtccgccagggcgcggtgctcctcacggttcgggacagagacaagccggaaatcatcgacatcggacgccggttccacgaattgggctttaagctcaacgcgacggtgggcacggcgaaggtgctccgcgaaaacggcctgccggttcacgtggtcagacgtttgtccgaagcgcggccgaatatcggcgacctcctcgaaaaccgggaagtcgactacgtcgtctccacctcgacgaaggggcgccagccgggtatcgacgaagtcaagatgcgtcggaaggccgtcgacaattccgtcacgctgatgacggcgctggatacggtccgggcattgctgggctgcctcgaaagcaagcgcaacctctcggatattccgctggtcgacatcacaaagatctgattgtttaaaagatttgcaatttatacgccagttcatgaaatgagctggcttttttatgtgattcttaaataagatacgatataatataatcagattaaattaaaaacacgcgccttatgcgcttcacgattacggacaggagggacagacacatgaaaatcattgcagccggcggcgccggctttgtgggcagcaatttcatacattattggcgcaagcatcacccgtgggacacgctggtctgcgtcgacgcactgaagcggcgcagcaatctgagaaacctcggcgacgcctttgaagcgccggatttcgccttcatcgaagcggacatcaccgatcaggcgacgatcgagagcatcctgaaggtcgaaaagcccgacgtcgtgatcaatttcgcgtcggtcggccgaaatagcggcggggtggacgcctgcctggacacgaacgtgaccgggaccgtgcgcctgctcgaggcctgcgtcaattgcggcgtcccgcggtatcatcaggtgtcgacggcggacgtgtacgcggcgatcgccctcggggacgaccaccagatttacgaaaccgaggcgccaaagccggattcggtttacgcggcgtccaaggcggcggcggacaatttcgtcctcgcctacggcaaccaccgtgctatcgccgtgacgatctcgcggagcacggccaattacggaccggcgcaggagcccaacgcgctgatccctgagacgatcatccacgcgctgcacaatcaggatattgatgcgccgggaacggggcagaatgtgcgcgactggaccttcgtcgacgaccattgccgcgccatcgaccggattttgttcaacggcgagccgggcgagatttacaacgtcgccagcggggcggaaaagagcgatctcgaaacggtgcaggccctctgcgacgccttcggcaaatccgccgggcagctcgataacgcgccggcacccggcccgaaggacaagctgttcacggtcaacgccgacaagattcacgatgagctcaactggacgccccggacgtcctggagctcaggcattcaaaacacctgcgactggtatctgcaccacatggactggtgggacgatcagaacagccaaaaataaagggctatatgcaaaatataataataggcagtaaaaagccgctctgtcacgagacagagcggttttttgtgtgcggcggcgcggttaaaagatcgaccccagcagttcgaaaacggcgtggacgtgctccgcgtcgatgctggcaaagttgatgatgatctggacgcagccctccggcggctggcggtgcagcgggtggaagaaatggaaccgcagggatttggcctcagctcgctttagaatttccgtttcggacaaatcggtgcggaccgtcatcagaaaataggtgccgacgccgtaatcggtgaccttggcgatgggggagagcgtcgggctatgggcgatttcgtcgaggatggctgcccgcagcttgcggtaatgcttcagcaggcggaacagatggcgctcgtaataccctcggtgaatgaacagcgccagcgcgtactgttcgaagctggacaccgagcaggagtaaaagctcaccgtttcctcgtagcgcttgagcagcgccggcggcagcaccatgtagctgatgcgcagcgagggcaccatggttttcgagaaggtgttgaggtaaatcaccttgtcgtgggcgtcttcggagaacatcgagcggtggccggccggcacaaagcagaattcggcgtcgtaatcgtcctcgacaatccagcggttttttccggcgttggcccactcgaaaaaggcgatgcgccggtcgatgggcatggctgtgccgtagggaaatagattcgcgggggagagctgcacgacgtccacgtccgtttggctgacgagatccacccgaaggtttttctcgtcgatggggatgtagcgccaatggctgccgtggttcttggcgatctgcgcgaatttggacaggccggtgtcggcgctggcgacggtgatgccggggccgagaatctgcatcagccggctgtagaggtattcggtcccggcgccgacgacgatctgttcgggggtgacccgggtcatgccccggtaattggcgagctcgcccgcgatggcctctctcagcgcccgcatgcccttccaggagatcgtagtcatcagcgcgctgtctgaggcgttaatggcctcccgcatgcatttagcccacagactggtggggaacaatttgagagacgcatgggcggcgcggaaatccatgaaccactgggtgtcctccgaggcgtcgggcggcgtgatcggcttgtcgtcgtggttgggtacgacgtaatttaatttgctgacgaaatagcctttcttttcgacggtgtacaaaaagccttcggagacgagtaaatcgtaagctgccatcacggtattcacgctgacgcccaagacgctggcgaacttccgcttgctgggcatgcgctcgtcggggcgcaggcggccgctcgcgatgtcctcccggatgcgggtgtacaaatagaggtagcgcggtttgctgccccgtttggataaatcgtaggaaatcatatctggtaccttaaattaaaaataatctgacgcttataatcatatcagatcgggtgcataatgtcatcaacctaaacaaaaggagctattcacatgacaagacaaagcatacttcaatcacaatatggcctgtttattgacggcgaattcagaccttcgtctgatcaagccacttttaaggtgaccaatccagcaacgggtgaacagcttgctgaagtggcggaagcgacaaaagaagatgtagacgcagcggtcaaagcagcctggaaggcttttccagcctggcgcgacacagaacctggcaaacgcgctgcggtcttatataaaattgcggatatcattgacgccaacaaagaagcattggcgcggatcgaaaccctcgacaacggcaaacccattcgggaaaccacgaccatcgatgtgccctacgcggcggaccatttccgctacttcgccggcgccatcctcacccagaagggcaacgcgtcggtgctggacggcggccttctgagcattgaattgcgcgaacccatcggcgtcgtcggacagatcgtcccgtggaacttcccgtttttgatggccgcctggaagctggcgccggcgctggccgccggggactgcgtcgtcattaaatcctcctcgacgaccccgctcagcctgttggcgctgatggaattgattcaggatgtggtgccggccggcgtcatcaacgtgatcagcgggaagggctcccgttccggccagtatctgctggatcacccggacgtccgcaagctcgccttcaccggatccaccgaggtcggctacaatgtggctcgggccgccgcagacaagctcatcccggcgaccctagaattgggcggcaagagcgcgaacattttctttgacgacgccaacctcgaacaggcgatcgacggcgcccagctggggattctgttcaaccaggggcaggtctgctgcgccggctcccgcatcttcgtgcaggacggcatttacgacgaatttgtcgcaaaactgaccgaacaattcggcaaggtcgttcagggcgacccgctggacccggcgacccaggtcggctctcagatcaacgctggacaggtcaagaaaatcgcctcctacatcgacatcgcgaaagaagaaggggcgactgtcgccgtcggcggtgaagtcaacaccgaaggagacctcgcaaaaggcaatttcttcaagccgacgttaatcaccggcgtcaccaacgacatgcgcgtcgcgcaggaagaaatctttgggccggtggccgtcgtgatccgcttcaagactgaggacgaagtgatcgccatggccaacgattcggaatacggcctgggcggcggcgtctggacccgcgatatcacccgcgcgctgcgcgtggcgagaaaaatcgaaaccggcagaatgtgggtcaatacctacaacatgatcccggcgggcgcacccttcggcggcgtgaaaaaatccggctacggccgcgaaaccgatttggctattctcgacgcctacacggtcaaaaagaacatcatgatcaatttgtccgatgcgccgtctgggtttttcccgatggcctaggacttttccaatacctccaaaataaccattacacgaaatgccctctgccctgtgcagggggtattttttgtcatcttacgaaagtcatttggttagttaccttcctgcattgcatatcgttaacaattttgatataattctaatgaataattaacatacatatttaatgtacgccgcataagacagcgcagctgctgcggtgcacaaaaccacggctaatcttagaaataatagaaaaatgattcaaaaaaaatatattattcacggaaaatacacctttgaggacatggttcgagacgttaaaagtcagccgatgtacgcgtcggcgtcggaccgtgttcttttgatgtttgaaagcgaaaacgacacggaacagatcgcggcgcacctggcttttctgaaggagaatctgtcggacgtcaaggtctttgggatgacccttctcggcaaattgaaatcggacatgatactggcggagcagaccaccttctgcagcctgatgctattcgaaaccagccgcgtgcaggtcgtcggtgcggacaccgccgacgtgccggcgaagacggcggcggcggattttctcaatcgggtcgatcggcgggacctcaagggcattttgtttttgaccgggatcaaatcgactcagccctctgattatttggagattgtcgccgaggaactgcctcacacgccgattttcggggcgcaggccggctccaaaaaactcaattccgatcaattttacgtgttctgcggcgcgaaaatttatcaggacggcgcggtggcggccgcctttaatggcgaagatcttgaaattgaaaccgatcaagtactcgggtggaagccgctggggcgggagcatcaggtgacgaaggcctcggagaacggactcgtcgagaccatcgacaaaaaaccggcgatggcactttacgaaaaatacctcggcctcaagcccgacgctaatttttacgcgaacaatgcggcttttccgctgctggaacagaccggcaacatgatgtccgcgcgcattcccttcgattttaacgagcagggcgccattcgtttcttcaccccaatgccggaaggggcgcgggtgagcctctcttattccagacgggggatgctccttgagcacgcctttaactgcgccaaatggattgcctcttttaagccggaagccatgatcctcatcacctgtttgaaccggcggcttttgctcggcaatgctgattcagatttagagctcagctattttacacaagtggcgccgcaggccatctggggctacggtggcagcgaaattttacaaaccgggcggaacggtgggattctcaacagtagcatcgtcgcggtggcctttcgcgagggagcgccgaaagccgggccgccggttcgcgtgaacggtgacaaattagaggacgaaagcgatcagcctatcgagttgtccgaccgactggtgacgtttttggaacagaccaccgccgaactgcacgaggtcatcgacaagcttcaagtgatcgccagccacgaccagctgaccgggctggccaatcggcggcttttgagtgagacgaccaacggcctgatcgaaagggaaaaagccggagaagccttctccgcgctgatgtacgacgtcgattattttaaaaaagtaaacgacacctttgggcacaaagcgggcgatgccattctctgtgaaatcactgaagtcgtcaaaaaacagatccgccggtcggatatgttgggccgctggggcggagaagaattcgtttgtctgtttcaaaacgccagcctgaccgacgccacctacatcgctgagcgcgtccgctgggccgtagatcagcaccgatttgcacatgtcggccatatcaccatcagcatcggcgtcgtgacgcgccacgagggagaaacggaggaagcgatgtttatccgcctcgacagaatgctctaccaggcgaaaaacggcggccgaaaccgcgtcgtcaccgaagccgggaaagtcattacgtcagaaagctgaacaggacaaaacaaaagacagctcgtacttttttggtacgagctgtcttttcgtttgccgcaaaatccttatcaatccaattcgagcttgccggtgtacagctggtaatacatgccgtgtttggcgataagttcgtcgtgagtgccccgttcgacaatgcggccgtggtccatgaccatgatcgcgtcggcgttgcggatggtcgagagccggtgggcgatgatgaacaccgtccggccgatcatcagcttgtccatcccggcctgaaccagcgcttcggtccgggtatcgatcgaggacgtcgcttcgtcgaggatcatggccggcgggtccgcgatggcgcaccgcgcgatggcgaggagctgcgcctggccctgggagaggccttcgccgttgcccgagatgacggtgtcgtagccattgggcagcaggttgatgaattcgtcggcgttggcgagccgggccgcggcgtgaacctccgcgtcggaggcgtccagcttgccgtagcggatattgtcggcgaccgtcccggtgaacaggttggtttcctggagcacgagcccgaaggagcggcgcaggtccgcctttttaattcgggtgatgtcgatgccgtcgtagcggatctggccccgttcgatatcgtagaaatgggtaatcaaattcgtgatggtcgtcttgccggcgccggtggagccgaccaaggcgattttctgcttcggcttgccgtggatcgtgatgtcgtggagaatcggcttgttggcctcgtattcgaaatcgacgtgatccagcgtgatcgcgccctcgagcttgcggtagtgaatcacgtttttcgaacggtcttccatgcgccacgcccaggtttcggtgcggtggtcagcttcgaggagcttgccatcgcggatgatcgcgttgacgagggtcacgtcgccgtcgtcttcttccggcatttcgtccatcagcgtgaagatgcgcttcgcgccggccaatgccatgatgatggagttgagctgctgggagatctggccgatcggcatcgagaagctcttggtcagattgaggaaggcgatgagcccgccgagggtcagcgctgtgtggccggaaagcatcatcagtgcgccgacgatcgcgacaataatgtagagcaggttggacatgttacccatgaccggcatcaggatgttggcgtaggtgttggcgcgttcggcgtcgcggaagagctgttcgttctttttgtcgaaggtttcgatagaggcgtcttcgtggttgaacaccttgatgaccttttcgccggacatcgattcttcgatgtacccgtcgacgatgccgagggaattctgctggcggatgaagaatttcgagctcatcccggtgattttgccggagacggcgatcatcagcgcgacgcagaccacagccaaaagcgtcagcggcagcgaagtgacgagcatcgagatgaagaccgcgacgatggagatcagcgccgagaaggacatcggaatcgcgatggacagcatctggcgcagggtgtcggtgtcgttggtgaaccgggacatgacgtcgccgtaggcgtgggtgtcgaagtatttaatcggcagatcctgcatcttcgtgaacatttcgtcgcggatatccttttgaatcccctgggaaatggtgaccatgatccggttgtagagcaggttgcacactgccccgaccgcaaacacgacgcccatcacgataaccgtgtggagcagcggcgcgaaattcggatgggactgcttgagcatcggggtgatgaagtcgtcgacgacgttgccgatgaacagcgacgataaggcgccgacgatggacgagacaatgatgaagatgaccaccgcggtgaaccggaagcgataattgcggccgatgtaggccaaaagccgtctgatggtggcgccgtcgatggcgtcggcgcgggagggcgccgccttcgggatcgggtgatccatgcggttgccttgttcgtcaacgaagtgaccgtccttgaatttacgcttcttcgccattgacctggcctcctttcatttgcatctgagtgtcgtagacctcgcggtagatgtcattgcgcgcgatgagttcggcgctggtgccgacgtcggccacgcgtccgccgtccatgacgatgatccggtccgcgtcctcaattgaggaaatccgctgggcgatgatcagcgtcgtcgtccccgggatgatttccttcagaccctggcggatcttcgcgtcggtcttcgtgtcgacggccgaggtggagtcgtcgagaatcagaatcttcggcttggccagcaccgcgcgggcgatacagagccgctgcttctggccgccggagacgttggtgccgccctgctcgatcatcgtgttcagcccgtcgggcatttccttgatgaattcgtcggcgcaggcgacctcacaggcgcgccacagctcggcgtctgtggcgtttggattcccccagcgcaggttgtcggcgatggtcccggcgaagagcacgttcttctgcagcaccatgctgacctgatcgcgcaggacctccatgtcgatttttttcacgtcgacgccgccgacgtagacggtgccggtggtcgcgtcgtagaggcgcgggatcagctgtaccagcgacgatttcgctgagccggtgccgccgatgatgccgatggtttccccggatttgatcgagaggttgacgtccatcagcgagagcttgttcgggtcgtcggcgtaggagaaactgacgttgtcgaagacgatcgagccgtctgtgacgtttttgatcgggtccggcgcgttggtcagcgagctttcggtgttgagcacttcgacgatacgttcgccagacgcctgagcgatggtgagcatcgtgaaaatcatcgacagcatcatcaggctcatcaaaatcatcatgacgtaggtgatcagactggtgagctcgccggtggtcaggctgccggccacgatgaatttcgcgccgagccaggcgatgatgatcatgcacgcgtacatgaccacctgcatcagcgggctgttgagggccatcagcttttcagctttgctgaaggtggtgtagacgtcgccggaaatgccgcggaatttgtcgatttcgtggtccttgcggacgtaggatttgacgacacggatgccgcgcaggttttcctggacgacggtgttgagcttgtcgtaaatcctgaaaaccttgcggaacagcgggtgggcgaatttgataatcagcccgaggcccaccgccatgatcggaatcgcgatcaggaagtagaccgccagctgggcgttgatcatcaggctcatgaccagtgcgaaaatgagcatcagcggcgcccggaaggcgatgcggatcagcagcatgtaagccatctgaacgttagtgatgtcggtggtcattcgggtgaccagactcccagtggagaagtcgtcgatgtttttaaacgagaaagtctggattttttcgtaaatatcgtggcgcaggtttttcgccagccccgtcgaggcggtcgcacagaatttcccggccagcgcgccgaagctgagggacaggcacgcggccgcgagcatgatcagcccgtagaaccaggtcgcgcgcatgtcgccgcggttgagcccttcgtcgatcaggcgcgccatcagcagcgggatgatgatttccatgacgacctcgagggtcacaaaaagcggggagagcatcgattcgcgtttgtactcgcggatactctccgacaattttttgatcataattgcctccttcttaatgattaactttgcttagtctttctattataacaataataatggtgaaaagatgataaaaagcggattaaaaagaggttaaaatgttacattttcctgtaattatttttatgtgtcccacacttgatttaatgggttaaaaggtttattatttaaacagactgataaatatgtaatgcttgaaaacagggggaaatatggacgcagttgacgaaacgagaggcttcggaccggaatttatcaaactggtactgacgctgaataaagggagcatcacccagtatttgagagaaaaggcggaattgatggagctgcgctacggcgagttcatcgcctttcttcagattttgcgggcggatgaggaaggcagaaaaacgacggtatcttccctcagccgagccaatcactgcaccaaatccaacatgtcgcagattgtgcgggtgctggaggaaaaagactacgtgggccgcgtgccgagccaaagggaccgccgcaccgtttttctcgaaatgacgccacacgccagagacgcgatactgaagcaccggctgtttctcgatacgcccctcaacgaagcggccaaacgcatgggaccggagaaatcgggccagctcatcacgctgctctgggagctgtggcgcacaatggagcagatcgcggaagaaaaagaagaaaccggccatacaacaaacacctgattcttacgaaccaggtgttatttttttgccaaaatagttgatattgatttaaatcgtcggattcaagtcggtgtcggcgactgcgatgaaacgttcgatgtgggcgtaagcggtcacgtccatgtccagcggcgtgacgacaacgtagttgtggttgaccgcgtagtcgtcgtagctcaaatcctcagcgttgtcgtcgtgattcggcgcgaccttcatgtcgaagtacatcgtgtggtcgtcctcgccctgggtcttcgcgaaggaattggcgtaattgtggcgccggcccattcgagagacgatagtgcccttgatgtcggcgtcggggcagttgggcgtgttgatcgagaggatgtagtcgcggttgtccggctgattgacgaaccagcgggcggccttcagggcgtatttcgccgagtaggtgtagtcgtaacggctgccgccgtttaaggacatggcgatcactgggacgccgttgaaataggcggccgacgacgcgccgatcgtccccgagtgaagaatgtcgtaggcgacgttggagccgtggttgatgccggtgacgacgagatcgggccgggtgtcgggatcggttaggatcgcttcaagggcgacagaaaccgagtcgtagggcgtgccgaagacgcggtagcccttttgaagcgccggatcgtccggctcaaagggttcggcgtggaccttcagctgtccgcgcaccgccttggaatgggatttggcggattgaggatccgccggcgcggcgacgacgatttcgccgagctttttcatctcagcggccagggcgtgaatgcccggcgcgtcgaagccgtcatcgttggaaagtaatattctcataatcaagtcctttctgattcaataggaaccatgcaaaagtcaaaggataacagcgcatcaatgcgtttcaattcgcgaaaaactgatcgatgccgttcgcgataccctgcaccattttggcctgataggcgtcggtctgcatcagcttgtcctcggtcgggttggtcatgtagccgacctcgatgagggtcgtcggcaccttcgcccagttgttgccggtcaggtcatcgcgctcgacgacgccttcgctcttagcgccggtggcggtgcagtaagccttgatcaggcagtccgaaagcttgcggcattggctgtaggtcgaggcggtgtagggattgtgcgccgtgatgttgatggtcatcgcgccggtgggtgtactgctttcggcggcgttggcgtgcagccggataaaggcgtcggcgttgttgtcgttggctacctgcgcgcgctcgacgcaggaatgggcggaattgctgtcggtgcgggtcagcacgaccttgtagccccgtttttcgagctcgggtttgagcttgttcgcgaggttcagcatgaagtcgtactcggtcacgccggtggcgacgcccttggtgccgaccatatccttggccttggtttcgctggcgcctgggcctaccggttcactgcccgagggcatgacggcggagtgccccggatcgagcacgacggtcttttgattggccgccggcttcgtctgagtagaggagtcggtctttgattgggatgcggtgctggtcttggacgctgtcgtcgtctttttcgaggtggacgtggcggcggaggcgtttcgggcgtggacgtcgtagaggacagcgccggccgagacggcgatgatggcgatcatcacaacgatcagaatgttttggtgtttcatacagcagattccctcgttattccggcgtgtagccgccgcgggcgtccatcgcgtttttgagcagctcgacgttggcgcgctcgatatccgacaactcgtagttgttgtcgaaatcgtcgggatcgatcgtcccgttgtaccagcttttgctgtcaaaatagttctgcagttcagtagccttgaaccggcggccttcccgggcgtaaatttcgttgagggcgtagttgcattccttggctgaaaagccggaaatgtcgctagaggataggtattcgctcgtcgaatcgggcaggatgtaggttcggctcatccaatttgacgacgaagacgacgagttggatgacgacgaggacgaggaagaattgctgcttttatttttcgaggaagatgagccgctgtccgaggattcggactgggtcgagccggagctcacactggtttgggcgctgctctttctgaacatcaggaaatacagtgcagtgacggcaaccgcggccgcgcagacgatggcgacgatgatgaccagggtattgctggcaccgggctgtttttcccgcttcaccggctgatcgtagtaagggtcttggctgtaatcggtcaggtcgtcggtttcagcgcgcaagtcgtcgtaatccgctgaggtgtaattcgggttcggcgcgccgcaaacctgacaatagggcaggttcgggtccaaattggcgccgcagtggttgcatttcataatggcctccttttatctttcaatcaatttaatcgagcttcaatcagataaatcaattatagcatagattcaaaggccatgggtaaaaacgtatagggaaaagcgccgaaacaaaagggctcgcacggcccggctctgagccgcctgagcctactttttggctgggagctcggcgagatcgggcagcttgtccggcgaaatgtcggagagaaaatcttcgacgtaaatcatgtgttcgagcatgcgcttgcgggcgaggatcggatcctttgcgacgatggcgtcggtgatgcgccgatgctgaaaatagagggcgttgccttcgtccttttctttggaaatgatcgcgatgcgggcttggtaacgcacggtttccagcagcgtcgtcgcggcagtcagcgaatcgcggatcaggcagttgtttgacgcggcggcgatggactggtgaaagtcgtcgtcgagggccgcggaggtgtcgatatccggggcgatttccatttgatcggcaacagccgtgatgtgttgaatgaaatcaggcgaaggatcggcggccgcgaggccggtcgcttcaatttcgaggctctgcctgaagtggtggatgtcgtaaagggagccgccgccgagatagaaggagatggtcatcggctgaagcagcgccaaatccatgcggtcgctgatgaaattgccttcaccctgccggctgacgacgaggccaatcatttcgagggcgcgaatcgcttcgcggatggtcgcccgggagacgccgaggctttcagcgagctggcgttctggggccagccggtcgcctggacgcagctttttattttggatgtcgctctggatgcggcggataacgatttggaaagcgcgggatgcgtttgggtttttggcgctcacgggtgtctcctttctcaaaatcacgataactcatttattatgcattaagccttattttaaatcaaatcaaaaatcaagatagtgaatattttgttctaaaaggatagaaaatttcaattttaggtgaatttaagattgacaaattggtctgaccactatatacttaaggtatcggtattcgtttacaggtgtaaaactgccgagaaaagggggaaaacatgaattttggtttatttctactggcattagttccgatcatctggctgatcattgccctcgcggtgatgaagatgccagggtattgggcctgtgtcatcgcactggttatcggcgcggtgattgccatggtctcattcggaagctccggctccaatgtcgcaacggcggcgctggaaggggcactcaatgcgttgtggccgatcatattggtcatcatcgcggcactgtttacttataatatcacgctggaaaccggcgcgatggacaaaatcaaggcaatgctcgcgtcagtctccactgaccagcgtgtcctgcttttgatcatcgcttggggattcggtaacttcatggaagggatggccggcttcggtacggctgtcgcgattccggcttcgatcctcgtcggcctcggctttgatccgattccgaccgttgtggcctgcctggtcatcaactcgacgccgaccgccttcggttccgtaggggttccgacgacgaccatggccgccgtcacaggcttaaacgccacagcactttccgcgaacgtcgcgctgatcgaatgcttgattatgttcatttcaccgattatcgcgattatgattctcggtaaaggcgcaaaggccatgaagggcgtctggggcatcacattggtctcatctctcgccttcacactgccgtgcttcatcgtcggccgtttcgtcggcgcagaactgccgaacatcgtcggttccatcgtctgcatggctgtgaccattttgatggcgcgtaaaatgcgcggccgcgaagtaccggaagcatacagcacgattcagcagcaggacgccgaaggtgtcaaagaaaaactcaccgtcgcgtcagccgttaacgcgtggctgcctttcattctgattttcgtgatcttggttgtgacctcaagcttggtaccaatcatccacgatccgctttcaaaggttgcttcggctgtgacgatctacaatggtaaaggcgcaacgccgttgaccttcacttggatcaacaccccaggtgtcttgatcttcattgcggccattatcggcggcttagcgcagggcgccagcggcagcacacttggcagagttttcgtcaagaccgtgaccggcaactggaaaaccattgtgacgatctgttcggttttggcattggctaaaatcatgactcactccggcatgaccggcgaaatcgcgagcgttctcgtcgccgcaacgggcacggccttcccgctgatctcaccgttgatcgggaccattggtgcctttgttaccggttctgggacatcgacatccgtcctgttcggggatctgcagcgtcagacggcacaggctatcggtgcgaacccggcatggctgtgcgcggccaacgaattgggcgctggcatcggcaagatgatcagtccgcagggcatcgccatcgggacatccgctgtcgccttggccggctcggaaagtgtcgtgctgagaaaggtagcgaagtactgcctgctctttgtggtcctcgcgggaattatctgctacttcttcccgatgattggactggtgattcattaaaagcgaaacccatggggtttgcctaatattacacccatatgcaatgatccccgcatcaagtcaaattgatgcggggatcatttttttgctaaaaaatgggggcggccgatcgatcagcctgccccaaaaatttaagcgcttccttatttgtttttcttttcgtaaatgtcgtcggcgatggcctgagccagggcgatcaggctttcgcgggtttcgtcgttcactgaggatttgacggtgatagggtcgccgagataggtgatattgtcgagcccttccaattcctttgcgatcagggagccggattttggcgcccagctgccgttttcaatgatcgagatggtgcggttctggatgtgcaggtttttcatgtcgtcgatcagattgtggaccgttgggtaaatgccgaggttgtaggtcggtgaagcgacgaccagatgggaatatctgaaaatcgaggcgatgacgtaggacgggtgggtcttggagacgtcgaagaaacggacgcgcttcacgccgcgctgcacgagggcgttggcgaggatgtccgccgcctgttcagtgttgccgtacatagagccgcaggcgatgacgacgccgaggtgttccggttcgtaacggctccataaatcgtatttttcgatgaagcggtcgatgtcctgacgccagatcacaccgtggagcgggcagatcattttaatgtcgaggcccgatgcttttttcagcagcatctggacgttcttgccgtatttgccgacgatattggtgtaatagcggcgggcttcgttgagccaggcgatttcttcagcgccgttgatttcgtcttcgaacaagacgccgtcgagggttttgaaggagccaaaggcgtcagcggagaacaaggtgcccgtcgtcgtgtcgaaggagacgaggacttccggccagtgcaccatcggcgcgccgataaaggtcagctcgtgcttgccgaaggaaacggtgtcgccgtttttgacggtatcgacgcggtcggcgatgtggtggccgaattgttcgaggaaggttttggccttcgcggagcacagcacgcgagcgttggggtaacgcatcaaaatttcgtcgagggttgcggcgtggtcgggttcagcgtggtgaacgacgacgaagtcgagatcgcggccgtcgagggccgcttcgacgttttcgaagaactgacgtccgcaggaccagtctacggtgtctaagagcaccgtcttttcatcttttaataagtaggaattgtaggacacgccttccggcagcggatggacgttttcaaaaagcgttaaccgtctgtcgttgacgccgacgaaggttaaatcgtcatcaattttgcgaatattgtacatagttgacctccaaatttaatatcgtaattcattccgcccttattttatcacgattcactaaatttttctggccaaaaaggaaaaaagaggatataatatagaaaaatcttgtcacaaacgatttcacaaaaaagagtaagctttacaaaaataattgcatttactgtgtggaatggcttgattttagaacaggtttacattataataaaggaagtggtcagaccaatttaaatgtgccgaccatgtgtatttattatgattgataaaaacggtatttgtggagagtaagaggaggaagctaaatgagctatacgtacaatccagtcacccctgaaattatcgaacagattaaagaagcggccaacggccacgtcattttaggggaagacatcaacgaagatttcgcccatgacgaaatgcgcatctacggtcaggaatacccggatgtcgtcgttgaaccgagaacgaccgaagaagttgcggccgttgtcaaaatctgcaacgacaacaaaatcccagtgaccccgtcaggcgcacgtaccgcgttaaccggtgccccagtttctgtcaaaaaaggcgtcatgatttcaaccctgaagatgaacaagatcctcgggtacgacgaagaaaacctggtcgtccgcattcagccaggcgttctgctgaacgacctcgcacaggatgccctgaaacacggcctgatgtatccaccagatcctggtgaaaaattcgcaaccgtcggcggcaacgtttcgactaacgctggtgggatgcgcgcagttaaatacggctgcacccgtgactatgtccgttcactgaccgtcgttctgccgactggcgaagtcgtcacagaaggcgcgaccgtcgcgaagacaagttccggctattcactgatgaacttaatcgtcggcgcagaagggaccctcgggattgtcactgaaatgacgatgaaagtcatcgtggctccgcaggcaaccatgtcgatgatcattccttatccgagcatcgaagaagcaatcggcgctgtgccgaaactgttccaggctcacctcgatccgcaggccctcgaatttatggaaaaagacgtcacgatggcgactcagaaatccctcgaaaaagacgtttatccggcagaaatggacggcgttgaagttaaagcctacgttctggctacattcgacggcaacgacgaagacgaattgatggacaagatcgaaaaggcatcagaagttgtcctcgaagctggcgcactcgacgttctggtcgccgatactccgagactgctcgcagacgcatggcagattcgttcatccctgcttgaaaccatcgaagaaagcaccaagctcctcgacgaatgtgacgtcgttgtgccaatcaccaagattcctgaattcttgatctacgctaaatccttaggcgaaggcaaagattacgaaatcaaagactttggtcacgctggcgacggcaacctgcacatctatctgtgctccaacggcgacgacaaggaagccttcatgaaagaatctgatgaattcatgaccaaggtttacgcaaaatgcgtcgaactcggcggcttgatctccggtgaacacggcatcggcatgggcaagatgaaatatttgaagaacatggtcggcgaaaagaacatggaactcatgcgcggcatcaagaaagtcttcgacccgaacatgatcatgaacccaggcaaggtttgcttcgatccggaagcggatgactaaatattatctttttaaagataaatttaataaattgacaaatatttcacagtttacttttcaacacgaaaattctgtgatataatatgttctgttaattcggaaccttctcaatccggattaacagaacttttttataaattttgcggaaaaatttgaaaagagaaaaattttaaagagaagaagggaaactaaaacatggcttatcaaatttctgaccaggcgaaggacttattgaacgacgttcatgatttctgcgaaagagaagtcatcgaacaggcaaaggaatacgacaaaactggcgaattcccaaccgaaatgtacgacaaggctaaggaaatgggcctgaacattttggaagttccgacggaatacggcggaatggaaatctccaacccagatgataaagaagggatgtcccgtgtcgatatcgctgcgcttttcgaagaaatggcaagagcagatgctggcttcgcaaccacaatctccgcttccggccttggtactaaaccagttctgatcgctggcaacgacgaccagaaaaaacgcgtttgcgacatcctctgcaacggcggcttcggcgcattcgcactgactgaacctggtgcaggttctgacccggcagctggcaaaaccacagctgttaaagacggcgatgattacatcatcaacggtacaaaatgcttcatcaccaacggtgggatcgcagatttctactgcgtcacagccatgactgataaatccaagggcacacaccacggcatgtccatcttcttggttgaaaagggcacaccgggtctgtcaactggtaaagaagaagacaagatgggtatccgtctgtccaacactgcagaagttatcttcgaagacgtccgcgtaccgaaggaaaacctcctcggcggcgaaggcgaaggcttcaagatcgcaatggaaaccctcgaccaggcacgtgcttggatgggtgttgtctccgtcggtttagctcagagagctatggacgaagcgattgcttattgtaaagaacgtcagcagttcggccgtccagtcctgaaatttcaggcaatgcagttcaagattgctgatatggcaattaagatcgaagcagctcgtcagctcaacgcttacgcactgacattgatggatcagggcaaacgctacaccaaagaagctgcaatggctaaatgcttcgcttctgacgctgcaatggaaatcaccactgaagctgttcagatgttcggtggctacggctactgccgtgaatacccggttgaaaaactgatgcgcgacgctaagatcttccagatcttcgaaggaaccaacgaaatccagagaatcgtcaccgcaaacaacacaatcggcagattctaatttatccatatcgatcattaggagtcggtgcgctgcaccggctctttttgtttttatattttccaaaaaaaaaaccgaagcgcgcgcttcggttgaatttgcgattttctgaaaaagggtcagtcattgtagatcagcgcgatgaagacgagatcttcgctgctgttgttttccatgctgtgccactggccaggttcaatcgtacagatatcgccggcgtggacggtcgttctcgatttgtcgttgtcgataaaggtgccttcgccagacaaaatgtagtagggctcggtttcgtggatgtgctggtgccagccgatggtcgatcccggcgggagcaccaccttggcgtacattctgccgtggccgtagagtttgtctgcgctgacgatgtggtagcgataagccttgccgacgccgccggccatgttttcgacgacttcgcgtatttcgtgttgaaccatttgtgcctcctgtactcgtgtaataaaatggaatttctattgattattatgacaggtttggccgcttttgacaacggtggcatttagcagagcagcgtgagcaaatgcgttttcatttcagatcattgtggtatgttgtacaattatgagtttgtgtaaagaaaagaaggaggcgttaaagatggcagaaaaccagaaggacgcgcagtacaacaaaatgatgtacagtccggtccacaagctgatcgtcgccctgtccattccgacgatcatttcgatgatggtctcgagcatctacaacgcggccgacacctattttgtgggccgcctcgggacgtccgcgtcggcggcgacgggcatcgtgttcgggctgatggcagtgctccaggcggtgggcttcatgtgcggccacggctcggggtcgatcatcgcccggtacctcggacgcaaaaaaacgcgggaggccagcgtcgtcgtgtcgaccgggctcgccctcgtggtgattatgactttggtgatcaccgtccttggcttgatctttatcgacccgctgatgcgcctcctcggcgcgacgccgaccattctgccctacgcgcgggtttacgggcgctgcattttggcggcggcgccgtttatcacggccagctttttgatgaacaacgtgctgcgctacgagggccgggcggtcctcgggacgacgggcctcaccatcggcgcgctgctcaacatcgccggcgacccgattttaatgtttaaatgccatttgggcattctcggcgcgggcctgtcgacggcgctgtcccaggtcatcgccttcgggctgctgttctatttcttcctgtcggggcggacgacgacgcggctgtcgctgcgtctggtgaagctcaaggcgccggtgattctggagattctgtctgtgggcatgccgagcctctgccgtcaggggctcaacacggtgtcgacgctgctgttgaacatcgcggccgcgggatggggcgacgcggcgatttcggcgatgagtatcgtcaaccgcgtcacctttatggttttcgcggtggtgatcggcatcggtcaggggctccagccggtggcgggcttttcctacggcgccaaggcctggaaacggctgaagagcgccttcgtgttcacggtcagcctgtcggcctgtgtcgccctggcgctggccctcgcggttggcttgaacgcgcggcacgtggtcggtctctttatcgacgacccgaaggtcatcgccattgccgccccggcgctgatttaccaatgcgcggccctggtggtcacgccgccctttacgatgacgaacatgacctaccaaagcgccggtatcgccggaaaggcgaccttcctcgcgctgctgcgcaacgggctgtgcttcatcccgctgattttgattctgccccggactatcgggctcctcggcgtgcagatcgcccagccggtgtcggacgtgctgacctttgtcatcgcgctgccctttaccctcgcgctgctgaggtccttgaaccgccgaatcggtgagacgcaggcaaaaaaataaggcctcatccgtgaggatagaagcctaaaaattcaaaggagcgggtgtgcgccatgacctgtccgataatggcgtccaaatgatcttcgtcgatgtcgccgatgaaatccatgaagaattggtaatgccactggctcgccggaatgggccgggactcgatcttcgagagattgagatgttcggcgtcgaagatgccgaggaggtggtacagggcgccgggctcgtccttcagcgtgaagcgcagcgagattttgttgcgccccggccggttttctggcattcgggagacgacgatgaaccgcgtcgtgttgttgtccgcgccgttgatcggcccggcgaggacgtccagatggtggatttgggccgcgcgccggctcgcgatggccgccttggatttatccccggcgtcgtggaccattttcgcggcgacggcggtgttgtggtagggcacaagggcccattccgggtatttcgagagaaaatcccgggattggtagaagccctgctcgtgggagtagacgctttgaatgtccgatattttggccccaggcacgccgaggagacagtggtgcaccggaatcagcacctcgccgacgatggacgcctggtagcggatgagcaggtcgtagttttcgttgatggcgccggtggtggagttttcgatcggcacgaccccgtaatccgcgccgccgccggtgatcgtcttgaacacgtccccgaagcttttgtggggaatgaagagccggtcgtccccgaaaaagcggatgcaggcctcttcggcgtacgagccctgggtgccggaataggcgatgaggccggccgcgcgcggcgcccgtatctgccgcttcatctgcaggtagcgggccatcgacgattgctgttcaccggtgaataccatgattgtctccctttctgttttcattgtgttttcaatcataacacaaaaggggacaaaacggggcagatagttttcagaggccgcgcatcctgcggaattttatttaaaattaagaaagaattaagtacagagaatgtgccggttatttctcaaaatatgcaaaaaaattcgtttagtttcatttatgaaacgcagaaattggggttaaaatcggctgaaaatcaatatatgggcgttaaaaacctgaaaaaagcggcaaaaatcccatataaaaattttaatagtgtaattatttacaaatcaaataatttgcacaaatttacagcttgacatctgttatttcaattgctataatatcacacctttacttttcgatggtatcgtgctataatggttacaacatacaagcgaggtgaaaaagatgccgcaacgtatccatgcgactttaaatgatgtcaaacgtgaagtggaatctcacaaaggagatttgattaaacttcaggcccataaaagcaaaaagaaattgtaccggaaaatcggcagaatcgaaggaatttatccgagtatttttaccgtgaaagtcgaaaatccgagaagtcatgtgccggaacgcctgtccttttcctattccgacgtgctgacgcgcgccgtcagaatcgcgctgattaaggacgaagcacaggaagcggaaaaagccatgaccgcgtaaccgccgatcggtgaatccaaggccatacagcgccgacgctgtatggttttatttttttaaaaatacataaggagggaatatggcctatacaattgtgacggattcagcgtgcaacctgccggcgcagctggtgaaggagtacgacatccgggtgatcccgctgaagctgattgtcgggcgcgagccgatgattttggacagcgagctggccgacgacgatgaagcgctgagaggctggaatcagcggctcagagaaggcgtcgacgtccgcacgtcgccggcgaacgaggcggcctgtgaggcggtatttgagaaaatcctggctcacggggaagatttgctttacatcggcttttcctcgcgtctgtcagacgtgtacgcgacggcaaaggccgtgctgtcgcggctggaaaagcagtatccggagcgccggatctgtctgttcgacagccgggcggtctcctttggcgaagggcttttggtgatgaaggcggcggaaatgcaggaaaagggcgcgaccctgaccgaggtgtttgaccagctcaaggatgaccgcaactgtctgcaccaatacttcaccgtcccgaatttgaagacgctggcccattccggccggctcaaggggcgggtccgtctcgcgggcagctttgggcgtcagccgctgctttcagtcgacgaggacggcggtattcacgcgaaggcctcggcccggagcgacaagggcattatcgacgcgattgtgaaccgcatgagccacaaaatcgccgacgccgacgaccgtccggtgatgatcgcccacaccgactgcatcgaaaaggcgcagaacctctcgcgcaaaatccgcgaggtcattcacccgaatcaggtgctgatccacaccctcgacccggtcatcgctgcccacatcggcccggacgccatcggcgtgttctttatcggcgtcccgcggaaaaaacgggtggtctaaaccaatcgcaattaaaaaggcaggcgcacagcgtctgccttttttaatggccgaaatattaaactttttctttgatgaagcccttgcggtaggccgcgatgagcatttcgaggtcgtagatattgtctcggaggtccttgccgatgtcggtgtcagcgacggtttttctgcggctgttggtttcgacgatttccttggtcgatttgatgtcgacgccgttgcggatggccgcgtcgacggattcgaaaggctgatgagagatcagcgtcatgccgtaggaattgtaggtcagggtgtagccggcgatgccggtggtcttttgataggccttcgcgaagccgccgtcgatgcacagcaccttgccgccggcgcggatcggcgattcgccgttcttcgtcttgaccggggtgtggccgttgatgatgtgtccgtccttcgggtcgaggccgaattcaatcaaaatcttgtcggcgatttcttcgctgtcggcgatgagcttgtagtagggcatcttttcttcgtggtgggtcgtcttgtcgtcgatgaaatagcgttcgaaggtcgccatctttttcttcccgaaaagcggagacttcttgttgcaccacaggaaccacaggaagtcgttgcgcggcgggttttcccgagcgttcgagaaataggcttcccgggcgagctggtcgaatttgtccatcagcgccttgcccgagtaggtatcgcctttgtagacgacggtgtcaaattcgccgtcctcggtcagcgggacgatggcgtggtagagcagattgtcgttgtaggtcaggtacaggctgcccttagcgtacatgaagcggatgtggcgctgcagcttttccgaatggcggaaggagtggcacagcagcgacatcacgtgttcttcctcgtcggagagcttcgacgggttttcggggtccagggtcgggaaattcgtgtcgttgagcgggtattcctttccctcgacggtgaccgtgcccttttccaggttgatggcgcgcatcaggcagcggtcttccatatggtattccgggtggcggtcgatgatttgttcctcgactttgaactggatgatcgagatggccttgtgcatcttcgagatcaagtcgatgtcgatgctggcgtttttgtcggcgatgttcttcgggtagaaatcggtgcaggggtcgtcgccgtaggtcttctgggcgaaggtcgccagcggcagcatgttgatcccgtagccgttttcgaggacccgggtgttggcgtagcgcatcgcaatacggacggcgcaggcgatgcaggcgcggttgccggccgcggcgcccatccagaggatatcgtggttgccccactgcaggtccatcgagtggtggtgcatcagcgtgtccatcacgtggtggggggccgggcctctgtcgaagatgtcgccgatgatgtgcaggtggtcagtggtcaggcgcttgatgacggtggaaatttcttcgatgaagtgatcggccatcccgtactcgacgatgctgtggatgatcgcgcggtaataatcccgcttgttgtagcgcttttcgtcttcctggatcaattcatccatgatgtaccggaaatccttcggcaggctctttctgaccttagaacgggtgtatttgccggccgacgcgcggcaaaccttgactaagcggtagatcgtcagctcgtaccaattggtcaggtatttgcccttcttttcctgtttgatcaggtcgagcttctgctgcgggtagtaaatcagcgggatcagctcttccaaatcctcgagggacaccgtgttgccgagttcttccatgaccttgcggcggatggcgcccgagccgttctggatgacgtggttgaaggcgaggtcctctccgtggatatcggtcaggaagtgctctgtcgctttcggcaggttcaaaatcgcgcgcaggttgatgacttcgctgaccgccgaggtgatcgacgggaaatccttggagagcagctccaggtatttcttgttttttctcagctgagttttcgtaaagttttgcatttctttcctttcaatcgaagcgcataaagcgcacttgattatgatttttgatatattaagtatacaacataatgccgattaagtaaaacaattatacaatgatttggatagaaagaccttaaaaactgcaatgtacgtcatcacaaaaaatttcaaaaaaaattcacaaaaaattaaaaaaaggctttacaaaacgcgaatagaccgctataatgatcaggtagtcgcgagttgatcccttagctcagctggaagagcgccaccttgacgtggtggaggtcacaggttcgagccctgtagggatcaccatttgatcacaacgctccgaaactttcgtttcggagtttttttattgccaaaaaattgaattttgcaccgggcacaaaaaaacggacctttcggtccgctgcaaatatcaaatgtcaaacaaggaatcccacggcgagcacgataatcccgaggaagattcggtaccagccgaaggccttgaaatcgtgggttttgatgtactgcatcaggaatttgatggccaacaccgagacgacgaaggaaacgatcatgccgacggcgaggacagcgccctggtcgccggtgaaatggtggaagtggcgcagcttcagcagcgagccgccgaacatcgccgggatcgctaggaagaacgtgaattccgcggctgaggtgcgggagatcccgatcatcagcgccccgatgatcgtcgcgccggagcgggacgtgccggggaagagggccgcgattaactggaagatcccgatgatgatcgcgtccctgtaggtgaaatcgtcaacgctgtaaacccgggcctttttggtcgcgttgtggttttcgacgacgatgaacagaatcccgaacaggatcagcatcacggcgatggacgtcgggttgtagaaatgggcttcgaagaaatcgtcgaaggggccgccgatgaccgccgccggaatcgtcgcgacgatgaccttgagccacatcttcaggatgttgtgatcccagccgattttgccgacccggtccttggtggtgcggatgcggcggatcggccacagccgcttccagtacagcagcacgaccgccagaatcgcgccgagctgaatgacgaccatgtacattgaaataaagctcttcggttcgttcaaattcatgaaggattgaaagagatacaggtggcccgtactggaaatcggcagccattcggtaatcccttccacaatgccgaaaataatcgatttgataatgttgagcatacaaattcctttctcgcgttttgtgaatcatggcgtggataaaattcaaagtttcacgctggattgtgttatgatgaggatgattatatcacagaaatccgcgcggaaaagcgcagattgctatattttagataaaatttagaaagggttttggagaaaaagaaatgaaaatgaaccgcagtacaaaggcgcatcggctgccgaaggcggccgtcttcgcgctggccctcggggtcgtcgcggcgatggtcgccgcggcggaaatcctggggattgaggacatcatcttcccggaggccgcggcactgaccatcggcttctggaccgcgccggtctgtccgtggcgcgtcggcaccaagcagggggtggccatgatggtagccgccgggcttttgggttacgggatttcggcgtggctgcccgcgccgctgatggtcaaaatcgcggtgggctacgcctgcggcgcggcgctgatcgtggtcagccattcgagtctctacccggtgttttccgccgtgatgcttccggtgatcctcggcgtcgacacgccggtgtactgtcttgcggtcgccgtcctcgcggcggtcattctgctgccggcgggcgcgatgcacggcgatgctgacgcggtccagaccaaacgggacgacgcccttccggtgcgcgctcaggtatgccgctttgggctgctcctcgtctttgtgctggtgctggcggccctcggccggcatctgaaccggctgatgctcatcgcgccgccgttaatcgtcggggcggccggtgtcgtcgacaacccgaagccgattccgctgatgaccctcgtcaaaattctgatcctctgcgccgccgcggccgtgttcggttccgggtgccgcctcgcgctcaccgagacgatgggcttcgcggccgctgtctccgcggcggctgctttcgcgctgctgctcctgctcgcgtggcggtggggcctgtggtttccgccggccggcgccgtgaccctgctggcctatttgatgccgcccgcgcggctgtccgcctacgcgctctggattcttttcggcggcgccgccctcggtgcctcggcggtcgcggtgcgcctgctcacaaaaaaacagacggacaagccgctgcgcttttgagcgggtccgtctgtgagataaatttgtagaaactatttgagctgctcgaggcctgagagcgccgcgccgtaggcgccgacgatttcgggctcttcgacgattttcagcttgaggccgagctggtcctcgagcacagccaccatgcccgggttcttggcgacgccgccggtcatcatcacgtcctcttcgatgccgactcggcgcagcagcgagatcgcacgcccggcgatggccacgtgaacgccgtgggcgatgtcctccggctccttgttttcggcgatcagcgagatgacctcggattcggcgaagacggtacacatgctggagatgcggatgtcttccttggatcgtaaggacagctggcccagttcctcgagggagacgtctaaggtgtgggccatcatttcgaggaagcggcccgtccccgccgcgcatttgtcgttcatcacgaaatcgacgacgtcaccggcctcgttcaggcggatcgccttgctgtcctgaccgccgatgtcgaggatcgtgcgcaccgccggatcgaaggcgtgggcgcccttgccgtggcaggtgatttcggtcaggtccgcgtcggcgaagggcaggtgatcccggccgtagccggtggagacgatccgcgagaggtcctcccgcttgagcttcgccttgtcgagcacttggttcatcgccttttcggcggacaaaatggatttcgcgccggtgcggacgatgtcccaggcgacgagctggccgctgccgtcgatgacgacggcgttggtcgaggtcgagccgctgtcgatgccgaggacgtagggcgccgcgtgatgggcggccggaacgattttcaccgcctccggctgtgtttcgactgaggccgccgcctcgtcagccggccgggctttattcgctgaaatttcttcgataaaggcctcgatccgggtcttaatctggccgctggactgccgtgtcaaatcggtttcgagatttaacaccggcacgtggaaggaatcgagctttttcaaggcggccgcttcgtagtggtattggtcgcagaatttgaccgtgtggtaaatcagcccatcgagcttgtcctcgaagtcgtcgagcatgttcaggcggtcctccgcgccggccatgcgcatgcacgggaactgggcgagcagctgttcgcagtagtcctcgagccggccgatggcgttggggtcgaagagccgggccagatggttgcaggtcacgttaaataaaatccgcgcgctgtgggcgtggagggtgtcgatcagggactggctgcaccgggcgccgatcaggccgacgttgaccttcgcgtcggcgggttcttccccctgcagctcggccgggtgggccttgaggtaggccttcagcgggcggatcattccgtcgctgtaaaaggcgcggccggtgtgttcgctgtaggccgagaccatcgcactgacgtttttcgtgaagagcttcacggcttcgggcgtcaccttccgcggcagatcgagcaggtagatgaacttgtcggggtaggtggccttcagcgcgtcgtagagccggcggcccgagtcgcagcaggaggtgacgatcatgccctcgacgtcgtcccgtttgttcaccaggtcggcgaacatttccagcacccctttgacgtaggcgcagacgttggggtggaggatcgcctccgcccggttgaactggacgacctccggctccatcaattccatgtccacatcgatggattcaaacaattcgatgggcgtgtatttacagatataagctaacatgtggttctctcttcattatcatcacagcatttccagaaacgcttcgagccgggtcttgatttgaccctctgggctgttgcgcgggtcgatgccgtcgccgtccaaaatcaggtaggggatattcgcttcggcgagcgcctttttcatcaggttcgcggcgccggccatctgcttgcagccccagtggttgaaggagatgacgccgtcggcgccggtttcgcggatcaggcggcgttccgcctcgatgcggcggtcgaggggcccgacgaagatgttgtcgatcatcttttcagccagggcctccaggggccgttcgagatccagcggcttgttgtagtcgaggttcatgtccgtggcctgaatctggtattttctgctcaaattgaaggcgtgcttcagcgccggttcgtagaagggcagcacgtggagccagaaaatccgcttgccggagaacaccggccgggacgccgcgtcagcctcgaggcgcttgaagaaatcgagggcctcggggctcccgatgatcaggtgagacgcgtagaggacgaacatctgcagcgtcagcgtcgacgggtagtagcgcgagcgcgtcagctcgatgaaatggcggtaggcctcaaaggactggttttcccggtcgagggtgtctcggagcttgtccagatcgaagccctggtggttcaaatcctcgagctgagcgatccagtcgttgagctgggtcacgacgtaggcgacgctgtccttcgacttttcgttggggatgtcgaggagggtcgtcgggatatgtctcgaatcggcggtgtagcggaaggtctggaggttcgcgtcgcagacgatcgacgtcgtcaccgcgcatttcggcatcgggattaagcccgcgtccactgctccgataaaggccttgtggtacgagcagagggtcggcgcgatgccctcggcctcggcctggtcgatgcaccagtcctcgatcgtgaagcccgagagaaacgagcccatcatctcgatcgagagacagctcaaatcgaaattctgaagaatttcgaccggcgtgaacagattggtccaggcggcggattccgggtgctccagggtgtggagcatcccgtccagcgccagacagttcaaatcccggtaggggagcgggacgttcttgtcgccgaggtggcgcttcgcgaagctctcgaggcgcagccccaggcggatgtagcggccggccgccttgggattgtccggcagtttatttttgatccattgaccgtagcggtgtacgatatccataaaaactcctattcgcagaaatgctttatttcaattgtataatctctcaatatgaacgcagccacttcggcggccggttggccagaaagaaggacgacagaatcagcgcgacgccgatggcgccgagccaggtcagggtctcatggagaatgaccacgccgagtactgtcgcggtggccggggtgatggcgaggaacaggctcgcccggtcggaggtcgtccccgattgggcgtagggctgaatcgcgaagccgaacaccgagcagactactgctaagtataacacatttccccagacgctgcccggcgcggccagggtgggggattcgacgaggcaggtcgcgacgaccgagcagagggccatcacggccacctgaatgacgccgagggcgatcgcgtcgtcccgcttcgagagggtgtcggtgacgatgaccgacagcgcgtagatcaccgccgtgccgagacaccaaaggatccccgggctcaagacgatgtgaccggtctggccgatggtgaagacgacgccgacgaaggcgaccaccgctgcgcagacgttggcccgggtcggcttgtcgtggaaaaatgcccaggtgagaaagggcacgagcatgatcgccgagctttcgacgagggcggtggttgagctcgaggttttggacagcgcgatggtttcgccggccatcaccgcgaagaagacgacgccgaggaccgcgccacgggcgagggtgatcagctttaagccccggagacggcggttgaagaggatcaccagcagcaccgctgcgatcgtgaagcgcaccgccagcagattgaacacgtcaaaggcggtcaggcagtgcttgaccagcaggaacgaggtcgagcgggcgaagatgaccgccgcgagcagcccctcggcgtggcgcctgttgtggatgtcaaatcgggttttcacagcgcgatcaccccgaggtcgtggagcagaacgtaaaggccgatcaaaaacagaatgaagccgccggcgacttccgccacccgtccgaacttcgccgagatgaaatgcccgatcaaggtggcgccgaaggagcaccccgcggagaccgccgtgatggtgatgacagccaccgggacgttgattttaatgaaggcgaagctgacgcccgccgccagcgcgtccaccgaggtgacgatcgagagcaggatgatttcctggggtgtgaagtgttcagaagaggccttggcctgatcggccggatcttcgtggaaggcgtcccagatcattttgccgccgacgatcgagagcagaatgaagaccacccagtgatcgaaggacgagatgaggttgaaaaactgcgagcccagcagccagccgaggaaggacatcagcccttcggcgccgccgtaggacagtgcgatcgtggcggccagcttggcgttgtatttcggcatggccagaccctcgcaggcggaaacggcgctggagtccatggccaatccgaaggccaacaataaaataccgataaagcccatattgcgttgtgttctcctttgatgacgcattgcgtttatttaaagtagaaagagtatatcacaaccggacgcccttcgcaatgaaggccgggaaccggcaaatctccaggcggcgggcgcttgttaaaacgcggggaatatggtaaaatattctaaaatttaacttattattgaaaagctcaccgatcacattataaaatcaaatgagatcagtttggatttggaggaaattatggcatcccgggatcaaaagcatcagcttgaagagctcatagaggattttagttattttgacgatctgccctgcggggttgtcatttttacaattgaaaaaggacgggaactggtgcccgtataccgcaacacctggtaccgccgccttttcggctacaaaagccagaaacaggccgcactgaaggacaacgtcttctcgaaaatatacgaaccggaccgcaaaaacgtcatccgctgcctgcgccagagtgcagagggcatcagcggcgaaatgacggcccgcctcgtctttgaagatcaggtcatgctgcaggcccacctgcggatttggtgcgtccagcggcagtacgaatacccgaaggtcggcatgatgatcaccggatcggacaacgaagaagaagtcgatccgacgacggtcaccttcaatcagaattaccgcaacatcgcgcgctacgaagcgacctcgagcttcgactacgacgtcgagcaggatcgtttctttttcattgtgcgggacgaaaacggcggggtgaaagaaaaggtgatcgacaactacctcgaaaacctacgcaaccacaagatggttcacatcagcaccgtgcgcgagtacgaaaaggccctgatgtcccggacggcgaccgaggtcgattttctcggcctgcgcaaggacggggagtacgaatggcgccgggcgacgtgtacgccgacgaccatcagcgtccacggcgctgtgagcccgcacaccatcggccacatcgaaccggtggcctcgagcccgactgcgccgcgccgcgcccacatggatttggtcaccggcctgcaggaccgcccgtcgacgatgatgaccatcaattggattctcgaggccagagaagaaagccagcgcgttttcgccttggtctgcctcaacggcctgtctgaaatcgaccgcgtctgcggcgaaaaggtcggcgacaagatgctccaccgcctcggcttcgtcctctcgacgtcgttgatggtgcaggacgtgatcggccgctactccggcgcctacttcgcgctgttcatccgccacgccaaaagcggcgagcagatcgcccagatcgtcgaaaacgcccgcaccgaaatggaaatcgaacgggcgaaatacccgcactgcccggaaatcggcctgtcctttggtcaggcggtcatgcccgacgacggcaccaccctcgaggaggcagaagccgtcgccaacgcccgtctcgacgagaaaatcgcccaatgggacgccgcccatccaaaggcctaacgcatgctacgacagccagtgtccactggctgttttttcttgagaaagggataccatggcacacacccacacattgattgtcggcccccacacgtccatcgcgaagggctacctcgccgcgctgaaggacgcctgcgctattggcgcctcgaccttccagttcttcacccgcaatccccggggcggcgccgcccgcgcccttgatcccgaggagatcgccgccttttcaaaggggctggcggcccaccactttgggcctcttttggcccacgcgccctacacgatgaacatggcctcgaagacggaaaagacccgggcattcgcggcggaaaccttcgccgacgatcttaaacgcatggcccagctgccctgcaccctttacaactttcaccccggcagccacaccggccagggcgcggcggtgggcatcgacgaaattgtcgacatcctcaacggcgcgatgacccatgagcagacgacgacggtgctcctggagaccatgtcgggcaaggggacggaaatcggccgcagcttcgaggagctcgccgagatcatcgcccgggtcgaggtgcctgagcacatgggcgtctgcctcgacacctgccacgtctactccgctggctacgacatcgtgcacgacctcgacggggtgctgaaacatttcgacgacgtcgtcggcctcgaccggctgaaggcggtgcacctcaacgacagcaagactgaattcggcagccacaaggaccgccacgaaaaactcggtgccggcagcatcggctgggacgccgtcggccgcatcgtgacccacccggcgttgaagggcctgccctttttcctggagacgccccagtctaattacaccggctaccgcagcgaaattgagcggctgcgccagtttgcggccgaatcctaatttggctgtgtgtttgtaaaaaatataaaagaaaaaagtgagatgaattctatggaaagcaagtcacacacttcaaccctcgcccagacggcaacgcacgtgtcgattgtgtcgattgtcgtgaacattgccctttcgctgatgaagctttttgccgggatcgtcgcccactccggcgcgatgatctccgacgccatccactcggcctcggacgtgttctcgacgatcatcgtcatcgtcggcgtgcgcatttcctcgaagaaggaagataaggagcacccctacggccacgaccggatggaatgcgtcgcctcgctgattctggccgggctcctcgccgtgaccggctttttgatcggcaaaagcggcgtccagaccatcgcctcgggcaaggccatcgcggtgccgggcgtcctcgccctggtggcggccgtggtgtccatcgccgtcaaggaatggatgtaccactacacgatccgcgcagctaaacgggtcaattccggcgctttgaaggccgacgcctggcaccaccgcagcgacgccctgtcctcggtcggggcgttgatcgggatcgccggcgcccgcctcgggctgcccattctcgacccgctggccgaaatcatcatcgcgctgatggtcatcaaggtcggcttcgacatcgggaaggacagcatcaataaaatggtggaccgctcggtcgacgaaaagaccctggcggcgatcttgagggtcgccgaacatcacccgggagtcgtccgggtcgacgacctgcgcagccggaccttcggctcgaatttctacatcgatctggaaatcgccgtggaccacaccctggacatccagcgggcccacgccatcgccgagacgctgcacaacgtcctcgaggaacgctacccgaacctgaagcactgcatgatccacgtcaatcccgacgtcgatctgtccgacgccgccaaagcggagctgcagcagcaggccgaagcccaggacggcgtaaaaaagtcttaaaggcagttccccgcggttgagcgccgtcttgcggcgtggtataatgaatcgttaagttcacaacaatatttagaaatgagaaaaatgcatggaacacgaaaacaaaaagcaccgcgtgcccggttcttttgaactgccgacgtgggcggtgcgtctgatttgcgccgcggcggtcgtctcggtgatcttcgcgctctacatgatgggccggctccacggctttgcggtgcgcaatcactacgcgggtatggccaattccggcagcgaggtgacgattaaggcgtcgaaggcgacgaaggtcaaaacgccgtcggtcgattccgaccacatcacctacacgtccaaagcgccggcccacgtcggctgtgagaccatcgcggcgctggtgctggatcacagcgaggtggacgtcaattattccctgcgccagcattattacatgaagcccgtgaacgggcagtaccgctacatgaccgattcaacgacttacagcgtgccttctcactacgcgcactacgtgagcaaaaagctggccaaggcgatgggcatcaaggtgaagacggtgaagcaacgctacacctgggtcatgcttcccaatcacaagggcaaaacctacgacggggaacgctacgggttcaacatctattgggtcaaccggaaaatcaccccggacgacgtccacaaaacattcgccgcggtgcgctacaacaccaagaacaagacctacaccaaggggacgatctcagctagaatggtgcgtcagaccgacgcgtcgatcatcccagatacctttgtggcgaaataagcttcgcctggattttaaatttcaaaacgataaggaaacaaaggagaagacatgcagtttccaagaaaattacagctggcgactgatctctatcagctcagcatgggcaatgtgtatttaaacgacggcaaggccggcgaaaccgccgtgtttgacgcgttcatccggcgcaatccgttcaacggcggctacaccgtcgcggccggtctcgaacagatgatcgactacatcaacgggctggccttcaccgacgaagacatcgcccagctgcatcactaccacccggaattcaccgacgcctttctcgattacatgcgtcatttcaaattctcgggcgaaatttacgcggtgccggaagggacgatcatcttcccacacgaaccgatcgtgcgggtcaaggcacccttgatcgaggcgcagctcgtcgaaacgaccctcctcgcgatcatgaatcaccagacgctgatcgctacgaaagcctcccgcatcgtcgaggaagccggggacggcccggtcatggaattcggcctgcgccgcgcccacggcacggaagctggctatttcggcgcccgcgcggcggtgatcggcggctgcgccggcacgtcggtggtcgaaaccgaaccgatgctccaccgcgcgtcgatggggacgatgtcccactccttcgtgctcagctacgacaccgaacgggaggcctttgaaaaattctgcgactacaacccggacaacgcggtgctcctcgtcgacacctacaacacgctggaaagcggcgtgcccaacgcgatcgaggtgttcggtgaatacaaggccgccgggaaaatcactggcaattacggcatccgcatcgactcgggagacctggcctatttgacctctgaagcgcgcaaaatgctcgacgacgccggcttcaccgacgcgaaaatcgtcgcgtcctccgatctcgacgagtatctgatccgcgacctcaaatcccagggcgcgaagattgactcctggggcatcggcacgaagctgatcacggccttcgattcgccgtccctcggcggggtctacaaaatggcggaaatcaacggcaagccgaagatgaagatctccgacgacccgggcaagatcaccaacccgggcacgaagaaaatcgtccggttctattcccgggacaacggcatggccctggccgaccagctctaccttgaagacgaagtggtcgacgacacgaagccgctgcgcatcttccacccgatccacacctggaagcagatgaccctgaaaaacttcagagccaaggagttgctggtgccgattttcgtggacgggaagtgtgtctacgacaagccgtccatcgacgaaatccgcgaacacctccgggaagaaaaacgcacgctgtggccgacctacaagcgcatggtcaacccccacgtgtaccacgtcgacctgtcccgcaagctgtgggatttgaaacaggatctgctcgacgaagccgacgtcgatctgaccgagaccgaaccgccctttgaagacccgaaaaaacgcaacgtcgacagaaaaacgtcgaaataagacgcgtcattttaacgtttaatgatagaaaaaacacaccaaacaggaaaggagtacgactatgccagaaacaaaaccccataacgaccagcctattcctgaaaaggacacccagattttcgatttgaataccgacgataccgccgaagcgatggcggtctgcggcagcatcatccgcaagggcggcaccgtcgtcttcccgacggaaacggtctacggcctcggcgccaacgccctggatccggccgcggtcgaacagatttacgcggcgaagggccgccccggcgacaatccgctgatcgtccacatttacgatttggcccagctcgatgacctcgtcgaagccgtgccggacaaggcgaagcgcctcgccggcgccttctggcccgggccgctgacgatgatcatgaagcgctcggaccgcattcccgacaccgtcaccgccggactcgacaccgtcggcatccgctacccgagccacccgatggcgaacgcctttttgaaggccgcggaccggccggtggccgcgccctcggccaatatttccggccggccgagcccgaccaagggggaacacgtcctcgaggacatgctcggcaaggtggacgccatactcgtcggcgacgaatctgacgttggccttgaatccaccgtcatcgacatgacgacgaccccgccgacggtgtaccgcccgggcggcgtcaccgtcgacgacatccgccgcgtgatcggcgacgtgaaggtttcacccggcgcgatcaagccggtggaactcaaggaagtgcgctcgccggggatgaaataccgccactacgccccgaaggggagaatggtcatcgctcaggggaacctcgacgaaatggtcgccaagatcaacgaggggatcgggaagctccacggcgaccagaaaggcgcgattctcgccactgacgaaaccatcgaccgctaccacaagggcttgattttgtccctgggcagccggaaggatccggcgggcatgtcccacaagctgttcgactgcctgcgggcctttgacgacctcggcgccaccgacattttcgcggaggatatcccggtgacagacgacaccctcgcgctgatcaaccggctctacaaggcggccggctacacgtttatttaatttcttaaatcaattcttaaaccttcggcagatgccggaggtttttttgtgtaattttttgccctgtacttgcatgatgtatgaaatcggtttatactgaaattaccaattggtcagaccaataaaaatagggggttttacaatgaattttaaaataccgtgtggccagcagaagctggacttgaccctgcctgatgaacaggttgtcggcgtattggaatcgaacatcggcacgatgaaggcgaccggaaccgaagatgaaatcgtccaggccgcgatggcgaagccttacggcggcaccaccctggcggaactggcgaagggcaaaaagacctgcacgatcatctgctcggaccatacccgtccagtgccgagcaagcatatcattccgtttatgctcaaggaattaagagaagggaacccggatatcgacatcacgctgctgatcgcgacgggcttccatcgtctgtcagttgaaaaggaaatgcgcgcgaaattcggcgacgccatcgtcgacaacgaaaagatcgtcgtccacgattcagccaacgcggaatccaacgtgaaggtcggcgtgctgccgtcgggtgcggactgcatcatcgataaggtggcggccaacgcggatctgctcgtttccgaaggctttatcgaaccgcacttcttcgctggcttctctggcgggcgcaagagcgtgctgccaggggtctgcgaccgcaagaccgtcatgggcaaccactgctcgaaatttatcgacagcccgtacgcgagaacaggtattctcgaaggcaacccgctgcacaaagatatggtcgcggcggcgaagatggcgaaactggcctacatcgtcaacgtggtcatcgacgaagacaagaaggtcgtcgcggcctttgccggcgatccttttgaagcccacaaatccggctgcgaattcctgtctggctactgccaggtcaaggcggtgccggcggatatttccatcaccagcaacggcggtgccccgctggatcagaacatgtaccagtgcgtcaaggggatgaccgcggctgaagcgacgacgaaggaaggcggcgtcatcatcatctgcgctgaatgtgccgacggcaccggcggcgacggcttctacaacgcgctgaagaactgcgaaagcccgcaggccctgatggatcaaatcctgaaagtgccgcaggacgaaacccagccagaccagtgggaatatcagattcagtcccgtattctgatccatcacccggtcatttacgtcagccgtccagaaatgaagcaaaccatcgaagaaatgaagatgatgtacgcggcaactttggacgaagccgtcgcaaaggcaaaagaaatcagaggcgaagacgcgacctttacggtcatcccgaacgggatttctgtcatcgtccgcgcttaacacgctttacaaaattccggcttcggccggaatttttttgtgcaatttttttcgctctcatgctgtccgtccagccgtgctataataaaagaaaacccaatcgcaatggaggagagtatgactttaacaacccgggcattcgcgtgcccatccaaatacgttcagggccccggcgaaatcgaaaatctcgccaaatggtgcgccgatctggaaacgacgcgggccttcgccgtgatcacgccgtcctttgtggacaagctgaccccgatgctgacccagacctttgaagccgaagggctgatgattacctgcgaagccttcggcgggcagacgacccggaccgagctcgaccgcctggcggcgctggcgggggaagcggatgccgacgtggtgatcggcatcggcggcggcaaggcgatggacgccgggaaatacgcagggattcagaccggcgcggccattgtgaccgtaccgaccatcgcctcgaccgatgcgccgacctcggccctttcagcgacgtatactgaaaccggggaacacgctggctcgatttattataaacgcaacccagacctcgtactcgtcgactcgcagatcatcctcgacgcgccggcgaaatacctggcctacgggatgggcgacgcgctgtcgacctatttcgaagcgaaggcccacgtggattctgacacgaagaaccgcgtccgcgccgggtacaagacgccgctggccgcgatggccctgtcggaactctgctacacgacgctgatggccgaaggccgccaggccctcgccgacgtccagaaccacgagctgaccgaagcggtggaagacatcatcgaagtcaacacgctgctctccgggatcggcgtcgaatccgccgggtgtgccggcgcccactccctcaacagcggtttttccgcgctgcccgaatgccagcacgcgagccacggggaaatcgtcgccttcggcaccatctgcgagctcgtcctcgaaaactacgaccaggcgaccctcgaatccgttctcgcgtttaatcaggacgtcggcctgccgctgaccctgtcggacatcggcatttcgcgggacaacaccgccagcctgaaacaggtcggcgaaaaggccatgaccaccaagcatatcgccgctgtcccggtcgaaaccagcccggacatcctcgtcgacgcaatcctcaaggccgaccagatcggcaccgactggaaagcaagccaccaataattattacctgggaaataatttcgaaaatcatttcaatcacaaaaagcgtatctgcgggggcaggtgcgctttttttgtcttgtttagctttagcgaaggattcgacgagagaaacgaggagaatcaaagaaccaccggctaggccggtgagtttactaaagcttcagcttcaagcaaaaaacctcctatgctaaaatgatgccggttcgccaaccgcaacatttcataaaggaggttaaatcattatgaaaaatgataaagatagtttagcacatacaaaatggaattgtaagtatcatatagtgtttgcaccgaaatatagacgaagagtaatctacggaaaaataaaaagagatataggaaagattctcaggctgttatgccaaaggaaaggaatagaaataatagaagcagaatgttgtccagatcacatccatatgttagttcacataccaccaaaatattcagtatcgcagatagtcggatatttaaaagggaaaagtgcgttgatgatctttgataaatatgcgaatctgaaatacaaatatggaaataggcatttctggtgtcgcggatactatgtggatacagttggaaagaatacaaagaaaatagcagagtatatacggacacaattggaagaggatatagcagaggatcaaataaatataaaagaatatatagatccatttagtgggaagaaaataaagtaaccctttagggttagtcggaaaagagttacagaagaaagaagtggagtggaaagcgaactatttcgaacatcttaagatgttggtcggtaacaggcccttatagggctaacacaaaccaccggctgagccggtggttatgatttcagattgaatatcagcaagtgaccattttagaaaaggtggccaatggccacaaaatctaaaatgagatgttatttacgaaatcatttcaatagcgggaagcgtatctgtgggagcagatgcgcttttttttggtttagattgaatattagcgggtgaccattttagaaaatgtagccaatggctacaaaatctaaaatgagatgttgtttgtaaaataattttgatagcgagaagtgtatttgcgggagagggtgagcttttttgtttgaataataattaactcaaaaatatggtaaaataaaaataaatgattaaaaaatggaagcatttttgaaatcatttcagatgaagctgtggaggaaacagtagaaatatccgtagctgtcaaagaacggagcaaatttaatggaaatatttaacaatacaacgaaagttgtgaaggatgatcttgagaaaaaaataaagaatggcagcaaattatctattgcggccgcttgcttttctatttacgcgtatcaagcattaaaagatgagcttgaaagttgtgacgaatttcgatttatttttacttcaccgacttttgttgcggaaaaaacaaaaaaagagagaaggaaattttatattccgcgtttgaatcgtgagaagagtctttacggtacggagtttgaagttcgtcttcggaatgagttaaaacaaaaggctgttgctcgagagtgtgcggactggatgcgtcgcaaggcgtcatttcggaccaataccacgagagaagcaatgaataatttcctcgttgttgaaaattcagaggacgcttatacatacatgccaatgaattcttttacggcggtagatttgggctgtgagcgcggaaacaatatcagtaatatggtaacgcgattcgaaaatccagccagttctgaatatttgcagctctttgataaaatttggaataatcaagacatgcttacagacgtgacgaacgatgtgatcgagatgatcagtaccgtttatcaggaaaatgcaccagagcttatttattttatgacgctctacaatatctttaatgagttccttgatgatatttctgaagatgtcctgccgaatgaagccactggtttcaaaaacagtgtcatctggaataaactatacaattttcagagagatgcggcatttggcatcattaataaattggaacagtataatggctgtattttagcagatagtgttgggctggggaaaacattcactgctttggcggtcattaaatattatgaagggcgtaataaaaatgtgcttgtcctttgcccgaaaaagctctctgaaaactggatgacgtatcgcggtaatttggttaacaatccattggcggccgatcgctttcgatatgacgttctgtatcacacggatctatctcgaagcagtggcatgacaggtataggtcttcccatcgatcgcatcaactggagtaattatgatcttgtcgtcatcgatgaaagtcataactttcgtaacggaattggtacgaattcacatggcggtgagaaagaaaatcggtatatgcgtttgatgaatcgggtaatcaaaccaggtgtccgtacgaaagtattgatgctttccgcgacgccggttaacaatcgattttatgatctcagaaatcagttggcattagcttacgaaggcaatccagaagagatcaatgaaaaattaaatacgaaatctgatatcgacacgatttttcgtcaggcacaaagggtttacaacgcgtggtgcaagctgccggaagatcagagaaccactgagaatttgctttcacagttggattttgatttttttgaagtgctcgatgcggttacgattgccagatctcgtcgccatattcaaacttattacgatacaaaggatattggaactttcccaagaagaaataaaccgatttctctttatcctaaactaaccgataaaaagggcgctatcaactacagagaaattttcgattgtctgaccagcctaaaattgactatttatacgccgacgcaatttattcttccgagtaaactttccaaatatttgtctgaagaggaaacggaaaattttcgtaaaggccgggaaacgggtattcaacggctgatgagtattaatcttctgaagcgaatggaaagttccgttcattcgttcctgttgacagttcagcgtgtttatcaatatttgagtgacacagatcagaccatcaaaaactttatccagagcggaaaaggcaacttgaatgagatgacggacttgtcaagtgaagcggcagaatttgatgacgatgatcaaaacacagactttttctctgtcggaaaaaaggttcaaattgatcttcgcgatatggattatatctcctggcagagggatatagaagaagatatagatacgctctcgattctgatcagcatggtggaagacatcacgccggagtatgactacaagctgaatcagctgctcaaggtgatacagaagaaagaagaaaaaccgatcaatccgggaaataaaaaggtgttaatcttcacagcgtttgcggatactgctgaatatttgtatgaaaatattgcgccaaaagctaaaaagctgggacttcatacggcgcttgtgactggtagcgtggaaggcaggacgacgattccgaattttaaggcggaaatgaatcacgtgttgacctgtttttctcctatttctaaagatcgggatgtgctctatccacaggacaagcataataatattgatattttaattgggacggactgtatttccgaaggacagaaccttcaggactgtgattattgtatcaactacgatattcactggaatccggtgcggatcatccagcgttttggaagaattgaccgtatcggtagcaaaaacaaggtaatccagcttgtgaatttctggccggatttgactttagatgaatatatcaatctgaaagccagagtagaaaccagaatgcggatctctgttatgacttcaaccggtgacgatgatttgatcaatcccgatgaaaagggagatctcgcgtaccgtaaggaacagcttaagaagttgcaggaggaagtcgtcgatctcgaagatatgacaagtggtgtcgccattacggatttggggttgaatgattttcggatggatttgcttgcgtatatgaacgatcataaggatatcgatcatattccctttggcattcacgcggtcgcacacggagaaaagcccggtgtgatttttgtgctgaaaaacgtcaattcaaaaataaatatcaagaatcaaaatcgcctgcatccattttatatggtttatgtcggcatggatggtgaaattatcaccaatcatctacagccgaaagagacgctggatgaaatgcggcatattgccagaggaaaagcgcagccgaatatgaaactttgtcggcgttttaataagaaaacaaaagacggtcgcaaaatggaaaaaatttcacgtcttctcgaagatacgattggctcgattattgatgacaaggatgaagaagatatcgatagtttcttctctgcgggcgagaccaccttccaatctggcggtttctcggggcttgaagatttcgagttgatttgttttatggtggtgatgaataatgattaatattaatttttttacagcattagctgctgttataagtgcagttgctgcagcaaatagtgtatctattgcaaaaaaacaattgaaggaatcgaaaatagaatttcaaaaaataaacagagcttttattgaaatggaatattttcaagaaaatctttattttggggtacgattgacaaatcatggaaatcgtacagcaataaatgtcaaactttcaattgatcaagattttattgaaagtataaaacaaactatatatcaagatattttaaaagaatataatgctaagtcatttcaaattggagtaggacagaaatatgatatttttatcggaaaggtggaaaataaaagagatcctggtttattgccattaaaaatgcacatttattacgaatggaaagatagtattcatagagaaaaaaatcaaagtgaagcattaattttaaaaagttttgaagatgactttgaaattgatattaaaaattatgtaacgatttatcataacgagttaaatgagctagaaaagaagaaagtaaaatctttagaaaatattcacaaggatttggaagaaattaactctaacattaataaattaagtaagacagaagaacaataaaattattatttgtggtgaaataaatgatcgattttcctaaaagtacaatcgtgcaccagcgcttaccgaaagaagctttttatcagcatttgtctctatctgcggcactcaaagctaaatttatatccgatattgaccgaattttggtggagaacagtttaaccaaaagtaatttgaatttagcaaaggattctgaaataaatgaaattatgcttctctcaatcagcttgaaaaagcagaatttcgatagcaaaattgtagaggctatcgcaaaacagaatccacatcaacttgtttttcttttgacttttgaagataaataccaatttgcggtttatcgaaataaactttaccgcacgcaatggatgaaaaaagaggaactttcacttgagctgcatggcgatacactcgacgaaatatgggatgatcttgtgcgccagattgtgatcacatcagaatctttgcttgaaagacaagatcaatcacttgaagagcagttggaaatacaagatgaaatcaaccgactgaataaattgattaaaaaaactgaagctgctgcgtggaaagaacagcagccgaagaaaaaatttgaaatttatcaagaattaaagcgtttgaaaagcgagctggcacaaataaaagcgaattaacaattttgatcgaagaagagtgaaagctcttcttttttattttcaattggacataaaattcacgagacaaattaatacatcaattgataagatgacaataatttttaaaaggatgtaatttggagtgaaattatggagaaattgaaaatgtacacgccggatcgtgcagagcaaaattataataagctggctgcgttgttcccaaatgcagtcactgaaactatagatgaagatggtcatactgttcgagcgattgataaagatgttctgatgcaggaaatcaatacgcaggttgttgatgacaaacaggaacgctatcagtttacgtggccggataagagaaaagctatagttcttgcaaaccagcaaatcgagaagacactgcgattcgaacaagaaaagtctgtgggcagagatggaacaccggaaggagcagattcggagaatatctatatcgagggggataatcttgaagcattgaagcttcttcaggagacgtatcttggtaaagtgaagatgatttatattgatccgccttataacacaggaaatgattttatttatgaagatgatttttcgcagaaagcagatgattatgcagataatagtggacagactgatgaagaaggaaatcgacttgttcagaataatgaaagcaatgggcgttttcatacagactggctgaacatgatgtattctcgattaaagatatcaaaagatttactaactcaagatgggcttatttttattagtatagacgacaatgagattacaaatttaagaaagatatgtaatgaagtatttggggagcaatgttttgttgcacagataacattgctatgtaatccaaagggcagatctcaggataaatatattgctaattgtcatgagtatatacttatttactcacattctgttttgaaaaaaggaagtgtatctattctaaaaacgaaagaagagattagcaaaaattattctttatttgatgaacaaggaaatccatatcgtgagttagaattaaggaatacacacagagattttggtagatttaatcggccaaagttatggtatccattttatgtagatttaaatgggaatgtctctttagaaaaaggaacagatactgtggaaatttttccagtatgggatgatggatttgaaggatgttggacctggggaaaagaaaagtcaaaaaaagaacttcatcttctgaaggcaaagaaaattggaaaaaagtataaaatttacaggaaatcatatgcctattatgatgatgaagcacccttaaaacaagttaagtctatttggatagaaaaatctttctttacagaaaaaggccaagctgaattaaatagactgtttaatacaaaagataagttttttcaatctcccaagtcattatttatgatagaacaatgcatttctatggcgcattgcgaaaacggtatcgttttagatttcttttctggttctgccacaactgctcaagccgttatgcagctaaatgctgaggatggcggaaatcgcaaatatattatggtgcaaattccagaagaaacagatgaaaaaagtgaagcacacaaagcaggatataaaaatatctgtgaaattggagaagaacgtattcgccgtgctggtaaaaaaataaaagaagaaacgggtgcagatattgattatgggttccgctgtttcaaggtcgattcttccaatatgaaggatgtctattataggcctgcagacgtaaaacaggaacaaattgatatcttcactgataacattaaggaagatcgcacgccggaggatttactgattcaagtcatgctggacctcggtgttctgctttcctctaaaattgaaagaactgaaattgctggaaagaaagttttttcagttgacgatggctatttgattgcctgctttgatcaagatgtgacggatgaggtcgtgacagcaatcgctaagcagcatccgtactatgctgtatttcgagacagctctatggcgaatgacagtgttgcagcgaactttgagcaaatatttaagacatatagcccggaaacagtaagaaaggtgctgtaaatatggccgacatgaaattcaaatttacgattcagaattatcaaactgaggccgtaaacagcgtggtgaaggtatttgctggtcagccgtttcaagataagattagctaccgacgggacactggcacacaaacttttgaaagaacgctactcaatttagatttatcggatgaggaactctatatggggtttgccaatgcgccggtagtactgaatgcgcatcagttgttaaaaaacattcaagacgtacagaatgataataatatcaaggaatcgcctgctctggcaaaacacatgggcgcttgttctcttgatgtagagatggaaaccggaactgggaaaacctatgtctacatcaaaaccatgtttgaactcaataagcaatatggctggagcaagtttatcgtcgtggttccgtcgattgcaatccgtgaaggcgttcagaagagctttcagatgatgcaagatcatttcatggaacagtatggcaaaaaagcgcggttctttgtctacaattccaaaaatctgacagacattgataactttagttccagcgcagacctttctgtgatgattatcaacgtgcaggcttttaacgcacggggcaagaacgctagaagaatccgaatggagctggacgagttcggcagcagaaaaccgatcgacgtgatcgcggctaatcgtccgattgtgatcatggatgaaccgcagaaaatgggcggaaagaaaacgcagaaatcactgttagaattcaacccgttgtttacactcaattattctgcaacccataaagaacaccatgatctcgtttatgttctggatgcgcttgacgcataccggatgaagcttgtaaagaaaatagaggtcaagggattcgatatcaagaatctccgcggcacggatggttatctctttttagaggaaatcctcatttctcagaaaaaaccgccgatggcacgcctggaatttgaaattggttatgacaagtcaattaatcgagaaacgcgtgttgtgggcgtggatgatgatctctatgcgctttctaaaggaatggaacagtaccgagggtaccatattaacgatatagacccgattaaaggggttttgacatttacaaatggtgttgagatccacactggggaagtattaggcgatgtcagcgaaaaagatatacggcgggttcagattagagaaaccattaaatctcatttcagcaaagagaaagaactttttaatagaggaatcaaaaccttatcgctgttcttcatcgacaaggttgaacattaccggaaatacgatgaagatggcaacgaaatccaatctgaatatggtcggatgtttgaagaagagtatacgtctattttgaatgaatatttgacgttgtttaatacgccatatgaacaatatttacgagacatcgatgttcacaaaacgcacaccggttatttcagcattgacaagaaaggccgggccattgacagtaaaattaaacgcgggcaggacagcagcgatgacgaatctgcctatgaacttattctaaaagataaggaaaggctgctttcactcgacaatccggtacgttttattttttcgcactcggcgctgcgcgagggctgggacaatccgaacgtgttccagatctgtacgttaaagcatggcggtgattcgacgacaaataaacgacaggaagtcggccgaggtcttcgaatttgtgttaatcaatccggtgaccggatggatgagcacgttctcggcgatgaagtgcaggatgtcaacaagctgacagttatagccagtgatggctacaaagactttgtttcgtcgcttcagaaagaaattggggaagatttgtatgaacgtccaacgaaggcgacgccggaatactttgaaggcaaacggctcaaaatcggtgatgatgtcgtcacagttacgagcgatcaggcatatagtatctatttttatctggtaaaaaatgactatattgacgaagatgggcatgtgacagaaaaatatcacatggatgaagagaacaagtcgtttgcgccattaccggataaagtgaaggatattgcggaaggtgtttatgcgcttgtgaacggcatctttgatgaacacgcgctcgacggcatgattgaagacgggcacacgacaaagattcaggaaaatgcgctcaatgataatttttataaaaaagaattccagacgctttggaattacatcaatcacaagtggacctattccgtacattttgacagcgatgaactgattaaaaaagcgatcaaacatatcgacgaaaagctctttgtatcgcagttgcagtacacggtgacggcaggaacgcaaggagaagactggaacgcagatacagtaaagtccggtgaaggctttgttgcggataagggacacacgtatcggcttgagcgcggagaaacgtctcaggtgaaatatgacttgatcggaaagattggtacagggacgcaccttacccgcaagactgttgtagcgattttgaaggggatttctccatttaaatttgcgatgtatcaaaataatccggaagaatttatttctaaggtgattaaactcatcaatgaagaaaaagctacaatgatcgtggacgacattacatataataaaacggatggaacttatgattcttcgatctttacggcagaaaagaataaggatttttcaaaggcataccttgctaagaagaatgtgcaggactacgtatttgcggatggcaccgctgaaaagtcgatagaatggaaattcgctgaagatatggatctggacgataaagtcgtcgtgtatgccaagctgccgcgtggctttcagattcctactccggtaggaaactacgcacctgactgggcgattgccttccagaagggaacagtaaagcatatttactttatcgctgagacaaaaggcagcatgaagagtatggatttgcgcccgattgagcaagcgaaaattaagtgtgccaaaaagctcttcaatgatatttcgacagacgatgtagtctatgatcaagtagactcttatcagaatttgctcagtttgatgaatgcaatttgatgtattgaagctaagaaatcataactatcagcgcagtccaaaaggccgcgctgatttttcttttaacgtatatttcaagattataaacgaaaaatccgtttataattatgaaatccacgacaatttcaccactttttccaaactataaacgaaaaatccgtttataattgtgaaatccacgacaatttcaccgctttatccaaactataaacggcaaatccgtttttatttatgaaaatgccggcgattcgatcgatttttcagatttatccacggctttttcgtttttatttttgctgctatcaaatccaccactgatcacacatgctcctcctgaaaatcaaataaattggcacgccgttgtattttcctatataatacatagttatcgaatacaatgacaacgacagcggaaaggaagaataatagagggcatggaacaaaaacacggatacgcggcggcctttaaagccgtctttcggtacacgatcccggtgctggccggctacgtgttcctcggcatcacctacggcattttgatgcgcacctcgggctatccggcgtggctgccggtggtgacggcgctgatcatctacaccggctcgatggagtttctcctggtggggattctcgcctcggcctttaacccggcggcggccttcgcgacggcgatcatggtcggggcgcgccacctgttctacgggatctcgctcctcggcacctaccgggacatggggccgaagaagttttacctgatctacacgaccagcgacgagaccttctccatcgtctacacgacgccgattcccgacgggatcgacaaggacaaggcctatctcgccatttcttttctcgatcagatgtattgggtcgccggggcgctgatcggcaccctcttcggcgggctgatcacctttgacaccaccggcctcgactttgtgatgacggcgatgttcgtcgtgatcctgctgagccagtgggtcgaggacggcaccgcgctgaagacgatgctgaaggatcacatcagcgagctcgtcggcattttcggctcactgctctgcctgatcgtcttcggtccggatcatttcatcattccggcgatgatcgtgattttcgtggcgctgacgctgctgcgccctgtgctcgatccggaatttcaacagaatcagcacaagcaaaagacgccccaggttaaggaggataacgcatgacagccacacaacaatgcatcaccatcgcggtcgtaatcgctgggaccgtgctcacccggtttctgccctacgtgctgtttccggaggggcgggccattccgaaatttgtgacctacctcgggaaagtcctcgcgccggcggtcttcggcctcctcgtcgtgtactgcctgcgccacgtcagcgtgttcaccggatcccacggcatccccgagctgatttcaatcggcgtcgtcatcgcgctctacgcctggaagcggggcatggtgctgccgatgctcggcgggacagtgtgctacatgctgctggtgcagctcgtgttctaaaaatttataaaaaacagtggcgcgttatctcaatctaatatatacttatcatatagtaattataagagataaggagctgccatgtttttaaatgtgttgacacagatttcggacttcctttgggggacgccgatgatcgtcgtgctgctcggcaccgggatttacctgtcgatccgcttcggcttccggtacaacttccggaaaatcggttttaatttgaagaataccttcggccgaatgtttcaaaagggagacggcgccggctcggtttcggggttcgccgcggcctgcacggcgatggccaacaccatcggcgtcggcaacatcggtggcgtcgcgacggcgatcgtctccggcgggcccggggccgtgttctggatgtgggtctccggcctgttcggcatgtcgaccaaggcctgcgaaatcatcctcggccagcgctaccgcgtgaaatacagcgaatcgatggatgagtacatgtgcgaccggtcctttgtgatgaagaacgccctgggctggaagaagggcgcgatgatcctcgccgtgtgctgcttcgtgctcgggccgtggacgtgcagcgtccagaccgaatcggtggtcggcgcgctgaagcagggcttcggcaccccggcgctcatctccgtcatcgtcctcggggtcacctccttcgtgacgattttcggcggcctgaagcgcatttcgagcatcatggaaaaggtcgtgccccttatggcgctgatctacatcctcggcggcctcggcattttgatcacccacatcaccgcgctgccggcggccttcgcgctgatcgtgaaatccgcctttacgccgatggccggggtcggcggtttcgccggcgcgaccgtccgcgatgcgctccgttacggcatcgcccgggggctgtactccaacgacgccgggacgggctacgggatcatcgcccacgcctcggccaagaccgatcacccggtgcgccaggccagctggggcttcggggaagtcttcctcgacaccatcgtcgtctgtagcgtgacggcgctgtcgatcatcctgaccgacgcttacatcgacttcccaagggtcagcagcgcgagcctgaccaccgtcgccttcaaggccgcctacggcagggccgggggctggttcatggcgatcgcgatcacggtcttcgcgtggacgacgatcatcggcatgtactacagctgtgaaaagtcggtcaactacgctttcggcgacacgaaggccaaccgccgcgcggtgcggatctacatggtctactacatgatcccctgcgtcgtgctgtacaacatcaaggccgattccctctgggccatgaccgacattctctcggcggtgtacgtcatcatcacgatgatcttcatttattccaagcacaaggaaatcatccggctgttcaaggatttctggttccggttcatcccggcgaaggaacggggcgaaaatcccgaaccggtcgtttacgggacgatcgacgccaaggccgaagccgaacagctgtcgtaatgtgataaaggagaacccatgaacgcaaaactcgaaaacattttgaaacaggaaaaacggatggtcatcgacgggtcgatgggcacggcccttgaagacctcggcgccgacctgaccaacgccctctggaccgcgagcgtcttgacgaagcagccggagctgatcgcgaaggtacacgaaaattattttaaagccggcgcggactgcggcatcaccgcgagctaccaggcgacgattccggggctgacggccgccggctacaccgaagcggaggccgaagggctgatcgccaaggcggtgcgcatcttcaatgacgcccgggacgcctggtggcaggcggaaggcgaggcggctggccgggcctacccgctgtgcctcgcgtcggtcggcccttacggcgcctacctcgccgacggcagcgagtacaaggggcattacggccttacgaaagacgcgctgcgggatttccaccgccgccgcgtcgaactgctcgccgcggaagaccctgatttgatcctgtttgaaacggtgccgtcgctgaccgaggcgctggtcgaggcggaaatcgccgaagacatgggcttggattattgggtcagcttttcgtgtaaggacgacgcgcacatctgcgagggcgacccgatccgcgacgcggcggctgcctttgcagaaggtcatcctcacctgcagatgatcggcgtcaactgcaccaagccccagtacatcaccgggctgatcggcgaaattaagacggcctgcgatctgccaatcgccgtttacccgaacagcggtgaagaatacgacgcggtcacgaaaacctggcacggcgtcgaatccgacctgaccttctacgatcacgcgttgtcgtactaccaggccggtgcggccgcggtcggcggctgctgcaccaccgtcgccgatcacatccggcaggttgtgcaggctcgggcggattatttgaaaggactgaaagaataagatgatcagctacgcagaagcgaagaaaagggcgctggacgcgagagcggagtacgattactgcacggttcggaaagacgcctatgttttctcgtgctcaaaagacgaaatgtgtgatggcgggcccgatgcgccgattgtgattttaaaagaggacgggcgcgcgctgaatttcactggctacatttacgatcatttgtcagaagaagatttggacagctttaaattgggatcagaaaaagaaaagaaatacttagagggtgaatcatctctttaaaataaaaaaagcaaggcgaaaaccttgctttttttgcgatttgcggctgtaggggcgattggcgaatcttaccacgagccaccgccgccgcctccgccgccaccgccggagaagccgccgcctccgccgaagccgccgccaaagccgccggagccggaatcggacgggacgtgaatcatgctgctgttcatcgcgttgaagctgcgatcgagcatcgatgagaagtaaatcacgttaaacgtggtgtacgggtcgtagccggtgtaccaagtcggcggttcaaccgccaggccttcgaagtttttcgcccatttatcggtcaggccgaagatgtaggcgtagggcaagatgtcgtaaaaataggacgggttgtcctcgacgagggctttcagccggtcgagctcagccgttttaataaaccggcggaagccgagaatttcgccggtccatttccggccggtttcgctgatgttttcgatttggctgcgcaggacggcgatgacgataaagacgagctgcgacacgataacggggatccgctggtcgccattccatgcgacgaaggttataaagccgaagaggatgagcacaatcagaatgtcgagaatgctgaggccaattttgcggccggctggattgcggtgcccctcagcgatgtgaccggcgagagactggcacagcaagtagtcaatcccgtaaataacagcgatcactagcgcattaaagacgatgacagaggactctacaatataagaggtgataaacccggcagccacggcctgcgcaaggccgaagatcgtcagtgccaagcgggatttgtgggcggattgcgagatcagctcgttttccggtttgtcgaaaaacatctgaacctccgtctgcgctgtcttgacatcctcgtagaacgagtccttgaggaagtcagacgtcgtcgattcaccgtttttcgttacggcattgaagactgtcttgagcggcgtcggctcgctttcgccgatgtctttcactttgtggaaagtgaattgtcttttgccggtctcctcgatggtgatgtagcccttttcggcgagggtcatgatgcaggccgtgatgtatttgtctttgatcgtgcagccgctcgcgacgtagccgactgtcgccggggagaaccctttcggcgggtggaaggagatgacctccggaatgggcgtgatgtggtcagcgcgcaggtaaaaccagaacgcggcagcgatcagagcagccgaaatgaggaaaaaggcgatcagaatcgggcggttggtacgcgccccgacaaaatagccctcgggcagccgcacgtttaaggtcgcgccggaattggcgggcagcgctttggtgctctgcgccgtgatggttttgccgctgacgctgacgttaaaatacgcattgtcggttgcgccgtaggtgccagagtatagatggactttgcttttgtcgaaggcctttggcatggtcaccgtgatggtgctcgagccgatggcagtcggccactgtttgggcaggacgttgaaatacacgtcgtcgaaatcggaaatgccgtcgtcgcccgggtcccaggtgtagtgaatcacgtactggtgattgccggtgacggtggtgtcttcgtcgccgatctgcaggacgacgctgccgtcttcccggctgacgtcgacatcgccgccggtgaccgagatgttagagaccttcgcgacgtagggtttttcgcttttcgcgccgtcgatctgccggtaaaagtccccttggtaggggatgtagcggtaaatgccgtggcggggttcagtgaaattgacgtcgatcgtctcggtcacgtcgtaggaatggtcggtgttgaccttcacgtcgacgttgtaggcgctggtggtgtagccgccggcattggccgaaacccgccccgggactgcgacgaggatcagggccgccgcgatggaaatgagccaaagcagggatttgcgtttcatggttcccctctctgtagaaaaaatggttagaactgaacgtggacgttttcccgttcggcggcattcgccacttcgtagaagggcttggtggtgtagtggaacatgccggcgatcaggttcgacgggaacatctggacccggttgttgaagttgcggacggtgccgttgtagtacttccgggcgttggcgatgtcgtcttcgacgagcttgagctggttctgcaggtcgatgaaattggtgttggccttgagatccgggtaagcttcagagatcgcgaacaaatgggtcagcgcctgatcgatttgattttcgcttttgatctttgcgctgagatcagtagacggcgtcgcggcggcgttgttgcgcgcggcgacgacccgctgcagggtttccttttcgtggctggcgtagcctttgacggtttcgacgagattgggaatcaggtcgtagcgttttttcaggtagacgtccatcgtggagaaggcttcgtccacctggttgctgaggccgaccaggctgttgcgggtggcgactagccaaatcaggatgatgacgacaaccgcgacgataataatagggatgagcataacatgacctcctaatagttttgttatattttagcatgaaaacgaccgaatcacaaacagaacaggcgggagtgtaaaaataaagggtagcaaaaaagcctgcggaaaatccgcaggcttggcgccgagcttaagcgtccggcatatccttgtagaaaatttcaagcatttcagcggttgaggcagcgccgggatccaaatggccgacagcccgttcgccgaggcgcatggcccggcccttggtggcgaccatgttgcgggtcgattcgagaccagccttgccggcttcgacagccttgcccatcgcggtcttgatgtcgtcgcccgcggcgtgggctgccttcagcgcgtcgagggccggcatcagcgtgtcgttcatcgtcttttcgccggtggtcgatttgccgcgcttctgaatgatcgcgatagccttgtccatcatcgcgacgaattcgtcagcggtaaccccttcgtctggtccctttttcttgaccggaacgccgaacttcatgaagaagctgccgtagagcggaccggcggagccgccgaccttgtcgagcagcgccttgccgacgtttttgtacagcgccgcgacattttcacctttccattcgtccaggtggctggccacttcgcggaagccgatggacaggttgatgccgtggtcgccgtcgccgatggcggagtcgagatcggtgaagtattccttccggtcttcgatccacgggatcagatcttcaatgactttgacaaaatattccttgctcagttcttctgacataaatgcatggcctcgattctattagacttgggtgaagtacggcgtatcgcacggatagtcgagcatttccttcagttcatcgtcgagcttcgccaaggtgatggacatgccggccatatccattgaggtggcaaacgggccgaccagagtcttgtagacggtgatgcccttttcgtcgaggatctgctggacgcgtctgaagcagacgtgcaggtccataagcggcgtggcgcccaagctgttgacgaggacgtaaacttcgtcgcccttttcgaaaggcaggtccgctaagatcggttccatgatttcgtcgacgacgttgtcagcggtatcgatcttaccgcggcgcacgcccggttcgccgtggatgcccatgccgatttccatatcgccgtcttccatttcgaagatggtgccgccctttgccgggatggtggaggaggacatcgcgacgcccatcgaacgggtcaccgagttggccttttccgcgatgcggacgacttcgtcgatatccttgcccattgcagcggcagcgccggcagccttgaagacgatgaagtccccggcgacgccgcggcggtcttcaattttatccttcggcgcggagacgacgtcatccttgacggtgacggatttgacgacgatatcgtcttcgtcttccgcttcttcagcgcccatgtcaaagttcatgacatcgccggcgtagttgccgtagagatagacgacgcccttgccggtgtcgacggctctcgcagccgcgtagcacgggtccggtgacggtgaggtgttgatgttgcccatgacgaccgcgtcggcgaaatccttgccgacgtagccgaggaacatcggttcgtgaccggtgccgccgccgacgacgatgccgactttatccttcttgccgacttcgttggaaacgaggacgcggccctgcgcttcttcgctttcatccatgtggacgtactgtttgtgcgccttggcgtagccttcgatcatttcgtctacgatgtcgtagggatcattgaataaacgtttaagttttgccataattactaccctcctggcgtaaaattaaatttatgatgaagatgacagccacgtcatctgatcagctgaaaatcattaatttttgtgaagatttctcgcgttgtccgattcggtaatgattttctgaacgtcgtccgatgccgccgcttcgactgcgccgaaaaaggccccttccactaacggtgcgtcgacaatgtggcatttcgctctcaataaggtgttgtcgatcatgtcgatcgcggtttcagagctcaagaccgagctgccgagatcgcagtagatcaagatgctcttgcaatcggataaggattcgatcgcacttaaaacggtcatcgcggaagtgcccagacgaccgtcgccggtaccgccggctgctttgaattcaacattgtcgttagccatttctgcggccagcttcacgacgccattggcgatttcttcactgtgtgaaacaataaccatacctgtctttgccatgttaaactccttagtgtctaattatttgcacaattggcatcaatttagcatgattataggggtataaacctataattatgcttaaccttatcataccagaattgaatcggggataccagatatttaagtaaattttaacgtctgaaattatgttaaaaataaaatcaaatgggcggaacgcggtaaattcggtataataaaataagacaaaacgaaataatcaaaaataaaattttaggagggaaatatgggtaaatttttattgggaaccaattggaagatgaacaagacgacggcggaaggcctcgcctacaccgacggcttgaccgacatcattccaaaatttccggaatatcagttcttcatttgttcgccctacgtgcagctctggaagcagcgcgagctgatcgattcaaaaaaatcgacgctgatgctcggcgcccagaacgtgcactacgaagactgcggacagttcaccggagaaatctcgccggtcatgctcaaggaaatcggcctcgacctgctggaaatcggccacagcgaacgccgccagtactacaacgaaacggactacacggtgaacaaaaaggtgctggctggcctgaagcacgggttcacgacgctgatctgcgtcggggactacatgcaggaaaaggaattcggcgtgtcggcggaagtgctcgcgaagcaaatcaagatcgcccttcacggcgtggacgaaaaggatctcgaccgcgtctggatcgcctacgaaccctattgggccatcggcgtgcaggggatcccggcggaaccggaagtggtcgacagcctgcacacaatgatgcgcggcgtgctcgtcgatctctacggcgaacggggcaaagacgtgccgctgcttttcggcgggtcggtcaacatcaaaaacgccgtcgcctacgccaaatgccaagacgtcaacgggctgttcatcggcagagccgcttggcacaccgacacctttgaagaaatcatgacggcgctgcgcgaagcgggcattcggtagggacaaaaaacatatccatcccggcgcacagattttttagattgatgaagatatcgtttgcagtctgtatatctttcctttatactcatagtatacgcagtgtgagggggatatgatggatcaacagattaataaaaaaagattcgaggtgaaatcctcagacggtaaaacgacgcttcaatgtacggcttgggtgccaaaatcgccggtgggggtggtacagattgtccacggtatgcaggaatacgtcggccggggtcattttgtccggctgcggcatgcaggcgatgtctacggtgaacatggcccgggtgatcggccgcatccttaagtttttcaaagggccgcgctaccgctcgccgctgatgaaccacatcgcctttggccactatctggaccgcatcgaaaatccgattacggaaaaggattggctgtctcacaatacggcggaaaaccggcgctacatcgccgacccgaagtgcaattacaccttcaccctcaacggcttttttacgatcgggaatctcgtagagcgcacccaggacatgaagcagatggcgaaaatcccaaaggatctgccgattctgctcatcagtggtgccgaagatcccgtcggggattacggcgaggcggtgcggcgcatctttaaggtctataaagaagatttatgccttcagcatgtggacatgaaactgtacccgggtcttcgccacgagcttttgcaggagatcggccgggagcaggtttttgaagatcttgctggttggatcgaaaaaaattgccattaattaaaaggtaaaatcaaatcagaaaatttgacaaagaatggataaatcgttaagctggagataaacacaggggagcttttgctgagaaaggccgatgcctgaccctcatgacctgatccggacaatgccggcgcagggagtggtatcgctgaagcgcctcctggaaaacaaggaggtttttttatgtctttacaacatttttttgaatccgccggcggaaaagggctgatcgtggcggtggcggcggcgctgctcattgcggtggcgttcgcggggaaaaagcgtacaaatcaggcgcaatcgcctcaggcccagcggtttgacacccgagccttggtgatttcggcgctgtgcatcgcgctgtcctttgtgctggcccagattcggctcttcaaactgccccagggcgggtcggtcacggccttttccatgctgcccatcgcgttgtgcgcctacctcttcggtgtgaaacggggggtgttggctggcatctgcctcggcctcatgaacctgatgtttgacccctacgtcattcatccggcccaactgctcatcgactatattctggcctttggagctctgggcatcggcggggtgtttcggaatcagaaaaaaggtctgctcaaaggctaccttctcggaatctttggacgctacgtttgcgctgtggcctcaggggtgattttcttcagggcttacgtgccgaagaatttcaacgcctggacctggtctttgtggtacaatctcacctatatcgcggccgaaggggtgatgacggtgatcgttctgtgtattccggcggtgagccgcacgttcgaacggatgcgggcgaaaatagacggcggcctagcgtaaaaaaacagcagatggtatgatgccatctgctgtttttggtttggagcggatttagagaattgtttcggtttcgaaagcggtccaaggaatgttgaccggtttgccctggttgatgatttcgtcgacgtgcatcaacagcgggaagtccttggtgtcggccttgccgtttttcgcgagggccttgacagcgcgggcggtgcgggtggcgatgacgatagattcgagggtgaccccggccagttcctgcatcgcgtcgtcaaagctcatgccgcggccgagcagggtgccgattttgcgggtgcggccgccgtaaatggtgacgtagaggtcgccggccccgtagacgatgttgtcgtcctgtccgccagctagtgcgaggagcttgcgcatttcgcggacgctctgtccgaacagcgctgcctgggaattgtagtggatggcgccgatgccttcgcgtttttcagcgaggccgaccgccagggagacgccgagggcgtaggcgtttttcagcgcgacggcgcattcgacgccggtcacgtcggtggacaggctgacgtggtagtagtctgtttcaaacaaggatttgaggtagcgcagcgtgtcgatgtcggtgccgcagaaggccaccgccgagtcgtccttgtcggccaattcgtagctcgtgcacgggccgccgatggcgtttaagttcaggtctttgccggcttccgtggatttccagaaatccgggtaagtcatcatcgagccgtcttcgcggtcgatcatgcccttggtgacggtgatgaccggcacgtccttgttcagcttcggcaggacttcttcagcgaaccaatcgacgccaaagctggaaacgccgccgaggatgacgtcagcgcctttgatcgcttcttccatttcttcgatctgatagtatttgatcccatcgtgaagggtgcgcttcaggttgatgtgataattgttttcgcggagtccgtcgatgacgtcgcggtcgaggggggtgccgacgaggcggacttcatgtccgttttcaaaggtcgggaatgtcagtgcagaagccatctgtccagcgccgataaaggttaaagttgccataaaattacctccaaaattactttatgatttttccaaaagattttccgaaaccgtgtcgtttgtggtcgtgtctttgttaactgtggctttattatatcggcaccaaatcggcgcgtcaatagattttggataaatttcttatattgggagaaatcccaaaacggtgaaacttgatgagcggatctgtgctaaaataagagcaaaaagccgaaaagaggacgcaaaatgaaagacaaggatccctacaaaatcaatttgattctccgggtggcaaagctgcgctacgagctgggcatgagccagatcgacatcgcccgccaggagcatttgtcgaaatcgacggtgagccggctcatcgcccaggctcaggagatgggcatggtgaaaatctcgatcgtcgagccgaagcacgcctttgtcgagctggaaaacgcgatggccgaggcctttggcctgaaccgggtgaccattctgcccgacgtagtgggcaaccgggacgtgctgcggaaggacgtgtgcgcggcgctggccgacgatttgagccgcgacgtccaggacggagacatcgtcggcgtggcctgggggcacacgatgtcggtgctggcgagcgtgctgccgaagcgcatcggcaaaaagggcatccggatcatccagctcaacggcgggctctcgaaggcgctgtacgacgccggggcggatcaaatcgtccgggccctggtgaactgctttgagggcgagggctacctgctgccggcaccggccctcgtggacacgccggacattgcggtgagcatcgagcgggattcgtcggtcagccggatcatccaaatggccgagcactgccggacggcgatctattcggtggggaccatcggccacggcaccgcgctgtatcaaatggggtatttttcggacgaagcctatcaggccattgaaaagaaatcggtgggcgacgtctgttcccatttcgtcgacgcccaggggcgcatcgccgatccgctgttagacgcccgggtcgtcgcgacgccgctgtcgaagattgtagcggttcccaataaaatggtggctgcggtgggcgtcgacaaggccccggcgattctggcggccctcaggggcggtatggtcgataagctgtacatcgaccagccggcggcagcggaggtcatgcggatggcatccgggcagaaataaaaaaagcggtcctatttcaggatcgcttctgcagttttgacgtcggcgtacaaatggctggccaggccgccctttaaggctgcgcgcagcaccttgccctttcgggggtcgctggcgatgaggagccggttggggatttggcggatggtgtcgagggcgacgccgacgacgcggcggtcgaggtcctcgtcaaacaggccgccgtcggcgttaagaaaatggccgcagcagtcgccgacgcagccatcggcggccattttcgcgtactgcacgtcgtcgatgatgcccatttcaaagatgacggagggccggccgaaggcgccggcggagtaaatcgcggtctggcagctctgggccatctgcatgatgttttgaatctgagaatcctttttgatcgcctgggcgatgtcggcggtgtcgacgatggcgggggccgggatcacgtaagcgtcgccgtcgacgctggccgcgaatttctgaaggatggacagggcactggtttcgtgggccaggcgggagtagccgccggtcagctgcagcaccgaaacgccccggcggtggagcttcggcagcatgcgggacagcgtttccagcgtggtgccccaggcgatgcccagcgtggtgtggtcgtcgatataccggggcaggtcggcgatcagcgcggagcagacgtcgttgagggtgatctgcgggttgtcgaccatcaccggcacgatggtcacgcgcttcaccggaaagcgcgaggtcagctcgtcttccaggtcagtgtacatcagggccggctctttgatgcggacctcgatgaggcccagatccttgcccattttgagcagccggctgaccgtcgacttgctgacgccctctttctctgcgatttgaacctgtcccatattgcattcgtagtagagcttagaaatgcggatgatttggttgatgcggtaggcgtctttttccatttcttttctcctttttcttgattttgcgcgttgtctgtttgttttcattatagccgaaaatgcggccaaatcgataaaaactttaaagaaggttaaaacgtgcaaaaattcccaaataatattgacaatttcccaaaaaccgtttacaatgggcttattcaaataaaacgattaaaggagaaagctatgggtattgttacactaatcggcgctggccagatggcttccgcgctgacgtttccgctgtttgaaaatgggaatgaagtccgcctggtcgggacaccgctggacggcgatgtgatcgccagactgcgcgaagacaactatcacatcaatctggaccggaccctgcacgaagggatcaaatattacaccgtcgatcaggtcgaagaagcgctggacggcgcggaattggtcgtctgcggggtgtcgagcttcggcgtcgattggttcttgaacaatatgttcaaattgattccggaaggggtgccggtgatttccgtcaccaaagggatgatcgacctgccggacggcacgctccaggtcttcccggaatactggcaggaacacatgccggaaggggtcaacgtggaactcttcgcgatcggcggcccgtgtaccgcccgcgatttgtctgatcacgatcactccttcgtcgcctactgcggcaaggatctcgaaaaactggaatggattcgtagccactttgaaacggattattaccacatcgcgctgacggacgacgtcgtcggcctcgaagcggcggtcgcgttgaagaacggctacgcccttggcaccgcgatggccatcgggctgaaaaaccgcctcggcgacgacggcatcgcccacgtcaactcgaagtccgcgctgttccagcagtccgtctgggaaatgtaccagctgttggacatcgtcggcggcaatcagaaaatgatcatgtacgcggccggcgacttagacgtcaccgtggccggcggacgcagccgcaaggtcgggcagtacctcggcgaaggctactcgatgccggaaatcgaagaaaaactggcggggcagaccctcgaagcggtggtcatcgcgacgagaacagcccgcgcggtcaaggcgatggccaaggccggcaaggtcaaggaatcggatttcccgcttttgatgcacgtggatcaatgcctgaaccacggcgcaaaggtcgatatcccgtggaaggatttccagaccatcacccgcgacgcgctcaaataatagtgagcagaattgcataaaatttaataaaaaacatgccgggtaaacggaagggggagccgtttacccagacaggcggagtcctcccaaacgaataaggagatacacagatgaaatacgtattgggactggatttggggacgagcagcatcaaaacggtgctgtttgaccaaaatggcaaagaagtggcgcagcgcagcgtggaatatccggtgtatcagccgcacaacggctggtccgaacaggatccggacgactggtacgaagcgggggtcacgacgatccgctactgcctcgacatttcgggggtggccggcgaagacgtcgtcgccatcggcatcgccgggcagatgatgggcgcggtccttctggacagcaagggccagccgctgcgccgggccattctctggaacgacgcgagaacgtcggaagcggcggaatcggttagaaagctcatcggcgacgacacgatgatgcgcatcaactgcaacccggtgcgcccgggcctgaccgcggcgaagatccagtgggtcaaagaaaacgaaccggacatctgggccaagacggcgcacattctgttgccgaaggactacctgcgctaccgcctgaccggcgaatacgcaacagaagtgtccgatgcctccgcgatgcagctgctcgacgtgcgcaaccgctgttggtcgcctgaactcctcgccgcgatggaaatcaaggaatctcagctgggtaagatgtacgaatccaccgacgtgaccggtcagctgaccaaggacgtcgccgggctcctcggcctgccggaaaagaccattgtcgtcggcggggctggggataacgcggccggcgccgtcggcacgggcgttgtcgcccagggccgcgcgatgacgaccatcggcacctcgggcacggttttcgcttactgcgacgaaccgatgatggacgaaaaggccagagtgtacaccttctgtatggcggtgccgggcgcctggcacttcatgggctcggtcaactcggcgggcaactccctgaaatggtaccgcaacaccttctatccgtccgataaggaatacgaacagatcaacaaggacgccctcaaatccgcgccgggcgccaacaatttgatctacatgccttatctgaccggcgaacagtcaccccatttcgatttgaaatgccgcgctggctttgtcggcttgtccgcgacccacaccatctgcgatgtgacccgcgccgtcatggaagggatcacctacgcgatgcgcgacgtgctcgaagccattcgcgaatcgggcgtccatccggatgtgatgcgcctttgcggcggcggttctaagagcccgttctggcgtcagctctgtgccgacatttacaacctgccggtggtactgccggatatgaactcggccaactcgacggccctcggcggcgcaattttggcgatggtcggcgccggcatgtacgacactgtcgaagaagcctgcgacaagatcatcaagatgcgcgacgaatccttcacaccggatccggcaacccgcgaagtctacgacaagacctacgccgccttcgacaagctgtacccgcagctgaaggacaacttcgcagaaattctcgacatctaaacatcccagtacacctgtaatgtaagctcaatttttctcttcataaataaacaacacatgacaagatcaaaaaaggcaaagcccctcggtccttccggatcggggggcttttgcctgtgtcatttaaggcatttgaattaatagtttagttgtgttaatattataaagtatattttgctaatctgttagtaaaaataaactatagaagggaatgagagagcggtgcttcgattggaacacgttcagaaacggtttaaggacaaggtggtcatcaaggacttgtccttagaggtgcacgacggagagcttttggtgctgatcggcccgagcggatgcggcaaaaccacgacgctgaaaatgatgaaccggctgctgcccctttccggcgggcacatttacgtcgacggcgaggacatcgccgccttggacccggtgaagctcaggcgcaacatgggctacgtgattcagcagggcggattgtttccccacatgacggtgcggcagaacatcgaaatcatcgaaaagctggaaaagcggccgaaggacgaaatgacggaacggacacggtcgctgatggccatgatcggcctggaccccgaggagtatttggaccgctacccggcggaattgtccggcggccagcagcagcgcgtcggggtggcccgggcgctggcgaccgaccccgaatacgtgctgttcgacgagcccttttcagccctcgacccgccgacgcggatggcccttcaggacgaggtggtcagcctccacgagaagctgaacaagacgatgatcttcgtgacccacgacatggacgaggcgatcaaaatcgcagaccgcatctgcctgatgaaagacggcgagatcgtccagctggacacgtcggagaacatcctgcgccatccggccaacgccttcgtctcggaattcgtcggaagcgggcggatctggagcgcaccggaatttatccgcgcccaggatatcatgatcgatcacccggtcaaatgccggggcgatttaacggtagagggctgtatcatccgcctccaggaatatcgggtcagctcgctgatggtggtggacaaggccgggcgtttgatcggcgtcgtcgacaagagcgtgctcatcaagcggccgaagccggacgcacaggcagacgcggtgatgcggccggtgcgcttcagcgtgcaccccgaggatcagctgatcgacatcgtcaaagcgatcccgccggaggacgtcgggcggatcaacgacatcccagtcgtggacagcgagaaccggctcgtcggcctcgtcaccaacaacaatatcgtgtcgaaattcattcggccctggctcgccgacacagaggccgatgaagaagggcgggtgacagctgatgattaaattgtggatgtacatggttgaccacggccaggaaatcggtcggctgacagtggaacacatcgagatgacggccatcgccgtcggcatcgcgattttaatcggcgtgcccctgggcattctgatcagttacgtcaaaaagctggacaagcccattatcggcgcggcgaacgtggtgcaggcgatcccgagcatggccctccttgggctgatgattccccttttgggcatcggccagaagccggcgatcgtgatggtcatcatttattcgctgctgccgatcatcaaaaatacctacatcggtatcgcggacatcgatccgcagaccatcgagtcggcgaagggcatcggcatgagccggggccagattttaagaaaggtgcagctgccgctggccctgccggtgatcatggccggggtgcggatttccgcggtcaccgccgtcggcctgatgacgatgggcgcctttatcggggcgagcggcctcggctacatgatcttttcagggatccggacggtcaacaattatcagattctcgccggcgccattcccgcctgtgtgctggcgctgatcgtcgactggctgatggggctggtggaaaagctcgtgacgcccatcagcctccagaaggatttcggcacggaccggaaagtactgcgccggaagcggaaacatcagaaaatcattttaatcaccgcggcctgtttaatcggcacggcgatcgtcggcagcgcggtgagctcgcgggcagcgtcgaagggccaaatcgtgatcggcagcaaggattacacggagcagctggtgctctgtcatatttattcggattatattgaggcacatacaaatctgaaatgcgtgcccaaggaaaacctcggcggcacccaggtctgctacgaagcgctgaaaagcggaaagatcgacatgtacgtcgattataccgggacgctgtacggcgacattttaaagaaaagcggcgagaccgatatggatcgggtctaccagatctgtaaaaagaatctgaagccccagagcattacgctgatgcaccaatgcgcgttcaacaacacctacaccctgtcggtgctgccggagacggctcagaaatacaacctgcacaccattggggacgtggcggccaaatctgggcagctgcgcctcggcacgacactggaatttttaaaccgcaacgattgcctaaaggccctcgagcggcagtatccggggattcatttcgctaagcagtccggcatcgacagctcgccgcggtacacggcgattcaaaaccacgagatcgacgtgaccgacgcctttgccactgacgggatgctgaagaaataccatttgacggtgatgaaggacacggaccacgtcttcccgccctattacgcggtgccctgcgtgaagacgacaacccttcagaaatatccggaactcaaaaaggcgattaacgcgctggcgcctcacctcaccgaaaagcggatgcgccagatgaattacgaggtggacgtcaagggaagagaccctgccgaggtagcacgggatttcctcaatcgggaggggttactcaagtaaaaaaataaagaccagacaaatcgaaacttgtctggtttttttgatacgctgagaggggaattaagcaggactggcctgcgtcttcgtttcgaggcggcgctttttgtagagaatccgaatcgagttgagcacgcagagcatggcgacgccggtgtcggcgaaaaccgcgaaccacatattggcgaagccgaggagcccgaggatcatgacggcggccttgactgacagcgcgaaaatgatgttggcccaagagacccgtttggtctgggcggcgatgtcgagagcggtcgggatcgcgtcgaggtccgaattcataaagacgacgtcggccgcttcgatggcggcgtccgcgccgctgcccatggccgcaccgacgtcagccccggcgagtaccggcgcgtcgttgataccgtcgccgacgaacatcgcgctgcccttttgttcgcggatctgtttgagggctgcgagcttgtcttccggcagcagcttggcgtacacggtgtcgatgccggtcttttcagccacggccttggcgttggcttccgtgtcgccggtgagcatcacggtggtgaggccggcctgcttgattcggccgatggcgtcggccgcttcgcgcttgatggtgtcggcgatgacgatcgttccggcaaaggtgccgtccaccgcgacgtaaaccggggtgccgtaggcggtgtccgccggcacatttggaatgccgtttgcggccatcagctttgcgttgccgacgaggacggtctgcccgtcgatgtcggcggtgaggccctgccctgccgtttcgacgacgccggcggccgaggcgatgtccagatcgtcgtgcttcgcgcgctggacgatgctcatgccgatcgggtggttggagtgggcttcagccgcggcggtcagcgcgaggagttcactttcgctcatgccgtttgccggcgtgacggactgcactacgaaattgccttcggtgatcgtgccggttttgtcgaagacgacgtttttcactgtgtccatagattccagcgcgagcccgcccttaaaaaggatgccgagcttcgacccggcgccgatgccggagaaataggcgaggggcaccgagagcaccagcgcgcaggggcaggagatgacgaggaaggacagcgcggtgtaaatccatttgctccagctcgccccgccgagtaacggcggcagcacagcggtgccgatggcgacgaacacgacgaaaggcgtgtagtatttcgagaagcggctgatgaaccggtccatcttcggtttggaggccgccgcgttttcgacggcgtcgagaatccgggtgaccatcgaatcgctcaaaggcttgtcgacccgcagggtcagcgtgccggcggtgttgacacagcccgagacgacttcgtccccggccttgacggcaaccggcaccggttcgccggtaaccggcgaggtgtcaatttgggaatggccttcgacgacggtgccgtccagcgggatgcggtctccggcgtggacgaggaccagatcgccgactttggcgtcttcagaagggatgacttcggtcttgccgtcttctgtgaccagatgcaccacttcaggtcttaaatccgcagcttccatgatttgggagcggctgcgttccgtggctttgtcttcgaaaaattctccgatgcggtagaacagcatgacgccgacggcctcaggccattggtggatcgcgaaggccccgagggtcgcgaccgccattaaaaagtgttcgtcgaagaactgccccttgatgagcattcggatcgcgacggcgacaatcggcaggccgatcacggcgtaggcgccgaggtaaaagccgatccagagcgaggaggaaaagcccgtgtgctcgaacacttcgccgcaggcgaagagaatcgcgccgaggatcagctgaattttcgaatagccttcgccgaagaaccattcggaaagtccaacagctttcgattcttcttcctgcgcgtgatgggcgtggcgttcggcgatggtgcagccgggttcgagacggtcggccaccgtgttgaggatgccgaggaaacggtccgggtccttcgctctgacctggacgacgccagcggtgaaagagatcgacacggcttcgagcccttcgatctggcgcacgccgcgttcgaccttggccgcgcagtccgcgcagtcgagcccctgaatgctgtagagcttggtcgtcgcctcctgaggcgggcaggtgcagcggtccatcggctgactgcatttcgagcaggtgatgtggtgagctgttaagtcggaaggattcagctcagccgcttcgtgatcgtggtgatgatcgtgatcgcagcaacagtgttcatcgtggtgatcgtgttcgtggccgcagtggtcatgatcgtgatgatgtgcatggtgatcgtggcagcaggatgcgccatgttcagctggtgaattttctttaaaggccataatggttctccttaaaataaactacaacgtaataatatatgaatatatgttcatatatcaataatacaagcatcccatcgatttgtcaagaagtatgagcagaaaattaaaaaaactaacaaattttgcttttatttttttaaagaaagttttggtaaaattaaatgcattaaaagccagaaaggacagatggtctatgaccaaactcaacctcaagcattttcaaagtttaaaccgaattcaaaagcagcgtcaagcggctcaaaagcctgaccctgcggcccctcaagcgccgcagcccgcacaggacgccgccgaagcgtcggacgcagcagaagaaaaaagtcaaaacgccgcatttggagaagaacaggccagcaaaaatatgacccggcagcagcgggtgtatcgcgatatggccaaacgcgccgaaaggatccgcgcccagcgcgcccgcgacgaacgggagcagcggcagaagcgccaaatggaggagcgcgagcgcaccttcgagactcggaaaaagtctcagatcgcggcgcagcatcggcaaaaaaataagacccgttgacgacgatcaacggatctttttttgttggcgcggacaaaacaatcagatgacgaaattcagtggcgcgttctgggccgtgtggtccagaatatcctgaagggtgatgccctcgaggtaatcggtgatttgtttgtagaggcccttccagactggcagggtttggcattcggcggcgcgttcgcatccaggcgggtcgtattcgaggcaggcaatgggcgcgagggagccctcggtctgctttaaaatatccgcgacggtgcattcgcttggggccttggccagctggtagccgccgttgggaccgcggctggccttcagcaggcccgaaccgtggagcaggatgacaatttgttcaaggtattttttcgaaatgttttgacgggcggcgatgtccttcagcgcgatgtagccctcgccgctgtgttccgcgaggtcggtcagcatgcgcagggcgtaccgtccctttgttgatattttcatctgatcacctttctctgcgatcacttcgcaagtgttagaatgtttaccattattatatgattttctgagcgaataagcaaatttcattttacatacccgagaaatttatacaatgtttatattttgattacgatttatttaaaggcgttgtctatactgttttttaatcaatgatcttttaagggatcaataaagaggagaacaattcaaagatgttgacgctatttggacacattgcgcggcggagtctcgccattgcggttttaatttgctacgcttatcagctccggtatttcatcgcgtcccattggaaaagcaggaaagtccacgacgctggaccccttagggattacgctgtgctcattgccgcgcgcaacgaagcggctgtcattgcggcgctgatccaaagcgtgaagcatcaaagctatcccgcctcccatctggacgtcatcgtggtggccgacaactgcaccgacgacacggcggacattgcgagagaagcaggggccgtcgtgtacgaacgctccaataggcagctggtcggcaagggctacgccctggggtggctgtttagacaattggaaagcgatcacagaagctacgacggttattttattttcgatgcggacaatcttttggacgaaaactttgtactggaaatgcacaaggtgcacaacgcgggctaccccattgtgaccggctatcgcaattcgaaaaatttcggagataactggatttcgtcggggtacgccctgtggtttctccacgaatcccagctgctcaaccgcggccggatgcactcccggaccagctgcatggtctctggaaccggctacttgatcagccaggacctgctcgaacgcctgggtggctggcattttttccttttaaccgaggatattcagctcaccgcggaatgtatcgtgagaggtgaaaaaatcgggtacgccgaacgggccgtgttttacgacgaacagcccacccatttcatggattcggttcaccagcggctgcgctggatcaagggctattttcaggtcttcaaaatttacggggaaccactcattggccgtcttggcaagtcaggtggatttgccgccttcgacatgctgatgagctacctgccggccttctttgtgatgctcgcggcgatggccatgggggtggggatgatggcgcttaacatcgcggcagccgggaatatctcagaagccctcacgtccattggcctgtttgcctttaagtccacgattgtcatctttgcgcttggcgtctacacgatgatttcagaacacaaacaaatctatatgcccattagaaaaaagatctggtgctgtctgaccttctcgatctttatgtttacctacgggcccatcgccatcgccgctttgtttaaacaggtcaattggacgccggtcccgcatcacgtggacacctccatctctgccattaagcggcagcagaatgtaaaagcttaagcatgagaaaaagttttctattatatacgtaaaaaatgaatcagttgacgcatcagctcttgtggcgaaattcgattcggcagaacagtgtaaaggcattgttctgtttttttgtaaaaaaatcaaaaaaatttgaaaaagttcttgacaagaatgtaaagtccgcgtataattaattacgctctcatcgagagagagtaattatcagctcggttgtgaaagttttttaaaaaacttcaaaaaagttcttgacaagaacgaagagagctggtaaaataaagaagttgtcgcttgaagcgacagcaggtcatagaaaagagaatagtaccataaaacctggaaaacaggttcttgcgttgcttcgaattaaaccacatgctccagacttctgttgcgggtccccgtcaattccttatgagtttcaacctttgcggtcgtactccccaggcggaatacttatgtgtaactgtgccaacttgacataaatgccaaccacctagtattcaatcgtttacggcatggctaccagggtatctaatcctgttcgctccccatgactttccgcacctcagcgtccagtatactgcccatcaagccgccttcgccccgggtgttcttcctaatatctacgcatttccaccgctacacatagattccgcttgcccttttcagtactcaagtcttacagttcaaatgcaccgtccaggttgagccggtaccatccttccatccggactaatataaaccgcactacgcgcctctcgtgtagacgcccagtgatttccggaacaaacgctcgttcccttacgtattaaccaccgcggactctggcacgttaattagccgggacttcctcattgggtaccgtcacttcttcttccccaaaacagaagcttacgatccgaaaaccttcttcactcacgcggtattgctgcgtcagggttgcccccatttgcgcaatattccccactgctgcctcccgtaggagtctggaccgtgtctcagttccccagtgtggccgttcgccctctcagaaccggctacctaacgtcgccttggtgagccgttggcccttcaccaaccagctaataggaccgggccccatctttcggcaccggagtttttgattatctcttcatgcgaaaaataatgttatgcggctttactccgggttcccgaggctattccgctccgaaaggcaggctgcccacgcgttactcacccgttcgccactatccaacttcttaaatcccgaaggatcattaacaagctctcgttcgaccttgccatgtgttaagcataccgccagcagttcgtcctgagccaggatcaaactctcaagtaaaatttacccgacagctttcgctgtttttagttctatctggttgctttgtttatccacagtctgctctgtgcttcgatttgaaagcagttctcactgctccggaattaaagtttttt

SEQ ID NO: 14 - DNA, 979090 bp, Unknown
  Metagenome-assembled genome
ggcacttgtctcgacacaacacccggtgaaattgtagtactacgtgaagatgcgagttacccgcacacgacggaaataccccgtaagcttaactgtagtctggcatggatttcgatatgtcatgtacaggataggtgggaggctgagaagttgttgcgtcagcatagctggagccgatgttgggataccacccctgagatattgaattctacaaagtctgtgaaaccagtcttcggacagtgtcagatgggcgtttgactgggcggtgcccctcctaaaatgtatcggagacgcctattaccctcatgatggttggaatcatcaataagagtgcaaaggcaagggtgattgactcgagacagacatgtcagcaggacgaaagtcgagcttagtgatccggtggtaccgagtgagggaggccatctctacacggataagctacctcggaataacagcttatctcccccaaagtccaactcgacggggaggtttggcaccctcgatgtcggctcgtctcatcctggctagcaggtcccaagggttgggcttttcgcccattaaagaggcacgcgagctgggtttcagaacgtcgtgagacatttcggtccctatcgtcgtgggcgttagaattttgagaactgttcctatacgagagtaccggaacacggacctctggtgcagaccggttgttccgccaggagcacagccgggtagccaagtccgggagagataattgctgaaagcatctaagcacgaagccccccttaagataagatatctcatcccttaaagggagtaaggccactgatagacgatcaggtgataggctggaggtgaaagcacagcaatgtgttcagctgaccagtactaatcggccgaggtcttgatccaagacgtgttaagcgctagaaactctatgttgttttgagtgacctcaaacaattgaataaacaatctaatttagttaaaattggtttcgtgactatagcagagaggacacacctgttcccatcccgaacacagaagttaagctctcttacgtcgaaagtacttggcgggcagctgcctgggaggatagatcgttgcgaggcctttttttattgcgtaaattctatgatttatttataataataaaatacgttgatatctcatatatatagaaaataaaaaaaggaaatcgtatgttacctgtagaacgaagaaaagaaatcctcaatactttattagaagaagggactgtaaaagtcagccaattagctgaaaaatatggtgtcggtgtgccgacaatacgaagagatttgaaagctcttgaaggtcagtgtggtgtgcaactgatgtacggcggcgcatatattgatggcagtattgcaaatgaaaatgcaattgagcttcaattggcacaaaaacaagtcgaacacattgaggaaaaacggatcattgccgaaaaagctgcagaacttgttcacgatggtgatacgattgcgctaaattcgggaagtactgttgaatttatgcttgattttcttcaagataaaaagaatattactattttgactttgtcagtgaatgtggcagttcgcgctacaacgatgcctgaaattacagtctatatgccgggtggaaagcttaggaatatttcaggtgcgtttgtcggaacatacacgaatgattttattaaattattcaatattgacaaagcttttttaggggttatggcggtttccttaaaaaagggcgtcacacatagttctttagaagaaattgaaactaataagacactagcaagtgtcagtgagcattgctatttagttgcagattattcaaaatttgataaaatagccatgtctaaaatgtttgatctcagtttatttgacgcttttatcattgatgataaaattccccaaaaatatatagattatgcacaaaacaatcacataaaaatcatttaattctcaataatgagtcggtgacggctctttttttatgcgaatatattaactttatatttatataatgccaatattatattgacatatcgaataaaaagacatataattttgataaaatattactataaacaaacaacaaaggggaggttgttatgaaaaggtatattttagtgattgatgaaggaacaacaggtacacgtgcattaatatttgataaatcatttaaaattgtttctgaaagctattgtgaatttacgcaatacacaccagctgaagacaaaattgaacatgatgcaatggaaatttacacaaaatctattgggatgtgcagaaatgcgatggcggcaaagaatataaatgccgaagaaattgctgcgatcggcatcactaatcagagagcgacttgcgttgtttggaacaagcatacgggtgaaccttatcaccgcgcgatcgtttggcaagacgttcggactgccgcagaatgtgacaagatcaatcagacggaatggggaaagaaagccttccaggcgacaggatggacagttgctccagtttacacatcgatgatgattcagtggtacatgcataacataccagaaattaaggaagcgatcgaaaaaggcgatgctgtgattggaacgattgatacctggctgatctggaaattgacaggtggcaaaactcacgcggttagttattcaaatgcgtcggttatgggaagttacgatctctacaatgactgctggtatcaggaatttttggattatctcaggattccagttcatatttttccagaagtcagaccggattcgggagattttggcgtgacagacaaaaatatctttggagcagaaattccaatcaccggggacattgctgatcaacacgcggcattgttcgcccaggggtgcagaagtggaggaaccggcaaaattacaaatgggacaggatcttttctcgacatcaatattggcaatgaattggtcatttctgacgaaggactaaacacagttattgcttggcagataaatggtgaaaccagctacgctttagaagggtacgaagccgtgaccggctctgcaatccaatggttgagagatgggcttaaaattatcgaatcgtctccggaaactgaaaaaatggcttatgcggtgaaagatgcaaatggcgtttattttgttccagcattggcgggactaagcgcgccttatcacgatccatttacgagaggaactattttcggaatcacaagagggacgaagcgtgaacacattgctcgagcgacgctcgaaggcattgtttaccgtttgaaagatattttgaatgcggtcgaaaaagaatccggcataaagatgaaaaatcttcgaatcgacggcggtgcttcggaaaataattatttagcacagtttttaactgatatgctcaatgtcacggttgaccgtccactttcggttgaagcgacaagtctgggtgcggcagaaatggctggattggctgttggattttggactatgaaagatatggaaaatgcactgcagattgaaaaatctttcacacctgaaatggaagaatccgaacgtgaaaaacgttatgcagaatggtcggatgccattcgccgttcgattggctgggcaaagggcaaaagtgtttaaaaatgaggcaaaaggatggaacaggcaattaatgaattttacaatcaagtcaaaagaacgtgcggcgatgaagtggccgaacatgttcaaatagagattgataaacgaaatgtcgtcaagcttacaggtgaagttcatacatggcaggatgtcgttgatatcggacatattgcaggcagactttccggaacaaagggtgtagtcaatagtatcaagacgccggaatttcaaaaaatgccaaatgattatccggctgcagaaaagacgggtcgagaaaaaggcataattggaaaatatgatattgtcatcataggcggcggtatcactggcgcatctatcgcccgaaccctctcaaaatacaacaaaagtattgtcgttttagaaaaaaagaacgacgtctgtgaaggcgcatcaaaggcgaataacggaatgatccattcgggttatgattcaaaaacaggttctttgaaacagagaatgtgcgtcaaaggcaacgcaatgtacacgcagtggtcgaaagaattggatttcaaattcaatcgctgcggttcctttgttgttgcgtttgatgaagaagatgaagaatatctgaatcaattctacgaacgcggaaaagccaatggtgtgcctggaattgaaatcctagacggcgatgaagcccgaaaaatcgagccattaatcagtccagaagtgacaaaagcgctatggacaccgtcggcgggatatattgaaacttacgaagttgtattggcgctgatggaaaatgctattgacaacggcgtgaaattgatgactgaaacagaagttgcagcgatcgatacagaaagtcaaaaagcgacgcaggtcatcaccaataaaggcgttattcaagcgggatgcgttatcaatgcggcaggtatttacgcggacgatattgcggaaatggtggatgaccgattctatacactgcacaaccgcagggggacgttggttttgatggatcggaagaagcgttcattttcacccaaatgttttgttgggaccgcgccaaagaattttacaaaaggcggcggaccaatgacgacgccggacggaaatccgttctggggaccgtcagcgattgaagtagcgaacaaggaagatgtcggcgtttctcctcaggacatccagtttgtcatggaaaaaggaaaacatttgtcccctgggattaatgaaaaagatattattcgattcttctcgggcgctcgtccggcgaattacattgaagattttatcattgaaccgtcggaaaaaattgacaattttattcacgtggccggcattcaatctccaggtgttgcatcagcgcctgcagttggagaatatacagaacaaatttatttaaatttattccctaatacgaaacgaaaagagaactggaatccgattcggaaaaaacaaaagccttttagagaatgcacacaggaagaaagagaccagcttatcaaagaagatccgaaatacggccatatcatctgtcgatgtgaaactgttactgaagcggaaattattcgtgcgattcacggcaaggtgccggcgacgaccgttgatgcggtgaagcggcgaacccgcgcaggcatgggacgatgccaggctggcttctgcgggccgcgcgttgttgaaattttagccagagaattgggtgtcgattcattagagattactaaaaatggcggagattctcgcatacttgtttcaaaatcgagaaaggagccagaaaaatgattgaaaaaaaagtcgattgtgttgttatcggcggcggaccggctggtctggcagcggcaattgaagccgacaaacagggattggacaccttaattattgaaagagacgtgactctcggtgggattctacaacagtgtattcacgatggatttggacttgatcgcttcaaaaaaagaatgactggcgggcagtacgctcagcgttttatcgatgtcatcaaagaacgcaagatcaatgtcttattaaatacgatggttctggacattactccctcgaaagaaatatacgcatcaagtccagacgaaggtatgctccatatcaatgcaaaaagcattattctcgcgatgggctgtcgcgagcggacccgttctcaggttttgatttacggtgaccgtcctgccggtgttttaaccgcaggcgcagtgcagcgttatataaatatggaaggttacctgccgggcaagaaagcagtgatcctcgggtccggcgatattggcttaatcatggcgcgccgtatgactctcgaaggcatcaaagttgaaggcgtctacgaaatcatgcaccgtcagaacggtttaacgcgaaatgtcgttcaatgcctaaaggattacaacattccacttcatttaggaacgacggttaagtccattcatgacaaaaaaaggattcacagtgtcactgtcgtcgaggttgataagaacctaaaagaaattccgggaacagaaagagacatcgattgtgatttgcttgttttgtcagtcggtttaatcccagaaaatgaattgagtgaaaaggcacaaattgagattgatcctgtgacaaaaggaccaattgtcgacagcgatatgatgacttcaattccaggaatttttgctgcaggaaatgttgcgactgtttttgatctggtcgattatgtgtcgcaaagcggagaaattgcagccagaggggcagcgaaatacgtaaagcatccgaaagaagaaaacatcgaaactattgatgtgcatccaggcaataatgtcgcctttgtttttccgcaaaaaattcgaaaaaaaatggaatcagaaacatttcctattttcatgcgagtaaagaatgaagcgtgcaatgttgcaacctatcttgaacaaggcggcaacaaaattaaaatcaaaaaacatctgattgtcaaaccgccagaaatgattcgtgaaatattgaaaacaaatcagctggatctatcatcggatttgacaattcatgcgggagaataacgatgaaagaagaagaatacacttgtatcgtctgtcccagaagctgtttgggcaagttgattatcgaagatgacggaacaatgaaaacggaaggattttcgtgtaaaaacggcgaaaggtacgcgatcgatgaacataccgatccgaaacgggttttaacgacaacggtcaaaattgagggcgcattgtttccacttttgccggtggtcagttcagaagcaattagcttttcaaaattaaaagattgtttgaagtatttgtatcagattaaagttaaaacaccggttagggaaggcgacgttctggttgacgatatattggataccggcgtcagtattctcgcagcgcgaacaatgctttaaaggataaataaaatgaagaaagagaatataaaagaatttttaaaacaactgaaggcacaatgtcctgatgttgaaattgttcaggaaaaagaagaaaggctgatttacgcacacggatgttatccggttgaatataaatggattttacaagggccttataaatatctgccattagcaattgtcagaccaaattcgacacaagatgtcagtatcattatggcgctgtctgatcgatacgatatttcagttatcccctacggaggtgggtcgggaatcgtcggcggcacaattccggatcatgaagaaatcatgatagacatgaagaaattacgctcttttgaaattaatccaatcgactgcacagcaaccggcggtgcaggatggaccggcgctgaatttgaaaatatgctgaatgaacatggattcacgagcggacattatccgcagtcttttcaaagtgctgtgttgggcggtatggtttctactcgggcaattggcaccttttcgacgaaatacgggaaaatggatgatatggtcaactctctcgaagtggttcttccgaacggacatatcgttcagactcaccgtacaccaaaggcttcaacaggaccagaacttgatcagctgtttttaggagcggaaggggtgtatggattagttacaaaagtcgagatgaaaatatatcctatggctgagaaacgttatttcgaagcgtatactttctcgaaaacagaagatgcgctggaagctattcgtcagtttgtacaaaacggtgtacatccagcagttgttcgcgtttatgacgaagaagaggccattccgaagattgaaaaatacggctatgaacctggtcaagtgtttgttgtgttcggctatgaagggttaaaggaaattgtcgatctggaagtcaagttagttaagcgatatgctgaagctagcaacggcgtctgtagaggaccgaaaccagggaacgactggtttaagacccgtttttcaacgaagaaaatgctcgattacgacgcaatcaagggtggaacggctgatgcaatcgaagttgcagcgccttgggattcgatagttaatgtttggcgtgaaatgagaaaagcccttgaaccgctgtgtgaaagtgttgattgccacttctcgcatgtctatcacactggcgcttctgtttatgtcatcttccatgcaaagacaaatggtgatgatttcgacggcgaaaagcgttatcgtgaatgtttagataccgcgattcggacgagtgtggcaaacggtgggaatgtttctcatcaccatggcagcggtaaagcaaaagccaaatatctcgtgctggaacatggtgaaggcggaatagaagtgatgcagaaaatcaaagatgccctggatccaaaagggcttgtcaataaaggagtcttgggactatgagagcatatacattgaaaaattacgaagatgaactgaatcatcaggtgattcatatggaccaagcagtctgctattgtccagaataccttgcgacaggttgcatgcatgattatccgtctcgaaaaatgcaattggcaagagcggttgcaaaaggtgagttgccattatcagatcgaatcggtgaaattgttttttcatctatactatctcgacagggtgaacgttggcagaacttcagagaaaatccggaaaatatgacagatgtaatgattcttagcagaggcatgctgcgggaaaaagggtttaaatacgctggagaagaagagctgaatcaaactttaaataaatataatggccatgtatgtgaagtaactccatggaatcttcccaaggattctgggagtaaacaagcgattttaattgatgatctcgctgcgaaaggttttaaagaaagcgaaaaagttttagataattatttaaaacaaaatagcatcacttttgtcaatgacgcgaagccagtttttgttgggtttgaatattttgcatgcggtatgattcgggaaggcaaggaacaaattcaaaaagttattgatgaatttgaaaattatggtgttgacactgtatgcgttatttctgctcaggcgaaatacatgttgacacagtttgtaaaaaaactcaatatccaccccaaatttgaggttaaatatttggcagattgcatgaattcgatactgacgacagaaccggtctatgtttacggcggcagttttaatttgcgttatctgtgtaatgcagagcaattaaacactcttgtaccgaatcaaaaggaagaacgaattaagaattctatcgaatttatcccacttttaaaaggagaccatcgtgtgaacgagcttacgatttggcagaaacctttaagtgcagaatacacattatttggcatggatgaagatgtcatcaagaagattgaagccgatgcaattgaagatattaaaaaagccaatccgcaaagtattatttcgtttgaaccatcatcaatgcagattttgcgtaaatatttccctaatatcaaagtagcaggttatttagatttcctgtaaaattagaataaatgaaaatgtgattgtttaatttagataacgcagttaatgctcatcataaaacaattcaaaagcaagttaaatcaagcagagcggcaccccgctctgttttttgctataataaaaacaaaatgattgaaccttagggggaaagacgatgaagggtcatgttcgagcacagatgaaccgatttgcaaaatggctggtggtgttgattgggctgttggccctattgggcgcggcatccccggttttggcgaaaagcgcgagcaaggccaagaccctccgcgtgatttacaccactcgagttgacggacagatgaacagcgacgcgaagggccggggcggtgcggcgaagctggcggcgttgatcaaggccaaccggacggacaacacgatcgtggtcgatggcggtggctttggaaatgggctgctcaacgcggcggtctacggcgaagtgggcgatccctggagtttgatggggacgatgggctacgacgccgcccttcagacaaatgacaatcggttcgccgcatattcgaagcaggccaaggcggtgaagacgcagaagaatcaagcgccgaaaatcgtcagccgaagtgcgccgtcggcgctcgagaaacagaccgagcgcatcgctgttttcaacaagggcggcatcaaagttggcgtgatggccctttcttcaggaggcagtttctggacaacggcacagcaggcgcgccaggatatcgcccgtctcaaggacaatcattgtgacgtgatcgtcgcgctttccgacctcacggacagccaaaacaaaaccatcgcccggctcaaccaccgcatcaacatcatcgtcgacggccggagcggacgggaaatcgacgatccgattaccgctggaaaggctgcgatcgtctcagcagggaaaaacgggacgcagatcggcgtgatggattaccgcgtcgacgcgcaggaggtcaaaactgacgggctgattccaatgggcgccaatgtcaagaacgatcaggatacggccgatcaggtggggcagatttcggccgcgctcacgcagcagatcgatccgtccaaggtgctggctgtgagccagcaggatttcacctcgaaaaaaacgagaacgaaaaaattcgctgacaacgacaccggcaatctggtctcagacgcctacgcggcccaggcagacggcgcggtcggcgtggtggcagaatcctctctcaaggacgggctggccctcggcgatgtgacggtccaaaacgtcgtcgacctgttttcgagaaacagcgggcgcctcgtgaagctgacggtttccggcgagacccttcgggatttctgtgaggttgacgcgacaatcggctacctcgcgacagggcggcagctgtatttttccggcctcacctatgactacgcgcccagccgcacgccctttaaccgcgtgacccaggtgcgggtgaaggcagacggcaagtggcaggcggtgcgggccaaccgtcattatacggtgatcacggaccagggcacagttcaggtgcttgaagcggcgccgatgaaaatcgcggtcaaaaagcagaagattcagagcaccctcggctggcaggcagtggtgtccgccgtcggcagccagagcaaggacggcgcggccgatttgtcagccaactacgtcgtgacgcgaaacgccaaaaaggcggttcagattcgaacggtgggcgcttactttaaaaatccgtcccgtttcggcgtattgacgtattgcgtggcaattgttgtgctcgcgctgatcgtcagcgtcatcatttcgaggcagatgaaaaaacaaaacggcttgacccggcgcggccagcgtgggcggaagctataaagcggatgtgtacagccagttgaaatttcaaattgatgaaaacgaaatttcagctggctttttttgcgattgatcggaagaaatagacattttgtggtatgataataatgacattgaaaacgagtagcaaacataaaaataggggggataggaggaccttatttatgggagtggcaatttttctcatttgttttccgctgatcgtcgcgccgatcatgtacctgattcgaaacgataaggtgcgcggccgggtgacctacgtctgtggggcagtgatcacggcggcggcgctgtgcctgacggtccgctggtgcgccggcggcatgcaggtcatcaaagcctacgacccggcggaatggatcgatcatttgattctagccggcgaaatcgtgttggcggtcatcgtgacgattttgtgttttaaataccacaggggcatcatcagcctgctggccatcgtgccgacggggatgatcacctatctggaattaaaggggccggcgcttgctgaggtcaacgccatttacgtcgaccatctgtcgattttgatgtgtctgatcgtcgggatcatcggcgtgctcatcgtcgtttacgcggtgggctatatggaaggctaccacgaacatcacaccgaattcgtcaaccggaaaaattattttttcatggttctttttctctttttgggcgcgatgttcggctttgtgctgtcgtcgagcctgctctggatcgatttgttctgggaaatcacctcggtttgttcgttcctgctcatcggctacacgaaaaccgatgaggcgatcaccaactcgttccgcgcgctgtggatgaatctcctcggcgggacggcgctggctgttggcatcgtctatctggcttatcgcggaggcaacgtgtcgctgcagtatttgatcagcctcggcacggccggcagggtcatcgctattattccgatcgcgctgattgcctttgcggcgctgacaaaagcggcgcagctgcccttctcgacgtggctgatgggcgcgatggtcgcaccgacgccgtcgtctgcactgctgcacagcgcgacgatggtcaaggccggcatctacatgctgtttcggctggcgccggcgatgccggggacgacgacggggatgatggtgtccctggtcggcggctttacgtttttcatggcctcaatcatggcgatttcccagcgggacgccaaaaaagtgctcgcgctgtccacgatctcgaatctcggtctgatggtggcctgcgccggtgtcggacggcccgaaacgatatgggcaggcatctttttgatgctgttccacgccgtatccaaatcgctgttgttccaggatgtgggggccacagaaaatgccaccggcagccgaaatattgaagacatgcacgggctgatgtaccgcctgccccgtttggcgattttcatgttcgtcgggattgccgggatgtacctggcgcctttcggcatgctcatttccaaatggtcggcgctgaaggcggctgtggacaacaacaacatcatcctcgtgctgttcattgcctttggatcggccacgacgggcttttactggaccaaatggatgggcaagctcatcgccttcagccaccgcagcggccaaaaggaatcggaccacatgttcccagaagaagtgctgtccttgacggtgcatgccgtgctgatgatcgcgctgtgcgtgctgctgccgctgatctcgaaggcctacgtggatccgcttttggtcgaaatgttcggcacctataccgacgtgctgtccacgtcgattttgatcatgctggtggtcacgatctgcttcgtcttcgccatcccgatgctgtcgatggtctacacccgcaacctcaagatgaacatgaagctctcgtacatgagcggcatcaacgccggcaacaacaagcgcttcatcgacgcgatgggcgacaagaagaaaatctggctggtcaattattattttgaagatttcatccaggccgatcgcatgatgcggtacagccagatctttgcagcggctgtactgatcatcatgatctgtgtggtgattggaggcgtcttatgattgaaaaaataatcggagtagccgcgtatattctgctggcgccgctggtcggtggtctgctcgacgggctcgaccggaaaatctcagcccggatgcagggccgtgtgggcccgccgctgctgcagcccttttacgacgtgagaaagcttttcgccaagcagatcgtcggcgtcatcaacagctctcaggcggccatgctctattcgtatctgctcctgatggtcttttcggggtgcatcttcttcgccggcaacgacatcttgatgagcgtcttcgtcctgtcgacggcgtcgctgtttctgtacttcacggcggtcatcacggggtcgccctacaattcgatcgccgcgtcccgcgagctgatccagatcatgacctacgaaccggccgtgatcctcgcctgtgtcggcttctacatggcctcgggcaccttcaacgtcagcgggattatccattcagacatggtcatgatcacgagactgccggggttctttatcgccttcgtcttcatcctgaccatcaaaatgcgcaaatcgccctttgacgtcagcacctcgcaccacgctcatcaggagctggtcaaaggggtcacgacggaaatgggcgcacgcaacctcgcgatttacaccatcgcggaatggtacgaagtggtctatttgctcggattcgttgcgctgttcgtcatcaatcagcagtggtggagctttgtgctggccgctatcgtcattctggcggtctatttcctggaaattttaatcgacaacagcgccgcccgcgtgaaatacggcgccatgctcaaatggacctgggccatgacccttttggcggcgggcgtcaacctgctgattttgatgctgatccgctagttgagggaaggaggcaaatttatggcaaaagtaaaaaaatcgccgtggctgctgcattacgacggttccagctgcaacggctgcgatattgaaaccctggcgtgtctgacgccggtttacgacgcggagcgcttcggcgtggtgaacacgggcgaccccctccaggcggatatctttctgatcaccgggggcatcaacacccagaacagaagcgtggtggaacagctgtaccagcagatgccccggccaaaggtcgtggtcgcggtcggcacctgtgcgtgcaccggcggcatcttcaaggactgctacaacattctcggtggcgccgacaaggtcattccggtggacatttacgtgccggggtgcgcggcgcggccccaggcgatcatcgacgggattattcaggcggtcgacttgttccagaagcggtcggacgaacacgaacagaaaaagaaaggagcggccaatggcggtcatcattaaaaaagaaccggagcagaagaccatcaccattgcagaactgctgcccgaggtcatcgcgattcgaaagcgcgggatgcgggtctgtcaaatctgcgcggcgtgggtgaacgagcagttcgagctcagctacacctttgccaacgacggcaactacctgctgctgacgctgcgggtcgtcatcgataaggacgtcgaggtgccgagcatcacgccgatctacccgagcgcggttttttacgaaaacgaaatgaaggaactgttcggcgtcaaggtcgaaaacatcagcatggattacaaggacaaattctaccgcattgaagaaaagacgcccttcggtccggaaagcgaggatgaatgatggcgagaaaacacaagcgcaacatcgtgcccttcgggccccagcatcccgtgctgccggagccgatccatctggatctggtgctcgacgacgaaaaggtcgtcggggtcatcccgtcggtgggcttcattcaccgcggactcgagggcctcgtcgacaagcgggacttcaaagaaatggtctacgtcgcggaacggacctgcggcatctgcagcttccagcacggcatgggctattgcgaagcggtggagcagatcatgaacatcgaggtgccgccgcgcgccaaatacctgcgcacgatctggggcgaaacctccaggcttcacagccacctgctgtggctggggctgatggctgacgccttcggctttgaaagcttgttttatcagtgctggcgcatccgcgaaaaaattctggatttgatcgagctgtccaccggcggccgggtcattttctcggtgaaccagattggcggcgtgctcaaggacatggacgcggagatgctgaagcattttctcgacgtgctcgccgaggtcgagacggaagtgcatgaaattcagaagaccttcatgctggactacacggttcagtcgcggacggtgggcgtcggcgtcatgacgaagcggcagattcacgcctgcgggagcgtcggccccttcgcgcgggccagcggctttaaggtcgacatgcgcaagctcggctacgaggcttatcccgatttggattttgagccggtcatcagcaacgacggcgactgctacgcgcggtgcgacgtgcgcatcagagaaattttccaatccatcgacctaatccgtcaggcggccgcgaaaatccccgacagcgagctcgccgcgaaggtcaaggggaacccggacggcgaatgctttgcgcggatcgaacagccccggggcgaggccatttactacgtccgcggaacaggaaagaaattcgtcaatcggatgcgcatccgcacaccgaccttcgccaatctgccggggctctgcgaaatgctcaagaacgcggattacgcggacgtgccgctgatgatattgacgatcgatccatgcatcagctgtacagaacggtaggtgagaaaatggcacacttttttacatttgcaaagacggcgctgaaaaatttaacctccaagccggtcaccacgaaataccccgacgcacccatcgactatccggcgcgcagccgcggccatatcgagatcgacatcgatcagtgcatttcctgcagcctctgcgtgagaaactgcccgacggaatgcctcgcggttgacaaaaacgccgggacctggacgattaaccgcttcgactgcatcgtctgcgggtattgtacggtcaactgcccgaagcactgcctgaaggtcgtcaacggctatcagaagcccggcactgaaaagcaggcggcgacctatcaaaaatcgccggaagtcatggccgcggaaaaagcgaagaaggaagccttggcgaagaaaaaagcggaagcgctgaaaaaggcccaggcggccaaggctgcgaaagcggctcaggcggctgaagcgaaaaaggagggcgattaaatgtgcgtggcattgccaggtacggtgatctcgtgtgacggcgattcggccgtcgtggatttcagcggcaaccgcgtacgggcgaaaacggggctggtcgacgtggcaccgggtgacaaggtactggtgcacgccggctgcgtgctgcagaaaatgcgcgaggaagaggccgtggaattggaacgcttatttaaggagctcggcgatgtcggatgaggcgctcgcggcggttaaggcgcggctgaaggcctacgacgggccgaggatgcggatcatggaggtgtgcggcagccacacggcggcgatcgtcaagaacggcattcccgggctgctttcaaagcagatcgagctcgtcgccgggccgggctgtccggtctgcgtgacgccgacggattacatcgatcggctgatcgcgctctcacaggaagagaacacctgcgtcgtgacctttggggatctgctgcgggtgcccggcagcgcaggcacgctgatgcaggcgaaaaacgcgggcggccgcgccgagatggtctactcgcctttcgatatcctcgcgatggcgcaggcggaacctgcgacgaccttcatctttgcggcggtgggcttcgagacgacggcgccagtttacgcgctgcttctcgaccaaatcgtcgaggcccatattgagaacatccggtttttgacggcgctcaaaaccatgccgccggtcatcgacgcgctgtgcgcgggcggcgcggacgtgcaggggctgatcgcgccgggccacgtcgcggtggtgatcgggtcggacgccttcaaaccgctggctgaagcctaccagctgccctttggggtcgccggcttttccggcatgcatctgctctacgcgatcgacggcatcgtccgcgcccgcggcagaggcaccgtgatgaatttctaccccgaagccgtgacgccgacgggcaatgtgaaggcccaggaccttgtcgcgaaatacttcgagccgggggatgccctctggcggggcatcggtgtgattcccggttccggcttgtttttaaaactggcagttcagtgctttgacatgggcagccaggcccttcagcacgaccacccgatgaatgcggcctgccggtgcggcgaggtgcttagaggggcgattgcgccccaagactgcccgctgtttaagacggcctgcacgccgctgcatccgcaaggcgcctgcatggtttcggcggagggcaattgcctttcggtttacaatcagaattaaaaggacaggagatcaatggaacagacagtgattacgacagagcacggcagcggcggcgccgcgactgctgcgctcatcgacgggatttttgccaaggccttcgacaatccggtgctggcgcagatggaagacagcgccgtggtgccaggggccggtgagattgcggtgacgacggacagctttgtcgtcgatccgcttttttttaacggcggcgacatcggccgtttatcggtctgcgggaccgtcaacgacctgctgatgcggggcgcagtgccgaaatatttgacctgcggctttattcttgagaccggccttttggtcgaagaactaaaatgcatcgcggcgtcgatggccgcgacggcgaaggaagccggcgtcacgattgtcgcgggagatacgaaggtcgtggaaggcggcggtgggctctacatcaacacagccggcatcggttttgcgcagggccgcgaaatcggcgcaagacagattcagccgggggacgtgatcattttgtcgggcaaccttggcgagcatcacgcggccatattgagcgagcgcctgtcgatcgacacggacatcgccagcgactgcgcgccgctggtggagatggtgcgggcgctgatgacatctgacgtaacggttcacgcgatgcgggacatcactcggggcggccttgctacgattctgaaagaaatggccgaaacgtcggggctgacctttgagcttaaagaaagcggcctgccggtcacgccgaaggtgcgggatttctgcggcctgctcgggctggacccgctctacatgggcaatgaaggcaagatggctgtgatggtgccggaatctgacgcggacgaggcccttagactgattcgggccagcgcctacggcgcccacgcggcggtcgtcggcagggtgtccgccggtgagccgggacaggtcgtcgtcgagaccgccgtcggcggccggcggaatatcgacgtcctgcggggcgaaggcctgccgagaatttgttagcaaaggagcggaaggtgcagaaggtcaaaacaattgcgctcaaaaagcaaatcctcgatgacaacggccgtgaggcggacgcgttgagagcggcgctcaaatcaaagggcgtgttttatctcaatctgatgtcgtctccgggatcgggcaagacgacgctgattcgcgaaacggcgaaatggcttcaaccgcgttaccgcgtcggcgtgatggaggccgacatcgattccgacgtggacgcggcggcgctcttagccagcggcatcgagagcgttcagctccacaccggcggcatgtgccatttggacgcggcgatgtccagacaggggctttcggcgctgggagacgctttcgacgtcgtgatcctcgagaacgtcggcaatttggtgtgtccggcggaatttgacaccggcgcctcggcctgcgccgctattttatcggtgcccgaaggggacgacaagcccttgaagtatccgctgatgttcgagcaggtcgacgcggtctgtgtcagcaaggtggatacggcggcctatttcgattttgatcgaaagcgttttgccgattacgtgcaccgcatccatccgggggtgccgattttcttcctgtcggcgaaaaccggcgaaggcgtcgcggaatgggtgacgtggctcgccgaacaaatcgaagggtggaaaggaaaagcagatgagcagaaaaattgaggtgatcgagatcggccgggatctcagtcaggaaaatgacgcagccgcgcagcgcatccgggaagacaacgcaaagcggcaccgctacctcgtcaacgtgatggcctcgcccggcgctggcaagaccagcgtgctgctgaaaacggcggaggccctctgcagccggtttcggctcggtgtgatggaggcggatattgcggcgcaggtcgacgcagaacgcatgcaggcggctgggcttcacgcggtgcaggtgcacaccggcggcgagtgcgcgatggacgcggcgatgacagcacagggactggccgcttttggcgaggtgcctgtcgatctcgtctttttagaaaatgtgggcaatttggtctgcccggcggaaaacgacgtcggcgcggacctcaacgtcgaaattctttcggtgcccgagggggacgacaagccgctgaaatacccgctgatgtttcgggtctgcccggtggtgctgatcaacaagatcgacaccgagccggccttcgactttgaccgggaggctgtgcgcgcgcgcatcctcgcccttcggcccgacgcgaaaatctttttcatgtcggctaaaactggagaaggcgtccaggaatgggccgactggctgacggcgcaagcgaaaaagaagatttaaggggttttcaccgcgattgaccgcagcaccgtggatttgccttggatcagcttcgccttggcgctgccgcaggccgggcagcggtaatcgttggtcctgtccgggtggaagcgggtgccgcaggcggcgcattgggcctcgaccgggacgacgtgaacgacgagacgcgacccctccagcagtgtgcccttcacagcggcggggtagtagcggaggaggtagtcggggacgatgtcggtcatctcaccgacgtcgacggtgatgctttcaatatcggcgatgccgcggcgttccgcctcctcgagggcggcggagacgaagcgcacgacggtgctcatttcgtgcatggcttatcctttcaaatcaaataaaaaacagacagccgatgcgaatcactgttatcagattcgcatcggctgttttaacgtttaaatcatgtaaaaccaacggttgtccagcggaacgtccttgggttcagcggcatcatccgcgtcggattttggatagttgatggacagctcctgatttttgatcgagacccgagcgtggggcgggatcgaggtcgtaatgaagcagctgccgccgatgaccgagccttcaccgatgacggtttcgccgccgagaatggacgcgccggcgtaaatcgtgacgttgtcaccgatggttgggtggcgcttcacgtttttgagactctggccgcctttagtcgagagcgcgccgagggtcacgccctggtaaatcttgacgttgtcgccaatgacggtggtttcgccgatgacgatgccggtgccgtggtcgatgaagaagtatttaccgatggtggcgccggggtggatgtcgatgcccgtcatgttgtgggcgatttccgtcatcatccgaggcagaatcggcacgccgagctcgtagaggccgtgggccagccgattgacgagggtcgcgtagaggccggggtaggagaagatgatttcatccttgttgaaagccgccggatcgccgtcgtaggccgcctgaacgtcggtttcggtgtaggcgcggatggcgggcagcttttcgaggtaggcgaaggtcagctttttggcctttttggtcagcgcctcgtcgtcgaggtctttgttgtctttaaggtagggcaggaccattttgatctgttgaatcaggttgtagaccacatcctcgaggatcatctgcacgttggtgcggcgggtgtagccgtggtacaccttgttgcggtagtagcccgggtaaaccaggatcatcaggtgacggatcaacgagatgacggtttccttgtccgggtgggtgtagggcatcagctgatcgatttttttgttttcgctgtaatccagcatcagcatgttggtgacgcggttaatatcgtcttccatttctgcgtttttaattttcatcgtgttgtgctttcttaaagaattatttgtccggtgaatccatttttccggcaatgtaacgggtcgccgtgcgcaagtcctgatcgagctgacgcagggtggcgatcagcgtgtcgttttgttgaatcaagagccagttttgttcgacgacagccttgagattggcgcgttctgcggccttctgggcctgttttttgtcgctcttttttgccggtttcatctgtgtggcgccgacgagctcccgcgcgatggctcgggtctgttcggcgtacgcctgcatgtcgtccagaccgcggctggtcaggtaggcgtcggtcaggatctgacacttcttttcccgcgcggcggccttagccgctgccttgcccgcttcaggatcgtcagcggccttggcgtccgggttgttttcgtcgaattcgagaaaggataaaatcggctggtgttggtctaagttggaatcagctgggtctttcatattgcgcactccattgtttattatttagaacaattttaacacagaaccgaggtattttgcaccgggctgtgataaaattaaagaaaaacatagaaatgcgataggaggggttacaatgcagtatttagtcgtcggcgccggcggaacgggtggcatgattgcctacaagctggccaaaggtggacaggacgttacactgatcgccagagggacacaccttgaaaaaattctaaacgaaggcctgaaggtgcacacacagtgggatgacgcggtcgacgcggtgccggtgaaggcggttacggcggaaaactgcggcgggccctacgacgtgatcttcgtctgcttcaaatggtattcgatcgaaagcgcgctgccaattattgaacgggcggccgacgcccacaccgtcgtcattccgattctcaacatctacggcaccgggcggatgcttcagcagaagctgccggacaagtatattttggacggctgcatttacgtggcggcctcgaaggaaaagccgggacagattttccagttcggcaaaatcatgcgcatcgtgttcggtccaagacaggatcaggaaaagcggccgatgctgacggccatcgcggcggagctcgacgcttgcgggattgaaggaaagctcagcgaccacatcgaggaggaagccctcgaaaaattctgctacatttcgccggttgggacggccagcctctattacgacgtgacttccggcggcttccgcacgccaggaaagccgcgggacatgctcgtcgagctgatgcgggagatctgcgccatcggcgaggcgatggggacgccgctgcccgacgacatcgtcgagcgcaacctcgggatcgtcgcgtccctcgatccggacaacggtacgtcgatgcagcgggatgtgatggccgggcacgtttccgagatggacggccttgtggccgaggtactgcgcctggcgaagcggtacggcgtgccggtgccggcttacgaaaaggcggcggcgcttttccgcaagcggggatggatggcgtaacggcgcggcgggcacagcccagtgatgaaatttatcagaaattaagtgaaaatagaaaatctggcaaaaacccgtcatttttattaaaagtgtctaaaaaatttgaaaattttcccgattatgctataatgaaattgccaagaaaaaggcgttgtatcggctgtttaagtcgatttctgctaacatgtctttttcatttcttttccttatgagccgccgaaaggcggtttttttattttaggtgggttttccgcgaatgtgctataataaaattattccaagaaatcaatgacaataggggaaggtttttgtgaaaaagaaacgcgaacgggatgcgcggacccgccatccctatcccgagacatccgaaaacggtgaatcccggctgaaagagatcaaccaggctatgcgcgaccagagtctgcgcgacacccgcagcaggaaggtgctctggattttgcggattctcgtgatcgtcgccatggtccggcaggtcgcgatgcacgactacgaaggggcggccctatgtgtgctgaccctgcttttgatgatcctgcccgggctggttcaggcgtcgctcagggtcgtgattccgcagacgatggaaatcgtcatgtacgtcttcatctacgcggccgaaattcttggcgaggtcaacaaatattacacccgcattcccttctgggacacgattctgcacaccctcaacggctttgtctgcgccgccatcggtttttcgctggtgcttttactcaacgcggacaagcgggcgattttcaggctttctccggttttcgtgtccattgtcgccttctgcttttcgatgacgatcggcgtcatctgggaatttttcgaatttacaatggaccagctgttcatgacggatatgcagaaggacaccgtggtgcacgcgattcactcggtcgctctcgacccgtcgaagggccagcacgtcaagaccatcagccacatcacccagacgatagtcaacggcaaggtgctgccgattcacgggtacctggatatcggactgatcgatacgatgagcgatcttttcgtcaattttatcggcgctcttattttctgcaccatcggctattttgcgttaaagggacgtcagcgtcagcggctgatggctgaacagctcatcgtggtgccggaagaggacgaagcggtccgagacacgctggaggcgcaggacgaaagagcctttctcgaagcgcacgaaaaggagctggcccatttcaagcggctgcggcgtcaaaagcggttagatcatggggcgacgcccgaaaaagaacaggcggcgcctgaaaataaagggggacaataacatggatttgatgaaattgctcgaatcgcgcagaagttacaggcggttcgatcagagccggccggtgccggcgaaggcgatcaacgatatggcgctggcactgcgctggtccgcttccgcgggcaaccttcagcccctgcgctgcgtgttcgtgaccgatcccgaaattgccgaggcgattttcccgcacacccatttcgcggcgtacctgccgaaggaactcggcacgccgaagccgggcgaacacccggtgatgtacgtggtgctgacttacgaaaagaagacgaaatggaccgataccgacgcgggcattgccctgtcaaacttgaccctcgcggcctggggccacggtgtaggcagctgcattcttgacaacatcgatcggccagaaattgcggcattgctccacattctcgacggggtgaccattcactcggcggtggcgctggggtatccgacccacacttcgaaaattgtggatcaaaaggcgccgggggacgtcaaatattatttggataatcagaaaaattacatggtgccgaagcggccgttttcggaatttattttcgaaaaccgatatcccgaagcgtaggcttaccgtaaaaaaagcgcgtgtgaaaaattttttcacacgcgctttttatgccagcggcgcttcgccgaattgggcgaggagctcgttggcggccatgacagacagctgatttttgaccgcgtagatcagcacggcgtcccgtcggttcttcgcgtagaggatgccttcgtgggtcagctccagaccgcgctgggtttcggttagatccagaccggcggcgagggacagcgcgacgatcttgtctcggcttggcttgcggctgccgtttaaaatgtggtaggcgtaggttcggtcgaggccgctttcgcggatcaattcgtttcgagagagagcctgcaccttgggcagggcggtgaaataggccgcgaaatccgcgggcagcggatcgagtccgcccaaataatcgtgcagctcgggctcgctgtcggcagagacgaggacgttcatcaattcttcggtcttttttatcggtggcatcgcttagttcctttgtactatgttaaaataacggtatgaatcagaaccataccaaacagtatcgcgcgtgtcgggatactttcttcaaaacattataccatttcgatacgcccgggcaaagcctggtgatcgacgagacgtcggggcggctgtttctgcgcaaagagctgacctattacgacccatcggtttaccagtttttgatgggctgccgcgacagccggctcgttcccgtattcgacgcctggcaggaggacggccgctttgtcgtcctcgagcagtacgtccagggcgagctgttgagcgagcgcctgcggcgggatgacttgagcgcgcaggagaaacaggctatccttcacgacgtctgcggcgccctcgaggtgctccacagcgcgtcgccgccgattgtgcaccgggacgtgaagccagagaacatcatggtaaccgacagcggccgggcggtcctgatggattacgacgcgtcgaagcgggtcaagccggctcagtcccgggatacggtcctcctcgggacgcgggacagcgcggcgccggagcagtacggatttggggcgtcggacgtgcgcaccgacgtctacggcaccggaaaactcatcgcggcgatgtttggggacgcgccgatttaccatcacgtcgttgaaaaagcgacgcggctggatccgaagcgccgctaccccaatatcgcggcgctggaccgtgcgctgagccgcttcgacaagccgatcgaaaatgtgaacagctgggggtggctcaaggtaatcagcacggcgctctgcgtcatgctcgcctttgcgctgtgccgcacgatgacctttgagaactcgtcggggccggcggaggatctcatcacgcagatcgctttttttatcgcccagctggcggttatcgaggtgtggttcgactggaccggcgcctttgaccacctgcccttcagaaagcaggggcaggtttcgctggggcggaaaatcgtcgaaaagcttatctacggcgcggtgtttttctgtttgatcttgatcatggcggttattttgattttgtgtatttttggagcataaggatgaaactcacaatacttggaacgggcaacgcgattgcgacccgatgctacaacacctgctttgcggtgcaggatcacgggcagaccctgctggtcgacgccggcggcggcaacgaaatattgagacggctgcccgcaacgggcatcgcgatcaacgacctgcacacgatgttcgtcacccacaagcacatcgatcatctcctcggggtgatctggattgtccgcgtggtgacgatgaacatgctcaaggggacgtacgacggggattttacgatttacagccacgacgaggtggtcgatttgattacgtacatgagcacccaccttttgacggggaagcaggccgccctcatcggcgaccgcctgcaccttatcccgctgaaggacggcgaaagcttttgcggcgcgggtcacaaaatcacggtgttcgacatccattcgaccaaggcgaagcagttcggctttgtgatggatttgggcggcgggcggcatttgacctgctgcggggacgaaccgtgcccgaagtcggcagaaaagctggctgcggggagcgaatggatgctccacgaggcgttctgccgctactgcgaccgcgaaacttacaagccctacgaaaagcaccactcgacggttaaggacgcctgcgagctggctgaacggctgaaggtgccaaacctgattctctaccacactgaggatcaccacatcgccgaccgcaaggccctttacggggccgagggccggcagtattattcgggccgtctggaaattccggacgatctggaagggttttacatcttgtctgattagaagaaaatggttttacagcggtttaaaaccgcgtgtttttgcgagaacgagcgcccgcgggcgctttttttattgctaacgaaacaggccttgggtataatgaaacaagctgataggagagaattaaatatggcaaagacactgaaagatatgaaaatcggtgaaacggtcacggtaatcgaggtcggcggccagggcgcactgcggcagcacttcctcgacatgggcatgatccccggcgtgagcgtcaccttaattaagtacgccccgatgggcgacccgatggaatttaaaatccacgactacgtgctgaccctccgcatatccgaggcggcgcagattacagtcacggatctgccgaagtctgaggagacgcacccgaaaaaggcgccggcccatgtcgagcacccgggctacggtgaaacgggcgtgcgtttccacaacgcgaaaaccgacgagagccgggcgctgccgaaggaccaaattttaaccttcgcgctggcaggcaatcagaactgcggcaagacgacgctgttcaaccagctcaccggcgcaaaccagcacgtcggaaatttcccgggggtgacggtcgacaagcgcaccggcgtcatccgcggtcaggcccgcaccgaggtgacggacctgccggggatttactccctttcgccctacacggaggaggaagtggtctccagggaatatattttaaaggaaaagccccagggcatcattgatatcgccgacgcgacgaatctggagcgcaatttgtacctgactcttcagctcatggagctgcacgtgccgatggtgctggcgctgaacatgatggacgaaatgcggggcaacggcggatcggtggatatcaaccggatggaagagatgcttgggatccctgtggtgccgatttccgcgtccctggacgagggggtcgacgagctgatccaccacgcggtgcacgtcgcgcgatatcaagaatgcgacgcggtgacggatttctgcgggccggaggatcacaacggcgcggtgcaccgggcgattcacggcattatgacgctgatttcggaccacgcccagcgggcagacattccgctgcgtttcgcggcgacgaaggtggtcgagcaggatgaaaaggtcatcgaggcgctgaatctcgacgagaacgaaaaggaaatgatcgaacacatcctcgttcagatggaaaaggaacgggggctcgaccgccgagccgccattgcggacatgcgcttccatttcatcgaacaggtgacgagtgcctgcgtcatcaagccgagagagtccaaggaacagcggcggagcgagcgcgtcgaccgcgtgctcaccggtaagtacacggcgattccgatctttgtgctggtcatggcggccgtcttcgcgctgaccttcaacgtgctggggctgccccttcagaacctgctcgaccggggcattacggcggtccgcgacggtgtcggcgcctggatgaccgcggccggcgtcgccaagggcttgaggctctttgtgactgagtgcctgttcgacggcgtcgggacagtcgtcagcttcgtgccgatcatcgtcatcttgtttttgtttctgtctattctcgaggacagcggctacatggcgcgcatcgcctttgtcatggacaagcctttgagaaagcttgggctgtccggccggtcgatcgtgccgctgcttgtcggcttcggttgttcagtgccggcgatcatgtcgacgcggacgctgccgtcggaacgggaccgccggatgacgatcatgctcattccttttatgagctgtacggcgaagctgccgatttacgcgctgttttccggcgtcttctttccgcattacgcggcgctggtgatgattttactgtacgtgctcggcatcgcagtcgggattttaacagctgcggtgctcaaacacacggcgttcacaggcgaaccggtgcccttcgtgatggaactgcccaattaccgcatgccggggatgaaaaatgtggggcggctgatgtgggaaaagactgccgattttattcagcgcgccttctcgatcgtgttgatcgccaatatcgtgatttggttcctgcgctccttcgatccggcgctgcacatggtgacagccgccaatatggacagcagcattctcgcgatcgtcgccggcgtactcgcaccgattttcgcgcccatgggttttggcagctggaagatggtcacggcgctgatttcaggctttctggcgaaagagagcgttgtcgccgtattgggcacgctgtattccggcgcggcccttgcatcagtgatttcgccggtttcggcggcggcttttttggctttctgtctgctttacacgccgtgtgtcgcggcgatgtcgtcagtgcgtcgagaactgggcaccggctggatggttggcatcatcgcgatgcagtgtatcatcgcctgggtcatctcttttgctgttttcacaatcggctcgctcatttagacgcagctcaaagactggtgtgtcctctgaggacaccaaccggtcttttttttgtgctaaactaccttaaagtttattgctacgacaaagggggaagcagcatgacaaaaccaatttacaaacgatggtggttttgggtcatcttggtgatcgttttatttatcattgcgggtgcggctgggggacatgaagattcgtcgtccagttcgggcagtaagtcagcaaaaaaagttgaaatggctgatttcagtgtgatgagtgaggccgatcgggatcaatgggggaaagacaatcaaatcacgatcaacgtgaagaaacaatactcaagcgacgtccagaacggcgcctttatcagtcagagtgttaaagccggcacgaaggtggcgcagggttcttctgtaacggtggtttactccaagggcgctaagccgacagcggaacagcgcaacgctttgatcaaggcgaaagaatattcagatacaatgtacatggcgaagcaggggatttacgaccagctgacgtcagattacggcgaacaattcccggcagatgccgcccagtacgccgtcgatcaccttgacgcagattacaataaaaatgcccttgaaaaggcaaagagctatcagaaagaaatgaacatgtcaaaatcggcgatttacgatcagctgacgtcgtcctacggcgaaaaatttacccagtctgaagcgcagtacgccgtggatcatttaagcaactaagatagagaggacatcaatgaaaaattggaaattagtttcgggaatcttatcaattgtgctttgtgtttttgtgctgtttcagtcctgcgcggcaggcacctacaacgcgctggaagctaacggcgaagtcagcgggagcgccggctttttggtcgcggttttcatgctcgccggcggcatcgtctccatcgcgacgcggaagagcaccggcaagggcggcaatatcgcgctcatcgtgatgtttgccttggccgcgctcatcggttttaccaatgcgggcagctattccgacctttacgtctggtcggtgtggtgcctgatctgcgcggtgctggcggtggtcagcgtgattttaaacaaaaagcaggcgaactgaccgcttgatgcgaaagggggtcaatgcgatgttatcgctgattattttgggaatcgtgttactacctgtcatgattttagcggacttgcttgaaatgaataaataagaaaaagtaaggaaaagaatatccatctcaaaagggactgtcgatgaggcagtcccttatctttttgccttcggaaatgatatagaagtacacaaaatgaagtatattaaaattattacgttttttgcctcatcagcccctcacccaatctcatcattttgaaatcttgacaggtgctcgtaggggaggatgagccttccagtgtacagcccacagccgtcgttgatccggtagcggtcgagagcggtgaacatattgacatcaatctttgaaatgtcaaggttttgaagcgcggcaatgcgtgcgtaggcctcgtcgaaataaggacacgcgccctccgggatttccttgcgtcgcagccgctcctgtgcctggcgcttttcatagctgctgtggttggctgccccgatttccgcgtaatcatccatgtccttcgtgcgcagctgaatctccagataacttctgctcagattatcaaaaagtgacagatgaagtgaacggtagcccaactcattggtgttggccacataatccttgtagtacggtcggacactgtcgctaagcagcggggagcacaccggaagatcggtgcgggagagctgcgcggtaaatccccgctcttcaagaaacgctggtaggatattggcgatctcatacagcgtatgcgcttcgatctgtgcccggtcatctccgggtttcagatgacaggccggcagggacaggacgatgcggtaagcaatcagatccttgaaacggccgatttgttctcgaagcatggaaatcgggggataggtgccatgttccgcgtgatagcgatagatgccgttgacaatataagcgttaaacttttcctccgtgcggatcagcgatttgatccggccccggaaggtaaacgcgaaaaggccgtagtgatcggccatatacttataaaattcccggatccgctgagactgggaggtcaggaaatcgttatgctccagaagctcactcatctggattagaaaattggcatgaatcagatccagagcgttatgggtgtccgcggcgtttttccgcagatcgtcggcgtatttgtggatgatacgcaagagggtatcaccagcgtaaagatagtcggttaactgaaccataggaaaagtgatcacttcccttcgaaaattaacgattaaaaaacgccgtgcggactttcccgatcatgtagagggagccgacaaaggcgttgacgacgtcatcggcatcgtcgagggtatccagcgcggcttccggtgagtcgaaggcggtgacgtccttgccgtattcatttttgatcttttcggccatggcctcggcgtcgacggcccgttcgttgtccggcgtcagcgtcgaaatcttttcagctcggggcaccagcagcttcagacagccgtcgatatccttgtccttgagcataccgaaatagaggttcagccggtaaggcttgtcggttttcaggaaataatcgtcgagattgtcgacgaagcactgaatgccgtcgaggttgtgggcgccgtcgatcagaaccatcggcgacttcgacagaatttcaaatcggccgtggagcttgacgtggttaatgccctggcggatcgcctcaaaggggatcacgtatttttcttccatcagcgcgaccagcgcggccagcgcgttgccggcgttttccagctgatggcggccgaggaggttgatccggaagcggcccagcgggtgataggcgaggcttcgcgaggtgacgagctgaccgtcgagatccgccttgaccagctgcagtttgtactgttcgccgtcgtaaatccgggcgcccttgtcccaggcgcgtttttcgatgacttggcgcacgccttcggaggactggggcgccatgacgacgccgccggtgccgaatttgataattgccgccttttccgccgcgatgtcttcgagggtgtcgccgaggtattcggtgtggtccatgccgatcttggtgataaccgcgcatttcggcccagggatgatgttggtcgcgtcgagacggccgccgagaccgacttcgatcaccgcgaaatcgactttcttatcccagaagtaaacaaaggcgatggccgtttccagctcgaagcaggtggcctcagcgccgcccttttcgacgaccgcttccgccgcggccttgaccttttctgtggccgctgcgaggtcttcgtctgtgatgggctcttcgttcaggcagaaccgttcgttgaaggattccagcgccggtgacgtgtagagcccggtctggtagccggcttcggtcaggacggcggaaatcatatgggcggttgagcccttgccgttggtgccagcgatgtgaatgcatttgatcgagcgttccggatggttgagctcgtccatgatcgcaccgatggtgtcgagcccgaggacactgccgaacacgcctcgggattggatgtatgcctttgcttcttcaggcgtcataattagcctctctttctttatgaatcattgtgattttattcgatgaattgactgcagtcgatgatgcgcttttctgtgatgagggtggggatgcgcaggtcgtgagcctcggtgggcagcgcgtcgaaaaggagaaattccgggacgagggcgactaagtgtgccgtggctttgagctttggcaggtagcggtcgtaaaagccgccgccgtagcccaggcgttcgccccgcttcgtaaagccgacgccgggaacgacgatcaggtcgatggcgtcaggcgcgagttccgggcagatcgccgggtccggttcgagaatgtccatcgtccctggcctgagatcgccaggaaagtgcgcgatcgaaagcatcttcatgatgtgggttttaggcacgcagtagggcaccgcgacccgcttgccgtcgcttaacgcctgctcgatcagcgggaaggtatttaactccgagccgaagctgacgtaaacggctagggtttgagcgttctggtaaacgtcaagttccgtcagggctttgacgatcgccgcgtcggcggcaggatcgtgtgctgcgtctctgagctttaaaatttggcggcgcgccgcctgtttggcttgcttcatcacagggtctcctttacattgacagtaaaaatattatagcatacctacgtgtagaggacaccagaaccatttaagctaatattgaaaaaaaatggcctctatggtacaatttttataaatttaacggaagtgaattaccgctagaatagcgaggaatcaattgtctaaagataaaaatcaatttcgaactcatgatggcagcacgagtgcctacgtgaagagcattctcaaggaaacgcggggaagtctccggcgcaattcgctgatgagcgccgcgtccattctttcgattgtcgctgccctgattattttgggaattttcgtcattttttcggccaacgtccagagtgtgacccagcaggtcgaatcgaaaatggagctgaaggtctacgttcagaacaacctgtcccaagaccagctcaaaattctcaattcaaagctcaaagcgaatgaacacgtggtcagcacgaaatacgtctcagcggacaaggcgctgtctgatttttcgaagagcctgaagagctattcgggcctgctcaacggctacaacagcagcaacaacccgatgccggcgtcctacaacgtgaaaatcgacaacgcgaagaatatttccgcagtgcgcaattacgcccttggccttaacggatacggggtgactgacgtcaaatacggcgaagagtacgtcaacgcgctgatttccttcagccatttcagcaatatcttcagcgccgtcctcatcgttatcctgtcggtggtgtcgctgttcatcgtctacaacacgatcaagctgacctgctttgcgagacgcaaggaaatccgcgtcatgcgttacgtcggagccaccgactggtacatccgcgcgcctttcattctcgaaggggctttcctcggcgccctcggcgcggtgatcgcgctggcgattatcggcttcggttataccggcatttccaattacattatgaaagcggtgtcgatgccgatggacgcgggtgtcgtgtccttctcgtcgatgttcgcgccgcttctggccttctgcctcgtgtacggcatcgcgatcggttcccttgggtccgtcttctcgatgcggaaatacctcgaagcgtaaacctcggcatttagaaatgggagattcattttgagtacaactaaacagacaaaacgaatccgaattctggcctgccttttgtcagcaggccttctttttgtgatgggattcggctttaatcgtcctgtgcaggcggccacaaaggaacagctcgacaacgtgcaggcgcagatgcagaagaccgatcagcagatggcggacaaccagaagaaaatggcggcgcttgacgcccagctgtcccaaaatcaaaaggcctacgacgaatccctggcggccttccaaaaacgggcccgggcgatgtacatggtgggcaactccggctatctggaagtgctgttctcgtccaaggacatcacggagatgatctcgcggttgaccagcatgcgcacgatcctcaaatccgaccagaatatgatcgacacgctggtgagccagcagaatcagattaattcgacgaaggccgagatccaaaaggcccaggacgagctcaagacgctgaaaaaggctcaggaagagcagtacaagaagttggccagcgagtacaacgctgaaaattcggcagccaattcgatgaacctgagcttcggcagcggcacttggaccaacgattacatctggccaatcgatttgaacaacccgaacgcgctgaatatcagcagcggcttcggcggccgggcttccccaggtggtatcggctcgaccaaccacaaaggggttgatgtgccggtgtccacaggcacgccagtgatggccattgcggacggcatcgtcgtctacgcgggggcagccagcggctacggcaattacgtcgccatcgattacggcaccggctccgacggcaccacctacggctccggatacggccatttgagcagtgtgaagtgccaggtgggacagaaggtcaagaaaggcgatgtcgtcgcgataagcggctctacgggccattcgacgggtccccatctccattacgatttttacgtcaacaacgcacaggttgacgcgcggacctattacccgaacctgacgttcacaggcaagggccgaaactaatttaaagtttatacagcggcttcaccgcgattgatcgcaatgattgcgtgatcaactgcggcggccgctgttttttatttggctttgtatttaaatattgaaaatatggataggggaaagggcggatgaaaaagcacgattaaatatataaattaaaataaatagcacaaaaaaacacccgaagcgtaaagcttcgggcgtattgtatttgtatcaacgaggatttgatttaaacagctggcatggttttggtggcgatcacatcgatgccggtgccgcagacatccttgagcaccacatcgccgaccttaaccggcgcttcaacgacaaccttggagagttcgtccatggcgtcgaacaatttgccctttggaatttcctgtgcggttttaaccggcagacgggaaatcatggcgcctttaatgacgacggttgtcggcaggatacgacggggatccgtcatttcctggataccgtatctttcaccgtttttgcaattgttgcccgtgacagtccagttgtcgccttcaccttcaacggtcaggtggcagcccatcgggcagctgatgcagaccatttcttttttcatgatgtttatgcctccttcggttcaacgacgaattttaattcaccatcgccgtatttttcaaggacagattttttgatcttgaagttgaccatttcggccggaacgaatttctgcgctttcttcgtcgcgatcttttcgtcgcccacatagcagttgatgacggtgttggtgctgacggagcggacacgcatgtagcagttgaccgaatcgtcaaggttagcaaccgtaatcttttcaggcacaacgttgccgatgccgtcgccgttgacggtggtgaagttgatgtcttcttccagatggcccttgacgtagcgggcagcgcccttgccagccaaagccgcttcctgggaaacgaagtcgaccaagtcgtgaacgtggacaacgttgccggctgcgaagacacctggcaggttggtttcgcagagttcggagatcgacggaccctgggttctgcggtcaatttcaacgccagcgccgcgggagatttcattttcaggaatcaagccgacagagagcagcagcgtatcgcaaggcacggtttctgtggtgcccgggatcggtttgaggtgttcgtcaacctgagtaatatcgaccgcttcaacacgatctttgccgtggatgaaggtgatggtgtgggacagcttcaatggaatatcgaagtcgttgaggcactgtacgatgttacgggtcaggccgttggagtacggcatgatttcagccacgcatttgacgtgtgcgccttcaagggtcatacggcgggccatgatcagtccgatatcgccggagccgaggatgacgacttctttaccggtcatataaccttccatattgatgaagcgctgtgcagtcccagcagtgaagacaccagccggtctaaatcccggaataccgatggcgccggcggttctttcgcggcagcccatggtcaggatgacagccttggcttccagtgccatgtagccatcttcttcgttaattgcgtgaacgattttggtgtcgtcgtcttttctttcgaggtcgagcaccatcgtgttcagtttgtacggaatcttcaggtccatcgccatgtcgatgtaacggcctgcgtattccggaccggttaactgttctttaaaggtgtgcagcccaaaaccgttgtggatgcactggtttaagatcccgccgagttcgcggtctctttcgaggattaaaatgttatcgacgccttcttttttggcttcaacagcggcggctaatccagcagggccgcctccgattacaataatatcatacatcgtgaaaaaacctccccttactgattcttcgttttgccgctgaggatgtagcctttatccttagcatcgtacatgatgtcttccatgtcgcagccgagttcacgggctaagatttcaacaactcttggctggcagaaaccgccttggcagcggccagcacctggacggcagcgtttggtgacgccacggaccgttgttgcaccgacgttacgattgatgacgtcgacgatttcagcttctgtgatggattcgcagcggcagatgatcttgccgtatctcggatccttttcgatggctgctttcttttcttcgtcgctgagctgattgaagatgatgtgcggacgggtcttcggattgaagtctttgttttcttcaacgtggacgccgtctctttcgagcatcggcaggatgacgtcttcaacgcagtaggttgcggatgccggagctgaggtcagacccggtgattcgtagccagcgaagttgacgaagttcttaaccggtgattcttcaatgatgaagtcgccgtctgttgtggtgtaggtgtcagcaacaggagtgttacgggttccggcgtaggaacgaatgatcttgttgaagtagtgttcgagttccggacagttcttcaaagcgttttctttgatgtagtccagacgatcctgagtggtgtcgatgtcgcctttcttaactggcattgcatccgggccgattaacaggttgccgtggacagtcggggagaccaggatccctttcccgttcttagtcgggcacgggaagatgacgttgtgaaccaagtcgccgatttctttatcaaagatgaagtacacaccgcggcgagcgagaatcttgaagtacggatcgccgaccatcttgtaaatatcatcagcgtaaacgccggcagcgttgacgacgtatttggcttcgatgtcttcttcggtcgtttcgattttgaaggtcccgtcatctttctttgcgatgttggtgactaagtggttcaatttcaattcgacgccgttgtcgacagcattttctgcgaccttgatgcccaattcatacggagaaaccaagccagctgtacctgcgtaaagtgcaccgcagatatctggagcgaggttttcttccatttcgtgaacttcgtcttcgaagatgattctcatatccggcacgccgttcatgaccccgcgctgatacaggcgctgcagtgtcatcatttcgcgttcagtgtgcgcgacaaccagtgaaccggtgcgtttaaatggaacccccaagtctttgcagactttttcgtacatgatgttgccaggtgcgttgaacaggccctttttcttgcctgggactgcatcgtagccagcgtggacaatagcggagttcgcttttgtgatctggttggcgacatcattttcgccgtcaagtaaaacgacgttcagctgataacgggagagctcccgtgctacgtaggatccggcgataccggcacctattatagcgatatcatacataataaaatcctccttgatgaatgataaatttatacaaataaaaaaccacacaagcaagaaaatgatgacacagtcatgacatcattctagttgtgcggctctccattgccatatttcatttagttttaattatgtttgtctttattttaacatagaatcggattctttgacaaaattttctcgaaaaatttttactgcatcaaatttatcccacaatggcttgtaagaggtactggaagaaatcgaacctgcttctatacagctctttacttcttcttccgtttcaatgaatccgccggtaatgatcggaatggataattccgcgttgaccttgcggatgaccttggaaaccagaccggggagtacttcgactgcgtcgggcttaattttcctggcagcgttaatggtgacatccattgctgatgagtcaagaagaaataaacgttgaatggtcatcaaattttcacgcttagcgatggtaattaacgaattccgcgttgaaatgataccggtagggtgaagctcttccttcaggtatttgacaaagtagtgatcttgtccgtagcccttcagaagatccaaatgcacgaaagcgtatttgccagcgacattgatgtagtcaatcattgttttgagattgtaaatattgcctgtcagaagaaagacaatttggcagggagaggcgacagcgtcataaatgtcctttggatcgcggatcgccgcgataattggatttttttccaataagtgcagacatttttttgtagtcattgatccccccttctgttcggaaaaagacaaacgtgatcaactcacgacataactctccgacgacacacggtcgtcggagagtataaaacaaaattgaaatgaagttctaaaatgaagtgttgacttattcttcgacttcgtcaggatcgacccagtgttctgcacggccaacagcttttgtccagcccttgtacagttttgcacgggtttcagcatccatcatcggttcgaaggtacggtcgatctgccagtgatcgacaacatcttgtaagtcatcccagaagccaacttccagacctgcgaggtaggaagccccttcagctgtggtttcaacaactgacggacggtctacagggcagccaaggatatcagcctggaactgcatcaagaagttgttgttggaagcgccgccgtcaactttgagtgactgcagagcgatgccggagtctttttccatcgcgtcgaggatatctcttgtctgataagcgagagattcgagggtagcgcggatgatgtggttcttgttagcgccacgggtcaagccgacaatgcagccgcgtgcgtacggatcccagcgcggtgcgccaaggcctgtgaaggcaggaacaacgtaaacgccgttggtatcggcaactttcttagcgaagtgttcggagtctggtgaagtatcgaccatgcggagttcgtcacgcagccactggattgcagcaccagcgacgaagatagaaccttcgagtgcgtagttgacttttccgttgatgccccaagcgatggtggtcaacaggccgttttcagatttaaccggtttttcgccagtgttcatcagcatgaagcagccagtgccgtaggtgttctttgccatacctggtttgaagcaagcctggccgaacagagcggactgttggtcacctgcgataccggtgattgggatttcgccgccgccgaacaatgtggtgacaccgaatttgcttgatgaaggctgaaccttcggtaacaatgatttcgggcattcgaaggtttcgcacagtttgtcatcccaatccaaggtgttgatgttgaacagcatggttctggatgcgtttgagtagtctgttgcgtgtacgcggccttcggttaatttccagagcagccagcagtcgacagtcccaaatgcgagttcgcctttttcagctctttcgcggacgccgtcaacgtggtctaagatccacagcagtttcgtggatgagaaatacgggtcgagaattaacccggtgtttttctgtacgtaatcagcaaatcctggaattgcgttgaagcggtctgcgtagctagcggtacgacggcactgccatacgatcgcgttgtaaacaggttcgccagtcttgcggtcccaaacgattgtggtttcacgttggttggtgatcccgattgcggcgacgtcttcagctgttgcgttgactttcgccattgcttcagcacaaacagcgttctgtgtagcccagatctgcatcgggtcatgttctacccagcctggatgcggataaatctgcgggaattcgtgctgtgcaaccgaaacgatttcaccgtcgtgattaaacagaatggcacgagaactggtagtaccagcgtcacaagccataacatattttgccataatataaaccccctcgtttataaatgttttttatttaatacaccgcgctggcggtgcgattaaatcgattggcgtgcgcctgtcgttaaatcgacggcacaaaaaaagaacataaatagcctttctgcaacgattaagttgtctttgttttgtgcttctccatgttctccagctttatattctgttaatgattgtattgattacatctcttcgatgtgttcataatagcataatttattttttgtgtaaagggtttacaccaaaaaatattcaaataaattttcattaactttcagtaaagatttcgtgtattttgacagaatgtataatgtttagaagaatctaaaatgtttacagcacaaacgtgtagattctgtgctacactaaatagaacataatagtgaggcagattataaattttatatatgagaatattgaggaggaattgaatgaaattttatatgccgaccagactgtatcaggaaccggaatgcgtcatggcccatcgcggtgaaatggccgcgctgggcagccgagcgctgattgtgacggggaagcattccgcaaaggccaatggctcatacgatgacgtgtgccgggctttggacgctgaaaagatcgcccacgtgcttttcgacgaggtggaacagaatccgtcgatcgaaaccgtcatgaaggccagagactttggcgtcgaaaacggcgtcgatttcgtcatcggcatcggcggcggctctcccctcgatgcggcgaaggccatcgcgctgatgatcaagcacaaagacaaggaccgcagctatctctatcagaagggagccgacagttcgaccctgccgatcgtcgaagtgccgacaacctgcggcaccgggtcagaggtgacgccggtttcggtgctgacgattcacgccgaaaagacgaagggctcgatcccgcacaaaattttcgcggattacgcactcagcgacgggaaatacttaaggaccgcgccggcatctgtgctgcacaacacggcgatcgacgcgctggcccatttgtgggagtcgctgatcaacgtcgacgccgacgattacacccacatgtgcgtggcggaaggcctgcgggtctggaaacggagcaaggcggtgctcctcggtgaacgggacgccactgacgaagactacgccaatttaatgaacgcgtcaagtttggccggcatgtccatcgcgcaggtcggcacgaccgtgccccacggcctttcctatccggtgacttacaaccagcacatgccccacggcaaagctgtcggctatttccaggccgggtacctcgcggaagctgacgcggcggatcgggaagaagcccttgctttggcgggctttgattcggtcgatgattaccaaagcttttacgaagcgctctgcggcagcgaaaaattggctgacgctgacctcgagtacgcagtcgaggtgctggccggcaaaccggataagcttaaaaaagtcccgtatacctgcgatcgggacgtgctgcaccgtattgcatttttcacgaagtaaagcgtggcgtatatagaagaaagtgcagcaggaaaaattcaatcgttttcacaccatagaatttgattaaaatttatttttatttaatagttttcatgctataataaaatcattaaatgatctactcttgaggagggttaatcgaaatgaaaaaatttattaacgctgttgaagatgtcgaaaacgaaatgctcgaaggtatgtgcgatgcctatcctgataaggttgaacgcttagaaggaacagacgttatcgttagaaaacagaaaaaagaaggaaaagttgccattatctcaggcggcggctccggtcacgaaccgtcacacgctggctttgtcggcaaagggatgctggatgcagctgttcctggcgcaatctatacctcaccagcaccagaccagattctcgaagctattaatgcagcagatgcaggcaagggcgtcttgatggtcgttaaaaattattcaggcgatgtcatgaacttcgaaatggctgcagatatggcagacgatatcgaagttgaagaagtcatcaccaacgatgacgttgcagtcgacaacaaagaagaccgccgcggtgttgcgggcacgatctttgttcacaagattgccggcgcaaaggctgaagctggcgcaagcttagcggaagttaaagctgtcgcagaaaaagtcatcgccaatacaagaaccatgggtgccgcactcaaaccgtcgaccattccggcagctggcaaaccagggttcgaactggcagacgatgaaatggaaatcgggattgggatccacggcgaaccggggatcagccgcgaacctttgaaaccggcgaacgacattgtcgacgaattgttaagccacatcttaggcgacgacgtcgattactccggctctgaagtagctgttatggtcaacggctccggcgcaacgccgctgatggaactctacctgatgaacaaacgcgttcacgacgtgctgaccgaaaagggcatcaaagttgcaaagacctttgtcggcaacatcatgacctccatcgatatggcaggtgcttccatttctctgttgaaactcgacgacgaaatgaaagaactgctgaatgcaccggctgacaccatcgcattcactcaggactaatcgtctcgttaatggtataatgaaatagaggaaattgacaggcattcgtgcctgtcaattctttttaaaatcaattgacgaaaagaggaattcttatggcagcaacaaaagaagatgtattgaaattcattgaagaattcgataaacgcatcgaagaacatcatcaggaattgacggatctcgaccaggccatcggcgacggcgaccacggcatcaacatgaaccgcggcatgaaggccgtcatggaaaagatcccaggtgtccaggacaaaaccatcaccgatattgtcaaaaccgttgggatgacgctgatgtcaaaggtcggcggcgcctccggtccgctgtacggcatggcctttgtgaaagccagcgccaaagcgaagggcaaagaagaactgagcccggaagatatcagtgaaatgattggtgccgccattgcgagcatcgaaaaagccggcaaatcaaccacaggtgaaaagaccatgctcgacgcgatctgcccggcgaaggaagcctacgacaaggcgattgcagacggcaaatccgtcgcggacgctttcgcagacgcggaagacgctgcttggaagggtgtggaatacaccaaaggcattatcgcgacaaagggccgcgcgagatatttgggcgaacgctccatcggtcatcaggatccaggtgcgacgtccatctcttatttgattcagtctgcccgcgcggtggcagaagccaaataagctgacacaaaagaataaaattaaaggcgcaggaagcgcagagactgctcgttggcagatcatgacattgatgcaggagcctgtatggagaacagagatgttgtgttaggaaacattaagtcaaatcttctgcacgaacttccgtaggaatatgttgtaaaaaagaactggaaagatatatgccggaattgttggtggttttctgcttggtaacggagtaaagggttacatggacaattataaaaacaaattaagtggttgtacgagtcttgacgatctctttgaaatctggagaaataagccagcaaaggaaataacatatctgtcaggaaagaagtcgatcaccaaagttatcaatcatggtgtcgatttttttatatctgacgggattgtaaatcaggacgtctggaatagtggtgaacggaaaagaattctttatgttctgaaagaagcatatgggacagactggggcaataagactctggtaagttggcttagaatcgatcatccacgcacccggatatggagtcgtgtagccagattaacatatggaatagaacattcagaaaaagataggatcgcgcgatataaaaagtatttgtcagattccgagcatgcgtcagcattagatcagattgctatattgaatcttaaaaaaagcggtggtgaatccacatcaaataatgatgagattgatgcttatgccgcttctgacaaaaatgaaattcaaaaggagatcgatttgattgatccggaaataatagtctgtggatatacatttggaagtttgctgacaaaggtattatgtcgagtacctttaaccgatgaaacgcggaacgataaccggtactactatatggagatctgcggaaaggaaagacttgtcatcgattattaccatccggctaatcactacccagactttatgaattattacggcttgatagggatttatcaacaggccctcataagaaaataaaacaggaaggagcaacagatattttgtagcaattgtgggaaagaggtacagcccgatgcgaagttttgtccttactgcggtacgccgatcaaaataggatcaaccgcaaaaaatagcgatgagtatgagttgacgattaccaggacaaaacaagacggcggcgggtttataaaaatcgctgtttccgttgatggtaaaaagctcggtaaattgaaacgcggagaatcgattaggacaagcgtttctgaagggtatcataagattacggcgacattaaatgcacaaagtaagagccttacgtttataaataccgggaagccgattattgtttcctacgatggatttgatgtagctatttctctgcctgatggtgcagaagggtatgtagagaataaaagcaatgcagaagttgttcagagcaatactgaggcagagggtcagaaggataatccggttctggcgtttgacgcgacctcagcttatggaaaccagggaaaactgaaaggaaattgacaggccttcgtgcctgtcaattctttttaaaatcaattgacgaaaagaggaattcttatggcagcaacaaaagaagatgtattgaaattcattgaagaatttgacaaacgcatcgaagaacatcatcaggaattgacggatctcgaccaggccatcggtgacggcgaccacggcatcaacatgaaccgtgggatgaaggccgttatggaaaagatcccgagtgtgcaggataaaaccatcaccgatattgtcaaaaccgttggaatgacgctgatgtcaaaagtcggcggtgcctccggtccgctgtacggcatggcctttgtgaaagccagcgccaaagcgaagggcaaggaagaactgagcccggaagatatcagtgaaatgatcggcgccgccattgcgagcatcgaaaaagccggcaagtcgaccacaggcgaaaagaccatgctcgacgcgatctgcccggcgaaggaagcttacgacaaggcgattgcagacggcaaatccgtcgcggacgccttcgcagacgcggaagacgctgcatggaaaggtgtggaatacaccaaaggcattatcgccacgaaaggccgtgcgagatatttgggcgaacgctccatcggacatcaggatccgggcgcgacgtccatctcttatttgattcagtccgcccgcgtggtggcagaagccaaataagctgacacaaaagaataaataaaaaggcgcaggaagcgcagagaccgcgtatgaatacgcggtttcaaaagagccaggaaggccgcaaggatcatcgtgatcattgtggcctttttcagcgtcagcggctgatcagctcagtgatgatacgggctgcgtcgagaatgtcctctttcatggactggtgggacgcgcccgcgatttgaatgccgcagcggctcaccggaattaaaactttttgagctcggctctcagagaccgccattgcaattttcggggtaatttctccgagcagggcattggccgcgatgatgccgagggggccggcgatgatgtcggcgcgcgccgccagaacgacggcagggttttccccggtcgcgccccggtcagcgccggccttgatcatggcctgagtggcgatgctgttggtgccaaccgcgatgacggtatgggtttcggttttgctgcttaatgctgaaatgagacgggcgccgatctggccgccctgtccgtcgatcacgagaatattcattatctcatctcctttttcgaaaagttaatataatatcattaaaattataactgattttatgcttttgtaatactgaaatttgtgttttattatgaataataaagtaaaggagtttaaccatgcatatccctgataattatttaagtccgcaaacctgcggcgtaatggccgccgcaatggtgccggtgtgggccgtttcgatcaataaaattaaaaaagacatgcccaaggccaaaatcccgatgatgggggtcgctgcagctttttcgtttctggcgatgatgttcaacgtgccgattccaggcgggactactggccacgccgtcggcggctcactaatcgcgattcttctcgggccctacgctgcctgtttgtcggtgagtgtcgccttgcttttgcaggcgctgattttcggggacggcgggatcctggctttcggcgcgaactgttttaatatggcttttgtcctgcctttcgtcggttacgcggtttataagctcattgccggcggtcaccaaaaagacacccgggaatacgttggtgccggcatcggcagttacctcggcatcaacgcggcggccctctgcgcggccattgaattcggcatccagccgatgctgttcagagacgctgcgggcaatgcgctgtactgtccctacggtttaaacgtctcgattccggcgatgatgatcgggcatcttacggtgtttgggctggctgaggttgtttttaccgtcgccattctagcctttgtccgaaaggccgcgccggagctgagtgtcagtacggcggaatccaaatcgtccaaccccctcaaggtgcttttggccgttttaatcgtggccacgcccgttgggctgctcgccgcggggaccgcttggggagaatggggcgcggacgaaattgccgcgactggcgtcggctacacgccaaaaggcatggtgcacggtttcgattacagcgcgctgctgccggattactcgttctctggactgcctgaatggttcggttatatcctttctgccgtgatcggtgtcgcgctgctgatcatcatctttaggctgatcggttacgcggcgggcggccgctcgaaaaccagtcacgcgtgagccgcgatcaaaaaaaggaaaccctagaaagacattcgaattaaaatatgagactgaatctaaaagtcatggaattaaccggccggcttttgaaaaacgaccgtgagaacgccgggcgaaagcccagccccgtcgcgccggctctgagggtcggtgcagcggtgctctgtattctgctctgcgccatctcgcaaaacgctgtttacgtcatcaccgttatcgccgtcgagctgctcaggcttgccctgatgccgcctgagcgcatcctcagggttttaaaggccttgatcctgccggtgatttttacggcgctgatcatgctgcccgccgttttcttcggccacccacggaccatgctcacggtgacgatgaaggtgtgtgaatcggtgctggtgctcgcggtgatgaacgaaagcctcgactggcgcgaggtcaccgaggccttcagcgtcacaaaagggatggcggtcttcgtcctgattctcgacatgacaatgcgttttctgatgatcctcggcgattacagcgacaaactgctggaggcggtcatgctcagaagcgtcggcaaaaccaattggaaaaacgcgaaggtggacggcattctcggtacgacgtttttgaaatcacggcagatggctgaggcgacgtcggaggcgatggcctgccgctgctttgacgggcagtacagaagctaccaccgccaccgattcacctggcaggacgtcttgtttctcggggtctacgccgcgatgatcgcgctatttgtgatgacgaaataaaaaggagacaatatgattcagctcgaacacatcgattacgattatcaggaaatcccggcgctccgggacatcacctatagttttgaaatgggaaactgctactgcctcgaggggcctaacggctgcggcaagtccacgctgtttcggatcctaaacggcctggcctttccgaccggcgggcggtatttattggacggcgaggcaattacagagaagcgcctccgagacgacgcctttgccaaggtttttcacgcgaaaattggctacgtcttccagaattctgaggtgcagcttttctgtaaaaacgtcgaggacgaaattgcctttggcctttttcagctcggcctgcccgaagacgaaatccgggagcgggtggaaaaatacatccgtttattaaaacttgagccgctgagaaagcgcacgccctacaatttaagcggtggtgaaaagaaacgggtggccctcggtgcagtgcttgcgatggacccgccgattctgatgcttgacgagccgttgagcggtctcgatgaggacggtcagcaatggatcaccgattttatcgcgtccttaaagtcgacggggaagctgatcatcatttcaacccataaccgcgagctggccgagcggctcgccgacgtgcacgtcaggatggacaaggaccaccgcataatctgtccttagagcccataatttttcatttacaatgcagactgcgggccgtaaaataaaaatagttatattatttcatagagaaggggaagaaacgatgaaagtcttactcgtcaatggcagcccgcatcagcacggctgtaccaaccgcgcgcttcaggagatcaaaaagacgctggagcaagaaggcgtcgaagcggatatcttttggattgaaaacgacccgattcgcggttgtatcgcctgtaatatgtgcctgaaaaacaagaaatgtatttttgacgatgtggtgaatcaattctcgaacatcgcaaagttctacgacggctttgtgttcggctcgccgacctattacgcgtcgtcggccgggcagatgagcgccttcatggatcgggtgttctattccaatatgaacgccggttccgatatcttcacccacaagccggtcgcgtcggttgcgtcctgccgccgcgcgggggatgtggcggccctcgatcagatgaacaagtactacggcctcgcgaacatgttcatcgtctgctcgagttattggaacgaggttcacggctttacgcccaaacacgtcgaaaaggatgaagaagggctgcagaccatgcgcaaccttggccgaaatatggcgtggtttttaaaatccgtcgaagccgcgaaaaaggccggcgtcaaggaacccgaaatcgaaaccggtcaatacacccattttattcgttaagctgtttaataaataatttgcggcataaaaaaatcgcctgtatcctgaggatgcgggcgattttgctttgcttagttaacggtcttggtgacgtcgtcaatcttcgcatttgttaaatcttcgccgaaccatttcttagtcagcttgccgaaggtgccgtctttcttaatttcgtcgagggctttgttgatcttgtcgcgcagttttttgtcgctcttgcggcagacaatggcgatcggttcgttggagagttcgtcagaagtggtcttgtagacgtctggcttctgagcggtgtagaagtctgcaactggtttgtcggtcatgatgtagctgatctggccgccctggagagcggtaaacgcgtcgaccatcgagtcgaattccttcaggttcatcgtgttgccatcttttctcaagtttttcgcggagtcgtcagcggtggtgccgagctgaacaccaaccttctggccgttgaggtcttcggtctttgtagccggggtgacacttgctctggagacgatgacgatcccgttgccgaggtaggaatcgctcattgcgaaggatttctgacgggcagtggtgttgctgacaccggagatgatgcagtcgtactggccggaattcaaaccgttgaaaatgccgtcaaagtcggtgtctttataggaagccttgaccttgagcttcttcgcgatggctttacccaagtcgatatcgaagccaacgatcttgttgtctttgttcttgtattccattggggtgtagtcggcgcttgtcccgattttgagcacaccgtcagacagcgggtcagagtttttggagccgcagcccgcagcgagtcccgcgacgcttaccagcgtaagcgctaaaacaaatgcgataattttctttttcattgctgaaaaatctccttccttaaggaattatttattttaagtttaattataaagcaagttagaataaaatcaagagtatattataaaattacggaaataatggataaaaatacaaatttttacagaagaggcgaaaaaatatggatcacgcgctggaaatttacattcacatcccgttctgccggtcaaaatgccggtactgcgatttcgtttcctggccggaacatgatttgaaccgcgtcaaacagtatttcgaggcgctcaaaagagagatcgcggcctttccctacagcggtgcgctgcccattcggtcggtttatttcggcggcggcacgccgtcagcggtgccgtcgtccctgctttctgatacgatcggcgctttagaagaaaaattcggctttgactttcaaagggcggcctttgagaaaaccatcgaggtcaacccgaaaacggtggacgaaaaaaagctttactattatagaaggctcggcttcaatcggctgtcagtgggcgtacagagctttaatgacgagctgctcaagaccatcggccggctgcacaccgcggacgaagcggaaaagaccctccgcgacgcggcggccgccggctatgacaacatctccgccgatttgatcttcggcctgccggggcagactctcgaggatgtggaccagacgatcgacaagctttcccatttcgcaccggtgcgccacatttcctgctacagcttaatcgtcgagccgggaaccgtctttgagaaatggcagcgcgagggcaggctggccctgccggacgagagaaccgagcgggcgatgtatcacgatatttgtgaacgcctcgcggaaaacggctttgaacagtacgaaatttccaattttgcccgtccgggttacttaagccgccacaattccgggtattgggatttaaccccctacgccggatttggcctcggcgcggcgtcattattcttggaaaacaaagcgccaggcgaagacggcgccttcctaagaaagacgacgacagcggattttgacacgtatttacaaaatccggccgcctgcgatgaaaagcatcggctctctaaaaaagaggccgagggcgattacatgttcttgggccttcgcagaacaaaaggcgtcgacgacagggatttccagacgttattcggcgaatccattgaaaaccgctacgctggagaaatacattccttaatagaagaaggtctgctcgagcgggagggttcgcgaatccgattgacgacccttgggctggacctggctaaccaggtgtttatggcctttgtctgagggaatggatattggacaagaagcatcaacttaaaaacgtctgaaaattttcaaaaagtgaaaattgagactgaattgttattgacaatttgaaaaggcggtgctatattatattcaagatgttagcactcaaataaaaagagtgctaataaataaggtggtgagtatcataaagccgagaaagaaaaaaattctagaagccgtaatcagagattacatcaatacggctgaaccggtcggctcgagaacattgtcgagacggtacgatttgggcgtgagtccggcgacgattcggaacgaaatgtctgatttggaagaaatgggttatctgatgcagccacatacctcatccggcagaattccgacacagaaggcttaccgctattatgtggacgaaatcatgcagatcaaaaagctggctgaaacgatgcgccgggatattcaccggggctacctgcaggcgggtcaggaaattgacacggcggtcaaccacacggccaacgtcctgtcacagctgaccaattacacggcagtggtgctggcgcctcgggtgtcgcgtttcaactgcaagcatctgcagatcgtgccgttgattcgcaaccgcgtcctggtcgtcatggtgacgatcgaagggctcgcgcgaaatttggaagtgaccttgtcctcggatgtggacgacgcgatggcgctcagaatgtccaacgtgctcaacagcattctcaagaatgtggcctttcaggatttcggtacggatctcatcgacaagatcggcgatttgaatccgacggaaagacagcttctcgacgagttgattccgatgattcgggatgcccttctcgaatcggaaaccaacgtgacggcgagcggcttcaagaatctgctgaattatccggaattcaacaacattgacaagatcaaaaatctcgtcgatgtcgtcgaagcgaagccgctgctcgcgaaagtgatgatcaacggagctgagcggaaagatgataacaacagtgtcattcacgtgaccattggtgacgaaaatgacaatcagcatttgaaggaattttcaatcatcacctcgacctacgagcgagagggtgtgccgatgggcgcgtttggcgtcatcggaccgacgcggatgaattattcgcaggtttcatccattctcgacgccattcgggatgaattgaatgccaatattgtgaaattgctgaaatagaacaatcaatatcaaaggtggaaatatggcggaagaaaaaaacaaaacgcaggccgcagccgacgaaccgcagcatcaagaagatgtagcggaaaaggaagcggcgaagcaggaagatccaaagggcactgacacaaaacaggaagccgaaacggatcagcagccggaagaagaaaaaccggcagaaaagcaggaagcaagtgacgccaaagtggcagcgctgacggatcagctgatgcggctccaggctgacttttccaattacaaaaagcggacgagccgggaaaaagctgaaatcgcctcgtacaccaccgaagagctcttgaagaagctgttgccgattatcgacaatttggaaagagcccttgcggcgagcgaaaacgacgacggcagcgaagaacttgcgaccggtatcaaaatggtctacaaggaaatgatgaagacccttcaggacgaaggacttcaggaaatcgaagcggaaggcaagccctttgatccgaaatatcaccacggcgtcgctatcggaaatgaagacgacgtggacgaccagatcgttttggacgttttccaaaaagggtatatgtacaaagacaaggtgattcgggcggcaatggtccggatcaatcaaaaataaatcgtatttaaatttagaaatgagaaactcaggaggaaagagttatgagtaaagaaaaaatcatcggtatcgacttaggtactacgaattcctgtgtggctgtcctcgaaggcggcgacccggttgtcattccaaacgctgaaggcagccggacaaccccgtcagtggttcagatcaaagacggcgaacgtctggtcggtcaggtcgcaaagcgcggcgccatcaccaacccggacgggaccgtttcctcgatcaagcgccacatgggttcagattataaagtcactattgaaggcaaatcctacactccgcaggaaatttcagcgatcatcctgcagaaactgaaagctgacgcggaagcttacctcggcgaagaagtgaaaaaagccgtcatcaccgtgccggcgtacttcaacgacgcacagcgtcaggcaacaaaggacgcaggccgtatcgcaggcctcgacgttcagagaatcatcaacgaaccgaccgctgcatctctggcttacggccttgaaaagggcgaatcccagaaaatcatggtcttcgacttgggcggcggcaccttcgatgtctccatcctcgaactcggcgacggcgtcttcgaagttaaggcgacagccgggaacaaccacttgggcggcgatgacttcgaccagaagatcatcgattggatggctgacgaattccagaaagaaaacggcgtcgacctgagacaggacaagatggccctgcagcgtttgaaggaagcggctgaaaaggccaagatcgaattgtcctcgatgctgaaaactgaaatcaacctgccgtttatcaccgcaacggccgacggtccgaagcacctgcagatggatctgacccgtgcgaaattcgatgaattgacgagagaccttgtcaacgcgacgagaggcccagtcaaccaggcattgtctgacgccggcatctccggctcagaactcggccgtgtcctgcttgtcggtggttcttcaagaatcccggcagttcaggcggcggttaaggaaatcaccggcaaagaaccggacaagagcatcaacccggacgaatgtgttgccgttggggcagctatccagggcggcgttttggccggcgaagtcaacgacgtgctgctgctcgacgttaccccgctttcactggggattgaaaccctcggcggcgtgaccactaaactgatcgaacgcaacaccacgatcccgacgaagaagagccaggtcttctcgaccgcagcggacaaccagaccgctgtcgacatccacgtccttcaaggcgaacgtgaaatggcgagagacaacaagacactgggccgcttccagctgaccggcatcccggctgcacgccgtggtgtgccgcagattgaagtcaccttcgacatcgacgccaacggcatcgtcaacgtctccgcgaaggatttgggcactggcaaggcacagaacattgtcatcaaatccacttctaacatgagcgaagccgatatcgacagagcggttaaagaagcggaacagcacgcagaagaagataagaaagaaaaagaattaatcgaagcgaagaacaacgcggatacggctgcataccaggctgaacagtccttaaaggacatcggcgataaggcgactgcagacgaaaaatccaaggttgaagacgcgattaagacattgagagaaaaagctcagggcgacgatctcgacgcgattaaatccgcaaccgatgcgctgaacgaatccctctacccaattgctcagaagctctacgctgacgcacaggcgcagcagcaggctcagggcggcgcacaggctggcccgcaggcgggtccacaggccggaccgcagcagggcggcagcaataacggcggcgacgacaacgtcgaagacgccacttacgaagacgtcaccgataaataatcatctgcataaaaatggataaaaagaaagggcagcttgcacgagctgcctttctttacaccggcgaaaatgatataatgctgtgcagtttgaacagcaaagccaaaagaggtgattatcaatgagtgaagaaaaacgcgattattacgaagtgctgggcgtcgacaaaaacgccagcgctgatgaaattaaaaaggctttccgcaagctggcgatgaaataccaccccgaccgcaacccggggaacaaagaagcggaagaaaaattcaaggaaatcaacgaagcctatgaagtgctgagcgatgaagataagcgccgcaactacgaccagttcggtcacgccggcgtagacggtcagggcttcggcggctttagcggcggctccggttttggcggcttcggcggctttgatgatatcttctcagatttgttcggcggcggctttggcggcttcggcggcggtggcggaacctcctccggcagacgcggcccgtccagaggctccgacatgcggatcaacctgcggctgtcctttaaggacgccgttttcggcacggaaaagaagattaagatcaagcgccgagaaacctgctcggcctgcggcggctccggcgcgcaggaaggctctcacccgagaacctgtgacaagtgcggcggcagcggccaggtcacaatgcgccgccagacggccttcggcatgatggctcagacggtggtctgcgacaaatgccacggcgaagggcagatcatcgacaatccgtgtccacactgccatggaaccgggctcgaagaaaaggaacgcacgatcaagatcacgattccggccggggtcgacaacgattccgtcctgccgctgagaggtcagggcaatgccggcgctaacggcggtgccagcggcgacattctggtttatatcaacgtgcaggaagacccgatcttcaagcgcagaggcgacgatatatacgtcgaattgccgatttcctttatgcaggcggctctgggcgacagcatcgaggtgccgacgatcgacggcaaggtcaagatgaagattccggaaggcacccagaccggcaaggaatttagaatgcgcggcaagggcgtcaagaacgtcaacggctacggcaagggcgaccaatacgtcaccatccgcgttgaaacgccacagaagctgacgcgcagacagaaggaattgatgaagaagttcggagaatccctgacggccaaaaacaatcagaaaggctcctctttctgggacagagtgaagaacgcactttaatcatgagatcaattgacacgctcctcaaagcgggagcgtgtctcagactgtagacaaacgaggctctgagaaaatactcagagcctcatttgatttaatatcaagctgcaatttgtagatttataaattgaaatcgaaatataggacgattcggtcccgggtgtttttttcaaaatatttttgctagtttttttagattcatgcatgcgaaagtaagcccgactttcattctatgcggcgttaccatacatttgtgtgtagcggaatccatgcgcttctttcgcagttccgaaaattctctcgatggtttcttttctgcgattataaattgctttcattccgtttgtgtgtcggatgtcctcgcagatttccatgtagtgggcccatagtgtgggctgaccactttgacatgatttttatcatgggtgcactggttaagataaggacagtctttacatattcagaacggcttttgtattcctgaactcgcggttggtggttgaatattttaaaatttgattatggggacagatgtaacagtcaaaagcttcatcgtagacgtactcatattttttgaaaaatccttttcgtcattggtcgtttatacgggaaaacgggtttgataccgtcgtctatgagcagcttagcaatggcaggggttttataacctgcatctgcaacatcatttccggattatgcttcttatcttgtcataaaggcctttaaaggttcggctgtcgtgcagatttcctgcgttgacgtcatagcgatgatccatccgtttcggtcgcaggccgtttgaaccgcgtaggcgaagacttgtttatgttcgcctttgtgaaaccagccgctctccgggtggttgtacttactttgtttccgtgttttgagcctgggtgatgttcacgtcttcttgatcgtctttatctttcaacggtttttgtggtgggcttcccggtctctttgaatctcttgttaactgcgtttcataaaaacatcgcttcatttctggcaattttcttttgtttctttattattggctcttgcctttacatgtgtggcatctacgaagatttctctgggatcgatcaaaattggtttgtagcattctgagaggatatgtgcgaagatttcttcgaaaagatcggtatctttaaatcggcgcgtgtagttcttgccaaaggtggaaaaatgcggaactttatcgtgcatatctaatccaagaaaccaacgataggacattgacctcgatttctttgatggtctgacgcatgcttttgatgccgtaaaggtattggataaatggaatttaatcacacaactggatcgatgcttggacggccctgatctgccgaatacttttcctcaaccagttcatgataaatgaccagtcaatggcctcatcgatattcgaagaagatgtcttttggaaataagtcgtccatacaaaattttgaatttgatctcgttttttcaccgtttgtgtcagatcttttttctcctgcgtaactgaatgcatggcctgtttctattattgctattttaccacgtttgtattgcgacaggtgaaaaatgactgactgctataaaaaaacaaagcctagagcgtttccctctagactttgtcgacagtctgtgacacgctcctcaaagcgggagcgtgtctttttttacgcaaactttaaaaccttttcatctaaattgcgctgaggtcattgacgccataaggccattttgctagaatatttatatcaacaagtgtatgcttaatcaatcaattttactgatagacaaggagagaaatattatggaacatattcaatttgatgccagccgcataaaggattttgtccgcgatcacgaattggaacagatcaaagcgcaggctgaaacggctcgcaaaactttaattgaaggcaccggagctggcaacgacttcctcggctggatcgatctgccggtagattacgataaagaagaatacacccgcatcaaagcggcggctgaaaaaatccgcaaggattccgacgtgctggtcgtcattgggatcggggggtcctatctcggcgccagagcagctatcgaatttttgaaaccgaatttctacaatcagcagtcccgcgacctcgttgacgcgccggaaatttacttcgccggcaacagcatcagcggtgcgtacctcaacgatttgatcgcgttaattggcgaccgcgatttctcggtcaatatcatctccaagtccgggacgaccacggaaccgtccatcgccttccgcgtcttcaaggcgaagctggaagccaaatacggcaaggaagaagctgcgaagcgcatctacgcgacgacggacaaggcccgcggcgcgctgaaaaccgaagccaatgaagaaggctacgaaagctttgtcattcctgacaatatcggcggccgcttctctgtgctcaccgcggttggcctgctgccgatcgccgtatccggcgcagatctcgacgcgctgatggccggcgctgcggaaatgcgcgacatggtcaagacgacgccttttgaagacaacccggcgatgcagtacgccgcgatgcgcaacatcttcagaaacaagggcagaatgatcgaattgctcgcaaactacgaaccggcgctgcacaacatttccgaatggtggaaacagctgtacggcgaatccgaaggcaaggacggcaagggcctttacccggcgtcctacgacctgtcaaccgacctgcactccctcggacaatttgtccaggacggcagcaacatcatcttcgaaaccgtgctcaacgtcgaaaaaccgatgtctgacgtgacgattcaggcagatccggaaaatctggacggcttgaacttcctggcggacaagaacatggacttcgtcaacaagaacgcgatgatgggcacgatgctggcgcatacagacggccaggtcccgaacctgatgatcaagattccggcccgcgacgaaaattccctcggccagctgttctacttctttgaattcgccgtcggtgtcagcggctacctgctgggcgtcaacccgttcaaccagccgggcgtcgaagcgtacaagaagaacatgtttgcccttctcggaaaaccaggttttgaagaacaggctgaaattctgaagaagagattatctgaataatttagcgtaaacaataaaggaaaacgcccggatccgggcgggaaaagggagaatgagatgaaaccttacgctttcggtgtggatattggggggacatcgattaaaatcggactggcaaagacatcgggctggcttttcgaaacccggaaaatcggaaccccaatcgatctttcggcagaatcctttctactcaacatttcggaagtgatcaaacagcgcattcacgcgcggggcctgcacccggacgattttgaaggcatcggggtcggcgttcccggcccggtcgatgaaaagggcgtggtgcatggctgcgccaacctcggctggggcgaagtggacgtgaagggcattatggagcgtgcgctgggcatcccggttcaggtcggcaacgacgccaacgtcgccgccctcggcgaaatgtggcagggcggcggcaaggggtacgccaatcttgtgatggtgaccctcggcaccggtgtcggcggcggcgtgatcatcaaccggcacatcgtctgcggacaatacggctcagccggggaaatcggccatctgcacgtgtcggatgacgaaaccgaaccctgcggctgcagcaattacggatgcctggagcagtacgcttcagccacggggatcgtccgcacggcggcgcgtctgctggacgcgcatcctgaggccaactctattttgaggcagggcacgcctctcgacgcgaagctggtctgcgacagtgcgcgggaaggcgatgaactggccttatcggtcgtcgaagcggcgatggatcagctgggcaaggccctcgcgatgatctcgtgcgtcatcgatccagaggtttacgtgatcggcggcggcgtttccctcgcgtcggatgtgctgatgccacccttacaaagggcctacaaacgctacgcctttccttcatcgagagatacggctttcaagaaagcgactttgggcaatcaggcaggcatcattggcgccatcaagcttacgatgccggatgccaaagaaaataaggagaaaataaaatgacggtgaaaagaataggcgttctgaccagcggcggtgatgcgccggggatgaacgctgcgattcgtgccattgttcgaaccgcagtttgttacgacatacaggtgtacggcatcgaggaaggttttcacgggctgaacgaagaaaaattcagacctctcaatggccgcagcgtggccaacatcatcgatcggggcggcacgatgctgcagacttcccgttcggcatttttcaagaccccggccggcgtcaagcacggggccgataaagtcaaggcctacgatctcgacgcgctgatcgtcatcggcggcgaaggctcgatgaagggcgcgaaggcgctgagcgatctcggcgtcaacgtcgttgtgattccgggcaccatcgacaacgatatcggcgcgacggattacaccattggcttcgacacggcggtgtcgaccgcgatcgacgcgatcagcaagatcagagacacgtccttctcccacaaccggatgaacatcgtccaggtgatggggcggcattgcggcgacatcgcgatgtacgcggggctggcctgcggggccaaggcgctgatcatcccggaaaaggaagtgcccctcgaagatatctgcgcgaagctgatcgaaggccacgaaagaggcaaaatgcacagcattatcatgctggccgaaggctgcggcagctaccgggattacgtcccgaaaattcaagagctgactggcgtagaaaccaagggcacgaacctgggttacattcagcgcggcggcgcgccgagccatttcgacagacggctcgccagctacatgggcttccacgcggtgcgggcgatcatgaagggcaacgtcaactcgatggttgtgacgaaaaacgggcaattccaagtgattcctctcgatcaggcgattgatacgccgaaggtgttcgacgaggccatgtacgatatgattcaggtgctctccatttaagtcaaatagaagtcaaatagaagacataaaagattttgagctttgcttttataagcggatccacagggggtccgctttttttgtgcacaaattgttatccacttattcacaaaattatccacagtcattttacggataacactggacatggcggctttatccacacttatgcacaattctgaaaggctttttcaacaggttgtggacaggttataagattcttgtactcagatacactttttgataaaataaaaacattaatgaagagaggatgacggaatggaccgaaataaaaaaatattgatcgcagcttgtgtggtggcggtcgcgatgattatcgtggtcggcattctgctggcgatgtccgggagggatgagacgccgttgagccagcacacactccagctgaaggtaaacggctgcgacatcgacgtgtcactgaagaaaaacaacgcgacgatcaacgccccgtcgctggctgtgggcgagaacgaatttgaagtgctgggttatccgggcggtactgtcaaggtcaacggcaagaccgtcaaggtcggcagcaccacgaccattgacgtcgacgcgatttcatcggaaaaccagattgaaattacagtcagcaacgtgaaggacagccgaacagttcagctcagaacctactcgacgcgcctgcccaagctgcgcgtcatcggcagcggcgtcaaggacgggcagtacctggtcaccgaagcggatcggccggtcatgtacgcgctggacgacgaaggcgatgtcatctggtacaaggcgctgtcgtccaaatccaagacgcgcttttccgattttaaatgccaccagaccgacagcggcacctattactcctatcaggtcatcaatccggacgccgacaatttcggcatttcggactatcgtccaggcaagcgggttgtcatggacgatgaattcaagaccgtgacagaagacgccggcattactgcctacaaaaagggcgaaagcatcgattggaaacaggcgggaacagcgatcgacggcaatgcctttgaaatgctctcgcgccacaacacctttacggtgcgccgcaagccgacccgcgcgtccaatatgccggagggcctcgatgccaaggataacacgacggtcgctgcggtgatcgtgcagaacgccggacgctcgagcgtgaactgggaatggaacagcacgaatgtggcgcggctgtacagcgactcggtcgccggcaacgattatacgagcgacgacattcaggattatttgaatccgtctgcgatggtcgtcgacccgacggacggcaacttgatcctttcctttaaaaacgcgaattgtctcgttaaaatcaacagcgagacgggcaagctgatgtggaccttaggcggcaattccgatgaatttggcttgaagagcagccagaaattctcaggccagaccgacgtccaggtgtcggaagacggcacgctgacgatcacgcagccggggaaaatcacgatgctgaagctcgacgaagggaacaaggccgtcgcgtcgattcggacgaaaaacatcgacaacgcggtcggggccaatttgatgaatacggacaacggcgtgctctgcgtcggcaaaaacggcagtgtgctcatcgaagaacgcagtgtcgacgggggcgaattgaaaaacgcgctgcagatcaaaacgacgagtccgcacaatctcgcgtcagtgcgttttgtgccagctgaaaaacattaatggcaatcaaaagggaccggagacggtccttttttttatgtgtaaacggtcttgaaattactttaagcttatgttaagctttaaaagcaatgttgattgcaactctggagagttcctaaaaggacgccgaaggtgtaagcatccatgcgatgtgatctctcaggcaaaaggacagaggtaattttttttacttcgtcttgactctcacatttttacatgtagaggaggacacatgtttcatttattcaatcaatttcttacgtggtttgacggtattgtctggggactgccgttaatcattttgattctatttgtcggcatcatgctgacgattcggctgcacgttctgcagtttgttcatcttccaaaggcacttaaatttatggtgcgcaacgaagaggacggcgagggcgaagtcacgagcttcggtgcgctgagcgtcgcgctttccgcgacgatcgggaccggcaacatcgtcggggtcgcgacggctatcgtttcgggcggtcctggcgcgctgttctggatgtggatcgccgcgtttttcgggatggcgacgaaatacgccgaagggcttttggccatcaaataccggaccatcgataaggacggtcacgttttgggcggcccgttctattacatcgaaaacgggatggggcagaaatggcgctggctcgcgaaaatttttgctttcttcggcatgggcgtcggcctctttggcatcgggacgttcacgcagatcaacgggattacctcggcggtcaacacctttttcgatccgaaaaacgtcaacaccgtgtcgctgttcggcaatcagtactccctttcagtggtcatcgcaggcctgctgatcaccttatttgcgggcctcgtcatcatcggcggtctgaagcgcattgccggtgtttctcaggtggtggtgccctttatggccatcgcttacgtggcctgcacccttgcgattttgatcatcaatcgccacgcgctgccaggggctttggctgaaatttttgaatcggcctttgggctccgcgctattgccggcggtgctgtcggcacaatgatcgtcgcaatgcagaaagggatcgcgcgggggatcttctccaacgaatccggcctcgggtcggcgccaattgcggcggccgcggcccagacccagtcctgtgtgcgtcagggtctggtctcgatgaccgggaccttcatcgacaccatcgtcatctgtacgatgacggggctttcgattgtgtcgactggctcttggaatgtcggacttgaaggggtcaacgtcacgatccgtgcgttccaaaaagggctgccgattccggcacaggcttccagcttcctgctgatgctctgtctggttttcttcgcctttacgaccattttaggatgggattattacggcgaacgctgcctcgaatacctgtcgaaccggaacaaaaaggccgtcatgacttatcgcctgctctacgtgctgtgcattttcttcggtccgtatatgactgtcgaagcggtttggaccatcgccgatattttcaacgcgctgatggctttcccgaacctggttgcgctgattgcgctgtccggcgtcgtggtcgccgaaacccgggaatatttcaagcacgaaaacgatccgcggattttaaccggtgcagaactcgaggattaaacgtccccgcattataattaagtactaaaaaagtctgagctgttatattggctcagacttttttgtttagctgatttgtcattcgtaataggtggtgtccaggggcgcaatcagatcgagcagaatcgtcgtgaagcggtcgatttcgtcgtggtggcgtctggcggcggcttcgcggctcagtgcctttggcgggttcttttccctgaggtagcgttcgtagagcaggttgttgatgttggcctgggtgatgacgatgccttcgggactgacgacggccagagcgttttcgatcagatcctgggcgagctcaaagtcgtcggtgacgacaatatcctccagggttaaaatttcggcgatctgcgccctgcggtcctccttgtagtggtcgtcgtccgacgagagaccgctgatgccctccgtcgggatctgacattccttcgagagggtctcgcagattttgcgttggtcccgcggcgtcgtgtcgtagtcgacaatgattttcattggcttaaatggcgctcctttctatttttttattattatcttattctgagaggcccgtggcggcgagctgaggggccttgaaaaactgattgtacagccacatgaaccggccgacgccgatcatcgcggcgacggtgccgacgccgatgccgacgatgccgccggtcatcaggtaggacatgaggcaggtcagggcgacgcagacgagatcaaacacgtttttgacgttgccgaggcgctggtgcagccggtcggcaaaggcctggacgatgccgtccccggggttggggaccagccgggtgttgacgttcatcgccgcgccgacgccggtcagggcgatgccgagaatcaagcagacgatccgcgccggaatcgaggtcacatctggcagcaccgcgccaaacaggttgaagaaccgggtcaggatgatcgacagcggaatctgcagcaggtcgtagagcttgaaatttcggcccttgacgacgtattcgatcacggcgagaatgcagtaaagcacaaaggacgtattgccgaaattcaagcgtttaatcgtcgaatagcaataagccagggatatgatcggcgtcacgccaaactgagacttggtgttgagcacgatgccgagggataagattaaaagcccgagaaaatagaagaaccaccgggcaattttatggttcatgctgtcatctctttctgtttaaatttgcctttatagtataacagaaaaatcctcatttgttaggcttttgttgatggcgcacgatgagccttttggcgcggccgtgaaagagcaggtaggcgaggaggacgatggagaggtaagctgcgaggatgacgagggtcaagaggtgattgtccagcatgatgccggcgccgatcagcgaattaagcaggaagccgggcagccgcccgagcagacagagcttcaaaaacttcgggaagggcatcggcgtcagtcccgccgcgaggcaggcgatatcgtcgggaaagccgggcagaataaagacgatgaagaggatcgtgccgagcttgtcttcgttgagatttaaaagctttttcgaccagtcttttttgtcgaaccgtttcacaaaagcttctccaacccttcgtgtaatcaaaaagcccatgcacgagccgaaaatctctccaagggcgctcaaaagaaagccctgccaccagccgaaaagcatgccgccgagcatggtcagcgggccgccaggaataggcgcgaccacgacttgaacgatctgcaggatcaggaagaccaagggcgtccagacgccaaatccgcacagaaaggtcttaagactcgacagggtgttaaaaacagaccacatctttgacgctcctttccttgaaatttgtacaagcataacacaaagagattgattttatgttaaattttgcttgacaaaataaaattctttagatataatatcattcgtctcaaaaatgaataacaaatcgctcgtagagcagtacagatggagaggtgtctgagctggttgaaggagcacgcctggaaagcgtgtatacgtatataaacgtatcgagggttcgaatccctccctctccgccatttgcaattcaaatgagatgaacgcgatcggataggccgatcgcttttttattgccggcaattgctttttgcaaaaataaaaaaggatcagctctcagctccaggctgagatcctgatccttttttgttgttgggaattacgcttcgtcgcctttatgcatgtcccgtgcctttttggagacgtcgatgatttcgtcgacatcgtcggtcactgaagcctgaaccacaccggtgaaggcaccttcgacgagaggacagtccaccaggtgaattttttccgtcagggcgtcgtcgtcgatcatatcgatcgccatttcggagctgatgattgagctgccgagatcgcagtaaatcaaaatcgatttacagttttcaaaatcactgctttcgagggcttcttgaatgcgaaccgcgtcggtgccgagacgtccgtccgatgtaccgccggcttgacggatgatgacattttcattccccatttcgctgaccaaatcgacaaggccctgtgcgagcttttcgctgtgcgaaacaataagtatacctgtagacatcatattcctccaattcattccattctgtattaaaatcttatcgtcattaattatagcgcaaggcccgcagatttcaagggagtgaaacgcgtttcaacgatgctgtcggtgttttcgaagaatttttttccctttcttttttctgagcacgctcatgtagaggaaataaacctcgacgagaaaattgaaccacatcacaaggccgcagccgacgcggacggacaagacgtcgctgcgcgaacaggcgacagcggtcagaaaaaccagaacggcggcgaggatattaccggtccacagccctgtcgacggaggggagagggtcaggcgccgccggtgccgtttcaaaaagggccgcctggccatctggactgtcatggcgatggcgatcacccaaaagacgacgtaaatccattcgccgacggtggtagacggcagattggtgaccatggtcccccagagggcgcggtacgagatggcatggcccagaaagagaaaatggcggatcaggttgatcagcatcagcagcacgctgatcagcccggccagtttttgtcgcttttcaattttcataacggcctccaaaaaaagtgaaccggttaaagatttaaatgcatgcagtcagcgcaggttgattttgcggcctgtatccggctgggcgtttgagcgggcgaaaaagcggcagatgatcgccgcgatcacgatgccgatgcctgcgccggcgagcacgtctgtcgggtagtggacgaataaataaagccgggagaagccgaccagccccgcgaggaccagcacccacgtgcaccatccggggtgagtcttcttgaagcagaggaagaacgcccacgcggtcgcaaacgccgcggcggtgtgccccgaggggaaagacgtcccgctggggtgggggacgatcgtcgtgaagtgggctgcggtgtagggccgtgtccgcccgaccaggggtttgatgccgaggttgacgataagggacgtgagggccagcgccaatgcgatttggatgccggctcttcgcgttttcggatagaggatcagcaccacacagagggcgatccagacgcgcccgccgttggcgagcagggtgagccctttaaaaaaggtgtcgagggcggggcaggacagcgcgcggtggatggcccagaggaagttgagttcgaccgcggtcatgacgactgtgcctccgcttttttcccgaagagaccgggatggtgggcgcgcaggtattccgcggcggccttggtgttctcaatcggcggaatttcccaattgaccggctcgagccccacctgagttagaaaggcgttggtcctggagaaagggcggctgccgaaaaagccacggtttgcagagagcgggctcgggtgggacgatttgataatcatgtgctgggggttggtgatcatcgggatcttcgactgggcgaaggcgccccagaggatgaagaccaccggcttttcccgagcgttgagcatctcgatgacgtggtcggtgaaaatttcccagcccttgccgcggtgggaagccggctgaccggcccggaccgtcagcaccgagttgagcagcagcacaccttccttcgtccagttcacgagacagccgtggttgggaatcgggcagcccaaatcgtcgtgaagctccttgtagatgtttctcagcgacggcggaatggctacgtcgggctgaacggaaaaacagagcccgtgggcctgatgcggtccgtggtacgggtcctgcccgatgatgcacaccttggtgtccgcaaacgccgtgtagtggaaggcgttaaaaatgtcgtaagggttgggataaatccgccgggttttgtattcgtggatcagaaactgccgcagattttggtaataatcctgggcaaattcgtgcttcagcggtttttcccaatcgttttggaagaaaatactcacgataatctccttaggttaataaatgatataacttaatcttattataaaggatacggggctgaaaagaaagtgtaaagggtgggtgaacggcctcaaaagaattcttgtaatctttttttaaaatgctataattgtatacagtattattcagaaaaggttgaaaagcgtatgattcgagaacaagcgccagcaaaaatcaatatgtctctgcacatcacaggccgccgagaggacggctaccatttgatgcacatggtcaacgtctcagcgaagacgctggccgacacactgacttttgaggcggcgccggcgctgactcttgcctgcgccgatccgaacgtgcccacagggcctgacaatttgatcgtcaagaccgccagactgatgcagcatacctgcggcgtgggcgctggcgtggcgattcagctgtctaagcatatcccgatgcaggcgggattggccggcggctcggccgacgccgcggcggtcatccgcgggctcaaccaattgtggcatttgtccttgagtctggacgagatgatccagatcgccgtcaaaatcggcgcggacgtgccctattgtctggtcaacacaccggccgtggtcacgggcatcggcgaacagatcgcgccgatcgcttcgtttccgtcctttggcgtcctcggcgtcaagccgccgattcctgtggcgacgcctgcggcctttgcagcgatggaccgcgtccagcagcacgtgccctttgacgaccgcgcgctgctcgcggcgattgcgtccggtgattttggggctatggcggatgagtgcgccaacgatttcgaaaaggtcgttttcaaaaaatacccagaggtggtggccatcggggaaaagatgcggagcgccggcgcctggatggccagaatgagcggcagtggatcgacgatgatcggctactttaaaactgccgaggctgcccgtcaggccgcacccgcttttgaaaccggtcagaatattgtatttaccgctggaatttgaatgttaaagagaagaaaataaggcagatatggaagcaacatcaaaaaaacatacgacacttaaaatggatacaaattcctgcaaaccgctgcgggaagtggtcttcgaaacgatccgcagcgcgatcgttcacggtgatttaaaacccggggaacggctgatggaagtcaagctcgccaatgagctcggcgtctcccggacaccggtgcgggaatcgattcgaaagctggagctcgaaggactggtcaagatggtcccgcgcaagggcgcttacgtcacgccgatgtcgatcacggacttacgggagatgatggaaatccgcggcgccctcgaagcgcttgtggctgagctcgccgcgcagcgggccaccgaggcggatctcgacaagatgaagcgcagcaaccagaaattcgaggactgcgtcgaaaaaaatgacggtcctggcatcatcgacaacgatattttgttccacgaggccttttaccagtcctcgggcaatacgcgccttcaaaatatgattcacaccctccgcgagcagatgctgcgtttccgcgtcgaatacgtcagacggatcgcgatgaaaaagccgctgccgggtcagcataacgaaatcatcgcgggcatcgaaaatcacgactccgaacgggcgggccgcgcggcgctgcgccacatcaagctgacagaagacgatatgctcgtgctcctggccgacgacgaagcctttgaaaatgatcaataaaaaaacgtcccatttggtttggttaaaatcaaatgagacgcttttctttttgtgattttttcttacaaggccttcacttaaaaaccttttaaaagggacgggtgtttgaggaagatgatgtcgaaatgggtcatcgtctggtcgcggtctaaatcgaggtcggtcaggtaagaccggttgccgtagacagcgtggacgccttcccgcgtcagggtgtcaggatcgtcgagggcggcggcgatgaaatccgcgtcggccttcgaccgttcgaccgcttcgttaaagaggtcggtgtaggacgccgtcgaggtttcgccggtgaccggatgctgccaggcgtggtggtccatgttcaagacgacgggctcgttggtgtagggcgggtagaattcccggctgacgagcagctcctgatgcgccagcttttcgatgtgacgcaggacgttgcgcttgcggtttgtcgggtcgctggtcatgccggcgacggcgtgggccgccttgaccgcccgcataaaatcaaaggtgtcgaggggcttgtcgaaaacgacggtgaagatgttttccattaagcggccgataattttggcttcctcattggaaatgcggaacagccgcttgaagttgaagtccgtcgcaagctcgccccgttcgtactgcagataggccgtgtccagaagcacctcgtagtaggtgtggatgtaggcgaagacccgcgtggccttgtcgtgctggtactggccggtgtggtaataaataaacgggtgggttttgccgtcgagctcgtgatgaaccgagaagcccatcaaataagcgaggcaggtgtcccgttcaaagggatcctgaagcttcagggtgtaaaataaaccctgatggaaaaaggcgtcgacgtcgtggctgtgaatcaaactgccgtatttcatatgggaagggtgccccggggaggggatcagatcaaaaaagaagaaatccggcccttccgcgccgaggtaaaaggcgtcgggatgggaatcgactgcgatcccgaggggcgactgggcatcgagctcgtgcgcgagatgctgcgcgcagtaataatgggttaatttttcagacattttgaggttcctttctcaaaaattggatattgcaattatttaaataatatactaccatagaatactttgaaaaatataaaaatcagaaaaggcggaacaacatgtatttaaaaggcattgcattttttccacggtttaaaaattcggatatcgcagaattggcagacacccatccagagtgggatcgggccgtccgcgatttggcgctgagcgtcgccaagacggcgccgaagacgatcgtctacctcagccagggcgaaccgagcttcaccgacgcactggcggtgctctaccagccggggctgatgggcaagtgcggcgaccgctggcttcagatgacgggcgacctcaatctgatgaacgatttccacgaccggctcaacgagtcgggcgtcgacgcggtgtttatcaacgatactgaggccgaacgctacgacatcacgccggtgattccccagcccctcaacgcggcggtgacggcaattgaccgggtctatcccgatcacgaaagcgtggtggtcaatgtcggcggcgtcgaccatacgacgctgtaccgagccgggcggattctgcgccaggccatcgagtcgggcgaccgggatgtgatgatcgctgtggcggctgaccagcggcaggccggcggatttttagaggcgctcgaaggtcaagacacagctggtctgatggcccttttggaaaagccggcggaaagcggtgatttggctgcggatatcatggccgctggcgcgaccgacggcatttacacgaggtggcacgatttgggaaaagaagggctgaccggtgtcggccgcctcgattacgatttagaccgggacgacccgacctacgaaagtctgctcgcacagatcgatcggaaacgcacggcggcgcaccgaaaggtactcagcggcgcggatccctacgtcggacttgcaatggccgctgtcgaaaaatgggttcgggaaaacgcccagctcgattcggagcttttcctcgaaaaatacaaaacagattatcccgacgacgtggcgcggatgatcgattcggtcgaggcgtcaggtgtctttgtcacactctacaagagcggtgaggttcgaggctgggccggtggctttcggccgaccgcgccggatatttcccgggaaattgtgaaaacggcgatcgcggcagcgtccgaagatccgcggtttctgcagatcgaaacggaagagctcaatcaaatcacggcgaaagtcgacatcgtgatgaacgtcgaggatgtgtgggcgctctctgaaatcgatccgaaaaaagaaggcgtcgtagtcgaaaagggcctcagggccagctttgtcatgccggacgtgagctttgcatcggcggaacaggccgtggccaaggccaaggaaagggccggcatcccggcggatgagcccgacgacgagcgggagttcggcggcgacaaattgttcatccgcaaatttaccgtcgagacccacgcgctggacgcgtaaagtaaatcattgcgtacaaaaaaacgccgggcattactgccaggcgtgaatcaatacgaagtgcaggccgtcaattaaatcgacgcgccaaaaggcaaaaataataaacaaaatcattaagcacaccggtaggccattgagcgccactcggatgtcctgcccgcttaaatccatgtgcaggaaaatgctgagggccaggtagccgacgaggacgcggagcccgatcatggtgcagaccggccagaggtagcggccgatcaagtagagggtgacgatgccgaggagcaccggcgcgatggaagacagcgtcagctgcagggactggcggacgcgtccgccccggggcagaaaattgacggagccgagggcgccggatgtgggcttcagcgtgatgcgctggatcttggcgccgagcacccaggccaacagcgcgtgggccagctcgtggtggacgacgccagggtaagtcaggtaattggcgaaaatcaacgcggcggtgggtcggacgatcaggctcaagagccagattaacgtctggcagatgagccggatcccgagcccgagcaccgcgataaagagcggcaccagcagcgtgttgatcagcgccgcctgccaccacggcccggaggcggcggtcaggtgataaaaggcgatcagttggttcatgacgttaagccttttttaaatgcaggttgtaataccatttgaacagcgccgtgccgatgatgaaggcgtagccgacgaagctccagacgtcggggatttcgccaaagaagaacagcccccacatcgtcgcgaacagcacctgggtgtagtcaaagacagaaatttccatcgccggcgcgtgggtataggccgcagtgactgtgagctgcccgccggccgccgccgtcccgccgacaatcaggcagagaaactgacggatcgtcatcggcacgaaatgaaggatcgtgaagggcaggcacagcagcaccgagaacagcgagaaggcgaagacgatcaccgggccccgttcgccctgaaggccgagcttgcgcacaaaggcgtaagcggtgccggcgccgagaccgccgagcaggcccataaaggccgggaagctcgccgcgaagccggcggagggtttgatgacgaagacagcgccgacgaaggcgaggatgacgcagagcacttcgatgtggttgggcttttccccgatgatgaaggccgagacgatcatcgcgaagaacggcgccattttattgaggatgttggcgtccgccaggccaaggcggtcgatggcgtagaaattgcagagcagtcccagcgtcccgcagagcgcgcgcatgagcaggccgaacccgctgcccttctttacccggaaaccttcctcggttctggccagcatgatcgtcgcgacgatgagggcgacgagatttctaaacagcgctttttcgaaggtcgggagatggccggcctgcttgatgaacaggctcatcagcgaaaaacagaaagccgaacagacgatgaaaaagatgcccaaggcatgatcgttgtggcggtattttgcaaataatgttttcaaaatttacatcttctttcaaaattgtatttttttcaaaatctgttttgatattgtatcagattaacagaaaattacaatacggttaagcgtaaatgaagtgaaccctaacaaaatttaaaattaaggtcgtctgtaatggtttaaatctcctgaagaatcggctctcaatttgttgacgttcgtgtctattaagggtaaaataaaaaagataaatgtctaaaaatctttacaaaaaattcaaaacaggaggtgaaaaagatgctgacaattatactggcaatttgcatcatcgttgcattttttgccggatatctgataaacaaaacagtgtcagaccgtcagatcggggccgccaaggaccgcgctgccgcgatcatcgatgacgcgaaaagagacgctgaacatcagaaaaaagaaatgctcttcaacgcaaaagaagaagcgatgtcgattaaagacgcgatcgaaaaagaaaaccgagatcgtcggagcgagctccagaaaatggaaacgcgcctgatgaacaaagaagaaaatctcgaccgcaaaacgtccaacctcgacaaaacgcgggaaaagctggaccgccgcagccgggaactcgaccagaagcagaaaaagctggcgggcatgatggacgaaaagatcgccgagctcgaaaaggtttcggggatgaccaaggaagaagccaaggaaaccctgatggacgaggtcgggcgggaagcccgggccgacgccgccgtgctctacaagaaaattgaggacgaggcgaaggaaaacgccgataaacgggccagcgaaattgtggcccagtccattcagcgctacgccgctgaccacgtcgcggaatcgacgatttcggtcgtcaatctgcccaacgacgaaatgaaggggcgcatcatcggccgcgaaggccggaatatccgcgccctcgaaaagatgacggggatcgacctgatcatcgatgacacgccggaagcggtcgtcctctccgggtttgatccggtccgccgcgaagtcgcgcggatggcgctggaacggctgatcgtcgacgggcgcatccacccggcgcgcatcgaagaagtcgtcaacaagtgccgcaaggaactggacaacgaaattaaagaaacgggtgaacaggcctgctttgacacgggcattcacaacgtgcaccctgaaatcatcaagctcctcgggcggctgaaataccgcacgagctacgggcagaacgtgctcaagcactccattgaggtttcttacctggccggcatgatggcagctgagctcggtgccaacgtgaaaattgcgaagcgcgcggggctgctccacgacatcggcaaggccatcgaccacgaagtggaaggcaaccacgtcgaaatcggcgtgaacgtgctgaagaagcacaaggaaaacaaggccgtgattcacgcggtcgaagcgcaccacaacgacgtcgaaccgcagaccatcgaagcggtgctgattcaggcggctgacgcgatttccgcggcacgtcctggcgcgagacgggaaaccctcggctcttacgtgcagcgcctcgaagatctggaaaagatcgccaactccttcgacggtgtcgaaaaatcctacgcgattcaggctggccgcgaggtccgcgtgatggtcgcgccggaagatgtcgacgacaagggcctgccgctgctcgctagagacattgccaagaaaatcgaaacggaaatggaatatcccggaaacgttaaagtcaatttgatccgagaaaccagggctgttgattacgcaaaataatcagaaaggaaggttactcaccttcctttttttatgaattttagaagacattgaggtcaatgacatgaaaatattaatgctcggcgatattgtcggacggccagggcgccagattgttcgggaatatctgccatcgattagaaagaagctcggcgccgattttgtcgtcgccaacggtgaaaacgcttcgggcggcaacggcctaacggaaaagaacgcgaagcagctgctcgccgcgccgattgacgtgctgaccatgggcaaccacgtttggaagcagcgggagacccgcgactacatcgaccggtacgaccgcatcgtccggccgatcaattacccgccgaagacgccggggcagggagcgcacatttacgaacacgacggcgtgcgcattgccgtgctgaacatgtccgggcagtcctttatggacaacctggattcgccctttacagcggcggaacaggtggtgccggagcttgtggcagacagtgacatcctgctcgtcgattttcacgctgagacgacgagcgaaaaaatcgcgatgggcttttatctcgacgggaaggccacagccgtggtcggcacccacacccacgtccagactgcggacgcccgggtgctgccgaagggaaccgccttcatcaccgacctgggtatgaccgggcccctcaacggcattctcggcgtcaaggccgggatcatcatcgaacagctgacgacgaagatgccggtgcgctacgaaattgagcgccagatgccctggcagctcaacggcgtgctgatcgacgtcgatgaaggtaccgggcgtgcccggcacattgagcgggtttacgaaattttcgatgaaaactaaagccttcagggtttataatgtagaggaagctgcgtttaaaaatgcttaagcaagggaggaagccatgtcatttgaaattccagctaatgtccatttgattgataacccattggtgaccgatcggctgacggtccttcggatgaagaagaccaacacccggaagttccgggaaattgtgaaagaaatcagcgggtttctggcctacgaaatcggacggaccctgccgatgaaggacgtcgaaatccagacgccaatgcgcaaaaccgttcagaagcgcattgacacctcaaagaaaatggccatcgtgccgattctcagagccggcgtcgggatgatcccgggctttaccaaggtgtaccccgacgtgcagattctcaacatcggggtgaaacgggacgaaacgactcacgcgcccatttcttattacgaaaatttcccgggcgatatccgcgcccagaaatgcatcatcatcgacccgatgctggcgacgggcggctcgatcgagtacaccgtcgaaaagctgaaagaaaaaggatgcaaggatattgtcatcgcggcgatcatcacggcgccggagggcatcgcccgcatcagcagcgcctacccggatatcccgattttctgctgcgcgatcgacgaccatttggacaaggataaatacattattccggggctcggagacgcgggcgaccgcatcttcggcaccgaagcaaaataaaggagtgtaacatgagcaaagagttttacgaaaatccattgattgaacgctacgcctcgccggaaatctgcagaatcttttcggcggattttaaattttctacctggcggaaattgtgggttgccctggccgaaaccgaacaagagctcggcctcgacattaccgacgaacagattgacgaactgaaatcgaaaattaacgacatcgactacggtttggcggccgaatacgaaaagaagctgcgccacgacgtcatggcccacgtgcacacctacggtgaccagtgcccgaaggccaagggcatcatccatctgggcgccacctcggcctacgtcggcgacaacaccgacatcattcagtacaccgaagggctgcgccacaccaagcgcatcctcgtcaacctgatcgcgaagatggcaaaattcgccgatgcgtacaaatcgctgccgaccctcggtttcacccacttccagccggcccagctgacgaccgtcggcaagcgcgccacgctgtggattcaggacctgctgatggattacgctgacttggaatacctgctctcgactatccgcctgcgcggcgccaagggcacgaccggcacccaggccagcttcatggatttgttcgaaaatgacagcgacaaggtcaaagccctcgacgaaagagtcgctgaaaaaatgggctttgataagaccttcgctgtcaccggccagacctacccgcgcaagctcgacgcccgcattctcgcggtactctccggcatcgcgcagagtttgtccaaattcgcgacggacatccgcctgctgcagcatttgaaggaagtcgaagaacccttcgaaaaatcgcagatcggttcgtcggcgatggcctacaagcgcaacccgatgcgctgcgaacgcatctgttcgctggcccgctacgtgatggtcgacagcttgaacccggcgatcacccaggcgacccaatggtttgaacgcaccctcgacgactcggcgaacaagcgtatctccattccggaagccttcctcgccgtcgacgcgatcatcggcatcgcgaacaacgtctgcagcggccttgtggtctacccgaaggttatccaccagcacattatgaacgaactgcccttcatggcgacggaaaacatcatcatggaaggggtcaagcacggcggcgaccgtcaggaccttcacgaaaagatccgccagctctcgatgcaggccggcgcacaggtgaaggaagaaggtaagcccaacgatttgatggaccgcatcgtcgcggacggctccttcggcatcaaggccgaagacgtgccggcgattttgaatcccgaattgtacatcggccgcgcgccgcagcaggtcagtgaattcctcgaaggggaagtgcagccggtgctcgacgccaaccgcgaccacatcgacactgaaaccgtcgaactcaaggtctgatcgagagaaaccgatatgaaccgtttagcccagatcaaaatgctgaaccagatgctgctcggtgaaacgccgacgccgccggtcgatccgtcggcctacggcagcgacgaagccggtcagcgggcgttgatgcgggcgctgatgaacgtccgcccgcccaagccgatgtcgttaatcgtcgaaaacctccaggacgctattttgaaatccttccttgaagacaagggcgtcgtggacggggcggcgctgccggtcagccggacagacagccgcctcgccctctggcagggggacatcacccggctcaaggtcggcgccattgtgaacgcggccaattctcagatgctcggctgctttgtgccgggccacagctgtatcgacaacgccatccactcggcggcgggcatgcagctgcgtaacgcctgcgccgcgctgatggcgggccaagacgggcctgagcccaccggccaggctaaggtcaccccggcctacaacctgccgtgccagtgcgtgatccataccgtcggcccgatcgtcgagggtgaactgacccaaggagatgtcgacgccctcgcaagctgctaccgcagctgtctcgacgcggcggacgacgccgatctcgactcgatcgccttctgctgcatttccacgggcgtgttccgctttcctcaggacaaggccgcggaaattgcggtttcaactgtaaaagattggctggacgctcatccacagaccagcgtcaaaaaagtcgtcttcaatgtctttaaggacgaggactggcgcctctacgacgcgctgctcaatcaggcgtaaggtctatgcgcatcatcatttcacccgcgaagcagatgattcgcgatcccgacgcgacgcccgccgcggcgctgccggtttttctcgatcgaaccgaaatcctgatgaagtggatgcagagcttgagcttcgaggcccagcggaagctctgggcctgcagcgacgccatcgccgagcagaaccaccgccgactggagacgatggatctgcgccgcaatctgacgccggcgcttttagcttttgacggcattcagtaccagtacatggcgccgacggtttttgaaagcagccaatacgattacgtccaggcccaccttcggattctgtccggtttttacggcgtgctgaagccgatggacggtgtgacgccctaccggctcgagatgcaggccaaggccgcggtgaacggcagtcgaaatctttacgatttctggggcagccggctctatcaggacgtgatggacgacagccgcgtgctgatcaacctggcctccaaggaatacagcaaaagtgtcgcgccctaccttcagccgggggaccgcatgatcacctgtgtctttggcgaattgcagggcggccgcgtggtgcaaaaaggggtttacgtcaaaatggcgcgaggagaaatggtgcgcttcctcgccgaaacgaaggcggaaacgccggaagccttgaaggcctttgaggtcagcggctactgctacgatcccgagcgctctgatgaaacgacttatgtttttacccggacggccgttcccggcaaagccggcggcagatagaaataaaattcaaaaaatcagctctttaaaaaaagagttgattttttttattttggccttgacatagtaatcaaataggtttaatatatacccataacatatttaaaccctatgtttaataataattcaggaggtgccgaattgaacagagtttacggaacggcctgtacgtgtcagagtgactggattcgacacgtactcaagcaaattacaagcggacgaatgtgctgccgctaatcaatttccaaataaaataagacagtcagacggcaataaaataaatagtaaacaagtaaatttagtaatagaattaaagaaagtgagaaattaaaatggcttataaatttgaaacactgcagttacacgttggacaggaacaggcggatccggttaccgattctagagcggttccaatttacgcgacgacttcttacgttttccacaactccaagcacgcggctgaccgcttcggcttaagagatgccggcaacatctacggcagactgactaactccaccgtcgacgtttttgaaaaacgtgtcgcagccctcgaaggcggctcggcggcattggccaccgcttccggttcagcagccatcacttacgtcatcgaagccctggcccatcagggacagaacatcgtctcagcgaagacagtttacggcgggacctacaacctgctcgaacacactctgccgcatttcggcgtgaccggcaaatgggtcgaacctgatgatttcgacgccatcgaagcggcaatcgacgaaaacacccaggcgctctacgctgaaaccctcggcaacccgaactctaacatcgtcgacatcgaaaaatgggcggaaatcgcacacaagcacggtctgccattggtcatcgacaacacctttgcgaccccgtatctggtcagaccgattgaatacggcgcagacattgtcgtccactctgccacaaaattcatcggcggccacggcaccgcaatcggcggcgtcctggttgacggcggtacctttgactggaaagccagcggacgttatccgtggatttctgaaccagacccgtcctaccacggcatcagctttgctgacgcagccggcccggcagccttcgcgacttatatccgcgcgattctcttgagagatcagggcgctacgctctcaccgttccacgctttcctcttcctgcagggacttgaaaccctgtcactgcgtgtcgaacgccacgttcagaacgcgctgaaggtcgtcgaatacctgaacaaccatccgcaggtcgaagcggtgcaccatccgtctctcgaaagcgaaccgagccacaagctctacaacaaatacttcccgaacggcggcggttcaatcttcacctttgaaatcaaaggggacgcgcagaccgcaatggacttcatcgacaacctgccgattttctcactgctggctaacgtcgctgacgtcaaatccctggtcatccatccggcatccacaacccactcacagctcaacgaagcagaactgttggatcagggcatcaagccgaacaccatccgtctctccatcgggattgaaaatgtcgacgatttgatcgacgcgttggataccgcatttgctgctgtcaaataacgaaaacattggattcatatttcggaggtaaccatcaaatggcaaaaatttatcagaatttatcagatttagtcggcaacacgccgcttttcgaattaactcatgtggaaaaagccgaagacctcgacgcgaaagtcgtcgtcaaactggaatactttaacccggcgggatcggtcaaagaccgtatcgcgctggcgatgatcacggacgcggaagaaaagggccagctcaaaccgggggccaccatcattgaaccgacctcaggaaacaccggaatcggtctggccgctgtcggcgcatctaagggctacaaagttatcctgacgatgccggaaaccatgtctgtcgaacgccgcaacctgttgaaactctacggtgcagaagtcgtcttgaccgacggtgcaaagggcatgaagggcgccattgaaaaggctaatgaactccacgaacagacaccgggcagctttgtgccggggcagtttgtcaatccggccaatcctaaggcgcaccgcgaaaccactggccctgaaatctggcgcgacactgacggcgaagtcgacattttcgtcgcagggatcggcaccggcggcaccctgaccggtgtcggtgaatacctgaaatctcagaaaccggacgtcaaaatcgtcgcagtcgaaccggctggctcgcctgtactgtctgaaggccacggcggcccgcacaaaatccagggcatcggcgccggatttgtaccggacaccttgaacacagacatttacgacgaaatcgtgacggtcaccaatgaagacgcttttgatacgacccgtgccgtcgctaaagcggaaggcattttgaccgggatttcctccggcgctgcagtctggaccgcgatccagctggcgaaacgtccggaaaacaagggaaagaccatcgtcgcccttctgccggataccggtgaccgttacctctccatgctttaagatcgggtcacgttccctttctctttgatacccctcaccgggatcttgctatgcaaggtctcggttttttgcgctcaaaatatcccttgacacgtaaccgtccggtcactataataaaggtaaccaaaaggtaactcgtgcgagacagacgcgaagacgcagtgcttaatttcacgaattgattttaagtgctgcttttttattcggcggtatttaagaacaacaggaggatagaatgaagtgccaagagaaaagtacgaaagacaggattttagaggaggcgctcgtgttgtttgcgaagaaagggtatctgggcacgtcgatgaacgacatcgctgcacggcttggcgtgaccaaagccgcactgtacaaacattacgcaggaaaacaggaaattctcgattgtattgtcaaaaaaatgaatcagatggatcagcagagggtgaagcaatacgcgatgccggaaggcagcatgacagatgtggttaaaggctatcagacggcagagctcagcaaaatcgcggcgttcacgaaagcgcagtttcggcattggactgaggaggcttttccgagccgttttcggaaaatgctgacgttggaacaataccgggacccgaaaatggcaaagctttatcagcactatttggccagtgagcccgtcgcgtatatggcggagatcttcaagggattcacgaacgatgcggcagaagctgaacagcttgcgctggaattttacgggccgattttcctgatgtacagcctttacgacggagccgcggacaaagacgacattgtaacgagggtcgagcggcatgtcgaacggttttcggtgaagcttcaggcgaaactgaaggagaaggcgtgtgatgccagataaacacattcggaaaaagtgggtgtattgcccacactgcggacagaaaacccgggtacagctgcgagaggacaccgtgctcacgcattttccgctgttctgtcccaaatgcaaaaaagagagcttgatcgacgccaagaattttcaggtcgttcaaattgttgaaatgccagacgccaagacgcagtgcgaattgtaaaatgattcgtattgcgtttttttatttgtcaaattgaggagaatttaaaatgaaagccattgtttacacgtccaatacgggaagcacacaaaaatatgcggaaatgctgtcggcgcgtttggctgtgcccgcgtacagcttgaagaaagcgagagcggccgttaaaccgggaacggcggtcctttatctcggatggatcagagccgggaaaattatgggttacgcggaggcggccagaaattacgacgtatcggcggtgtgcgccgttgggatggggcagaccggcacgcaggttcgggaagtcagagaaaaaaataaaattccggcgcaagcgccgttgtttacccttcagggtaattttgacatcaaaaagcttcacggcgcgtacaaagtaatgatgcagatgatggttaaaaccgtagggaaggcgctcgcgaagaaggccgagcggacccctgaggaggacgacatgctggaaatgatgatgcgcgacggcgagcgcgtgaaggctgaaaatttaaacaaagtgctcgattgggccatcgcgcagcaataggagggggaatatgaagctttatattggaaatgtcgtcacgaccgtgacgacggtgatgattttagtgttacttggatttattagttattccgtttacaaccgaacgaacattcaatattggggacgaagaagtctttttcttctgatttacggactggtcgtttgctgttttgcagcggcgcgggatggcctcgacaagacgattcagcatgcggtcgacggcagctgcgcgccgggtgtgtttcccctgctcagcttcccgactgtcgtcggctgtgtcggcgcggctctgattcttatcgcggccatcgcgacgccgattgcgaaaacacagcacatgcgccgcatttggtttaacgtgatgtcctgcgagattgtgatgaaaattgccgtgatggaaatttcgagggtaatgattggaatgtaataggaggtcatcgcgatgaaatgtccaaaatgcggaaaagaaatgcgttccggttatttatttgccagtaaagatggcgctttcagttttgcaaatgaagttccaggtgtatttgaaaaagcagatagatcagacggctttgtcgaaatcacacagttaaggctcggacacagggtccatattgaggctcattgctgcgaagcctgccgattcgtcgtttttcattattaatcatgacggaggagctgacatggcattaattgtagatcgactcacaaaagcgtacacggttaagaccgcggtcgacaatgtctcatgcaccttttgtggatatggaaaatatgatcggcaatatgatgcgatgcgcaaatgtaacggaacgggagcttgcggaaaaacaggaggttgccacagaattcggagagaggctgtcttggaagtatctttgttatgtgagagcgcatctaattctgtggcgtgttccaactaaaatactatatagcgaacatgacaatatgaccgattgggaaaccgtatccgcatttgctgaacgtcactgtgcagagctcacggtcatgccaggtggtgagcattggttccacactgaagaacagatgcggttcttagacaattggctgaaaattcaagctgatagacgagattagaattcttgtaatgcaaatttcgagaattttgattaagatgtcataaaagaaggatagttaggatataatagaaataaaaaggaaaacgttcaatgaaaacaatagaaaatgattcgaaatgtattgaaatcaagctcgacgaagcggacgcagcagccgctagatcagatgttcgatactcggcgtcagaggtatttgaccgcgtcagagaacgcatctgcaaacaaaagaaaaagaaataaagcatcacaaaagccattgatttgaaagatatttcagatcaatggcttttataattttgttttaggatctctgccaaatgctcgggacaaaaagcaggagcatcgggaagatttccagacggccggcaagcatatcaaaagtgagaatcaatttgctaattgggctgtaggccgagaaatttgacgccggcccgacaccggccaatcccgggccgatgttgttcagtgtcgcggccaccgctgtgaagttggtctccatcgagaagccgtccagactgatgatcaagacgcttaggccgaaaatcagaaaatacacggccgtgaagacgttgatcgagcgcagcaccgtgtgttcgacggtttcgccgtcgagcatgaccttccggaccgaccggggatggacgatctggaacagttctttctttaaagttttgagcagaaccaggatgcgcgagaccttcatgccgccgccggtactgccggcgcaggcgccgcagatcatcaaaagcaccagaatccatttggagaaggacggccagagatcgaagttcgtcgtcgagaacccggtcgtcgtgatgatcgagccgacctggaatgccgcgtcgcgcacggcgtcgctgagatggtggtagagatcggtgcgggtgaagatctggaccgtaatcagcgcgatggacgcgaggatgatgaggatgtaggcccggacttcttccatcttgaaggcttccttcggtctgtggtaaagcagcaggaagtagaagctgaaattcaccccgaaggcgatcatcgcgatcgtgatgatccactgctgaacgggggtgtaggccgcgcagctggagttcaaaatgccgaagcccccggtcccggccgtcccaaaggtgatgcacagggtgtcgaaccagggcatccgcgcgatcaacagacagacgatttggccaatggtcatgccgatgtagatcttgtagaggatcgaggcggtgttgtgcacccggggcacgaatttggacacatccgggcccggactttccgcccgcatcaaattcatctgggagccgcccttcatcgggatgaacatcaggatgaagacgaggacgcccatcccgccgatccagtgggagaagctgcgccagaacagactcgcgtggctcagggcctcgacgtttgtaagaatcgacgaccccgtcgtcgtgaaaccgctgacgatttcaaagagggcgtcgatataattgggaatctcgctggtcaggacgaagggcagcgcgccgacggccgacatgacgatccacgccagtgcgacggtgatgtagccgctcttttgataaatgcggttgtcgtcgggctgcttggaaagcaaaaagccgatcccctcgcagccggcgatgacgatcaaatacgccggcagcacagcaaattcgcggtagatcagaccgatgacgatcgaggagcagagcagcagcccctcaattcggagtatccagctggtgacgtagcgaatcatcgagcggttcatgggcgcacccgcgtttccagaatgtcgccgatttcgtcaaagccggtattcgtggtgacgacgatgaccgagtccccgggtatgaaataagactgcccgtcggggatgatgagctgattctttcggtagatcccggcgaccaatgtgtttttcttgaagtggagatcctcaaaaggcacatgcgtgatcggcgaattgcggcgaatggtgaattccagcgcttcaacgcggtcgtccatgattttgtacaaggtttccacattgctgtcgtaggaattggccatggctcggacgtactgcagaatcgtttcggtggtgatggttttggggttgatgaccgaatcgaggtcgaggctgcggacgacgtcgttgaattccagacggctcattttcgtaatgaccttctggcggattttgtccttcgcgtagagggacaggatgatgttttcttcgtcgatgccggtgcaggcgacgagggagtccatttcctcgaggccttcctcgcgcagcaggtcctcgtcggagccgtcgccgcagatgatctgcgccttgtgcaggtgttcggccagcatttcgcaccgttcgcggctgcgttcgatgatcttgactttgatccccatgttgagcagcattttcgcgaggtaatagcccatttcgccgcagccgatgatcatcgtgttgcggacggtatcggtttttaagcccacgtcgccgatgaatttcagcgcgtttttcgggctcaaaatcacggagagcttgtcgtttttggagacgacgtaattcccgtcggggatgacgatgtcgttgccgtgctcggcgatgcagatcagcccgtcggtctggaggatcttggcgtccttgatcgcctgtccgatcagcggtgagtggtccggcacgcggaagcggaacatttcgatgtggccctttgagaagctgttgatgccgatggcggtcgggaagcgcagcaggcgcacgatttcccgcgcggccgcgtgttccgggttgatcgtcatggccagccccagctcccgccggatgtaatcccggcccgtcgagtagatcgggttgcgcacccgggcgatggtgcggcaggctgaagcccgtttagccagcacacagcacagcaggttgacctcgtcgctgaaggtgaccgcgatcaggatatcggcgttctggatatctgcccgctcgaggatctgataatccgtgccgttgccacaaatccccatgacgtcgtaaaggtccgtcaggtgctctaagcgctcagcgtttgtgtcgatcaccgtgacgttgtgatcttcattggaaagttttgcggccagagccgatccgaccttgccgcagcctacaataataatttgcatacaatctccaaatagaataaataatatttttttataaagaatacagccattgtatcacaaataaaaattcaagtgagaggaatcagaaatatatttcaaaatcatggttttaaacatttacataaaaaagaataattattataataaactatatactcaatcatttggttgaagagaaattatttgaagagaggattttatggattacaaggcaactgcacagggggttctggaccacatcggcggtccggacaacatcgtgtccgcagcgcactgcgcgacccggctcagactggtcattgcggacaacagcaagcttgacaaagcgggcgttgaaaacgtagacggcgttaagggggcgttcgaggcttccggccagattcagatcatcatcgggaccggcgccgtcaacaaggtctacgacgagttcatcgcgctctccggcgcctcggaaggcacgaaagacgacgtcaaggcggcggccgccgacaagcagaactggttcatgcgggcgattaaaacactgggggatattttcgttccgatcattccggccatcgtcgcttctgggcttttaaacgggctcctcggcgggctcacccagatcaacccggccctggcggacagcggctggtacacgatcatcaacatgatggccggcgccgcgctgaccatgctgccgattttgatcgcgatttccgcggcgaagaaattcggcggcaaccaattcctcgcggcggttatcggcttcgtgatgattcacccgagcctggtcaacgcctggtctcagacagtggtcaagggcggcaaaatggttgccaacccggaaattcacgcgctgcttaaaattggcagctacaccgtgaaaaacgtcggctatcaaggccacgtcattccggtcatcatcgcgatttggttcatgtgcttcttagaaaaacggctgcacaaggtcgtgccggaaatgatcgatctctttgttacgccgctggtgacggtattggtcaccggacttttgaccttcatcgtcattggaccgatcttctcgacggtagaaggctggatcctcaccggcgccaccgcgctgattcggatgcccctcggcattggcgggctcatcatcggcttcgtctacgcgttcacggtggtcgcgggcttccaccacatgtacaacatgatcgaggcccaaatgctcggcagcgtcgcccatttgaatatctggatgccggtcgcgacggcggccaacgtcgctcagggtgccgcggctatggctgtggcctttaagacgaagaacaaaaagacggaagcgatggccttcccggcatctctctccgccttcctcggcatcaccgaaccggcgatcttcggggtcaacgtccgttaccgcaagccctttatcgctgggtgtatcggtggggcagtcggcgggatgctcgcctcctggatgggcatcggcgcgacggcctacggcgtcaccggcctgtttggctttttgattgtaccgggcttctggattcagtacgggattatgatggcggtggccttcgcggtggccttcggcatttcctttgtgatttaccgcgatcctgaaccggaactggctggctcagcgaaagaaatggaagccgaaatcctcgacaaggaaggggacgtcgaagaagacggcaagctgaaagtcgtctacgcgccggttaaagggacggctgtgccgtcgtcggaaattcacgacgaaacctttgcggctgagctcctcggaccgggcatggccatcattccagaagaaggcaaaatttacgcgccttttgacggcacactgacgatgatgttcgataccaaacacgcgctgggcctcgtgtccgaagacggcgtcgaagtgctgattcacgttggcattgacacggtcaatttgaagggcgaacacttcaaggcgctggccgaatcgggcgacaccatcacccgcggacaggaactcttggaatttgacattccggccatcgaaaaggcgggctaccacatggatacgccggtaatcgtcaccaacggcgaccagttcaagagcgtcaaagcggttaagaccggtccggtggaaccgggcgaaccggtcatcgaaatcgaataggtgccggcgcaagcgtctcggaaaagggggacagcaaatgaaaaaggataattggcgtctggcgtatcatctgatgccgccggacggatggcttaacgaccccaacggtctctgcgaggcagacggcgtttaccacgtctattttcaatacgcgcccaatacgccggcgcccgacgggcgcatggcccggacctgggggcattacgccggaccggatctgatcaatctgtcctttaagggcgtgccgttctggccggaaacgctggaccgggacggctgctattcgggcagcgccctcgtcgaggacgacggaaccatcgatctgtattacaccggcaacatcaaggagccgggggactacgattacattcacgacggccgcctgagcaacacgattttagtcaaaaccgacgccaacggggacacctacagcgataagcacctgctgtttggcaccaaggattacccgaaggactgcacccgccacgtcagagacccgaaggtttggaaggaagacgaccaatactacatggtgctcggcgcgcggatgaacgacgacagcggcgcggtgctcttttacgaaagcctcgacggcgtcagctggcggctgcttaaaatcgaaaagaccggtgagccctttggctacatgtgggaatgtcccgattattttgaattggacgggcagcccgtgctgtccttctgcccccaggggctcgaggcggaggatttccgctttcagaacaaccaccagtcgggctactgtctgctcggcggcgagcttagaggcaagcaggccttcaggccatttcacgaatgggacatgggctttgatttctacgcgccccagagctttgtcgacgaccgcggccggcggatcatgatcggctgggccggtctgccagacaagccctacggcaatcccaccgatcagcgcggctgggaaaactgtctgaccgtgccgagggttttgtttaaaaagggcgataaaatcgtgcagaagccgatttccgggctcaaacgcctgcggacgcatccaagccggccggacgccgaaggcacactgaccctgccggacgcctccggggatatcgaaatcgcctttgccgatccggacgcgggctggcagattcagatcggttcgggcgtgcgtgtgagctacaacggctgcatcgtccgcctgacccttgacgcgcagaccggctgcggccgcgacgagcggctcgcgcaggtcgacggcgtgcgcaacgcgaaaatactggtagaccggtcgattctggagatttacctgaacggcggagaaacggtgttcacgacgcggtattacgaagatttcgaggcggaccgcagcctcgacgtgacctttggctgtgagggcgccgacatttacgcctgggaaatgcgcccgatgccggccaatcaaatttacgatgaagaggagaatgacattgaagtatgatgtgacagcgctgggagaagcgctgatagattttctgcccgttgggaaaagcgaatacggcgcaaccctattcgcacagaatcccggcggggcgccggcgaacgtgctgaccgccatcgaccgcctctgcggctcgacggcctttatcggcaaggtcggcgacgacattcagggccgctacatccgcaacgtgatgaacaacctggccatcgacaccagcggcctgattctcgacccgaactacacgacgacgatggcctttgtcgatttggacgaaaacggtgaccgcagcttttccttcgcgagaaagcccggcgccgatacgcagctgaccaaggaggaagttaacgtcgagctgatccaaaacgccagcattttccatttcggctctctctcactgacggacgaaccggcccgcagcgcgacgctgtacgccattgaagaagcgaaaaaggccggtgtgctcgtgtcctacgacccgaactaccgcgcgccattgtggccggacgaagcgacggccattgcacagatgcgttcggtggtgccgaaggtggacatcatgaaactctccgaagaggaatgcgcgcttctgacaggggaagcgaagccggaagcggcggctgacgcgctgctgtctcagggcgtcaaatgcgtgttcatcacgctgggcggcgacggctcgatgctgcgcaccaaggacgtctcagtgtttcagccggggatgaacgtctacgcggtggacaccaccggcgcgggcgacgccttctgcggcgcgattctgttccagctggccaaccagggaatcacgcagatcaacaaggacaacggcaagcggatcctgaaattcgcaaatatcgtggcgggcctctgcgtcgaaaaacacggcgggatcccgtcgatgccgactatcacggacattcaggacgtgctggggtggtaatttcacaaaaattaatattttatagcaataaaaaaactgctgtcacgccgacagcagtttttttgtgaatgtgtttaaattacgcgttcttctgagcttcttcgattgcaacggaaaccgcgacagtcgcaccgaccatcgggttgttgcccataccgatcaggcccatcatttcgacgtgagccggaacggaggaagaacctgcgaactgagcgtcagagtgcatacggcccattgtatcggtcatcccgtaggaagccggaccggcagccatgttgtctgggtggagtgtacggccggtgccgccaccagatgcgactgagaagtacttcttgccctgttcgatgcattcctttttgtaggtgccggcaactgggtgctggaagcgagtcgggttggtggagttcccggtgatggagacgtcgacgccttccttgtgcatgatcgcaacaccttcgcggacgtcattggcgccgtagcagttgactgcggctctttcgccgtcagaataagcggtgcgggagacttccttgagttcgccggtgaagtagtcgtaatcggtcttgacgtaggtgaagccgttaattctggaaatgattaaggcagcgtccttgccgagaccatttaagataacgcgcagcggttttttgcggaccttgttggctgaacgggcgatcccgatagcgccttcagcggcagcgaaggattcgtggccggctaagaaagcgaagcagtcggttttttcgtcgaggagcattgcgccgaggttgccgtggccgagaccaactttgcgctgttcagcgacagagcccggaatcgtgaaggcctggagcccttcgccgatgacggcagcggcttctttagcggttttgacgccgcgtttgaaggccagcgcagcgcccatcgtgtaggcccagcatgcgttttcaaagcaaatggtctgaacgccgcggacgatgccggcgacgtcaacgcccttgtcgtcgcagatctgcttagcttcttccagagaagcgatgctgttttctgctaagaccttgttgattttatcgattcttctttcgtaattttcaaataacgccatgtcaaacctccttattcttcacgcgggtcgatgtatttcacagcatcatcgaagcgtccgtactggccggaagctttttctaacgcttctttcggatcgacgcccttcttgatgttttccatcatgacgccgagattgacataagcatagccgatgatttcgtctttgtcgttcagggccagcttggtgacgtagccttctgccatttcgaggtagcgcggtcccttcggcagtgtgccgtacatggtcccgacctgtgaacgaaggcctttgcccaagtcttcgaggccagcgccgacaggcatcccgttttcggagaacgcggtctgggtacggccgtaaacaatctgcaggaataattcgcgcatggctgtgttgatggcgtcgcagaccaagtctgtgttcaacgcttcaagaatggttttccccggaagaatttcagacgccatagcggcggagtgggtcatcccagagcagccaatggtttcgaccagggcttcctgaatgatgccttccttgacgtttaaagtcagcttgcaggcaccctgctgcggggcacaccagccgacaccgtgggtcaaaccggaaatatctttaatttcttttgccttgacccattgcccttcttcaggaataggtgcaggtccgtggttggcgttgctggccaccggacacatgtttttgacttctacagaatattccattcacataactcctttcagctatcgtacaatgatattttattgatcagttttctgtaaacatcgcttatattatagcctttaaatgttaaaaaatcactctttttttatcaattattataaatttgagttagaataggaacaggacaaaaaatacggacgatctctcgcgaatcgtggagtttctttactctaatcaggcaaaatcttgtggtgaatcgacttgacgcaatggggtataataaactgtattttaatgtagagaatacagaaacttagagagatcaatttaagtaaaggagagacgtatggaatatactcacaatttttcatcaggtccgctcttgatggatcatatcatcgatgaatatttttctctccgaaaggctagagggaagtgcctgaggtgcccgaagtacaacaagttttggtcgtgccccgaatttgggttcgacgaaaagctgctgctcgggcagttcaagtacctttacgtgatcggccgggaatacgccgttccgaaggaacacaagcagcggatcaccggcacggtccggacgcggaattacgtcgaagaagtcaaggagcggatgaacactgagagctggcgggatctgttggaaatcgaaaaggattatccgaacgtgatgaccctgcgccccggcaactgcaacatctgtgtcgcggccggcgtcggctgcgcgaagcaggaacacaagcgctgccgccacaccgagctgatgcgcttttcgatggaagccctagggctcgacaccgactccatcgcgaaattcgaggtggggatgatgctcaactggccgaccgacacccacctgccggaaaaaatcgcgtgcctgatgggcgtgatgaccaacgaaaaaataccgatggcccagctgcgcagctacttcccagacgcacagaaatcctacctcaaggccgggcagacgattctcggcggtgaagacgcgccgaaggcgaagcgcgtcgacagctggctggaacaccaggccgaggaagcgcggatccgcgaagaacgggaagaagccatggcccgggccgcggctgaagaggaaaagatgatggccgaagcggcagccgctcaggcacacccctggacgcagcgcgatgaaccggccgacgaagcgcaggctgctgaccagccgcaggcggaaaacagcgaggacctcgacgaaaacggccagcctaaatacaaatggctcggcttcaaacggtccgtcgaagaagcagatgaaatcatgcgcgaacggccgattccgaagtttacgaaaaaagaaccggaaccggcgcccgaacccgaagcgccagcccgcccggcagcgcctgagccggaaagcgccgacggtggcaaccttcagttcgaccggatggcgatgctccggagcagcctggccgaggccatccgccgggaaattcccgacgcgaccgacgatcaggtggtgatgttagccacggaaacccttaaaaacgcggcggcgaagatgcagaaaaagagccacaccgcgccgggcagcaaaggcggcaccacctttgcccacgtgcctcagcagcaggtcgacgaaacgcgccaccgccaaatgcaggcggcgagacctcaagagccggagcgtgaaaaggaattggaaccggtgcccgaaaaggcctcgatctcggaacaggtggtccaaaatctcagacagagcgcggccagaccgcagccggcacagccggccccacagcgcccgaagatgaagaaagttgtgcgccgggtgaaacggcagccggcggctgacgcgagcctgccgaagcgcggcagcgtgaacgacgtcctcggcgccgcactgaaaatcgcacagacagtcgtctccgagccggaaccggaatacgaagaaatcgtcgaaatggtgccggatgtggaagcggcctttgaacagcagccggtggaaccggtttacacccaaagcgcgccggaacctgaaccggcgccggaagaaccgatggatcccaacgatctgaaaggcgacgacgacacccgctacaaatggctcggcttcaagcgcgatccggacaatccaggatcacagtccggccccgacgcggctgaaacgcctgccgaaccggaggctcagagcgcaccattggctgaagaagtggaccctaacgatttaaagggggacgacgatacccgttacaaatggctgggcttcaagcgagaccccgacgcgggcgacggcttccagcacggcgattggcggaagaagaaaaattattaatagggagtggcggtgtttttgcgccgtcacttttgtatttaaaggcaattacgatatacaggaggattgaacaatgtattattcagcagatatcggcgtgttcggaggctcaggcctttacgaactgggagaagaataccggcgcgtggacgcagacacaccttacggcaaaccgtcggaagccatcagcctgctcgacgtcaacggcgtcaaggtggcctttatgccgcgccacggcaaaaaacacatctattcaccggccgaagtcaattaccgcgcgaacgtcgacgcgatggcacagctgggcgttaaatcgatcatttcggcgaactgcgttggctcgctccgcaaggaatacgcgccgggcgattttgtcgtcaccgaccagtacatcaacatgacctccggccggaaggataccttctttgaaagcccgaccgtcgaacatttgagctccgccgatccctacgacgaaaagctgcgccagttcgcactggaagaaggtcagaaaatgggccacgtcatgcacgacggcgggaccacggtcgtcatcaacgggccgcgcttctcaacgaaggcggaaagccgctacttcggcatgatcggcggcgatctcgtcaatatgacccaatacccggaagcctacctctgccaggaaaagaacattcctctcgtcaacatcgcgctggtcactgactacgacgccggcctgaaggataatccggatattccgccggttaccaacgaaatggtcgtccaggtgctcaacgaaaacaccgaagaaatgaagactttgatcttcagattgattgcacggattggaagtgaagcatgagaccggtttatttcgaagacggtgagttaaaactcatcgaccagacattattgccgacgcaggaaattgtgcgcggctacactgactaccgtgaagtggccgacgccatcgtgacaatggtcgtccgcggcgcgccagccatcggcgtcaccgccggctacgcggtgtatttggcgtccaaagaatttgaaggcctcgacgccgaggcctatcagcaaaagatgcaggaagcctgcgacctgctccggggcacccgcccgacagctgtgaatctgttctgggccatcgatcggatgtccggcgtcttcaaggccgaaccggacgccgacccgaaggcgatgagcgaaaagctcaaggcagaagcggacgcgatttgcgaagaagatatcgcgatgtgcaaagcgatgggaaaagccggcgcggcgttgattaagccgggcagcacgattctgactcactgcaacgcgggcgctttggcgacggccgattacggcacagccctcggcgtcatccgcgcagcccaggaagcgggcaaggacattcaggtctacgccgacgaaacccggccgctgctccagggcgcacggctcacggcctacgaactgcacaaggacaacatcccagttacgctgattaccgacaatatggccggctggatgatgcaccagggcaagatcgactgtgtcgttgtcggggcagaccgcatcacccgcaacggcgacgtggccaacaaaattgggacattttcggtttcggtgctggccaaagctcaccacattccgttctacgtcgcggccccaacctcgacgatcgatttttcgatgttctcgggcaaggacatcacgattgaacagcgagacccgtcggaagtcggccatttcgctggcgtccagacggcgccagacggcattaactttgaaaatccggccttcgacgtgacaccccacgacaatgtctcggcgatcatcaccgaacaaggcgtcatcttcccgcctttcgcgccggggatcttgaacctcaagcattaaaaaatgattacagatcaacacaaccaaaactggaccacgagcatgttctcgtggttcggttattttatgcccttttccgagcggattgccgccattgccgatgcgggcttcgacggcgtgatgctctcctgggaggacgaggaggcaccgaacttcatctcccggtacgattttccgaagctggtgcgggacgccggcctttcaattacgaatttccacgcgcccttcatcggctacagtcaaatctgggagcggtccttggaagaaaatcgagagcttctcgactttctggttcggattctaaaagacgcggcggatttcgacgtgtcggctgtggtggtccacaccgttgatatggagctgggggattacacctttgagaacggctacgctttttttacagaactggccgaagccggcgagcggtacggcgtcgacgtcgcggtggaaaacgtcacgcggcagtttttgctgtacgaactcctcgaccgcatccagacgccccatttcggctactgctacgacacatcccacgattacatgctgggctgcggcagcggacgtttgatcgcggcctaccctgatcggctcaaggcgctgcacttttcggacaacgacaagactgtcgatcggcactggattccgggagagggatttctgcctcttacttcgatccttcaaacgctggaccgtatggattggcacaccctttcgtgtgaagtgattgcgccgttttggtggcaggaacggacgccgcaggatttttgtgtggcggtacagcagggattaaaaaaactgttaagaaatctaggggaatagttgcaattcgaaaggggatttgttataattcgttccgtcattgttcgaagcttgtcttcggacatttcatttcttttccttattttatagccgacgcaagtcggcttttttatttgcttcaaatataatattttcacaaaaaagaaaggctgcctctttcgagacagccttgtgaaaggtcgcaataaaatgataattataaataacgtttgtgatcagttcgtaggtgaactaaactttagcttagagccagccaacaaccatgttgccgagcagagcgccaacgataccgcctaagattggcatgataccggagatccacatatagccccagttagcatccttctgatcgtttggtttgattgggcagattgcgtaagcaatacgcgggccccagtcacgggcagcgttcatagagaaccctgtggttgcaccaagtgcaaaaccgatgaccatgatgattaacgcaacaacaaatgcggatgcacctgctgcaccaactgctgcaggaatggttttgatgaagaacagcaggaagattgtggcaaagaattctgagaaagcgttggctgccggactgtcgatcgccggtgctgtacagaagatgcctcttaatgctgcattgcccaaatcagatgatgcgtcaaactgcggtttgtagtagaggtatacgaggataccgccgacgataccgccgaggatctggcagataatgtagccaggaaccattgaccagctgaagccgccgataacagctaacgcgatggtaacggatgggttgaagtgagcgccagactgtgcgccaaatgccatagctggcaaaccaactgcgagaccccagccgaggattacataaataggacctgagccctggaagtttgaatgattaagtgtgttggcagcgcagatgccgtcccctaagacgacgagcatgatcgtgccgataaattcggataaataaggaaccattgtccatcccccttaaaatattaaattatgataatagaattgcattgtctgagcggcaggagaattctcccaaatctcctgccgcgagatcattgcgaatcccttcacatccagtattatagaatatcttaaggaaaatgtaaagccttttcatcataaaataaaagataaaaaatagaaataaaagataaaaaaatgttctgaacattcaaatttctaaattaatgatagaatatattctatcacttatcacataaaaatcaagaaatatttaagaggaaaagtcaaaatgttgcgattaattgcaggacgatacgacaaaacgcgcccgacgatgactcagttgatcgatcgggaaatcgccgaccgattaaagaaaggcggacacgccatgctgctcatcgtgccggagcagttcaccctcggcgcggagcaggcattgatccgcgaaggcgggctgaaagggctgatcggtgtcgacgtgctcagcctcaagcggctggccgcccgcgtattcgaagaggtgggacagcccaaaggacaggctgtcgacgagcacggcagacagatgctgctgactcgggcggtcctcggctgcggccaggatttacgcgtctaccagaagagcgcatctcaggcaggctttcagaaaaaaatagcggactttatcggcgagttcaaggacagccagctgggcgcggcagatctcgacgcggcgatggacaaggttgaccccgaccggctgctgagccgaaagctctccgatataaaaacgattttaaccgcctacgagggactgctcggagacgagcgcttcgacgaggcagaccgggcggcgctggtggctggggctgtcgggcagtcgaaaaggatcgccgagacatgcgtttatctcgacggctttcacaccttctccgaggcggacttcaacatcgtcggccagctcatcgctacggcgccggaggtcacgatgacgctgatcaccgacgacgtcgacaacggcagcgacggcgcgattttcgaaatcgccgaacagaccaagcgccggatgattgcgatggcgaaggacgcgggacaggaggtggctgtgattgacgccggcgaattggccgtgcagttgttcggcggcgcgccaaaggtccagccggccgcaaaggacttggcgctgctcgaggaccagtgcttcgccgcgatccctgaatcctccggtgaggtgccggcacacatccaaatcgtggagtgcagcgatttgtggcatgagtccgaggaggcggcgcggcaaattgtcgcgctgacccgggacgagggcctgcattacgaggatatcggcattctcgtcggcagtcccgagacgatgggcggcacgatccgccgcgtcttgagcttttacgacattccctgctttgtggacgcgccgaaatcactgatcgggcagccgctggtggactgcctgattgcggcctttgaggtggtggaccggcacttcgacacgcgggacgtcatggccttcggcaagtcgcccttttcgccgattgatggggcggacatgatggatttagaaaattacgccgtcgtcatcgggattgatcacggccggtggctcacgccctttgaaaaggacgcgccggatatgccgcggacgatcgcggaactcaacgcaattcgcgaaaaaatcacggcacccctcgtcgacctcgaaaaaagcatgaaggacgcgggcacttatcggcagcgcattgcggcggccctttcctttttagaaggcctcaacgtccagacagtcctggacgaggcagccgcggccgcggtgtccgatcaggactttgaaaaggcgtcgacggccaatcagatctggaatatcctgatgacggtgtttacgcagatcgacgcggcgctgtccgacgagccctgtacccttgcggccttcatgcaggtgtttaaaaacggcatcgacacctacgacatcgggattctgcccgaggacccggacgtcgtcgatgtgaccgacccgttcagaagccgccatcttggcaaaaaggtgatgatcgtcatcggcgccaacgaagggctgctgccgccggacgccagccagtttccgattctctcggaacgggaacggcgggaaatggctgcggctgggctggatctgcacaacgacaggcgctacactcaggtccagaaccagtacaccctttacctccagatcgcgtcggtcacagaaaaactcatcatttattacggcatgaaaggggaggacggcaaggcgctgcggcgctcgcggctcgtgacgcagatcttaaatgtctttccgaaaatgcaggtccactcagcgctgtttttcgatccggagcagtcttgggactgggtcacgggctttgaggggacggaaaacatcgctcggtctcaggtcagcggcagcgcgcctcgcgtgcgggctgtggcaaagcgatttgacgcggcggcggacgtcaaggcagtggcggcgctcgcgccgtcgttcttcgcgctggacgacggcatcgccgaccagctcatcggcccgaagctggtgctcagcgcgacggactgccggacgtacagcgcctgcgcgtggcgctacttcttaagtgcggagctgcggccggtgccccgggagccttttgaggtgacgctgccggatatcggcaacgtcatgcaccggatgatcgatgccttctttaaagaactgaacgcgtcggggacgcggctcgaggcgctgagtgccgacgaacgggaccgcatgaccgaccgcattttaagtgacatcctgtctcgaattcacggcgcggtcttcaacagcagcgcggccttccactatcaagggcgcaagctcaggcggatggggcggcgcacgatgggcatgctcgccgaacaccttcaaaagggccgattcgaagtggtggacagcgaacaccccttcgcctacaccctcgacgcgaaagggctggccaagcccgtcgtcattcagggcagcatcgaccggttggaccgcatgacccgtgacggcgtgagctattacaaggtcatcgactacaaaaccggcagcgatgccgtcaaaccgtccgacatttactacggcctgtcgccgcagctcctcggctatctcgaggcggcggtgcgctacggccgcagccggcacgaggacgcggaggctgcggcggggttctacttccacgtagccgacccgatcacgaacgtcaccggcgaatccgaagagcaggcccagaaggatgtggaaaagaaattccaaatgagcggaattttcctcgacaatcaggccgtcatctcggcgttggacagcgaaacagacggcgcctcgaatattttcaccgtcggcagaaaaacgtcggattaccgttacgcgcccgaggggatggccgcgattttgtggaagaatcagcagaattaccgggacacggcccgagcaattttgtccggtgagatcgcgccgaatccttatatggtaaaggatgaaacagcttgtaagaattgcggctgcagagaaatctgcggctttgccagagaaattgatccgcgcatttttaggcggctcgaggatatggaccaggcggaattgctggaaaggatagaggaggagcagcatgaaatggacgactgaacaggaaagggcgattgccacccgccacaaaaatctgctggtttcggcggcagccggatcgggcaagacggcgcttttaatcgagcgcatccggcggatggtcgtcgacgaacagatccccgtcgattccctgctgattttgaccttcacccgggcggcagccggagaaatgaaggagcggctgaccgcggcgttcaccgagagcctgcggcagacggacccgcaggatcgggagcgggtgcactggctggtcgagcagatgcagattctgccgaccgcctccatcgacacctttgacgccttctgctcccgggtcgttcgggaatactttcaggaggtggatgtggacccggactaccgcatcggcgacgccactgagcttacgatgctctacactcaggcgcaggacgaggtgttcgaggcggcctaccagcagattcctgaggacggcgggacggccttcagccgattggtcgactgttacaccacggcgcgcggcgatcagggactcaaggatcaggtcgagcggctgcggcattttttaaacgctttggccgatcccgaagcgtggtgccgcgacgctattgcagatttgaagcaaagcggcagagatttcgaacattctaaatggtacgaggtgctcgcgtccaaatgcgcagaggacttgtcggccgccgaggcggagcttgaccaggggctcagcattattgagggcgacgcggacttcgtgaagaccgaagcccagctgaaagcagaaaaggcgatggtcgagggcattcataggacactcgatactgaggactggtcgaccttccgggcagcgctgatggctgcggattacgaccgttacaagggcagccgcaagaataaggaagacagcgaccgggtcaaggcccatcggaaccgcgccaaggacattgttaaaaaaggccttcaggcggatctcgcccaggatccggaggatgaacaggccgaggttgaggccatggccgaggtgatgacagatctcatcgcgctgacgaaagctgtcgaggatcgattcaccgcactcaaaagagaacggggtcttctcgatttcgccgacgtcgaccggtacgcttacaggatcttaaaggagccgaacatcgcgaagacctttcaggaaaattacgaggcggttttcgtcgacgagtatcaggacaccaacgcccttcaggaggggatcatcgcgcagattctgcggccggacaattattttatggtcggcgacgtaaagcagagcatttaccgtttccgtcaggctgacccgtcaatttttatcgataaatacaacgcctacgccaccgatggcggcgggatcaaccaattgatcaccctcggtaaaaatttccgctccgacaagggggtcgtcgacagcgtcaatgcgctgttcgaaaggatcatgagccccgcattcggtcagatcgcctatgacgacaaggcccgcttggtgcagggcgcggaaagtgcaggaccggcggcgccgccggtcgttcggatttttgaagcgccgagcggggaccgcctcgaaaaagagggcgcgtggatcgccaaccagatcgacagatcggtggggcagccgattaccatcgcgaagaccggcgagacccgaaatctgcgctatcgggacatcgcgattttaatgcgcagcacgggagacggccgaggtgagcagatcgcgcagatgctttcggacaaaggcatcccagcctattacgaagggggcgcatcctatttcagtacgccggaaatcgaatgggtgctggatttgatccgcatcgtcgacaactaccgtcaggacatgccgctgatgacggtcatgctctcgccgatcggcggcttttccgccgacgaaatggcgcagatccgcatcgccggcgaagacaagacgttttacgaatgcgtcgacgccgtcagcgctcaggggacgcccctcggcatgaaggttaagcgctggctcggccagctcggaaaatggcgcaccctggcttacggcgcggaggtgtccgactttttgtggcagctctacaccgaaacgggattttacatctgggccggcagcctgccgggtggtgcccagcggcagaaaaacctcgacgcgctgatcgacaaggcgcaggattatcaatcgtcgaccctccacggcattttccgattcgtggattacgtcgagcaggtccagaagcgcaccgacggcagtgaagcgccgggcatcctcagcgaaaacgacgacgttgtgcggatcatgacgattcacaaaagcaagggcctcgaatttccggtcgtctttctggccgatacggctcaccagtttaaccagaccgacagcacagcctcgatcattctggacaaggatctcggtatcagcccggaatacatcgacggggaaaaacgcatccgccgaaagacgatggtacaccagatcgcggcgtataagaataagatggataatctcgccgaggaaatgcgcctgctttacgttgcgatgacccgggcgatggaacggcttgtcattaccggcggcgtcagcaatttggaaaaggcggagaaaaaatgggataacccctgcgacgtgtcgcgcctgaaggcgtgccgcagcccgctggattggatcatgctcgcgctctacagcccgaacagcgcgggcggcgcggacagtgcggcctttaagatcatcaccggcggtgacgaagaggccgaaacgccggcggatgtgcgccctgcggcgccggaggcggcctgctctgaagaagaccttgcggaaatcgaccgccggatggcctggcgctacccgaaaaagagcggcaggcggctgccgtcgaagatcagcgtgaccgaggtcgaggcgctgaggcagcaggatcatccccgggaaaaaattgtcgagcgccagcctgtccccgactttctgcgcggggcagaggatcagccccccgcgttcaccgcggcggaattggggaccggtgtgcacacggtgctcagacacctgaatttggaaaaattgagggaaataccggacgacgagatgcaggccgtggtcaaaaccgagggcgaaacgatggctgagcgcggtcaaatcgacgaggcgctgtttgaggcgactataaaaaacggcggcctcgcccacgcggcggcctttatgacttcggacctcggccggcggatggcggctgccagccgggtcgaacgggaatggcccttcgatttggaaatgccgtcagaaaaaattgcgccggatctagctgagcctagcgtgctgctccaggggatgatcgactgctgctttttggaagaacgcggcggcgaaaaaggttggattctgctggactacaagacggaccgctggcagaatcgggaaatcggcagacagaaatctgtccaaaagtacaagacccagattgaaatctaccggcaggcgttagaggcattgacgccttacccggtgtgggaaagctatttgtgctttttaacgatggaaacgtgcataaaaataggctgaagggtgaaccttcagccttatttttttgacgtgacaaacaaacgccgtgtttattggatgccggccataaccttttcgcggctcgggtgatccttttcgttgagaattgccttgagtgcggtctgcaccgagcggatcttgcccatgatgccgatcgtgatgaaggactgggggcagttgccgacgatttcgtacgcgccgacgtcgctggccttgacggcgatatccgcgcagtacagcatatctggaatgctgccttgaatgaggagcacagcaccgacgccttcttcgccgaattcgtccatggccttgcgctggtcggggcgcatcttcccgcggatgatgcggatcgtgttgtcatccggttttgaaataaattgatatttaacgttcattggaatccctcttgttgtttaaataatacatctcttctgtttatcatataatgaatataaacggtttgcaagttaatattttacacgattatgcaaaatttagcgcaatggcctgaatgtagtagaaggtgatcaagcttaaaatcatttcgggagcagcctgctctctgaaggcgtcgatctgttcgaccgacagggattcgggatggacggcgatcgcccggacgcagtcgaagaaattcggctcctggacgtcactggcagacggcgcgttgatcttgagggtctgttcggcccagtctaaaatttcaaagatcagctgatcgggcatgtaaatcttgagctttggcacctggatggtccaggctgtcatttcaagcatcgcgagaatcgtattgtcggacttgcgccagctcgatcggttcatcagcgccaaaatcttttccaagatgtcgacctgctccagagacgtgtagggcttgtcgatgcccagcagcgccatcaaaatctggcgttccagcggcggctgcggcgggaaaccgatgtgcgccaccaccagatcgaaaaactgatgggggccgtaagggttgatgtaaagcttgcggccggtcagctggcccagcgccttgagggtgtcgagatagccgagcttggcgtggcgctggtgatcctggccgttagccgccgcattctccggcgcggaaaggtcgagatattctgagctctggatcgtcaagaaggacagatcccgctgatttttgcgcactgcccggcgcacctccactggcgagtagccgacggccatgagctttttacaggggagaaggactgccgtttcaaggggaagctcggacaaaaaaccggcttcgaagtaggtggcgtcctgatctctttgggtgcggaaaacaggaaaaaccgcgccgaggagcagcgtcgggatgagctgaccgttgggaatttcctcgatcgtgcgcttgacgatgctcaggctctgcgggtcgatggtggtgagcatcaatcggcaggaggagcgccggatgatggtctcgtcgagatagcgggacaaggtccgccgcaaaggcatggccttctgcacgaaggtttgtaaaaactgaaggcgaaaatcgtgaaaattgagatccgaccagtactgcaggtagaggccggcaatactgtcgttgagcgctgtgatcttttcgagcaccgcgttagaaaggaattgagaaatctgatggaggtctttttgggcgattaaggccgcagcaatccccccgattgacgagctggcaacccaatccaaatgaaggttcgattcgtttaaagcctgccaggcgcccagctgaaaatccgcctgagcgccgttcccgtttaagagcaatccgtatctcatgatttcgtcaattcctttttaattctggttgaactgatttgacttgttttttcttttttaacttattaataattaggcatcgggtaacttgtagggcgcatccgggtatttttcacgcagtgcgtcgacgagcatgtacgcgaccttgttaatatccccggcgccggcgacgagcaccagatcgcccttttcgagattgtcggttaagaatttggtgatgtcttcaaattcggaaatcacgaccgtcggcacgtggtggcgctgtttgatgcgcttggccaaatcttctgggaaaatgtcccattcgttggtttcccggttggaataaatttcactgatgacaagcttgtccacctgattgaaggagtcgacaaattcgtcgaacaggtaatagatccgggagtaggaatggggctgatacacgacccagagattgttgtgttcgtggtgcaggcaggcgtcgatgacgaccttgagctcggtcggatgatgggcgtagtcttcgtagacgttgatgccgtccacctggccgcggaattcgaaacggcgtttggcaccgctgaattggtcgagggccttctcgatcgcttccgtaccgacgccgagatagtcggcgcaggcgatacaggccagcgcgttgagcacgttgtgctgcccgggcacgcgcagctggtagtggccggcaaaggtgccgccgtggtatgcgtcgaaggccggattgccgttgctgtcgtattcgatgtttttcgcgacccagtcgtttttgtcgctgagaccgtaagtgacgacctggcatttcaaatccttgaccgcgtcgagcacatcctgagagtcgccccaggcgatcatcaagccgtccggcgggatgatttcgccgaattcgtggaaggaatgcttgatctgttcgagaccgcccttgaaatagtcgaggtggtcttcttcgatgttggtgatgatcccgatgttgtgggaggttttcaggaaggagtcgacgtattcgcaggattcaatgacaaagtaattgctctgtccgagggcagcgttgccgccgaaaaccggaatgttgccgccgatgctgaccgacggatcgaggtccgcacagtgaagaatggtcgcgatcatcgaggaggtcgtcgttttgccgtgggtaccggcgacgccgatggttttcgggaaaatttcagaaagcagcccgaggtaatcggcccgttctactttcgggataccgagggcgccggcggcgaccatttccggattgtccgggtggatcgcggcagtataaaccaccagatcgatgccgtcgtgaatattttcggctttctggccgatgtggaccacagcgccgcggctggagagcaattctgtatactttgaatttacctgatcagagccttcgacatggaacccctgttcaagggcaattttcgccagaccgctcatactgctgccgccgatgccgatgaaatagaccgtttcaacggggtggccatatttttcagacaaatgttttttcatatcatgctttgatgatactgaaattgtatttccttttatatccaatcttgtctcctttttacatttatgaaaaaagatttttcatttattatatcagtagactatggtgaacgcaaatacttatcaatttgtcattttttcttttgaaaattaatctgacaaaaagattaaaaatggtttaaaataaatcgattttatgataacatatacatataaaaaagcgtggctatgacttttaggaaaaactgcggaaggggggccgaaaaatgacgattacagatattcgcgtccgaaaaatctatccaacagggaaaatgcgcggcattgtctcagtcacttttgacgatgagtttgttgtgcacgacatcaaagtaattgaaggacagaatggattctttatcgcaatgccgagtcgaaagacgcctgaaggtgaattcaaagacatctgccatccgatcaagtcggaaatgcgcaagatgatgcaggatgctgttctggcagcgtacgacgaagccgcgaaagcgcagcaggaagaggaaaacagtcaagatcaagaaaatgaatcgcacacgttagaagtagattacgaagaagagtgaagttaaaaagaggaggcttgggccttctctttttttgtttgcgcggcgccagaaaaagattatcggcaaaaatcaaatttatccggtggacttttttgagataaaaaggtatgataggaaataattgagcttttatgttttaaacctgaaatcattggataggaaagatttgaaaagatgaagcaaacaaaagcagttattttagcggccgggaagggcacgcgcatgcgctcccgaatggctaaagtcctgcacccgatctgtggaaagactttgatcgaccacgtcatcaacgccaaccgagaagccggcattcaggagattgcggcggtcatcggctatcaggctgacgcggtaagcgcggcgctgccgaaggacgtcgtgagcttcgagcagaccgagcagctaggtactggccacgcggtgatgcaggcccttccgttttttgagggattcgacggcaacgtgctgattctcgtcggcgacgcgccgctgattcgaagcgaaaccctcgaaaagctgatcgaggcgcacgaggcgggcggctacgcggcgacggtgctgacggccaattttgacgatccaaccggctacggcagaatggtcaaggatggcgatgagctcgtcaaaatcgtggaacagaaggacgccacgccggaggaacagcagattcacgaaatcaattccgggatgtactgcttcgacgcggcggcactctgcgatgcgctgtcaaaaatgaccaacgacaacgcccagcacgaatactacctgaccgacagcattgaaatactgaggtcggcggggaaacgcgtcggcactttcccaacgccggattaccgggatatcgtcgcggtgaactccaaggcccagctcgcgcaggcagcggccattatgcgggaccgcatcaacgaaaaatggatggatgccggcgccttgattgtcgacccgaaacagacgtatttgagctgtgagacgacggtcggccaggatgcggtgatttatccaggcgtcattactgtcggcaaagttcacatcggtacgggcgcggtggtctacccgtcagtcattgaaaatcgggatatcgccgacggcgaaattgttcaagcctatcaacaactgcagtaatagttaaaggattctacactggaggattttatcaaaaatggatggaaattttagcggaacaaagatcattacgggcaacggcaacaaaaagctggctcaagacatcgctgcgtatttggaactgcccctctgcaacgcagaagtgctgcatttcagcgacggcgaaattggtctgaacattcacgaatcggtcagaggctcggacgttttcgtcattcagccgaccagcgcgccctgtaatgacaacctgatggagcttttgatcctgatcgacgcgctgaagcgcgcatctgcgggcagaattaccgccgtcatgccgtacttcggctacgccagacaggaccgcaaggcgaaatcccacgatccgattacggcgaagctcgtcgcgaatttaatcacgaccgcaggcgctgaccgcattctgacgatggacctgcactctaaccagattcagggattcttcgacatccctctcgaccacctggcaggcggcagcatcattgcgcagtactttgccgcagaaaacctcgataacctgacagttgtcgcgccagacgcggggtccgtgaaacggacgcgtaagctggccagagccttgggcgttccttttgcgatcatcgacaaggaaagaccgaaaccaaacgaagcggaaatcatgggcgtcatcggtgaagttgaaggcaaaaactgcatcatgatcgacgatatgatcgacaccgccgggacgatcactgctggggccaatgccatcatgaagctcggcgcggcgtcagtcagagcgggctgcacccacggcgttttctccggcccggccatggaccgcattgaaaaatcggcgctggaagaaatcgtcaccctcgacaccatcgaaattccggaaagcaagaaaatcgacaagctgaaaattttgtcaacggcagacgtcttcgcacgcgccatcgattacatccacctcggacgtccgctgagccgcctcttcacaggaagctacagctaatatgtacatcattgcaggactcggaaatccaggcccacgttatgcgaatacccggcataacgtgggctttatgacaattgatactttggcagagaaatggtcggttgacgtcaacaaatccgagcatcaaggcctgaccggaacggcgcgcatcggcggcgaaaaggtcatgctcgtcaagccccagacctacatgaacgaaagcgggcgctgtgtcggcgagctggttcggttttacaaaatcgatctggatcatttgatcgtgatttacgacgacatcgatctcgacccgggacatctgcggattcggaaaaagggcggtgccggtacacacaacggaatgaaatcggtggttgccgcactcggaggcggtaatttcccgcgcgtccgcattggcgtcggcgctcagccgccggagtgggacttggcggattacgtcctcgagaatttatcgggcgatgcggaaaaaacgatcaaggcggcggtcgatcaggcggcgaaggcggcggagatgatcgtcaccgacggcgtcgatctggccatgaaccgcatgaacgtgcattaacagagtgatctgaaatgaatcgggaaatttacaatttttttgataccaaagcgagccgggcgatcatcaaaagtctgaaatccggacaatctatcaacctttcaaacgtcaaagatggtttgaaaggttttttatcgttgttcatcgcggaccagctcaagatgcgcgtgctctacatcgcaccgacggatgtcgaagcggaaaagcgggcacagaaaatcgcgacctgggacgcggcgcacacgctgtactttccggccaagccggtgcacgattatttcaccgacgctcacagcagcgaaatcacggaaaaacgcatggccgcgctggatcggctgctttttggccgcagtcacgatgtggttgtcacatcgattcaggcgctgatgcagaaaatgccgtcagcatctgactttaaaaagaagatcctgacggtgaaggcggggcagcagatggacccaatgaccctcacaaggcagctggccgatctcggctacgtcgatgcggatcaggtcgaggcccgcggacagtttgcccggcgcggcgaaatcgtcgactgctttccgatgaatgcgaagcagccgatgcgcatcgactttttcgacgacgagatcgagagcattgcgcccttcgatatccggacgcagcgcagtgaggcggaggtcaagcgtgcggtgattctgccggcggacgaaaacgcgatgccggctgcagaacaggaggcgcgcttaaatcaaatcgtgaagcggtacaggcaggacccgggctacgaggaacggctcggcacgatcgccgcggcgcccgccgactatctcgaggtgttaaacgcctttggagacagcgaaggcggttctttgagcgcttaccttgggccccattgggcggtgttctgggacgaccgcgaacattgcgggaacagcgcggacaccttcctcgaaaagaccttccaggattttgaaagtctcttggacgaaaagctgatgttcccagaggaacaggataaatttttcgattttgcgtcctgctgcagctttttagaggggtatccctcggcggacgcccggcttttttccgagggcacgaaggacaagggcatcgattgcgattcaaagagtgtcgagagcttcgccggaagactgcccctttttgccgaatacaccaaacggcagattgatgctggcagtcgggttgccatctgctgccgggacaaaaaaggcgagaaacaaatgcgggaggtgctcgcgtcttacgacatcgctgaattcagcgacggacagacgccaggtgtacttttcctgaagggtgatatctccgagggctttgagctgccgggggcgcggctcgtctttctgagacagcaagaaatcttaaaggaaggccgaaaaaagaaacgccgacgccagttaaaaaacgcgcggaaaatcgattcctttacgagcttgtccatcggcgactacgtcgtccacgacattcacgggatcggcatctaccaaggtatccaaaagatgaccttcggcgacacgacaaaggatatgatggtcatcgcttatcacggcgacgacaagctctatctgccggtggaacagatggacgcgatccaggtctacatcgggaccggcggcgaccgcaagcccaaggtcaacacccttggccgtccggactggagccggacgaaatcgaaggcgaaaaaagcagtcgaggaaatggccgacgatttgatcgccttgtacgcggccagacgtcaggccaagggctttgccttcagcgctgacacgccctggcagaaggagtttgaagaccgctttccgtacgaagagacggacgatcagctccgctgcatcgaggaaatcaaggccgatatggaaaagccagtgccgatggaccggctgctctgcggcgacgtgggctacggcaaaacggaagtggcgcttcgagccgctttcaaagcgattatggacaacaagcaggtggcgttcctcgcgccgacgacgattctggctcagcagcattaccagacgatgatcgagcgcttcaagggctttccgatcacggttgaggtcctcagccggttcaggacgccaaagcagcagaagcagatcgtcaaggatctggccgcggggcggatcgacctgattgtcggcactcatcggctgctgtccaaggacattcagttcaaggatctgggcctcctcgtcgtcgacgaggaacagcgcttcggcgtcaaatccaaggaaaagctcaaaagctttaaggaaaacgtcgatacgctgacgctgtcggcgacgccgatcccgagaacgctgcacatgtcgatgtccggcatccgggacatgagcatcctctccgagccgcctgcaggcagacggccggtgcgcacctacgtgcttcggaaaaatccggtggtgctcggcgacgcgatcgagcaggagctggaccggggcggacaagttttcttcgtccacaaccgaatcaaggacattcaggaaacggcagcgcagatcgcgcggatggcgcccaacgcgcggatcgtcgtggcccatggacgcatgacgccggataccatcgaaaccattatgagccgcttcctcaatcgggaatacgacgtgctggtcacgacggcgatcgtcgaatccggactcgacattaaaaatgcgaacacaatgatcgtcgacgacggcgacaaaatgggactgtcccagctgtatcagctcagaggccgagtcgggcgctccaaccgccagtcctactgctacatcttgtacgacaggcaggtgctgtccgaggtggcacagaagcggctcaaggcgatcaaggactttacggccttcgggtcggggttcaaaatcgcgatgcgggatctcgaaatccgcggtgccggcaatattctcggcgcggcgcagtcgggccacatgttcaacatcggttacgaaatgtactgcagaattctcgaagaaacggtggccgaacacatgggcggccaggtcgaacacaaggaagcggtgccggtgaagatcgcgatgaacgtcgacgcctttatccccgaaaaatacatcgcaagcgaagtggtcaaatacgacgtgtacaagaaaatcgcaaccatttccgacgaagaggacgcccgcatggtcgaggacgaattgaccgaccgcttcgggaaaatgcctcagtccgttcagaatctgctgacgctgtcgctgatgagcagtctggccggcgcccatcaaattaccgaaattcgggaaaagggagacaaaatcttgtttttcttcgacgaaaaagcaacgatcgagatgccgaacggcgcggtgattcaaaaactgtttgaccaattcgatattaaattcaagggcgatccccgtcgggataatgtctggtccatcggcgttcggggtcaaaatgccagaatgcggtgccaaacggtcatcaaatttcttaaaatgtggaatggccaggcctaaatatgatatgattacaccataattttgatttgctaaaggagaacgttttgaaaaaacgaataatgggaaagaaatggctgaaggcagcggccctgatcctctgtgtcgggatgatcggcgtttggacgtcagggtgcgcgctggtgaacgtcaacggcgtcagagatcgggcacaggtcattgccgagattaacgggcaaaaaatcaaaaaagcggaatttaacaacacgatggcttacatcgcgctgacctattcggtcaacggccagtcgatgcccacagggtcggacctcaaaacgctgaagcaggacacctacgatcagctgatacagactgaagtctttgcggctaaagcaaagaaagacaagcagaaggtcgatgaagacgcccagcgcaagtctggacaaaaggcttacaaggcgatcaagaagcaggcggctaaaaaatacagcagcatccttaaaacctatctgacgactgacaaatcttttgcggcatttatggaagacaacgccgtgaccacggcctacgcgcagaaggctatcgccaaatacgacaagaagctttcgaaaaatccagatgcattcttgaagacctcggtcggttcggtcgaaggcaagagcgtgactcacggtgaatactactatcagatgattcagcagacgctgtcggcttacgcgagttccggtcaggcgccgtcgtctgacagtgatacccagaagcagctggggcgcaaggccttcaaggcgatcaatactgaacgcaaatggattgcctactgcaaggcgcacgacatcaaaattacaaaatcggcgatcaaaaagcaaaacgacaatttgtcggcctacaccaagcagttcttccagtcggacagcgtgcttaaaagctaccttagcgaaaattttgaaggcttcgacattgacgcctacaaaaaagaacagcggaaaagcgcgaaggctgccgcagctaaacaagcggtcaaagataaaatttacagcggcgtgaaggtcaccgacaaggccatggaagactattacaacgaccataaggatacctacagcccgagcactgtttccgcctgccacatcctgacgagcgataaaaagctggctcagcagatttacaaggaagccaaaaacgtcaagaccaagagcgcttttaaaaagatcatggacaaatacaaggacaacagcaaggtcgaagaagccaaggatctgggcgcgttcaagagcagcgatatggttgaaaacttctcaaaggctgcgttcagcgccaataaaaattccgtcgtgggaccgattcagacctcctacggctaccacgtgatttacgtctacgacaagagctccggcaagaacgacagctggaagaatcacaaggccgcactgaagaaagccgttcagaaagaaaagggcaagccagcctatcagaagttgacgaagaaattcaacaaggctacccgcctgcgcatgaacgatccgattcagtccgcctcagaactgtacgcggaaaagctaaagaagaccttcaaggtcaagacctacgaaaaacgcattaaataaggaaaaatgtttagagggttaacgtgagtaaaaaagcaagtagttatttaaagggcgcaaccattttgacggcagccggatttttatcccggctgctcgggctgtttttcaaggtccctttataccgcattgtcggcagcttcggcaacggcatttacggcaacgtgacgaacatttacaacatgctcctgatggtgtcgacggtcgggattccggttgccatctctaaaatggtttcggaaagcacggctgttggcgattaccgcggggcgaaggacgtgttcaaggtgtcgacgacggcgctgctcattctaggcgcggtctccagcttgattttgggatttggcgcccacgccatcatccgcctggcccactggccgaaggaaagctacgcggcgatcatcgccatcgcgccggcgccgtttatcatttcggtgtgttcggcctttagaggctttttccagggcttccagattatgacgccgacggccgtctcccaaatcctcgaacagattgtccgagtggccctcggaattttcctgtgctggtatttcatgcatgggctcagacatgacgttgggaaaagtgtcggcggcgctgttttcggcgcgaccgccggcggcatcatcgcggcgctctttttggtctacgtgttctggattttcatgtcgacctatcggaagaaactcagaaagacgacccgcagccatccgagacgctggcagagtattttaaagcgcctcgtcatcatcgcgattccggtcacgctgacatcggtcatcgtttcgctgtttgcgacgatcaactcttttatctacgtcggccggctcagcgtcgccgggatttccgcccataccgcgacggaaatgttcggcgatttcaccaacgtcgatacgctggtgaatgtgcccctcgtcatttcctcaaatttggcggtggcgatgattccggccatatcggaatcctttgcactgcgcgaaaagaaggtcatgaatcacaagattgacctggcgattcgcatcatcattctggccggactgcccttctgcgtcggcatgtcggttttgtcgaccgcgattttccgcctgctcttcccgggctccaagtacgggccgggcatgctgcaggttttcgcctacgcgacgatgttcatgatgctctcgaacaccttccagagcattctccaatccatcgacaagttccgtgtcccgctggtgaccttgagtctcggaattattgtgttctcagtgaccgggtggatcacgatggccattccgtcgatcaatatttacgggatgggcatcgactacatgctgaccttcatttatctgaccgtagccaattacgtctgcgtcaagaaattcaccggcgtgcgcatccactggcgccagtcggtgttcaagccaatcgtatcggctgccgtcatggggctggctacggcgggcgtttacaacggtctgtacccgcacaccggcaacgtgatcgcgatgctgctggcttttatcgtggcggttttggtttacagctttatgattgtgttcaccggtgtgctctctgacgaagaaatggacgtcatgccgggcaagcgcagactgatgccgatttatcaccgcatcgtcggtctccggagaaaggtattcagccgatgaaagatccgaaggattgtctcgatttagatccccggcagctttcgacgctgtgcgccgtgatggcggcgctgcggtctgagggcgggtgcccgtgggacaaaaagcagacccacgagtcgctgaagcgctatttattagaagaaacctacgaggtgatcgaagcgatcgatcaggaagacacggaaaatctggtcgaggagctgggagatctgctgtttcaaatcgtctttcacgcgcagatcggcgaggaagacagcgcgttttcgatgggcgatgtcattcagggcatcaatgaaaagatgatttaccgtcatccccacgttttcggcgatctgacgccagacgaggtggactgggacaagctcaaggcggcggaaaagcacagcgcgtccctcactgacgagctgcaccggatcccgaaggactttccggcgctgatggcttccgaaaaaattcagaagaagcttgcgaaaagcggcagacgcaaaacagatgaggcctttgatctcgagcaggtccgcggcgcagctgacgcgctcgagggagcggacgaaccggaacaaaaggccgaggcccttcagaaaatgctggcggcggctgccgatttggcgaggttaaaccatcttcagcctgagctattgcttaaggaatacaacgaccgcatgattgatgaacaggaattggacgcaaatcattaatttttcttatttcagcacagaaattgcttgtcttttctaagggttcgcgcttataatagtaaagaaatatttgaatagaaatccatggaggaactcaatgaataaaacacagttagttgcatcaatttcagaaaagtcaggtttatccaaaaaggaatctgaaaaagcactgtctgcttttactgaaagcatcgttgaagcattacagaaaggcgacaaagtttctttagtcggatttggtacttttgatgtccgccacagagctgcaagacagggtctcaatccgagaacaaaagaaccgattgaaattaaggcttcaaatgctccggccttcaaggcaggtaaagcatttaaagatgcattgaactaagtgaacatgggaaaagccggagcattccggcttttattttttaggagggaaaatgcggatcgataaatttttgaaaaattcacggctgattaagcgccgcacggtgagtaaggcggcctgcgacagcggacgtatcgccgtcaacggtcaggtcgccaaggctggcacccagatcaaggaaggggacattatcatgctgtcgatgggcggctcaacccaaaaggtcaaggtgctcgcaacgccggaacacgttcggaaggaagacgccgaaaatttgtattcggtgattgaatcctaacatggctgggcagcgtaaacggagaaagcggaggccgaagcgcgtgaatctcgcggattggctgtcgaaaaacggcatccgcctgctcgtcatcatcggcattgtcgcgattgtcggcaccctttacggcacgaagatttctcagatcgtccgccttgaagctcaaaagcgcgagctgcagcagaatctggtctccgaaaagaaacggtccaaccgtctgaataatgagctcaaatcgatcaaatccaaacactacgtggagtatatcgcccacaaaaatttaggcttggtctatccggacgagcagattgtcattaaagtcaacagccaggcggaagcgaaaaagcagcagcagaaggctgaaaaacaggcggcggaagcaaaacagaaaaacacgtccgattcccaggacggcgccacgacgacgggggtggatcaatgagacagaatcagacaaaaaaacgctacggcgtgatcgatatcggcagcaactccattcggatgatgttgttcgactacaacggaaaggcccagcctttcgcgaatgtcaaaaagtatttgcgctcgacgcgcctcggacacggcgtcgacgcttcgggtaatttggccgaaacctcggtggcgcgcagtatcgacgcgctggtggaactcaagggcattgccgacgccgaggacgtggaggaaatttacgcctttggcaccagtgcgatgcgcgacgcggggaacgcgtcggctttgacagcgccggttctcgaaaaaacagggattgcgatcgacattgtcgacggcgacaccgaagcgaaatacggtttttacggcgtctcttcgtgcttttccggcaatattctcattgccgatatcggcggcggcagcacagagctgatctgcggcagcagcgccgcaggcatcgcttgggacaagagtctgaacatcggggcggtccgcgatacggagaaatttatccgcgaggacccgccgcgtaaagcgtcgattgaaagccttgaagcccacgtgaaggaacaggttgccacgctgctcgaggcacacatgctgcctcaagacacgacccttgttggcatcggcggcaccattacgacgtgttcggcgatgcgtcagcacatgacggtgtacgacgaatcgaagattcacatgagcacgctttcggccgctgatgtagctgacatgcaaaccgacctcgcggcccgggatctcgaaggacgtaaaaaaatcgccggtcttcagccgcggcgcgcggatatcatcgtggccggcacgtcgatcttaaacgcggtcatgcgctgtgtcgacgccaagcagatcacggtgtgcggccgggacaatatggaaggcgccgccatcgtacactttggtctgtaacaaaaagataaaaattaaataaaaaaagagttgacaagggcaggggcttagattataatagctcttgtccttgaaaaacaggtgctatatgtgaacgccggagtggcggaactggcagacgcacaggacttaaaatcctgcgatcctaaccgatcgtaccggttcgattccggtctccggcaccacttatattttatcatctcgtcgcggggtggagcagtttggtagctcgtcgggctcataacccggaggtcataggttcaaatcctatccccgcaaccatttttttatggcggcgtagctcagttggctagagcatacggttcatacccgtagtgtcagcggttcgaccccgttcgccgctaccatttaaaaatggccccttggtcaagcggttaagacaccgccctttcacggcggctacgggagttcgaatctcccaggggtcaccaatttaaaaatatcctgaagtgtttcacttcaggtttttttttacaaaaaatttgacaagtacaattgtaaaaataagtaaagaagagaaaatgaaaccacaacgtatttcccaaaacgtccaggactttgaaaaaaccgtcggcgattttgtgaaacgccaccgcatgtttgcggccactgacagattgctggtcggcgtgtcgggcggggccgattcgatgggactgctcacttatctcaaacggtgccatccggggccgatcgccgcggttcacgtgcatcacggcatccgcggagcggcagccgacgccgacgcggcgctggtcgacgatttctgtaagcgccagggcatcgcctgccgaatcgtcaaggtcgatgtcccaagtgaggcagcgcagaaaaaaatcagcctcgagttagccggaaggcaggcccgccagcgtatttttgtgaagcttctagcggaataccgctgcagccgtttggttttggctcaccatatgaacgatcaggcggagacggtgatgatgcggctgatccgtgggacgggggttgccggcgctgctgggattcaaccggtctcagggacagtcgtgcggccttttctgtgtgtcaaaaaggacaggattaccgcgtactgcgaggcgctgcaaatctcattccgaacggatgctaccaattttgacacccgcttcacgcgcaacagcattcggcaggatatattgccgcagatgacggcgatcaatcccaaagccgttgaccatttggcggattttgcgcagatggccgcggcgtaccaaagagaaatcgatttttggcgcacaaagctgacggaccgatgggtgacccaagacggcgatagtttgatcttaaatttaacggcattcgatacggcctccgagctgatgcgccacttgatcgttcaagactgcctgattaaagcaggaaaaaccatggtcgacgtcgaaaagcgccacgtcgatgcgattacgagactattggatacgggcaaaacgacttgggatctggatatgccccatcgggtccaagtgtcaaggcggtatcaaaagctgatttttaagcctgtccttgagacaaagcgcgatcgaacgacgttggcaaatccggtccgattctgcattgtcccgggcggaaggccccagacggtggtcggacactatcgtattaccgtgacaaatgtcgaaaatttacaaaaaaaatacaagaaaggtcatttaatcaatgaaattcttgttaattatggtagaataaaacatgatttagtgctgagagggagggaacctggcgataccttgaagattcaaggcgtcgggcaccgaaagctcaagaagtttttaattgatcacaagattgataaaaatgagcgggcgtcaatgctgtttttggcagacggtccgcgcattctgtggatcccggggatttggcgggacgcggaaattggaacagcacaggatcaaaacgatatggggctattgataagattggagaaaatcggtaatgaatgagataaaaaaggtgctgataacggaagaacagctcaaagccagaaacgcggagctgggccgacagattacagaagatttcaaagggaaagatctgctcgcgatttgcattcttcgggggagctacattttcttctcggatttgacccgggagattgagctgccgctggaggtggcgtttatgcacgcggccagctatttcgacggcacggaaagctccggcaaggtaaatctgccggatcaaaatatgctttctgttgaaggcaaggacgtgctgctggtcgaagacatcgtcgattcgggccggacccttgcggcgctgaagggcaccctgctcaaaaagggtgtcaacagcctgcacattgtgacgctgctcgacaagcccgaccgccgcgtcgtcgacatcgacgtcgattattcgggatttgtcgtgccagacgaattcgtcgtcgggtacggcttggattacgatcagcgttttagaaatttgaaatacgttggcatcttaaaagaagaagtttatcaataattaactgttatcaggaaaaggagaaagtgattgaaaaaatacatgcgcatgatcggcttttatctgctggtccttgtggttatcatattagcggttacctttttaaatccgtcgcgcgctgaaacgaagcgctggacttattcggatctcgtgacgaatctgaatcagaacaaagtcgcctcgattcgaatcaacggctcaaaagcgacgggcaaaacgaccggcggtaagcattttgaaacggtcgtgccagaatacaccattgatcaaatcgtcagcaacgcgatcatcaaaaatccgaagctgaaggttgaaatcgctcagaatcaaagctggctcgtctcgctgattccttcgatcattttagtcgtgatgatggtgctgttctttatcatgctgtcccagcagtccagcggcggcggcaaagttatgagctttggcaaaagccgcgctagaatgcagtcgccaaacgacaagaaggtcacttttgacgacgtcgccggcgcggacgaggaaaaggaagagttagaggaaatcgtcgatttcctgaaatcgccgaagcgctacacggatatgggcgcgagagtgccgaagggcgtgctgctggtgggccctccgggaactgggaagacattgctcgcgagagccgtcgccggcgaagctggcgtgccgttcttcatcatttcaggttccgactttgtcgaaatgttcgtcggggtcggggcgtcccgtgtgcgcgatttgtttgaaacggccaagaaaaatgcgccgtgtatcatctttatcgacgaaattgacgcagttggccgtcaccgcggcgccggtctcggcggcgggcacgacgaacgggaacaaacgcttaaccagctgctggtcgaaatggacggcttcagcgccaatgaaggcatcatcgtcatcgctgcgacgaaccgcccagacattctcgacccggcgctgctcagaccaggccgcttcgacagacagattacggtcggccgtccggacgtgaagggccgcgaagctattttgaagatttaccggcgcaacaaaccattggatgcgtcagtcgatttgaaggtcattgccaagggcacaccgggattcaccggtgccgacctcgaaaacctgatgaacgaagccgcacttttagcagcccgcaagcagatgagcgtcatcacgatgaccgagctcgaggaagcgatcaagcgcgtcatcgccggcccggaaaagaagagccgtgtgatcgacgagggcgaccagaagattaccgcgtaccacgaagctgggcacgccatcgtcatgcgctatctccacaacggggaagacgtacacgaaatttcgattatcccgagagggatggccgccggctacacgatttcgctgccgactgacgacagtcagcacatgtccaagggcaagctgatggataaaatcgccggtcttttaggcgggcgcgccgcagaaaaggtcgctctcgacgatatctgcactggcgcctccaacgatatcgaacgcgctaccgatattgcgcggaaaatggtcaccgaatggggcatgagcgaacacctcggcccgatgacctttggcaacaacgagggcggagaagtcttcctcggccgcgatttgggccggacccgcaactacagtgaagaagtggcgtcggtcattgaccgggaaatccgcaacattgtcgaaactgcttacgaacaagcctgctcgatcttaacgaaaaaatacgacactttggtcgacgtcgcggaaacgctgctgaaggtcaacacgctgacaggcgacgagttcgcagatatttacgaaaatggcagcgcgaagaaggcagaaagcgccgattcggctgatcaacaggaagactcaaaagaaaaagaagatgctgcagcggatcaggctgaagcagatacaccagaaataaagacagaagctgaagggcagaccgaacagctggaaacagaaggtgcaccggcagatgatgaagcatcgccggaagacgcatccgatgtggaagttacggtctccgaagcggaagatcaatcaacggccaaggaagaatcgcctgaagcctcatctgagacggacgcgccagcggacgcatcagaaaatgaccatacagaagcacaataaggaaacaggaggaggatggatcatgactgaaggacaaaatgaaaacggcggcctgcgcgcaggcatggaaatgaaaaaggattacgtggtttcgcgcgatcaaaccgcgcgggttgttggaagcggcggcctcgacgtgctggcgacaccagttttatctgcttggattgaaaatgtcgcctacgaaatggtcgatctctggctgaaagacgaccagacgactgtcggcggcagcatcacgacggctcatatcgcgccgacaccggtaggtctgaaggtgcgggtcaatgtccgtttggaaaaaattgatggcagaaagttaattttctcaacagaagcgtgggatacggtccaaaaaatcgccgaaggcgaacacgtccgctttattgttgacaaaaagcgctttatggataaggtagcgaaaaagaaagaaaactgatcgatttcttcggaacaattcaaaatgattttagtaatagatgtaggaaacacaaacacggaagtcggcgcctttgaaggtgacgatctgatcacttcatggcgctttatgacgaaaacgccgcggacttccgatgaatttgcagtgacatttagagggttctttcagaccgatgaattggaccccaaggcagtggaatcgatcattgtcgcgtccgttgtgccggatgtcatgcactcgatgatcaatggggtgaaaaaggtttttggccgcacgccgatggcagtcggtccgggcatcaaaaccggtatgcccattttgatgaacgacccgacagaagtcggcgccgaccgcattgtcgatgcggttgcggcgtacaatctttacggtgggccggtcctggttttggatttcggaacggcgacgacctacgactacgtcgatgaaaacggcgcgctggtggccggtgtcatgacgccgggcattcaaatttcggctaacgctctgtttgccaacgcggcgaagctgccgagcattgcgatccgcaagcccaaaacgatcatggccaaggacacggaaaccaatatgcaggccggtttggtttacggctatattggccaggtgtcgtatatcatcgacaaaatgtgcgaaaaaatcggggagcgcgtcaaagtggtcgcaactggcggctacggccggatgtttctcgacgaggtggacagcattgacattttcgacccgaagttgaccctcaaaggactgaaaatcattcatgataagaatcttgcatcacgaaagcgaaagtgaatgaacgaacaaattcataaaattgtgccagttgaactggcaccgatggcaggttataccaacctgccttttcgtttaatggcggaaaaatacggcgccgaccgtgtcacgacggagatggtttcggcgaagggcttgtattaccgggataagaaaaccgccaagctgatggcgacagtgccggaggagacagccgctggcgttcagattttcggcagtgatcccaaaatcatcgcagaggcggttgaacgttacatcaatccgctggatttcgactttgtcgatttcaacgcaggttgtcccgcgccaaaaatcgtcaaaaacggcgacggttcggcgctgttaaacgacctgccccttttggaacaagtcgtgtcggcgatggtcaaggtctcggataaaccggttcgggtcaagcttcggctgggctgggacgacgccaacatcgtgatcgatgaggcgatccgcagggtagaggatgccggcgcggccgcggctgtcattcacggacggacccgggcggccttttattctggaaaggcggattggggggcgatcgcccgcgcgaagacgctggtcgagatgccggtggtggccaatggcgacatcgactccccggcggcggcggtgcgctgcctcgacgtgacccacgccgatgggctgatggtcggccgcgccgcggtggggcggccctttatttttgcgcagattaaagcgcgtctggctggaaaggctgtgccgcagccctcggccggcgacatccttaacatcgcgatcgatcacgtcaggctggtcgatcactgcgccggtcaggtggggccaatggttgagatgcgcaagcagctggtggcttacaccaagggtatgcccgattcggcacggctgcgccagcacattttcagctgtcaaagcgcgcaggacatggtgggctgcttgacagattacgccgcggcggaagggattgcgatttcatgaatcagtgggtaaaagatgaacacgttagaattgcggccatcggccagggcgattggcgcaaattcgcctgcgtggtcgacaaccatcaatacgcgctgatggcttggctcaaatggtttgaaatgcatcagacccccgcggtgctggtcagcatcgattttcatccggacaccgatccggccttttggctctacagttatcagaaggcgctcgccaaggtggatccattggacgaaaaggcggttgaggccgagcagcagcgtgtccaacagaaaattctcggtcagatggatgtccgcgatttcgagtctgtagcggcgcagatgtccaaaatgaacaatgacgagcagatcaacaccgcgatggatttgggcgttctgtcagattaccatatgatcaactgcatggcggcgcatcactacgcggctggcacccattatttggtgcctgagtcccattttggcgatctgtccgatcagatgtttgcggcctgcggttttgacgactcggttatcggcaggacgccgctgattttagatatcgatctggattattttccgaagccgtcctttgataccgctggagatcttttcaataaactcgtcaggcgcgcagagctcgtgacgatggcgcggtctgagacgtattttaattacctcaaaattgagcaggaaaagggctttacgatccgccattgcgaggacgagtgcctcgcattgttaaatcgctgtttgacaatggacgagtgaggccgaaatgttgtataatgagagacaatcacaggctatggattaaaataggagaatcgaaggaaagcacaatgaattatcacgatttattaacagatgaagacatcattgaaattaaaaacggcgaattgacggtggacatttcggacgtggtttacgattcgagacaggtgcagaaaaacgcgctttttgtcgcgattttcggctttgctacagatggtcatcaatttatcgaaccggccatcgaaaagggcgcggccgtgatcgtgcatcaggccgacctgccccagtatcacgacgacgtcacctacatcaaggtcaccgatacgcgcaagatgctcggcatcatcgcaagccgatttttcggccatccgtcgtcgaagctgacggttacgggcatcaccgggacgaacggcaagaccagctcgacctattttctgacgcggattttaagcgaagctggcaaaaaatgcgcgcgcatgggtaccatcaacgacgaaatcgacggcgaaatttttgacaacaagggtcgtaccacctcagaatctcgggatacccaggcgtttatcgcgaaggcggtcgactacggctgcacggatctcgtgatggaagcgtcgtctcaggcgctggatctggaccggctcgtcgacgtcgattttgattacgcgctgttcaccaatctgacccaggaccatctggattatcacaaaacatttgaaaattatttcttagcgaaggctaaactgtttgatcagacgagcaaggcggcgattatcaacacagacgatcagtggggcgtgaagctggtggaacgtatccacacgcgccatccggagctcaaggtcatcacctacggcacgtcagacgacgccgactacaaaatcgaatcgatcgactgtacgacgagaggcagccagtttacccttcgtcacggcgaggaagaagaagcgctgttcctcgatgtgctcggccggtttatggtctttaacgcggtcggcacgatcattgcggcgcgcgaacagggtgtcggttgggacatcatcaagaaagcgctggccgacgcgcctgtcgtcgacggccggatggaccgggtcccgctggatttggatttcgacgtcattgtggattacgctcacacgccggatgccctcgacaacatcctttcgacggtccgcgaattgaccgacggcaaaatcatcgcggtctttggctgcggcggcgaccgcgaccacgggaaacggccgaaaatgggcaggatttccgcagaaaaagcggatttcacggtgctgacctccgataactctcggacagaagatccggacaagatcatcgacgacatcgaagcggccgtgaagccgattaccgaccaatacatccgcgtgaccgatcggcgtgaagcgacggcggcggcgctgaagctcgcgaagaagggcgatgtggtggtctttgccggcaaaggccacgaaaagaccgaaaccagccggaatggtgtgcgcccctattacgaaaaagaagtcattcaggaagtggtcaaagaactcggtctttgacaataaatcacacttatcaattaaaaaagctgcggtggatccgcagctttttttagatataaaacatgtagttccctttgtttttctgcgagacgtactcgtcgagcagatgggacaatttgattttagacaaggtatctttgacgccttgatctaaaacatcgtacacattttcgttcaagatgctttcaatggttggtgctttttcttcgacgctgctttctgtgggttcaaaaagggtctgttccagcgccgataaaatgtcgtagacgctgatttccgatgcgtcccgcgccaggcggtagccgccttgagctcctttcacagaggtgacgagtttgccgcgtttgagcagcgagaaaatttgttcaagataaatttttgaaatgccgagatggtcggataaggtagcgacgggaatcagtttcccgttggcgctcagccaggtcagttcgaccatggccgcgagtccgtaccgtccctttgcagaaatgcgcatgattccctcctaataaacatactaaatatatatatattattgtaatcaagctggaaggcgccgtcaaggccttttggaaaaataaaaaagccctgtgaaattttttattcacaggactagattgatgacagtgatgaagattacggggcgacattgatgtaattgtccggcagctcgtcgaaaaacatgatgccgatgcagtcggggccgatatgaacggtgagggctgcgccagcgccctgctgcggaatgatgaaattcttgacgcccatatccttcgagatggcctttttgactttatcctgaagggacggcgccttgctgtgaacgaagccgacgcactgatttttatcaggcattttttcgtcgaccagctcgagaagccggcgttccgcgcgcttctgtccgcggaccttttcgtagggaagaatcttgccgtcttcaaaatacagaatcggtttgattttcagcatatcgccgatgagggcggcgttcttgccgattcggccgcctttggcgagccagcggatattgccgacgaggaagaagatattgatgtggcggctcaaaaagttcatcgtgtcgctgatttcctcgaaggagcggcccagtttgttcagcttcagtccctgatgcaggatgagcatcatgcccgtcgtagccgtcttggaatcaatgattgaaatcttccgttcggggtaatcctcgagaagctgagaagcgatgagcgaagcggtctggaaggttccggagaggccgcttgaaagcgctaagtaaatgatgtcgtcgccgcggtcgaggtattttttaaagcattcctgatacgtgacggtctgaacctgagaggtctttggaaaatcgtcagggttctgcttgacggaatcgagaatcatatccggagtgatatcgatgccgtcgtaataggtcttgtctccaatcgtgatcggaatgggcagcacctcgaaggggtaacggctgcgtatattttcatcaatgtcgcacattgagtcggtgataaattgaattcccatcggcgcctcctttggggaatgttaatcaagattgcctaatattttatcatggccgttttgttttgacaactttgttttcatttgcattcatgataaaatagaaataatttttgcaggaggacgacattgacaaccataatcgagacgttaaaaggcgaatttcatctttcagaaaaggttttgacgcgcaccatcgatctgatcgacgcaggcaacaccattccgtttatcgcgcgctaccgcaaggaagagacgggcaatatgaacgacacggtgcttcgggagctgaacgatcggctcggctatttgagacggctggaggcccgcaaggccgacgtggccgaggctatcaaggcccaggacaagtggacgccggcactagaaaaggccctctgccgggcggcgacgatgcaggaggttgaagatctctacctgcctttcaagaaaaagcggcggacccgtgcgatgaaggcaaaggaagccggtctcgaacctttggccgaggcccttaaagccggagaaagcgacgacagactgctggctatggcgcaagatttcgtcaatgccgataagggtgtcacctcggcagaacaggcggttcagggcgcgcaggatatcgtggccgaagaaatttcagaacaggcagtctttcggaaaaacatccgcgaggtcttggaaaaacggtcggtcatttcgacggaggtcaaacccgaatttgccgatcagaaaacggcttacctcgattattaccaccacacggaacccatcgcgcacattgccaatcaccgcatccttgcgatcaaccgcggcgaaagggaaaaggtgctcagtgtcaaaatcgacgcctttgaggcacaaacgctccgttacctgatgaagaaaacggcgccgtgccccgaggacgacgcccaccactattttgcacaggccgtcgcggacagctacaagcggttgattttcccagctatttcccgggaaattcgcagcagctgcagtgaacgggctgaaaaatcggcgattgcgagtttcggcaccaatttaaaaaaactgctcctcagccggccgctgaaggggaagaccgtgatgggattcgatccgggattcaaaaacggctgcaaaatcgcggtgctcgacccgacgggcaaactgctggcaacctcccggattttcctgccctacggcaaaaaacgcagcccggaggcggaacggacgatgatacagctgatcgaaaacctgcgcatcgacgtcatcgccatcggcaacggcacggcctcccgggaaagtgaacaatttatcgcggatctgattagtagggaagaccttccggtgcagtacaccattgtgtcagaagcgggggcgtcgatgtactcggcctcgcccttagccgctgaggaataccccgacgtggacgtttcccttcgaggcgccatctccatcgcgggccgcctgcaggatccgatgtcggagctcgttaaaattgagccggagcatatcggcgttggacagtatcagcacgatgtggatcaaaaggctctgcgggaagcgctggccggtgtcgtcgaggacgcggtcaaccacgtcggcgtcgacgtcaaccgcgcgtcggcggtgctgcttaaatacgtctctgggattacggaaaagacagctcgggcgatcgtggcgtgccgggatcaaaacggtccttttttcaaccgcagatcgcttttgaaggtcaagggtcttggtgcgaagacttacgagcaatgcgctggctttctgcgcatcgacagcgggaatgaacccttggacaatacggctgtgcaccccgaatcctatccggccgcgaaggccgtgctgaaggcagcggggctgagcgaaaatgatctcaggtgtcaaacgccggaggaactgggcagcgccctcgacggcctcgatttggatcaaatcgccgcggcgtaccacgtcgggaaatggacgttaaccgatattgtggatgagctcaaacgcccgggacgcgacccgagagacagcgcaccgccaattattttaaagcgcgaggtgctttcgatcgaggatttgaagcctgatatgcagttgaccggaaccgtgcgcaacgtggtggatttcggcgcttttgtggatatcggcgtgcatcacgacgggctggtccacatttccgaaatcgctgaccgctacatcaaggatccgtctgaggttttgtccgtcggggatattgtgaccgttcgggtgctggatgtcgatttagatcggaaccgcattgcgctttcgatgcgtttataaaaagggcttgacaaactctaaaatagtttgtataatttctgttttacgtctgtgaccttttatgctataatagaattaattaacagacagaggtgcaaaacatgtataaagtcggtgacaaaattgtgtatccaatgcacggggcaggcgtcattgaagatatcgaggaaatggatatctttgataaaaaacagacttattataaagtgaccattgcatccgagggcatggaaattttaattccagttgacaaagccgatgaagtagggttgagagacatcccgaatcacgaagacatcgaaaaaatgttcgaggtgctgggacagccgcaggaccgcatgacttccaattggtccaaacgctatcaagacaatatggatcaaatgaaaacaggggatctgctcgatgtggcgcgggtaacgcgcaatttgatgatcatggaccgcaagaaaggtctttcgagcggcgataaaaaaatgctgatgaccgcaaagaatttcttgatttctgaattgatggtcgtcgaacataccgaaaaggaagcggccggcaacgccattgaagacgcggtcaaagcctgaacgaaacccaaagcccaatcgggctttttttattgacacgaaaaactaaaaaataaattaaaaagttaatcatttcgtaacaatttcgggttaaatggtataataggagcgttatctaaggatacatccatattagaaagtattaaaaggaggtgagaaaagatgttaaaaaagatattgcgcggcatttgcacggtcatcggcatcgtgctcggctatctgctcggcctgctggtgtgccggaaggatgcgctgccagaactgctcaaccacgttcagctgctgcgtcagaaccaatggatcgtcattctaatttttgttattatttttggtttcatattttttattatttttccattggtggcgcgcattggcaaatccatttcagaagcggtggaaaaggccacagctgaagtgcgtctggcggatattgtcctcggcatattcggtttgattatcggcctgttaatcgccatgctgatctgcgtgcccgtcggccgcatcccgatcagctggctgtccagcaccattaccctgatcgtttacgtgctgatggcttacctcggcgtgaccattccgctcaaaaagcgggatcagattctggacagtcttcaagtgatgcgggaaaatagcagtgtcaaacggctgaatcgcagaaaaggcggcaatcctctcgaggaacacacgaaggtgctggatacctcggtcatcattgacggccggatctacgacatcatccagtctggttttctggaaggcccgcttgtggtgccgtcctttgtgctgggcgagcttcagctgcttgcggacaacggcgacgatttgaagcgggtgcgcgggcgcagagggcttgacatcatcaacaaaatgcagtcggaatacggcagcctgattcagattgtcgacaaggattatcccaatttgagcggcgtcgacgacaagctgctcgagatgggaaaagaagaaaaaatgaaaatcatcaccaacgactacaatttaaataaggtcgcgaaggtgcggggcattccggttctgaatatcaacgagctggccaacgccgtcaagccggttgtgctgcctggggaaaccatgcaggtgcatccggtgaaaaacggcaaggaatccggtcaggccgtggcttatttagacgacggcacgatgatcgtcgtcgaaaacggccggcgcttcatcggtcagcagatcgtggtgcgggtaaccagcgtgctgcagaccgccgcggggcggatgattttcggaaaggcagagcatcattaagatggcggagatgaaacgaaccctccctgaggattttgtagacagaatggcggcgctgcttggaaaagaagagctttcggcgtttttggaaagctacaatcgtgtgccgaaaaagggcctgcgggcgaacaccctcaaggctggtcgggatgagatgaccgggcttatcccctttaaaacgcagccaatcccgtggtgcgacaccggtgcctacatcgacgcggaggaacgccccggcaaacagctggcctacaacgccgggctctattacgtgcaggagccgtcggccatgatcccggccgcggccctcgcgccgaagccgggcgagcgggtgttagatatgtgcgcggcgccgggcggcaagacgactcagctcgcctgtgcccttcaaaatcagggtcttttggtggccaacgaagtggtcaaaactcgggcgaaggtgctcgcgtctaatgtggaacgtatgggcatcgccaacgcggcgataaccaacgtgaggccggatcagctcgtcgacattttcggcccgcagagcttcgataaaattctcgtcgacgcgccgtgctcgggcgagggcatgttccggaaggatccggcggtcaggtcggcttggagcctcgacaatgtcgcccagtgcgccagacgccagaaaaaaatgctcgagacggtcgatctcctgctcaaacccggcggtgagctcgtctattcgacctgcacctttgcgccggaggaagacgagcagatcgtcgaatatttagtcgaaagcggcaaatacgaggtgctgccgatcgacctgccaggcctgccggatcacggccgcccggcgtggacggtgcacggctgtggggcggtcagtcaggcagtccgcgtgatgccccaccgtgtcgaaggcgagggccattttatcgcgaagcttagaaaaacggcggacgcggcgccagcggcttcaccccaagggaagcgttctaaaaaaaagaaacgcagtctctggcggcgggcatccaaaaaggatttgaaagatttcaccgctttttcggaaacggtcgggctgcatttagaccgatctgattttgtcattgcgagcgacacgttgaccgtgctgcctgaagggctgtatctcgatcaattgaaccaaggcagatgggtacgcccggggctggaaatcggcacctttaaaaaaggccgatttgagccgtctcataccctcgcgatggcgcttacgcgcgatcagatcgcgtcggtgtacaattttaaggacgacgatgaagcctacgcctatttaaagggcgagccgattgcgaataccggtgcgctcaaaggctggacattgatgtgctggcgcggctatccgctgggctggggaaaggcctcgggcggcgccatcaaaaatcattttcccaaggggcttcgcattttaaagaaataaacgaaaaggaaaactcattacaaagtaaggcgatttttatcattgtattaaatctctcagggatttatcgacatcaacaattttatacgcaaagggatcaatggattgatttggaaaacgtgccgggaaccaccgggtattgcgacgaccaggctgccgctatcatccgaaaacggattaaggattgcagcgccgaagcgctccatttcatcgacaacggcaattaccattacctgtcctatttttggcttgaaaaactgaaagagccggtggatttattggttttcgaccaccactccgacatgctgcggccggttttcggcgagctgatgagctgcggctcttggctgctgcggacggttcaggagctgccgaaggtgcagcgggtgatgattttcggaatcgaccccgattatgtgagtcacgtgcctaagtctctcagagaccgggtggccacggcggatacggacgaagggttccacgcgtttctgcgcgaacaccccggcggatccctttatatttcgctggataaggacgttttttcaactcgggatgtccgaaccaattgggatcagggaaccctgcgatacgcccattttgagcgtctgcttaagactgcggacaacacgcggaatattgtagggatggacgtctgcggcgagagcacggaatacggcgagcagtggcacgccgatggctttaacaaaaaattggtagcgctgatccgcagcacgcgtttttatcagaaaatctgcgcataacaaaacggtatcttttaaccgatggttaaaggataccgttttttgatggcgtttatttgtttttgattttgcccgcagcgccgtactcgtcacgccgtttgtgagtgtggcgcgccgtcagcttttcaaagacgtcgtcgaaggagacgccctgataattgagcagcaccgagaggtgatagatcaggtcagaggtttccgaaatcaattcgtcgggatcgccgtttttcgcggcaatgaccgtttcagtcgattcttcgccgacctttttgcagattttgtcgaggccttcgttgaacaaataattggtgtacgagccttcgaccgggtgggccttgcggtcttcgatctggtcgttcaaggtctttaaaatcgagctgttgcccttgtcgagctcggcattttcggcaatttccctgtaaaagcaggaagtgtggccagtgtggcaggccgggccgtccggaatcacttcgagcagcagcgtatcggcgtcgcagtcgtagtagaaggtcaccacgtgctggaaatggccggaggtttcgcccttcgtccaaagggcctgacgcgagcggctgtaaaaggtcgccttgccggtgtccagtgtgatttgaatcgattcggcgttcatccaggccatcatcagaacctgacgggtgtgataatcttggagaatagctgggacgagcacctgatcgttgaattgaatcgcggcgtcatcgagcgacgtcaccatttgcagagtttgagacataatttcctttcgttgatgcagagtcagacgaggcgcatcgggagcccttcgtcagacagatattttttcagatctggaatcaggatttccttgtagtggaaaacggaggcggcgagcgcggcgtctgcgccagccttcagcacttcggagaaatccgccattttgccggcgccgccagaagcgatgaccgggattgtcagggtttcagacagctttttgttgagctcgatatcgtagccctgtttaacgccgtcggtgtcgatggagttgatgcagatttcgccggcaccgagggattcgccttttttcgcccattcgatggcgtcaataccggtgttgttccggccgccgtcggtgaacacatcccaggagcctttgtcgttgcgcttggcgtcgatggagagcacgacgcattggttgccgaagcgcagcgctgcgtccatgatcagctgtgggttgttgaccgcggcggagttcacggaaaccttgtcggcgccggccatcagaacttgtctgaaatcgtcggtggtgcggatgccgccgccgatggtgaacggaatgcgcaccgcttcagcgaccttttcgacgacgttgatgaaaatgtcccgcttttcgtagctggccgtgatgtcgtagaagaccagctcatcagcgccctgttccgaatagtaccggcccagctccacaggatcggcgacatcttgaatgtttttaaattttttgcccttgacgacgcggccgtggtccacatcgagacagggaatgattctttttgtcagcatgagattgatcctttcaggaattccggtgttcagccagatattgtttcaaatcgatggccccttcgtaaatcgcctttccggtaattgcaccgtagagacccatatcgcgcagacggtccaaatgtgccgagctggcgacaccgccggaggcgatgatgtcgatattgaggttttgatttaaaacgtcgagcatattgaaattcgggccggacatcatgccgtccttcgaaatatcggtgtagaccagtgtcgacaagccgattttttcaagggaggtggccagctccaaggcttcgacgtcgctgtcttcggtccagccttcggtgcggacgatgccgtctctggcgtcgatggacacgcagattttgtcgtcgtaatcgtaaatcaggtgttcaatgaagttgaaatccttgatggcctgagtgccgatgatgatgcgggaaatgcccgcgtcgatgtaggtcttggcgatttcggcgttgcggataccgccgccgagttcgacgggaatatcgattgcggccagaatctttttgatgatgtcgaaatttttcggtttgccgtcgaaggcgccgtctaaatcgacgatatgcaggtattcggcgccccaggattcgaactgcttggcgactttcaccggatctttgaaatagacggtttcgtcgtccttttccccctggcggagacgcacgcattggccgcccttaatgtcgattgcaggtaaaatgatcatgaaatgagctccttccagttgatcagcagctgattgccgaccgccgcgctcttttcagggtgaaactgcatgccgatgacgttttccctgcggacaatggcgggaaccttcacgccgtatttggcgtacgcgacgacgtcgcggtcgaaatggtccggtacggcgtaataagagtggacaaagtagacgtagtccttgtcgctcaaggttttggcgatcggatcgtccggctgatggatgttcaggttgttccagcccatgtgcggcaccttcaggccggtcttcttcgtgtcttcaaagcggacgaccttgccggggacaaagcccaggcccttccactgtccgtcttctgaacttttgtcaaataagagctgcatgcctaaacagatgcccagcaggtatttgccgtctttgacgtttttgacgaggacgtcgtacaaatcgaatttgtccagattgttcatcgcgtcagcaaaggcgccgactcccggcagaacgatagcggaggcattgttgattgttctcgcatcccgcgtgatgacacagtccatgtcgagggacttcaaagccgtttcgacgtttttcaggttgccgacgtcgtaatcgataattgcaactgtcattcaatcactcctttcgtgcttggaatgccgtgaatatcgggatcgatggcgaccgccgctttaagcgcccgtccaaaccccttgaaaataccttccacgatgtggtggttgttcacgccgtaaaggcttgccacatggatggtcatccccgaatgggacgtgaaggcgataaaaaattcccggagcatttccgtttcaaaatcgccgatgtattcccgcgtcagctcgacgttccagaccaggtagggacggccgctgatatcgacgttgattcggcagagggattcgtccatcggcagaaaaaccgtcgcgtagcgggtgatgccggccttgtcgccaagagccttcgcaaaggcctggccgaggacaatgccgaggtcttcgagcacgtggtgggtgtcgacgccgtcgccctttgcggcgatcgtcaaatcgaaatggccgtgggccgcaaaaagggtcatcatgtgatcgaaaaaggcgacggaggtatcgatatttgagcgtccgctcccgtcgagatcgagggtgacgttgacgtccgtttcggcggttttccgcgcaagggttacttttcggctcacgataaactccttttcaagaccttgatgacggcgtcattttcctccggcgaaccgacggttaaacggatgtggtcgacgtcatcggatacatcgtgttttaaatattttaccaaaatgccttcgtcaagtaaagcgtcgtagaggggcgcgccgtccggcacttcaaagtaaatgaagttggacgcggttggataaacccgagtcacgccctttaagcctttgagaaattcgtacaggcgctgtctttcactgttgatgacgtcgacgtttttcaagagtgtatcccgatgttttaaagcgatgaccgcggcggcctgggtcagcttgttcaggttgtacggcgatttgaccttgtacatcatgtcgatcagaggcttgggaccgaccgcgtagccgcatcggatgccggcgaggccaaaggccttggacagggtgcgcagcacgatgacattgttgtattcgttgacgatgtcggtgaggtcgccttcctttttaaattcgatgtaggcttcgtcgaggatgaccagtgcgttggtttcttcgaggatgtcgatgacgtcgtggcgcggcagcagcgagcctgtcgggttgttgggcgagcacaggtaaatcagcttcgcgtttttgagcttagccgtattgatgatgttttcgacatcggggtagaggtcgtcgttgtcgggtacccagataaaatcggcgccgccgatgacgctccagatctgatacattgaaaagctcggcgcgtgggaaatgacgacgtcgccgggattgatgaaggtctggttgagcatggacatgatttcgtcggagccgcagccgcagataatttgatccgcatcgataccagtgtaatccgcgagctgttcgcggagcgccgtcgcggacggatccgggtagcggttcagcggcatgcgcataatttcgtcgttcaattcctttttaagggcgtcaggaaaatcgaacgggttttcgttggcgttgacgatgatgttgtaattgggcgggacgactttgtaagcctccagatcttttacacagaggcgggtgaaatcaggcgtcattggaaaatctcctttcaatggacttcgcgtgggcatcgaggccttccgaataagcgaaggcggtgatgtcgtcggcagctgccttcaaattgtcgcggtcgtactgaatgatgctggaacgtttgatgaaatcgtagaccccaagaggcgacgagaacttcgccgtgccagaggtcggcagcgtgtggttcggaccggcgaaataatcgccgaggggttctggcgagtacatgccgaggaaaatcgcgccggcgttgcggacacagtccagatatttttcggcgttgtcaatggcgagttcgaggtgttccggcgcgatctggttcgtcagctcgaaggcgtcgtctaaagtttcgcagacgaagacaaagccgtgatcggtgacggaagctttagcgatggccttgcggcgcagatctgtgtcgatctggcggtcgatttcggcgatgacctgatcggccagggcgtcatcggtcgtcacgagcaccggcatggccatttcgtcgtgttccgcctgggacagcaggtcagccgcgatgtagactgggttcgctgtggcatcagcgatgacgcagacttcgctcggtccggcgatcatgtcgatggcgaccttgccgaacacttctttcttcgcggtggcgacgaaaatattgcctgggccgacgattttattcaccggcgcgatggtttcagtcccgtaggccagggccgcgatggcctgagcgccgccgactttgtaaatttctgtgacgccggcgatttttgcagcgcagagaatgttttgattgatattgcccgaggcgtcaggcggggtgaccatcgcgatggtgccgacgcccgcgacgacggccgggatcgtatccatcagcacggtagacgggtaggctgccttgccgccggggacgtagacgccgacccggtcgatcggggtgatgtgctggcccaaggtgatgccggccttcggatggatcgtccaagtcgtttccttctggtgttcgtggaaggctcggatgttttcggccgagcgcttaatcgtttcgatcagcgctggatcggtttcggcaaaggcgcggtcgatttcttccggggtcaccttcagactgtcgagctggcagtggtcaaattttgcttcgtaatctttcagcgcgctgtcgccttcggatttgacgcggtcgataatgtcgaggaccgtcgcgcggacatcctggtggtcggattcgctgcgtttgaggataatgtcaagctgctgtttgacatcagcgctgtacgtgtattttttcatattgcctccaattgcgtgtaatctgttaaaaagccaattccttgaatttttcgacaatggggtcgatctgttcccgcttggtcttcaagctgacgtgattgacaatgagtctcgagctgatatcgaggatgctgcgcaggacgaccaggccgttttcccgcagcgtgttgccgctttcgacgatatcgacgatgcagtcgcagaggccgagaatcgggccgagctcgacagagccgttgatcgtgatcaaatccacaggctgatcgatctgcgtaaaataatttttagcgatgtggggatatttggtcccgacggtcagcttgcggttgtactgaatctgcgtatccttaaagccggccacgcacatgcggcactggccgatttttaggttgagcagctcgtagacgtcagccgggtgttccagaaggacgtcccggccgacaataccgatatcagcggcgcccttttcgacgtaggtgccgacatccggcgatttgacaaggaaaaattcgagggtatctgtggtgtcggtgaagatcagcttgcggctttccttcgaataatcgggaaaaacgtagccgatttccttcagacggccaatggttttattggcgacccgccctttggccagcgccattttaattttatttttctgtaaagacatgatgttctcctattccgattctgaagcgaccgcgacggattcgatcgcagtgacgggattcagcgaggacgcttcccatttaaagacgccgtctctttcaaagacgtagaaatcggcatcctgataaagtctttgaacctggagccgttcaatcatcgccgtcggcagagaattgataacgaagacctcggtcatgcagccttgagcacgcaggcggctcgcaatatcaaagacgccttttttttcgctttcccggtacagcagcacgatgtgtttgggcgattcaacgtggatcaaatcgtgttcttcgaggtaatccatcagactgaggagattaaccgcgaaaccgcaggccggccggtcgatgccgaactgctggctcagcttgttgtatcggccgccgtcgatgatcggcgcgccccagtttccggcgtagaccttgaagatcaggtcggtgtagtaattcattgagctggtgaagcctaaatcgaaggtgacgtattggtcgagcccgacagatctgaggtgttcaaacagcgcactcagatttttgacgacatcctgcatcttttggttgatgcagagcttggtcatgcgggcaaaaacgtcggtgggatcgccgtagagcatcggcagctcgaggataatatccgaaatcttcgggtcgtaatgccggctcgagaggaattcctgaatgtcaccgatgtttttattttcaatgagctcgaataattcggcgcggtccgtcttggagatcgtcagctcgtcgagcagacagttgataaagcccacgtgtccgaggtcgatctgaacgtcgtccacgccgttggccttcagcgactgaatggccagcgagatgacttcgccgtcgcattctggggaattgtcgccgaaaaactcgacgcccatctgcgtgatttctttgcggacgtcgccgggactcgaaaagtgtcggtagatgttggtctgataaaagagcttgataatttcgttcgggtcgtggtgattgatggcagccatccgcgcaaccgaaagggttgcgtccggcttcagggccagcacccgccctttccggctgataaatttgaacaattcgttggccgaaatggcgtcgttgccgatgaagctgtcgtaggtttcaaaggtcggtatagcgacctgatggtatccgtacccggtgtacaggttggttaaattgtgctcgatctgggataaagcttgaaatccctgatactgaatgttttcaaagccttcaatggtataggttgttagcattttgcctcctgaagctgtatatcactgtcgtactgtaacgtaaaaaagtatagacagatcatagcactttactcaaatgaagtcaaccgcaattcgctataatctgcgataaaatttattttatcataaattgagatttaatcattgaaaatttatattcaatgggggacaataagcatgatcttaaaaccaattagaaagagggggtacaggtgtcatatcgctgtgtttgttttgattttgacggcacgctggcggatacagaaggcatggtttttcggattttcaacgaactagcgaaaaaatatcattacgcgccaatcgataccagtcggcgcgacatgatcaaggaaatgtcggcccaggacatcctgcgccatatgaatctgcccttttatcaggtcttccgtctgatggctgaaggccgtaaacacatgcgcaaccagcaggaggatattgtcgcgattcaggaaaatttgccggaggcttttgcggcgatcgcgaagctgacggattattgcggcatcctgacgtctaattctgaggatacagtccgcaattttttgtggacgcatcagctgacgccatatgtcgatttcgtagagggtgcggcgcttttttcaaaaaagcgcaaacttctgaagctctgccgcaagctgcgcatttcgccctcgcagatgctttacgtcggcgatgaaacccgggatgtccgagcgtgcagagaagcgggtatcgatgtggcggcggtggactggggctacaataccaagcaggcgctcgctaaatgcggcccgacctacgaggtgtcggacatggcgaccctcgttcaaattgtggcctaccgcaaccgcaatcaggaggcggggccggaaaaggcccgccgctatatcagacggatgcggaaaaagcagcatcggacgagctgacagatgccgatgaatcacaactttttggaaaattggcccttcgacgtattatttgaggcctttacacaacagggcgaggaagtttaccttgtgggcggggcagtccgtgatctgctcctcggcaaacgtccaggtgactgggacttcacctcgagcgcggagccggacaagatcgcggctattttggccgaggctttccctgaacacaccttaattttaaagggtaagcgctttggcacgatcggtatcgacctgtctgatgcggcagaggacgtgagttttgaaatcacggcctttagaaaagaggaaagctatactgatgggcggcatcccgaggaggtcgcttttcaggcgtcgattttcgaagatgtgcgccgtcgggatttcacggtcaatgggctgtggatggaccgtcacggcgcgatttttgacgcggttggcggcttttcagatttaaaagagaaaaaaatacggtgtatcggccaggccgacgagcggtttgacgaggaccggctcagaaaatggcggtgcgtgcgctttgccgctcaaatcggcggacaaatcgatgcgcacacccgagatgccattatcgaagcgccgacgacagatggggtgagtgtggagcgcattcaaatcgaattttcaaaaatgctgacaggcccagatgccgcctttgctgtgcgcgagctgaaagccaccgggctttgggatgatctgctccggcggtcggcgtctgaagatctgcccgagcctgtgacggaaaaaatcaatgaggtgccgtctgatcttgcgatgcgcttagcctggctgcttcagaatgggtcggctgatcgggtgcgcgccttcttgaaagggctgcgcttcagcaaccagatcgtcagggaagtgacagtactgttgaatttttctacactcgactgcagagatattgtcaagttcaagacggccttgcgccagatgggagcgccgctttttgaaaaagcattggcgctgcagaaggtaaaaagcgataatgcgcagaaccgtgtggtatttataaaaattgtgaacgaccacgaaccgattgtgccgtccgatttggcgattggcggcagggacctcaagtccctcggctttcacggcaggcagatcggcgatgtgctggcgcgcctgctgcgatgggtttatcagtcgcctaagcagaatcagcgcgaggcgctgctcgagcgtgctaaagcttggcgcgatcaggaaaacaaaaacgaagggaaacaatcagaatgaatttaacctcaccgtcggtgatttctgagctgatggcggcccatcagcttcatttcaacaagcaattcggtcagaattttctcatcgatcaaaacattctcgaaaaaattgtcgatgccggacaaatcacagaagcggatacggtgcttgaaattggaccgggtattggctcgatgactcaggaaatggcggcgcgcgcgcatcaagtcgtgaccgtcgaaatcgacaaaaaattgattccggttctcgaagaaacccttagcgaatttgacaacattgcgcttgtcaatcaggattttctgaaaacggacgtgctcgatttgattcaggcgccgacaccgctgaaggtcgtcgcgaatctgccttactacatcacgacgccgattatcatgaaactattggaaacaccctggccggacggcattgacttgtcgcggatgacctttctggttcaaaaggaagtgggcgagcgcatctgtgccgagcctggcagcaaaagctatggcgccctcagtgtgatcgtgcagtattacgccgacccgaacgtgatgtttactgtgccggcgtcggtctttatgccaaagccaaaagtcgactccatcgtgatcagtcttcagaaaagaacgcagatggcctttgaaccctgtgataaaaatcagttttttaaggtggtgaaggccgcttttcagacgagacgcaagacgctgatcaacagcctttcaaacaacacggcttatccgaaagacgtgctgctcgacgcgctgaatgaggccaggattgacccgaaaaaacgggcggaacagatcgacggggaagatttttgcaggctttcgaatattctgtatcaaaagggcgccaataatgacattgaatctcgtcaaaaatgatgataaaatgaaacgtaacatcataatttagaataggagagaagctgatgatcggagatctattacgaggcaaattcgtatctaaccgtctgttgacggatgtagaagactgcatgctcgaacaatacgaactgccggaaggccatatcgatatcggtttgttcacaacggcgtgtgacggcgtggggtatgtcgcggcagacgacgcgacgaaaaaggcgaacgtggaagtgccgaagatttacaccacctacggcggctgcggcaaattcaacgacgggcaggttttcggagtcatttccgggccgaaggtgtcggacgtcgaacggggtctgcgctacgtgcgggcctttaccgaacagcagtcgacgctttacagcatttcggacgatgattcgacgctgatttacgcgcagtgcgttccgagaatcggccgttatttttcaaaggcctacaatctgccggaagggtcgtccatcgcgtatttaatcgcgccggcgatgcagggggcgatcggcatcgatgaagcgctgacgcaggcaaatgtcgacgtcgtgcgtttctggagcagtccgaccgaatcgaatatgagcggcgccattttaactggccgcgaagcgcagtgcgacatcgcggtcaaggcgttccgggatgtcattatcgaagcggtgcaggatccgattgaatattaattaattaatcatccaaatatattttaataatttaaaagggacagtccatatcaattggactgtcccttttgcgtgtgaatgattttatttagttagtagtagtttcagttgtagtcgagctttcagatgattttggggtagttgtcgtaggagtatctacgttagattctgtagaaggggttgttgttttcggtgcacttgtcgatggcgatgtcgtcgtgctttttgtactgtaattgctcgaatacgaacgagtcgatcgacggcttgtcgatgatgatgacgagccagacgaataagttgaggtcgatgaagagcccgtagaggaatcagcacttgtggtgccggtcagcgtaccgacgccagttcttcggacaatgccgtcgctgatttcattgacggtgtcggatggcgtgtaggatttttcagttccgtaaatggcctgatgcagctggatgacgttgtcaaccagggtttttggcgcaatagacgagccttcgtaggtgacaaaagcgtaataattgtcgaatgggacgtgctgattggtcagctttttgctatctaactgcatgtaccccctgagcatggtcgaaagctcggttgtggacatggatgttctgatattggggtaaatttttgtgaccagattggccagcttcaagctgctgagctttgtcagcttattgaagaccttattaaaaacctcccgctgtcgttccgtccgtccaaagtcgttgtcgctgtaacggttgcggctgtaagccagagcctgaattccgtttaagtgattctttccagtgtgagtcaatgtcttggcttgggtgttattcagccggttataatcgttgatgtatttattggtgtattttaatatactgtcatctttgatgttgatagtgacgccgccaacggtgtttacggcatcgatcatgcattgaaagctgatggtgacgtaatcggtgatgttcaagtcgtagttttcatttatggtcttgaccgccagctctggcccgccgtagctgtacgccgcgttgattttcgtgtaagaatcctttttgatggtgctgtttgctggaatgcgggcgatggtatcgcgttgaatcgaagttaagaccgttttccctgttttgaaattaatggagatgatcataatggtgtcggaacggtttccctcgacatcgggccggccgtccacgccgaaaagcgcgagattgatgacatcgtgatttaaatacttattaacgctgacggcgctgtcgtcgatggacgcccctgaaatactgcttcggatattgaataagtaaacggcgccgcttccgacgacgagtaaaattgctgaaaggacaacagctagaattttcttgccaacagacataaaactccttcccagattaataaagtttaaaaatcgttcattgttctcgaaataaaatattgtcttattatatcataatttttctgaattttgaaaagttctgtgaattcgccgcatttttaacaaaaatttagtttttcattaataaaaatttaaagctttaaaaagagcaggataatgcgtgcaatgctatcgtaaatatgctataatgaaagcgtaatcaatcaatgactgaagtgacaagtcgatacagccaattgattgagattttcaaagacggcatcgtttttgaaaaacaacacgaaggactggaggacataaaaatgaaatttacgatctatggaaagaacatgcacatttcggatggattgaaagaaacacttgaaaagaaattccagaaatttgatcgttattttgacaaggaaacagaagtttacgtgaccttcaaaaaagaaaagagctaccaagtgattgaagtgaccattccgctcggcaagacgatccttcgagctgaagaaaagaccgacagcacgatggggtcaatcgaagccgtcatcgacaaattggaaggacaactgagaaaatacaagacaaaactgagaaaacgctacgaagcccaagacagcaaattaaattttgaagccttcgacgatggcgacgaacaggcaccagatgttgacgaacccaaaatcgtcagaacgaaaaaatttgcgattaagccgatgtcgccggaagaagccgcaatgcagatggacctgctggaacacgatttcttcgttttcctgaacgcggaaaccgatgatgtgaacgttgtgtaccgccgtaaaaacggcgactacgggttgattgaaccgacctttgcataatgcatcgaaaaacaaataaaccataattttagaaccgccacccgctaagtacttttagcgggtgttttattgacaggggtagggttttgttttaaaattattttagtttacctttgcattaatatagaagaaaaggcaaaaatataaaattaaaatgggcgtcatccatcacacgaaatcacgaaatgtggacaatacgatggagaacaatatcaaaatttagggtggaatcaatgtttgttatattagcgattgttatcggattgatcgtgggggctgcgagaggtggctctatcggactgatgagaaaacgaaaaatcaatctatggccgatcggtctgatcggcattatcctgcagattgtactccacctttatttttattttgggcaggcgagcggcattacgacctttttgaatttcgccagctacgtctgcattttgctgatgctcattttcaattttgacgatttgtgggccattctgctcaccgttgggacgacggccaattttatcgtcgcttttatcaacggcggcaagatgcccgttacgccaacgatcgtgagtgctcttaccaatgccaatttatctgccggcattacccgtggcattaacgcggtgtatacgccgctctccagagcgacgacggcgctttggatgcttgggatcaatacgcagatcccatacgtttcgcgaatcacctcctattacggcggtgtgggcggattttctattggaagcgtgcttgtctttgtcggccttttgggctgggtacagcacgcgatgcaggggaacaaacagcaggatcccttctctgaagaactcaatgaaggggatgcggattacattatttcgcctgatgaaaacagcatgattgaagaaatggctcagaaaaaagaaacgggttacgaaaccggtccccttgactggctgaatcaggattctgaaactttgtttggtcaggaaattaagcagcagacaggcgaaattccaccggtaaagccagaaaaaaaagcggcgagaaagccaagaaaacgtcgagctccgcaggaaccagcgcggcctgaggcagacgccacgaaaggccataaacctgaggaggctcaaaacaagcagccagaaaagacgacagtgctgcctgatttgtcgccggaattgttggatcggatcaagtcccacaattcaggcgcggcgaaaaaacgtccggcgtcgactgtttcagacgacacgcgggtgtttaccacattgaaggatttgggaaaatacgatacgaagcccattgatacaggattttcagcgtcagctcagagagaaagaaaagaagcagaggattttgcggaatctggatttttcacacagtcgttctacacagagcgggaaaaaggaaaattagcttttggttctcaaccgagcggcgatcgcagagaaaaagcagcaaaaccaacagggacgtatcgtcgggcaataaataatcaggaggataagaatcaaatggcggattacaaaccaacagaaggcgacacagtcaaatcaacagcagcggcagaacagccgaaaccggcagcaccgaaaagaaatacgcagcagacaacgacgcagtcttcaagcgcgtcacgatgggaaatgcctgaaaaggcaaagaaaacaaaagctgaaccgaccgctaaaaaaatcaatccgtatcggaaatacagcgacgaagaagcggctagacgagccgatgcgtcccgtgataacgaaaagcagatgctgaacatttggcatcaggtctcggaagatacgcgcgcgctgcgccagcgcggccgccggagcgccagcgaagaggtgcagtccgacagcccgttcagcagatcggaagcggaacgcaaacggctgaagcagcagcacaaccgcgccgcagcacagaaaagcgaaaacgaaatcgcttccgcgcaaaagccgaaggcgggcggtacgaaaaagcaggccgccgcggctaatgtcaccaacgacgaagatcgggaacggatcggctttgaaaaagttgaaatcaatgtggacaaccgaaaggtttccttctggagaaaaaagaaatcctgagcatcaggaaaaatacatgtttgaaatggaaagggctgtgtattcagccttttttgtttgaaagctttatttgcctttcagacgaacatgatataaaataagccaacacattcacatgatttgaaataaggagattgaaatatatgggatttttgcaaaatctttttgatccgagcaaaaaagaagtaaaaaaattaagcaaggtcgcagatcagatcgtcgcgttggaggatgaatacaaggcgctgtctgacgacgacttaaaacacaaaactgtcgaatttaaagaacgctacgccaacggtgaaactttggacgatttgctggttgaagcctttgcaacagttcgggaggcggcagcccgcacggtcaatatgcgacatttcccggtacagctcatcgggggcatggtgctccacaacggcgacatcgcagaaatgcgcaccggtgaagggaaaaccctggtggcgacactgccggcttatttgaacgctttgagcggtgaaggggtttatattgtaacggtcaacgattacctggcacgtcgagacagcgaatggatgggcaagatctataaattccttggcatgagcgtcggtttggtgatcccggatttatcctacgaagaaaaacaggccgcctatcgttcggatatcatttacgggacaaacaacgaattcgggtttgactacctgcgcgacaacatggtcacgtccaaggaagaacaggtgcagcgcggtctgcactacgcgatcatcgacgaagtcgactccgtcctcatcgatgaagcccggacgccgttgatcatttctggaagcggtgacgaaagtaccgatctttaccgtacggctgatatttttgccaagagcttaaaggacgacgactacgaaaaggacgaaaaggaaaaggccgtcacactgactgaaaaagggacggctaaggctgaaaaattcttcggcatcaaaaacctggccgacgttgaaaacatggaaatcatgcacaacatcaaccaggcgctgtacgccaacacgctgatgaccaaggatgtcgactatattgtcaagaacgacgaaatcatcatcatcgacgaatttactggccgccagatgccgggccgccgttattccaacggcctgcatcaggcgattgaagccaaggaacacgttacggtgaaccgcgaatccagaacgatggcgacgatcaccttccagaactatttcagaatgtttgacaagctggctgggatgaccgggacggcgaagacggaagaagaagaattcaacacgatttacaacttgaacgtcgtgaccattccgaccaataaaccgatgattcgtcaggatttaaacgatttggtctatcggacggaaaaggcgaagttcaaggcggtcacagaagacgtcaagcggcgccacgccaaaggacagccggtgttgatcgggacgatttccattgaaaaatcagaattactgagtaaatacctgcgccgcgaaggcattaagcacaacgtcttgaacgccaagcacctcgaaaaagaagcagaaatcatttctcaagccggacaaaagggcgcggtcacgatctcgaccaacatggccggccgtgggacggatattgtgctcggcgagggcgtcgcagaactcggcgggctgcacatcattggaacagaacgccacgaatccagacgtattgacaatcagctgcgcggccgtgccggtcgtcagggcgacccaggttccacgcagtttttcctgtcgctcgaagatgacctgatgcgtattttcggctccgaccgcatcaaatcggtggtagaaaaccttgggatggacgacgaaacgccgctggatgccaagatgttaaaccgtagcatcgaaagtgcccagaaaaaagttgaagcacgcaacttcgatatccgtaaaaacgttctgcagtacgacaacgtcatgaaccgtcagcgtgaaatcatctacgcccagcgtcaggaagtgctggacggcaagaatatgcacgaacagattgacaagatgacgaaggatttgattaacgattacgtcgacatgtacaccaacgccggcgattcgctggaagactgggacgtcaaaaagctcaagcgttattttggcgaattcctgccggtcgaccgcctgcaattcgaagaaggtgttacggttcaggacatcaaggatcagctgtacgccctctgccgtgaaaattaccagtcaaaggtcgcattgatcggcgaagacgaaatggaaaatatggaacgggtggtcctgctccgcgcggtcgacgcggcatggatggtgcacatcgacgacatggaacagctcaaggaaggtatcggcctgcgggcgtacggtcaaaacgacccagttgtcgcgtatacggacgaagggttcaaaatgttcgaggacatgaacgctgaaatccaggaagaaaccgtcaaatacatttacaatatgaaaatcaagcttgtgccgccgaaacagcggcagagacgggcgcagatgcacaccaacgaggcccagatcacaggacagggcagtgaagaaccggttcaaaagacgatccacaaaaagaaaatcggccggaatgatccgtgcccgtgcggcagcggcaagaaatacaagaattgccacggccgttacgcgaactgatgccgaccaaaatgaattgagaaaggaacaggatattgatagatttatacgaagcgcggcaggctgtgaacggcatgtccggcgaaatggcagatttgggcaagtctttgaatttgccggagctggacgctagactcaaggaattggaacagcagactacagcgcccgatttttggaacgatcaaaaaacggcgcagaaggttctgaaggaagaaaccctgctgcgcagcaaacagaagcgctacaatgaagtgaagagcgatctcgaagatgtagaggtcatgctggaactggcagaagaaggggaaagcgacggcgagctcgaagggatgctgagcgccttccaaaaagaatttgacgactacaaggtcgaaatgctgctttccggcgaatacgacagcaacaacgcgatcatttcgctgcacccgggggctggcggaaccgaatcccacgattgggcgtcgatgctgctgcggatgtacgtgcgctgggcggaaaacaagggcttcaaggtcaaacagctggattatcagcccggagacatcgccggcattaaaagcgcgaccctgctcatcgaagggatcaacgcctacggttatttgaaaaccgaacgcggcgtgcaccggctggtgcgcatttccccctttgattcatccgggcgccgccacacttctttcgcgtcgttggacgtgacgccgcaggtcgatgactccatcgacattgaaatcaatccggacgatatccgggtggatacctaccgctccagtggcgctggcggccagcacgttaacaagacgtcgtcggctattcgcatcacccacattccgacaggtgtcgtcgtgcagtgtcagaacgaacgcagccagcaccaaaacaaggaagtggcgatgaacatgctgaaatccaagcttctggaaatcatggaacaggaaaagaaggaaaagctggaggacgtcgttggcgactattcgcaaatcgcctggggctctcagatccgctcctacgtgttccatccgtacacgatggtcaaggaccaccgcaccggtgtcgaagtcgggaatatccagagcgttatggacggcgatctcgaccagttcatgaacgctgagctcagacgcgaagcggaagaaaacgcgtaagaaaaaacgcaggcaaaaataaaaatgcgaaaggctgaaaagtctttcgcatttttttaatcacaaaatttacgcaccgtaatcttttaagtgctgttcgatcttagctttcatcgcgtcgtcgataacgattttgccgtcgacagggtgattgtagagatggcttaagatatcttcaatcgtgaccatcgggtgggtttcaatgccgagggtttcgctgatttcctgaactgcggttttgtcgccgtcgcccttttccatgcggtcgacggaaatgatcaggctcttaaccttgacattgtcagccagagattgaagcagcggcaccgattccttgactgaggtgcccgcggtgatgacgtcttcgacaatcattgcggtgtcgccggactgaggacgatagccgatgatcgaaccgccttcgccgtgatcctttgcttccttgcggttgaagcagtacgggatgtccacgttgtgatcccgatagagggatgcggacgcgctgatgaccagcggaatacccttgtaggccgggccgtacaggaaatcgatgccgtctaaatgttctgaaatttcatccgcgtagtactggccgagtttggcaatttgttcagaagtacggtaattgccagtgttgatgaaatacggggtcgggcggccgcttttggtgatgaaatcaccgaaggtcaggacgccagaacgcaccataaaatcgataaagtcgtcttgataacgcatgatagcctccgtttttttcttaaattatagcttaaagagggcacggcacgcaagggcggcgcttgacgaactgagaagatgtgcatataatattcaggattaaaggaagtagtatcctagtcggaacttctggtctcgagggcgggcctaaaaatccgtcgaagggcatatcgatgaagtctcttggcagggcctttgacgcccagttgggggttttgccaggaggttaagaaggagggggcatcctgcaacggcatgcagaccatgaccctgccttcgtggagacttctgcgctactggaagggtgtaacaatacggcggtgttcatcgcagcaagcgcttctgagtaagcagagggaaaacctggggacaagtcagggcctgttgtggcctgagaagattttgaaccagcgtagcctgccttgagtggtttgggtagatggtctgacagttgccatgttgtcagggcccgacaagtggcaatattgcgaccgaaacccttattgcaaaagaggctaaaggtcagaagggccgccgcggaaaacgcctaggctatttgaaagaggtctggcagggattaaagtgcacgcttagtggcaatccagtcccaactttttaagctggagaatcggataatgagaaatcgctcatccggcgacggatagtctcgattctgggaaatcctactggacttatgttgcaaagtttacttgtcagattttcctttaatcgtttttttaggattatgcatcgtcatagtccttttttattggatgagtttacgttataataaaaatatcattaaaatgaaattttatgcaatttgagataaaatcagaaaggaagtttaacggattggcaaagaccaaaaaagcgaagaacgaccgaaagaagtggatcgccctcgtggcggtgggcacctttctgtcgacctttgtgatcgattatatttccgatacagtgctgtccaacgcaaacctgatcgtcgcgattgtgattctgtttttgatcgtcgctgtcggtatttttatggatatgatcggcattgcggtgacagcggtgaaaattgagcctttcaacgcgatggcctctcgaaaaatcaaaggggcgaaaacggcagtgaagatcgtcaaaaacgcgtcgaaggtgtcgtcggtgtgctgcgatgtcatcggcgatatctgcggtatcatctcagggagcgtcgccgtatccatcacggggcagctggcgcagttttacaagctttcgagttcgatgctgctgggccttttgatttccgcgtcggtcgcgtgcattacggtcggcgggaaggcaatttttaaagatgtcggtatgaaacagggcgtgcgcattgtgtcgggattatcccgcagcattgcaaacgtccggggattttttaataaacacgaataaaaatggcaaaacaaaaagaacgattagataaaaaattagtggaactgggatttttcgacagccgggaaaaggcgaagaaatccatcatggcgggccttgttgaaattgatgggatcgtgcacacgaaggccggggaccaggtgccggcggtgctctcgaaggaacaggtaaccctcaagggtgagggactgccctacgtgagccgaggcggcttcaagcttgaaaaggggctaaaagtcttcgatttcccggtgcaggaccgctggtttctcgacatcggcgcgtcgaccggcggtttcaccgatgtgctgcttcagaacggtgccggccacgtgacgtccattgacgtcggctacggtcagtttgactggaagctgagaaacgacgaacgggtcacgtgcatggagcggacgaattttagaaagactacgccggaagacatcggcggtctcgcggacggatcggttatggacgtaagcttcatttcgattttgaagctgatgccggcgatcagccgctgtgtcaagaatggcgccttgggcatatggctcatcaagcctcagtttgaagcgggcaaggaaaatgtcgggaaaaacggcgtcgttcgggatcctgaaatccacaaaaaggttttgatcgagaccacctccggcatcgaagcgaacggcttttcggttctggggttgtccttctcgccgattcggggaccgaagggcaatatcgaatttttatgcttttcgagaaaggaaggcgaaggggtgccggtcgatcatcaagaaaccatttcaggcatagacagcattgcggcgctggttgaaagcgcccatgaacactttagacatcatggacagggaagcgaaacatcatgacacaaaatcaaaacacaccaaaacccatgcggacaatcggcatctacattaatacggacaagcagaacgcctacgaaacggcctttcgctgtgtgaaataccttctcaagcagggaattacaccgatgatgctccacaatcagtacgcagaaatcggtggtattgccggcgtcaaggcctgctttaaggatcagtttttcagcgcgccggactgtattgtcgtgctgggcggcgacggcacgctcctcggcattgccaggcaggccagcgcctacgaaacgccgatctgcggcatcaatttgggaaagctcggttttctgaccaacggcgacgcaggttcttacgaggaaattctgcagctgctcatcgatggcgattacaccctcgataagcgctcgatgatcgtcagcacggtgaagaagctgaacggcgagtacgaatctcaggtggccctcaacgatttggtcgtcaaggccattggcatccgcatgatcaagctgaccgtcaaggttgacggtgcgcttttggatgaatacagcggcgacggcgtcattctcgcgacgccgacggggtcgacggcatactcactagcggccggaggaccggtggtagacccgcgggccgacgtgctgctgctcaatccgatctgtccgcaccggctgcacgacaagtcgtatattttgccgggatcagccgcggtcgacatcagtctgccgggcagcgtcggcgaggtgatcgtttcggcggatggccaggtgcagatgtcgttaagcttcggcgaacacctgcacatcgaaaaggcaccgtacatgaccaatctcgttttattccaaaaccgtaatttttacgaacagctgcggaaaaaattcgcagatcattaatagattaaataaaaaaggtaaaagaaaggaaggcattcatgaaagggacgcggcaatccgaaattctgcacatcatcgaaacacataaaatagaaacgcaggaagagctggcccgttatttggagcaggagggttatcgtgtgacccaggcgacggtctccagggatatcaaggagctggggctgattaaggtcgcggacaaaaatggcggacagcgctattctgtgatgcaggatatgaagggcatctacgacgagcgggtcaagaacgtatttagacagtccgtgatgcgcgtggataccgcggggtttatcattgtgctgcacacgctgccgggcatggcccaagcggcggccatggccgtcgataacctgaactggccggaaattgttggcaccattgcaggtgacgacacgatttttgtcgcccttcgaaatgagaaggacaaggaaagcatcgccgaacaattccgcaagctgatgaagggcttgctgtaatgtgacagggaaaagggagaaaacaatatgctgaagcggatttcaattgccaattacgcgctgattgacaagctcgaggtggattttgacgaccgccttaacgtcatcaccggtgaaaccggcgccggtaaatccatcgtgattgacgcgctgacgctgatcctcgggcagcgcggcaatcgtaaaaacattcgcgccggtgcgggcaagctttcagttcagggggtcttcgagattgacccggaggggccggtggcgaaaaagctttcagacatggcgattccggtcgaggacaggacactgatcctcaatcgatcgttaacgcagaacggccgcaatacctgccgcatcaacggttttgcggtgacggtcgcacaattgaaggcgatcgggcaggaccttgtcgatattcattctcagcacgaaaacaactcgctgtttcaggccgccgcgcagagacggctgcttgacgcctggggcggcggcgaggtggcggagctgctgagtcagacccgtcagcaggccgagcggctcaaggagctgagccgacagattaaggcccaggcgcaggatgacagagagctggccagacagaaacaggtgctggcctttgaaattaaggatatcgaagaggcccacctccgcgccggcgaagacgagaagttggaaaaggaacagcggattctcgaaaacagcgagatgctcttttctcaggttgaaaccggcaggcagctgctcaacggcagagacgacgatacggacggtatgctttcgcagctcagcgaggtgcagcggattgtcgggcgtttgagccagtttgacgacgcgtttaagccctaccaggccgcgctggagacagcatccgcggagctttcggagcttgcgatcgagctggccagctatcaggaggatttgaatttcgagccgggccgcctcgacgaggtggaaaagcggctgtcgctgatcgacagcttaaagcgcaagtacggcgacacggttgaagagatcattgcttacggggcgcatttaaacgaacagtacgacaatctcgctcatcatgacgacagactcaacgcgatgaaaaaggaatacgccgagctttggaaggcgtaccgtcaaaccgccagagccctccacgaaaaacggatccaggcggcgaagtctttagaggccgcaattgaagggcagttggccgatctggccatgctccgagcgcgttttgtcatctcggtggaggaggatgaacagatcatcgccccttggggcaacgatcaggtgaactttaaaatttcggtcaacccaggcacgccgatccgtctgttaaaggaagtagccagcggcggtgaaatctcgcggatcatgctggccattaaatgcattttcggccgttacgaccgcgtcgagacgatgatctttgatgaaatcgatacggggatcagcgggcggacggcgcaggtcgtcgctgaaaaaattctgcagctctcccgtgagcgtcaggtcatcacgattacccatctgccgcagatcacggcgatggcagatgcccatttccgcgtcgtcaaacagggcgacgacagcactacccaggtcagctttgatcgacttgatgatacggaaagccgaaacgagcttgcgcggatgctttccggcgcgaaggtgacggacttgtcggaaacccacgcgaaggaaatgctcgcgatggcggcacagcagaaagccgcgtatttcaaagacgccaatcaagataaaaagaaagaagtgaatccatgagcgcaccgaatcccatagcatttcaaatcggctccctgaccgtcaggtggtacggcattttgatcgcctcagcattggtgatcggattgctgatcgccgcaaaacgctcagataaagcgggtatcaaacgggacgacatctacgacttttttattatcatggtgccgtcgatcatcgtcggagctaggctctggtacgtgatttttcagtggtcctactatagccgataccctggagatatcgtcaaaatttggaacggcggcctcgcgattcacggcggcatcatcgcagggttgatcgccggcgcgcttttctgcagggcgcggaagctctcgtttttgaagctggccgatgtgttcattccggctctgcctcttggacaggcgattggccgatggggcaatttctttaatcaggaagcctatggcagacagaccaatctgccctgggccatcaccgttcacgaccccagcctcgggtggattcgcgtgcaccccacctttctttacgaatcaatttgggatttgtgcgtgtttttgattctcatttttgtgattgagcggaaattcaaaaagtcggacggtgagctgctgtttagttatttcattctgtattcgatcggccggttttttatcgaaggtcttcgcacagacagcttgatgttttttggacttcgcactgctcagctcgtcagtctgacgctgattgcggtcggggtcattgggctcgtgtggctgaagaggagaaaaagaaatcaatcgtagttttttaaaaaaataaacacaaatataaagatcgggattgcagcgcttttgtagttctgatcttttttaatgcaaaaaaattagcagattgagtttttataaaaggtgctcatcaataaatgactttatgtgccttacgtgttaaaattaagcatatatacagaaaaatgacggattaatttaaaaaggaaaacgatggaattcgagaatccgacggcgagtttgttgattttgcaagacaatgcgcaaaaaattgaaatcctcacattaaaacaggaaaaaaatgtgatcgggagagtttcatttgacgcggaaaaaacaaatcaggtcgatattgcgctgacttctaaatttgtttcgcatcggcacggccagatgatttaccaaaacaatcgttggttttatcaagacctgaacagcaggaacggcattttcatcgatggccggcgcatcgctcacgatcagaagctttaccaattgaaggacggtacgattctttatattggcggggacgagcagtttatgaaaatgtaccgcggagaaggcgtgctgatgattttcctgctgggggattacagtaaacaacaatgggaaaaagttgcgctcaacgacatgcttgaccacggcgatgtgacaatgggcagagccccttcctgtgatatcagattggacagcttttctgtcgcccagattcaaggcacctttacccgccgaaacggtcagatcatttatcgcaatactgctcaaaaaaatctggcgttcatcgacaatcatccgatccgcagtgatatttatctcaaagacaataacgtcctcatctttggcaatatcaaaatgatctatatttcgggactgctgatctatttagcgccaaattcgggagaacggctgaccattcacgagctgtgcagaaccgtccaagtgcgggatcacgggctccaaaaaaagaacaaagtcattctagatcacatcaatgtcgaatttacatcctcggagctggtcgcgattttgggcacatcaggcgccggtaaatcaacatttgtgaattgcgtgatcggttacgagaaattgacgagcggttcggttgaaatcaatgggcaggactttaacagctccgctgaaaaaaatttaatcggctacgtgccgcaaatggatttaatccggcccaatttaaccgtgatgaaaacacttgaatacgtagcgaagcttcgattgaattccgatgtgacgcagcaggaacggagaagaaaaatagaagagtgccttaaaatgctggatattggtccggccaaatggcaaagtcgtattcgggaactctccgggggcgagcgcaaacgggtcagcatcgccagcgaattaattccagatccaaagctcctttttttggacgagccaacgtcggggttagaccccagaacggaaaagctgcttgtgttagcgctgcaaaaattagcacatcagcacaataaaacattgatcgtcatcacccatacgttaaaaaatattgagcagtttgacaagctgctgttcatcggacctggcggcagggcgtgtttctacgggacccctgaaaatgcgttgaaattttttgatgtcgaggatttggttgacgcctacggcaaggttgaaaggaacgttaaaacttacgccgatcggtatcgccgccaatatttcagggagaagtgatcatgtacaaaaatagaagaaagccagggtttattgagcagctgggcacgctgttttgtcgagacgttgaattgtttgtggtcgaaaaatccaaaatattcatcacgttgttctttccaatcgtgatcgcagtattgattgtttacgtcacgcacagtatctttttcgatacgtacgaagggaccaaatcttcgctgttcaccattgtcagcgccagtatttacatcggcatgttcaatgcgctgacggcgatttgccaggaacggcgcattgtgaagcacgagtatctaactgggatgaatctttggtcgtacgtctttgcgcaggtgctgtggcagggcgttgtgtgtattgtgcagactgttgtttttatgacctattattggcatcatatcgatttcccaaccaaggggatttatttcatcagcacactgcctgaatattttatcagtctttttctcgtgatgtacgcggcggatgtgaccgggatttttatttcgtgtctagtcaagaaaaatgaaacggcgaatctgctggcaccgctggtcgtgatttgtcaactgatttttagcggcgtcctctttgagctaaagggattttccaagaaaatggccaatgtcatgatcagcaaatggggcatggaagcgatggggagtattgcccgattaaatggcttgaccctgaaaattcaaaagaagtataaaaatacagggatgagttttccacacaaggcagaaaatgcttatacggcaaaggcggcacatctgttttttgattggagaatacttttaatttatattttgattctggcagtggccagtgtcttagtattgtttcgagtgaaaaaagatcaacggtagataaagagagttttaaaggataaaggagtttgtgatgagtaaaaaaatgatggtaccggctgtcttaaaatcagaagatcaggaaatcaatattgatgagtcgccgtttaatatcggcagctttaaagatttctgtcaaatgacaatagacggagacgatattgcgcctattcactgctgcattgtcttcaatcagggagaatggcagattatcgatcagaaaggccttggcggtgtgaccgtcaatggagaacgcatggaacccggcagtacacagacccttcaaaacggggatcagattgaaattggatctaagggattcgtattttctgcgatgtctactttattttcacaggatgaaataaaagaactggaagatgactatcacacgatgatcgtgtcggcagatcctgaaaaagctaaggatatcgttgcgcggctttggcagaaaattgaaatggtcaaccgcatctcggacggcgccagtcaagaagaacccaatagcggatcggacgatattgcgccagctcaaacaaacgaagcggcgcagagccgacgtaccggagaatttgaaggttttgaggctgaagaatcagattttaacgcatctgaagacgaagcggtggcagcggatggtgaatttgaaaatcgcggaaatccaattgaaaatgctgaaaatgaagtcaagcagggaagtattttagccagtagaagagtcagagcagtcgatccagatgagtacaacattgaaaatgaagaacaaaacggattcgacactttaccgatttgtatctttaattcgaatgatccggctgttccgtctttcgaaattcagaaaacacctttttctattggacgcagcagctcgtgtgaccaaactttaaaatatagaggcatgagccgcaaacatgccaccgtgttaagagatgacagcaatcaatatttattgatcagagatgaagggtccacaaacgggacatttgtcaatgaccgaaaattggaggctcatacagaaatgcgcatccaaacgggagaccgcgtcagattttacaagacggctttcaccgtacagcttacccaggattgatgcgatggacacaaaaattaataaaagcgttattttctattcggttctcattggcgttgccctaattgcgacggtgatgccgtggatgagcgttggcgtttcagaaagtgcaatccaatcattagggtctggttttacgctgccgcgaacgataagaagcatcatcaacggtacggccgcgctgtcgcaaatcctcaacgtcagtctttcggatttggtcgatgccgttggcgcctccaatttgtctgctatgtttgcggtatcactgttgatttatattgaaccggtcgtgtttggccttgcatattattttttacttgcgaaaaaagaaacggatcgctttgtcaggatgaccctctttggcttggcagtgattgtggtgatgccgataatttatattttattttgttctcatttgaacagtaaaattaatcaggctattagtacaggactcagtatttttggattatccggttcttcaagtgtcagcctttttcatgttggcgcgggattaattcttgcacttctcgtcggattatttggtctgctgtacacattgattgttcgtcagatggtcaaaagtggccaaaaggtttctccgttgagtatggaaatatcaggacttaatggcgccaattcaaatcagaaagaggtttatccaaagcagatgccgacgcaaacagaagataaaccactacgccccagcgctgcgtccccaaagaccattgtggtcgagttgtgtgaaattggcgatgaaccgcgccgcttggcattaacccattttccggctgtgattggcagtgacgataagctttcctcggcagtgattgaagcgccgtctgtcggcgcgaagcactgcatgatcaatgttgagggtgatcaggcgatgatttgcgacctgggttcggcgaatggtacgtatatcgaaaacgaaaaattaagtccgagggaatattacgcgatgatggatggcgatcatctcaaaattggtgaagtgtcgttactggttaagattagtcagagagtcgtggccaagaaagtgcaaaagatagcgcctttgccttcagaatcacaggtgaatgaaacagaggaaacaaccgtgttgtcaaatatgcctgaaatgtcggaagaaagggtcggcagtgagacgattccgatcaattataatggcggagaatcgccgtttccgagaaaaatcatgacttggcttgacggaagagatacctttatgattacaaagacaccctttattctcggccgagaagcagaaaaagtcgatttcgtgattgacgatcgcggtatcagccatcagcatctagctattgtccgcgaaaatgaagaattttttgcagaagatttaaattcaaaaaacggcattaagatcaatggggttcaggcggcgccaggcgcaaaggtcaaaattcacagtggcgatgtcatcacgataggcgtcagaaattacaggtttgaagatgaatgacgagcagaatcgattgattgaagtcaaaaaagacattcagacgctttttcaaaatcgataccgggttgtcgcgctcctcggccgaggcggcatgggtgaggtgtacctcgctgtaacgaacgatcaggccgcaattcagcgagctattaaaatcattcataaaggaaatcattcgaagttaaatgcctacgacgaagtggaagcactgacgcagatcaaaaatcccggcgttccgaaaattattgaaattgaacagaatgataaagcgttttttatcattcaggaatacgtcaagggcaaatctttccagaaaattgtgaaagaaagcggcagggtttctgaagatacggtgcttttgtggatgcaggatgtagcgaaaatcatcgaggctgtacacaatgaaggattcctccatctcgatatcaagccggacaatatcatcattcagggagacggaaaggcgaagctcattgattttggggtcgcccaaaaattagaaaaacgctcagatggtgcgggcagcattttcggatcccggtactatactgcgccagaacgcctgcgcggcgagcctaatgactaccggacggatgtgttcgggtacggtgcgactttttattttctggtgatgggcgagcggccgccggcaatcaagcctaatgacgaagcgccgatcacgataatgaagcggaaattggagtcagtccagtcgccggtgattcgttttatcctgcaaaattgtatcagctttaatcccgaccgcagatatcaaaactttagggatatccattccgatcttcttcagaaggatttatacaatcaagctgttctcaatgaggaaaaaaagagaaaaacgcggctatacggcatcatggccatgtttgcagctgggatcattttgatcgcaggcggcggcttgtatttgaatacagcgcgcaataatcgatacgacacgctgattaaccagggcgagacctatatgacaagcagcaatttgaagaaggcaaaaaaatgctatcagcaggccatcaagctcaaaaaaggggaacctgccgggtatcagggattgtacgaaacgtacacggcaaaaaaagaatacaataaagtcattcagggtatcttggaattattcggcaatgagccgtcgatgagcgacagcgctgaactgcgctatcttctcggcaatgcttattacgaaaatggcgattacgatcaagccgagtacaatttaaaaaaagcggtggcgcttaaaccgtcgctggaagagcatctggttctcggcttgacctattgcgcagagggacgctacgaaaaagcgcagcaagtcattcaggacctgcgtaaaaatggcaagaataccgacggcgcagactatttgtcggggcagatcagcgaaaagcagaatgacgaatcggacgcgatcagtgattacaagcaggtgatcgacgaaacgaagaatcatgcgctcaaacagcgggcgattctgtcattggctggtctttatcggcatcggaagagcttttacgacgaaatcaatgtgctggaaacggcacaaagcgaagatgcctttgctaacaacattccaattagagagcagctgggagaggcttattattacgcggcagaaaacggcggccgctcgtattacaaaaaggcgcttgatcagtatcaaaagctcattgacagcggcttttcttccgcgcagacttaccgcaacttagctatctgctatcaaaaatacgggaattacgcgcaggctgacgcaacgctcgaccagatgattcaagcttatcctgacgattatacaggatacatgcagcgctgttatttgattttggaagaggaagaaaataaggatcaggatcaacgggattattctgcgtttgaaaccaattatcgagcgatgatgaacagggccggtgatgcggcatccgatgattctgaaatcgcggtgctggaaagccgttatgaagagcttcaggagaaaggatggttatagcgtatggtgattggatttgtcctcatcgcgatcggcgcggccgttattgtttctgcggcaattttattaaaaaaatatttgaatacccggtatgatatttctgtcgacgaattcgaccgcaaattcagacacgaacgtttgatcgcgtctgaagagctgacgactgacgacaagtacgaagaaattgctgaaaaatacggcattacgccggagcagctcgatgcggaaatcaaacaaaaaagcacgcagtttaatgaagaaattgcagccaatgggttagatgcagcatcacttcaggatgatgagcaaacagaaaagctatagcagacagcgtgcgcatgaggagaaaaaatgatagatgattacgaagtaacagaagatttaactgcgcctcaggagaacgacgaggccccgggacaggtcccaaaaccagtaaaaaggccaaagaagatctggacaaaacgaatgaagatcttgatccccgttttggcagcggccattgtggtgctttgcgtatttggctacaaaatttacgcccactcacaatacgaaaaaaagctcgacttggcagaaaaatatatggacgacggaaaaattgcccaagcgaagctggcctttgaggacgcggcccagatcgaaaagaaaaatcccgagccctatgtcgaaatggggaaaatgtactttgacaattcagattatgacaaagcgattaaatacctcagtacagcgaaccagcgtcaggaaaccagtgaaagctataacaaaattgcggacagctacgaagaaaagggcgacgacaaaaaggctgaagaaaaccgacaaaaggcggaaagcctttctcagcaggagacaaagcggcatcgtgtctttagcgcgaaaaacaatagtaatgtgtccggcgcgtctaatgcgggaaatacaaatggcaatctgacttattcaggcacaacgtcggattcttcctttgcagcgggaggaaaaatggtacatgccggcgactggacgtactacagtacagtaaacggtctgttccggacggatggcagcaaggtcaaacaattgtcagatgaagcgtacgccagcttgaatgtctacaagaataagttttacgtcttagaaacggatgacgacgaacaaaaagttgaaagtatggatctcgatgctgaaaacgaaaaagaaatttacagcacgacggacaacgacattgcagaggcgatggtctacaaagacaaaatctacgtgatcaagacggatgcaggtgaaggcactgattggcaggaaggcggcaataactttggaccgacgacaagtgtgaccgcgatggatttagatggcagccatcaaaagaaagttttgtctaagtccaataccggtggacaggtcagcattgataatggcctcatctattattacgatgctgaaaatgctgcgatccgcagtgtcaatttaactggcggcgatgatcaattggttcttgaagtcaaaaatttaagtgattacggcacagatacaatcccatccttttatgttgacaatcagcatgtgtattatacagcctttgttggtaattatattgattataatttaaaaacaaaggataaggttacatttgaatcagatgattggcagcacacttatattttgaacaaggactcaaatggcaaatacgtttatgtgattagttatgaaaaatccgattcgagtagctacgacagtgacgagaataacgattatgatgacggtgaagatgacagctacgatagcggcgaagactacgattacgacgacactgaggatgattatgactatgacagctattcgcatagttcgaccggcgccccttatacgctgtggcggatcgatgcggatggcggcaatgtgacaaagctatacaccagcgattcgggaaacagcagcgtcggcttcgtatacgccaatgacgatggcgtttttgtcatggaaaacagcgggacggttaaattaatcgattcagatgggaatgtgacggaattagaaacagatgattaatgcgatgaaagataaattgaggttatggtgcttaaatgataaatgattacgaagaaacagaagagttagagcctatctctgatcccaactcgtacaaacccaccggtcagcagaaaaacaacaataaaattattctattagttgtgattctcattgcggctgcagcggttgttctaggttattttggcattcgccacattcagtaccgcaaaaagatcgagcaagcggccgcttatcaggatgcagggaagacggaccaagcgaagcaagcctacaaagaggcggcggcgcttcaaaaacgcaatgcctatccctacacgcagctgggtgaaatctatctcgatcagggtgcgtacaatcaagcgatcaagtatctgaaacttgccaacgacagagaggaatcatccgaggcgtacaccgcgctcggcgacgcctacacgggaaaaggcgacactcaaaaagcagcggcggcctacgaaaaggcagacaaacagactgacacggagacgaatcaggatcagaaagaaaaagccggcaacagcagtgccaatgtcgagtttagtttcaacgatggctgtatttccggcagcagcgtagccaagtcgggtaagtggcttttttattcagcatatcagggtacttatcgcacgagcggcggcaagccggaaaaaattcaggacgatagcgggtattttctcaacgcttacaaaggctggctctattacgaatgtgattacaatgacggaggattttgtattgagaggacccgcaccgatggcagtaaaacccagacgatttatgaagataaaaatgattctgtcggcgtgtattggatgaaggtgtacaacggcaagatttattgcttagaggcggacagcgatctcggcgacaaccttaagggcggctggctgatttcaatgagtctggatgggggtcatgagaagaccgtgatcgattcggacgtgtattacaattcggtcagcatcgatcagggacgaatctattatattgataccagcagccgccagtacgtcagcacgaatttaaatggagaagattcagaaaatgttttggatttttccgacagtgcctacgatgaaagctcgtcgatgccgcgcgttgtctacaccgatcaaaaccacgttttttattggatggataaatctctgcatgtgctggatttaaagacagacaaaaccattgacatcaaacagccagaaaatacagtcggatacgaacagattaatcacgatgaaaatggcaaatattattatctattatctaacgatgaaagaggtaaaaccgcgacatacagcgagtggcggatggataccgacggcagtaactacaaaaaattatatacattcaggtcgaccaaggttccttatcaatacgcttacggcaataaaatctgcgtgaactattacttagatggcagagaaagggtcgatgtgattgacgcgaataaaggaagcagtcagaactacattgatcttccattagatgattagatttatagcataacgcattccatgttcggcaaatgcgtgaaaagacagcatcttcaggattctgaaggtgctttttttgtaaaagatgtgatgattattgattaaaaatgaataaaaatgattgactttgaaagaaaaggggagtatactaccagtaaagagatcgaaaatcgaaagatgagtgaccaccatgttgactgaagaaagacaagcaattattttacaaaacattaaagaaaagggctcgatgacggttgctgagttaagtgatctgctccacatttccgaatcgacggtccgaagggacctcagtgcgatggattcggaagggttgattaacaaggttcacggcggcgcgacagctcggattggaaatcttttctcgactcgcgaaagcgaaatcgggatgaagcgcacgcagttccagcaggaaaaggcagcgatcggtaagaaagcggccagcttaatcgagccggacgatttcgtttatatcgatgccggcagcacgacagaagcattggcgcgggcaattgtcggccaacccaagaccgaggccatctatgtgactaacggcctcattcaagctgaaatcctgcttcacaacggctgtaccgtttacgttttggaagggcggctgcgttctgaaacagaagcgatcgttggcagcggcgcgatcaattctctcaaaaaataccagtttacgatcggatttttcggcacaaacgggattgactacaatctcggctacacaacgccggacatagaagaatctgaggtgaaacgggacgccttcagccgatgcctgaaaacctacgttttagcggataattcgaaatttaaccacatcacaccggtgaccttcggcaatttgtccgatgcggtgatcattaccaatcaattaaccgacaagcggtataaacaaagagtaaaaattttggaggctgatacatgatttacacagttacgttcaatccgtcgctcgactacatcgtcagcgtggaacatttcaagttgggtcaggtcaaccgcacgcacgcagaactgctttatcccggaggcaaaggggtcaacgtcgcgatcgtgctcgggcatttgggcatgaaggcggtggcgcttggcttcacagccggctttaccggagataaaatccaggatatgctggccgaacagggcgtggcaacggacttcatcaagattgataacgggatgagccgtatcaacgtcaagctgagaagcgatgaagaaagcgaaatcaacggaatggggcctgtgattgctgatacagacctggaaaagctgtacgaaaaattggatcagctcaaggcaggcgatacactggtacttgccggcagcattccggccagcatgccaggggacatttacgaaagaatcatggcgagactggaaggcaggggcatcgaaattgtcgtcgacgcgacaaaggatctgctgctcaacgtcctgccttaccatccgtttttgatcaagccgaacaatcacgaattgggcgacatgttcggagtgacccttgaaacgaacgaagaaatcgtcacctacgctaaaaagctgcaggacaagggcgcgcgcaacgtgctgatctcgatggctggagacggcgcaatcctcgtcgcggaaaacggcgaaatcatccagagcccggcgccgaagggcaaggttaaaaattcggtcggcgcgggcgattccatggttgccggtttcatcacaggcttccataaaaatgacggcgatctgaagtcggccttcaagatgggcgtcgcgaccggttccgcctcggccttctccgacggcctggctacggcagaagatgttgaaaaagtactggctgaagtcaattcattcggtatttaaaatttataattattattgttcataattattttcgcaggagggaaatatgagaattacggatttgctcaagaaggaagggattgagctgaatggcccgtcgggcaccaaagcggaaaccatctccaatatggttaagctgatgacggcgacagggaacatcaacgatcctaagggctatgaagcggcgctgaccaagcgtgaacaggaaggcacgacgggaatcggcgaagggattgcgattccccacgggaaaacagcagcggttgaccacgcaggtcttgcctgcatggtctgcaaggacgggacggaattcgattcgatggacggccagccggccaatttgatcttcgcgattgccgttccaaacaacgcggacaacacccatttggaaatgctgtccagattgtcgatgatgctgatggatgaagatttcagaaaagaactcatcgattgtaacgacaaagatgaattcttgaaaatcatcgacgcgaaggaaacagaaaaatttggcgatgaagagctcgacattccggaagaaccggaaaaagaagaaccagcatcatctggatacgatctgttagccgtaacggcctgcccgacatggatcgcccacacctacatggcggcggaatccctcgaagaaaaagccaagaaaatgggctacacgatcaaggttgaaaccaacggctccggcgggatcaaaaataaacttaccccggaagaaattgaaggcgccaagggcatcatcgtcgcagcggacaaaaaggttgaaatggaccgtttcgacggcaagcacgtgttgattactaaagttgcggacggcatcaacaaaccggaacagctgattaacgacgccctcgcacaaaagggtgcagtttaccacgcagctgccggcgcatcgaagtcggatgacgacgaaggcggcgaagaagaatccgttggccgtaagatttacaaagacttaatgaatggcgtttcccacatgctgccattcgtcattggcggtgggatcatgatggccctgtccttcttgatcgacgccggcaacatcggctcatcctttgggaccggcacaccggtcgccgcgttcttcaaccaggttgggaacggcgcattcgcgttcatgctgccggtactcgctgggtttatcgcgatgagtattgcggaccgtccgggtctggcagtcgggtttgtcggcggctggctcgcgaaagaagggatccgcattggctactacaagggcaagctggcattcctgtattccggacttgatccgaagctttccctcgtttccgccgggttcctcggcgcaatggcagccggctttatcgcagggtatctggtcttgggcctgaagaagctttgcagccatatgcctgaatccctcgaagggatcaagccgatgctgatctatccatttgtcggcgtactgttaatcggcctcattatggtgctcatcaactggccgctgtcagcactgaatcagctgctgtacaacgccttggaaagcatgggcaacggttcaaaagcgatcctcggcctcgtcgtcggcggcatgatggccatcgatatgggcggcccgttcaacaaggcagcttacctgtttgggaccgggatgctggcctctggcaattacgacatcatggcagctgtcatgatcggcgggatggtgccgccgctgggcatcgctctggcgacatcgatcttcaaaaaccgtttcaccaagcgcgaacgtcagtctgggatctcctgctacgtcatggggttatcctttatcacagaaggtgcgattccgtttgctgcctctgacccggcacacgtcatcccaagctgcgtcgtcggttcagctgtagcaggcgcactgtccatggtcttcaactgtaccctgcgcgcaccgcacggcggcatcttcgttttcccggtggtcggcaattggccgatgtacctcctggcactgttgatcggatcggtgatcacgatggcactgctcggtattttgaaaaaaccgcttccggctgaagaatctggtttggaaaaataatatagctttttccagttgattttaaactcggaaatgataaaataattttatacaaagatttgaataaattgaaggagttcaatacaaatgaaagaatttacgtacaccattacagacccagcaggtattcacgcacgtccggcaggcattctggttaaaaagacacagccgtacgcttcagaaatcacattagtcaaaggcgacaagcaggctaacggcaagagcatgctctctgtcatgggccttggcgcaagaaatggcgacgaaatcacggttcaggctgaaggtgcagacgaagcagacgcaattgcggaactcgaagcattcttcaaagaaaatctctaattcaaatcgatttcgacgacagcttccagctatgctggaggctgttttttattgccaaatcctgtgttataataataaagtattacgcatgaaaacggcgcaaatcggatgatggcgccggggaggataaaatggcatcacaacgcgaaatcatggaggcgctggctcgggcagccaagcctgagggcgcggaaaacgcggacaaatacgcagaaataaaaaaacagctggaggcaaaggccaaacagaaacggcagcagaagaggcggacgggcgggaccgtgctcgcctccggtcataccgctgatcaggtttcgccgcggccggggcatctcagcggcagcagccacacgagtattccccatccggtcgatggcggcgaagctcgggtcgcgacgacgccgaccagccgacgcacgacgcgtcaggcacgggtcagacgctccggcacgaccctggcctctgggcattcggcggaagaagtgacaggtcacgcgctgccgaaggtggagacgccggaagccgatctgccgccggttcagacgcggcgttcaatttttgccaatactggcacgactttggcttctggccacacagcagacgagattttaagcggcgcgccggagccgccgaagccccaggccgagcctgagagagctggtgcggcaagccggccgcagccaaaaccagagcagccgtccaaaccggccgcgccacaggctgttgaaaccaaaccggaaccggctcccgcgccggcagcaccgcaggcagctgaaatcgaagacgcggtgatcgaagaaattcctgaaacaccacaggctgcagcaccagatgaaaaagcggctgtgcaggacgcggcggcagcgcgggccgaacgggaaagagcggccgccatcgagcaggaccgcattgctacaatggccgcgcaggaagcggcgagagagctgaccgaggccgaaaaggctaagcagcaagcggctgaaacacaagagacaccagtccaaacgccggcgcagcagccgggtctgtccttttctgaacagattcgggcggccggcggcgcaatcccggatgcggttgacgtgggccgcgaaacagaggacctcggcgaattgtggcagcgcctcaacgagtacaaggtcaaatgcctgtcgacgccggaaatgttcagtgaaggggcggtcgacctgccggacgcgctcatcgacttctttaacgccgatggccgagaaaagcgcgtgatggtgctgtttgaagggcgggaatacccgtcctatctcgaaagcagcgatggtgtcggtggctatcgtctcgaatggagcaaggcgctgagccgtaaattctacagcatgttcccgcagtacgaggaatttttcgatggggacatgacggaagcaaaacagaaaaagcgcccctatcttgccatcgaaaagcttagcgagaacgaatttgcctgcaagctgattctgccctcggatcagggcttaacccgcaagcagacgctgttcgacctgctcggacccggcaaatcgctggctaattttaccgattcctacgatctggtctttttaaagagttattttgaaaacatcgataaccgctggcgcagcgacgtatttgtcgtctcagccaatgtccagaagttttacaaaaagcggattgaagagggcaaacagcctgacccgaaatccgaccggaatctcgaaggcattgccaacgtcaagctggacgcgattttggatttcctgatggacgggccgtacctgctccttgcggatcaaaagcttttgtccaccgttcaggaggacgatcatttctatttcggcatcgatcaggatttgatggacgaaatgacgatggacgaccgcaatttgatcgtcagccttcttgaacagaaaatcgactattacttcagccgcctcgacggaccgtcactccaggaaagtctgtccaactgggtggaagaatacgcggattattaccatcgggatttccgctactccttcaaggatgtgatcacggaaggcatcccgggcagcatcgaagggctgaagcagtttgacgaaaagcgctaccgcatctacggctttgcgggcgaggacgactgggcggatatcccttgggtcgaaatcgtcgacaagcacgtcacccgttttgcgaacaccggcgtcggcgtcaaatacttgttgagtaaggacagcaagaagctgtatttggcgctgtctctcggctttaagcccatccgcgccgaaatcgccaagaccggcgatctggatccgatgctggatccggacgaagcggtcgacgaattggtcgctgaggcgctgccgccgaaggtggcggaaatccgctcgatcgtccaccccgggaccttcagcacgaaaacggcggatatcgatctgccggacgcaagatttgttaacggcatcatttgctatagggaatacgccggggtcgtgccgggagaaaagattctcgaggccgatttggcggaaatgcttgacgtctacaaccattatctgcaccggtgtatcatcggcgacgaaaaacctgaagtgatcgcagcgccggtggaagaaccggcggcagaaacgacggccgaacaggaaacggatgacacaacatcggaagaaatgccggacggcggcgctgtcggcgctgaacaagatacaccatcgcttgacctcgacgacgatttagacgaagcattagtagaagatctcgacgatttagaagatcttgacgatatggatgatttagatgatgtggacgctgaagacaaggccgcatcggctgaagcagctgaatccgctgaggcagcaccggcagcagaagctgcagacgaaataggcgcagcctcggaaaattcagatgcagcagaagtggcagaagatcgagacgacacagcgcctgaggaagaagtcgcgtcggaagcggcgatttccaaggccatggctgccgccgtcgcccgcaagcgcgaagaaactgcgccggcttggcagcccacgtaccgaaacgattatcagccagcgccccatacagcggtgcaggtggtgaacaccggcggcctgacgaaagaggatttggctgctttccagaaatcgatgattaaggcccagctcaaggtgcagaaaattttgatgcgcgctgaagaaaagaaagcggaaaaacaaatcgaggcggaaccaagaaatcgccgcgaccttcattatgaagaagttcttcaggatccgccgtcggatatcgtcggcctgatgcgccacatcgtgcagtacgtcaacagcacaggcggcatgtgcgatcaagatgaggtcgccgatttgttcctaagcatcaaatccggatcgatgccgctggtgaccggtgtggccggcctcggcaaggccgcctttatcagaggcttcgccggcgcagtgggggcgaacgatcagaacgggcgattcaagatgattccagtgcgccccagctggcagaacgcggatggcttactcggatatgccgacgcggacggacacttcattcccggcgcgatgattgattttgtggcggccgctgtggaaaatccggacaagccctatttcctgctgctcgacgaaatgtgcgcggcgccgatcgaaaaatatttctctgaaatcctttcgatcatgaatacccgccgggtcgtgggcggcagatcggtgacggatccgattctaagcgaagagcttctcgcgagagatcctgaagcgcaggcctattacggcgatctgtacctgccgcagaacctgattatcatcggcaccatcagcagcgacagcggtgtgagcggcatcacgtcgagactgatcgaacaggcggcggtcatcgaaatgacttcgcccgacctgacgctgacggctgaaccgcctgaagcctttgagcccatcgcgctgaagagcgaatttttcgaacgggacatcgcttctctcgcgcaaattcagaatcaccgaaagaccatcacggatatggtcacgctgctgaacgtcatcaacgagattctcaaacgcgcccaggcccaaatcggcttccgcgtccgggatgaaatctgcttcttcctgtactacaacgcggaatacggcttgatggttccggaaaaggcgattgacacgacgattatgcagaaaatgctgccacgcatttctggcacgacggcggaaatcgaacaggtgctgatcgagttattcaagatctgcgcgggtacccaggacgacaatatgatttatcagcccatttcgactgaagaaggcctgttcccggtcagcgcggccaagctgtccgaaatggccggctaccttcagaccgacgggcaggcgtccttctggaaacttggaccgttacaatcttaggataaaattaagtaaaacatttcatttcataataagcactctcgattgatgattgttttaaggattgttcgatagactataccccgtaatcataaatcacatttatacaaaggagtctttttaatggaaaagcacaaattgggctggcgttcaatcgtcctcaacgtattagcaattatctttttagcagcattcttctatgggatcttcatctcagtatctcaggttgcgtctatggtcgcccagtacaaggcgatgggtacgagcattccgacaagctatgccgttcagcaaatcgtctttgcgattatgcagtacgcactgccggaattgttctttgctgtgatgtgcgcggtggtctcgaagatcatcgatcatatgggtatcggcgcagacaaggcagcacagaaggccgataaagctgaagacaaggcagaagaaactaagacagaagatacaccggcggaagatgaaacagcatcggaagaagcggtaccgtcgacagaagaactgaacgtggaaccggctgaatcatcagaagaagctgacgcatcagaagaaaaagaagatgcagaagaagcgtaaataaaagaatcacaataaaaaatccaaagctgaaaatcaatcagctttggatttttttgtgcccattatgcgttttcagtgagatcgatggcgcgggccatcagcgtgatttctcggttgtgactgcccgtgagatttaagtagccgaacaaggcttcgagaccagtcgcgtagcggtaatccatgacgtcggcgtgcttcggcggcatgctcttggtattgcggcctcggcggacgatggcgcgttcctcctcggtcagttccggcagcatcaagcggatcgccttggcctgagctgaggcgcggacgtagtcgatggaacgcttggtcaagcggtcgaccttggtcatgccctctgcgacgagataccggcggatgtagtcggaatagacgacgtctccgatgtaggcgagggtcagcggattcatcatccgcgcctccgccttggaataggttttgtccagatcagccaggatatcggtgttgtcccggtggacggctgtcattgtcatgctttgtgccatttgacgccatcccgcgtgtcttcaagaatgatgcccttcgcggcgagatcgtcacggatggcatcggccgtcgcaaaatctttagccttgcgcgcggcctgacgtttttcgatcagcgcttcgatttcgtcttcgaggctgccttctttttcatctttatttttcgtggctaatcccaatacgtcggaaagctggttgaacatttgaagggccgcttcgacagtttgctttgacgaagcttcagtcagagtcgagttagcgtcgcggaccaattcgaacattgcggcgatggcgtcggcggtgttgagatcgtcgtccatcgcggcgataaactgatcgttgtaggttttaagatgatcggcccattgtgcttcgtcttcgctcggcgccttgtcttcgcagcgttcgagcaggtactgcatctggaatttggcagtgtagaggcgttcgagggcgtttttcgcctgggtcagcagctcgtcagagaaattgactggacttctgtaatgggccatcagcatgaacatgcggaccacttcgagatcgtactttttggcgatgtcccgaacggtgaagaagttgcccttggatttcgacatcttttcgttgttgatgttgatgtagccgttgtgcacccaatagtgggcgaaggtgcagccgttagcgccttcagactgggcaatttcgttttcgtgatgcgggaagatcaggtcctggccgccgccgtgaatgtcgatggtcttgccgaggaatttgcggctcatggctgagcattcgatgtgccatcctggacggcccttgccccagggactttcccagtagggttcaccgggtttggcctttttccagaccgcgaaatccaacgggctctgtttttcgtcgttgacgtcgatgcgggcgccggcttcgagatcggcgatgttctgcccggacaggcagccgtagcgcgggaatttttcgaccgcgtagtagacgttgccgtcgatgttgtaggcaaggcctttgtcgacgagggcttggaccatgtcgatgatttccggaatcgtgtcggagacgcgtggatgcacgtcggcgcggcggatccccagcgcgtcagcgtcggtgaaatattccttgatgtatttatctgcaatttccttggctgtgcagttttcttcatgagaacgattgatgattttatcgtcgacgtcggtgaagttctgaacaaaggttacatcgtagccgatgtattcgagatagcggcgcagcacgtcgaacacgataaagggtctggcgttgccaatgtgaaaataattgtagaccgtcggcccgcaggagtacattttgacctttcccggttcgatgggttcaaaggtttccttgcggtgggtcatcgtgttgtataatttcatagggttctcctctttaatctaaaatcgttccaattataacacagaacccccggggtttcacgaataaatctagatcgagtggtttaacttgcgacagtaaagtggtataatgaagtatattttatgtagcaagcgtatctgcaaagaatagaggtaagattcatggaaaaggaacgtgacgtgctgatcaaggcactgctgtccctcaaaacaccggaggaatgcgaggcccttctcgacgacatgtgcacgatcaaggagatcgaggacatgtctcacagattgatgatcgcccttcttctggccgagaggaagacgtttatcgacgtcgaaaagaaaacgggcgcgagctcggcgacaatcagtcgggtcaacaaatgcctgaagcacggaactggttatcaaacggtcatcaagcggattcttgatgatcaggatatagaaaatcaataaatagaaggaagttaggaaaatgaggcaatttcagaaatcccataagctcgacaatgtgtgttacgatattcgcggaccagttgtcgcagaagccgaccgcatgcagcgggaaggcgtagacatcattcagctgaacaccggcaacccgccgcattttgatatgaacgcgccggatgaagtcattcgcgacgtgcgcctgcacttgaaggattcagaagcctattgcggctcccaggggctgttccaggcgcgcaaggcgatcgtccagtattatcagacccaggggattatgggtgtcgacgaagacgacgtctacatcggcaacggctccagcgagctggtcagcttctgcatgtccgcgttattgaacgacggcgacgaagtgctgatcccgatgccggactacccgctgtggacggcggcggcgacgctggccggcggcaaggctgtgcattatctctgcgacgaaaagagtaattggtatccggaccttgacgacatccgcgcgaaggtcaccgataaaaccaaggggatcgtcgttattaacccaaacaatccgaccggcgcggtttacccgaaggaaatcctcgaaggtattgtcaagattgcggaagacaacgagctgatcattttctctgacgaaatttacgatcacatcatttacgacaacttgccctacacacacatggcgagcctgaccgaagatgtcctcgtcgtcacactgaatggcttgtccaagagccaccgcgtgccgggatttagagtcggctggatgatgctcaccggcaacaaggaatgcgcgaaggattacatcgaagggattcacattttgtcgacgatgcgcctctgcgccaatgtgccggcgcagtacgcgatccaaacttctttgggcggctatcagagtattcaggatctgatcgcaccgggcggccggctctacgaacagcgcaatatcgtgtacgagggcatcaactcgattccgggattatcctgtacgaagcctgccggggcgatgtacgcgtttgtcaagatcgacacggcttccttcaacattaccgacgacgtgcagtttgcccttgacctgctcaagcgcgaaaagatcttgatcgttcaggggactgggttcaactggccggaaccggatcatttcagaattgtcttcctgccgagcccgattctgctcaacgaaaccatcgaacggcttcgccacttcatggcccattacatccaggaataatcatggagaaaaattgggaaagtgcgtcgccggaacagacgctgtccatcggcagaaaaattggcgaagcgcttaaaggaaagagcggattgatttttttgaccggcgatctcggggccggcaagacaaaattgacccagggcgtcgtgagcggtctgggtatcgacgccgaggtcaccagcccgaccttcgcgctgatcaacgaatacggcccggacgccgaggcggtgcacatggatttgtaccgtctcgaggattatgaagagctgcaggaaatcggctttgaggattacctcgacggcgaccgcctcattctctgcgaatggccggacatcctagaggatgaaggctatgaaccgatgctgcgcatcgatttgcggcgggacgacgccaagggcgaaacggccagacggatcacggtggtttgtgaggacgacagcgctgcggaaaggatcgcggccattgaaagctgaaacacctgacgcccgtccttttgtctcggtcgtcatcccggcagcaggccgaggccggcggatggggacgaaaacgaacaagcagtttttaaagcttcaggacgaaccaatcctgtactggacgattcgggcctttgatgagagcccgagggttgacgagattgtcgtcatcctcaacccagacgattgggatatttttaatcgggatatcacgtcgacacatatttttcaccatcaaatcaagacgacggctggcggcgacacgcgcagccagtccgtttacaacggcctgaaagcagcggatccgcgctgcagcgtggtgctcattcacgacggcgcgcggccgatgattggcgagacattgattggcgacagcatagactttgcattaaagtacaaagcggcgatcgcggcggtcccggcgaaaaatacgatcaagtcggtgacgccagcaggcgacggaagcagcacgcttcaggtcaatcagaccctcgaccgccgggtgctctacgaggtgcagacccctcaagcttttgactacaagctgatcctcagcgcgtacgaagcggcggctgctgatcacgtcgaggcaacggatgacgcggcgctcgtcgagcgtttgggcctgcccgtcgccatcatcccgggagattacaacaacatcaaaatcacaacatcagaagatttaatgatcatcaacagttttctgacattaatgaataaaaaaaaccagcacgaaagtggagggcgttcaatatgaaatttactgaagaattactggcaacgatgtattaccgcatgaaccaggcgcggtttttcgaagaaaccttaaaatctatcagcgcatcggacaagatcaacggcgtgtcccatttgtccatcggacaggaagcgtctgcagtcggcgcgtgcatggccattgaaaagggcgacgacatcgtgatgagtttccgcagccacgcgcaggccatcgcttcaggtgtggaaatcaagggcatgatggcagaagccttaggcaaagcgtcgggaatcgacggcggcctggcgggttcggcgcatttgtctgatttatccgttcacaatttgggcacgagcccagcaccgggcgcgaattatccggttgcctgcggtgcggcactgactcacaagcagaaggaagacggccacgtcgtgctctgcttcggcggcgacggcaccttagacgaaggcgcattttacgaatcactcaacctggcggcgctctggaaactgccggttatttttatgattgaaaacaactttttcagcggggcgacggccattgaagaccaccttgcaccgcaggatatcaaagaagtgatcgaaggctatggcgtaccggccgtgacggtcgacggcaacgacgcggttgcggtcgcgatggccgttgaaaaagcgcgggcccacgccgcagcgggcgaagggccgttcttcatcgaagcccagacctaccggctgtgcggttacgacacgagcgatctccagctttaccgcagcgtcgacgaacagaagatctggcagcagcacgaccccatcgcgctctttgcgaagtccctcgtggacgactacggcatgaagcagaatgtgctggatcagcttaaacagaatgcgtcccgcagcgtgagcgacgcgctgagctacgcggaagcgtcggacgatccggcgatgaacgacgcattgtcaccggtattagcataggaggacaggatcatggaaatcaaagaattatccttcaaggaagcaatgcgtcaggcattgcaggaagaaatgaaagcggaccaatccatcgtggtgatgggacaagatgtgcgcgaaaacggcggcagctgcggcattacccttggcctcgacgaagacaggatgctcgacaccccgtcatccgaacaggctgtcattggcgcggcagctggcgcagccatgaccggtctcagaccgattgtcgagctggcatcgatggatcaggcgttgaccgccttcggcgaattggttcacaccgcggcgcggcccttctattggtccaagggcaaggtcaacgtgccgatgacggtgatcgtaccggtgggcggcggcgatcagccgcagaacggccagaccctcgaaagccttttcgctcacattccaggcttaaaggttgtcgagccgtcaaacgcggcgcagggcaagggcctactcaaggcggcgatccgcgacgataacccagtggtatttttaattaaccgcgatctcttgggctataaaacccaggtgccgatcgaagacgaatacgtgctgcccctcggcaaatcctacaccgaacgcaagggcggcagtgtgacggtcgtatcgtggggcgcggcattggtatctgtgctcgaagcgtcggtcattctcgatcacgacggctacaatatagaagtcatcaatccgatgaccctcgcgccgatggacatggatacgatttataaatcggtcaagaaaacgggacatctgctcattgtgcacgatgaaaacaagaccggcggactcggcgcggaaatttcagcatcggtcgcggaaagcgaatgtttcgattatctcgaagccccgattttcagattgtgtgggctcgatgtgccgatgccctacaacaagggcctggaagacgtggtgacgccgaaggccgaagatgtggttcagtccgtttacgatctgctgggggttgattgatgggcgaccaaaaggcaaaaccttcaaatggacgtctttctttaagaaatttaggcggccgagccagacaagccaacagcggcagacaggtcctgccggcgacaccggcagccagacgctacgctgcggaaaagggcgtcgaccttcaggaactgtctgaaatcggcaaagaacgacgcatcaccgaacgggatattgacatctatttagaaaaaaagaaaattttcgaaaagcatacccagaacgggcgccgtcaagaagcgcaggaaacccttgaccagccggaagagccgaagttaaaagcggcggcggataacggcggcccgcaggccgatcaatcgcaagcggcagagcctgaatctgcaagccagcccgaaccggaagcggaagcatcggctgaagccttgccaaagacagagccggatatacagccggaaagtgtcgacgaaacagaaatagaaaaagaaacagaaaaaacagaagcatctgctgcgcctgaagtcaagacagaatcggaacagccagaggcagcggaaactccatcggtcagtgaaacgaaagaaaaatccagtgggtttaaccttgacgattttgatcccaacgatgtgaccatcgtcagcgtgtcgccgctggctcgggaactcgccgaagaacaccacgtcgatttgtcgaagctgacgccgggcagcggccccaacgggcgcatcgtccgttacgatgtgcgccaatggctgaaagcccatcccgatgagacagaggctgtgcctcagccggtggtgcacaagccgatggcacaggaaaaacctgcgccaaaaaaagaacagcaggcggctccagctgagcaggtccagatgcagccggaacccgaaaaagtggccggcgccgcggacaagtcgaaagcggattcaaacctcggccatcacgatccggtggccgcgaaaatttatcaggccattcgggataacatgggggataccttcacccataaggcaccaccgcagcgcgcgaaggcccaggatgtggtggcgtcggcgatggcggaacaagggtcgcctcaggacggcacatcgagcgatttaacgcgccgcgaagatccggccgacacggtagcggtcgggccttattcgctggacatcacggtggacgtgacaagggtgcacgacgcctgcagaaatcagtcggaaaacagcagcgtcgagttgaccgattacgtcactgcagcggcagcccgttcgatgagtcttcatcccaaagcctgtggggaaggctcgaaaattgtactaatgaccctcagcgaaagcaaagggctggtctgcacgccggcgcttgacgccgacgaagggacgtcgcctcaggccatctcggagcagcgctgcgatgcaatgcagaagatcgaagacggccgcctgaacggctcggattgcgacgccggtcttcacatcatgtccctcggtcagggtgttggcgtcaattacatctgtgacaagcagaaggccccgatcctggcggtgggcgctgtgcgcaaggaaatgcagatcggcggcatgcactacatcgctgcgctgactctgtcacaaaagcgcggtgcggccaacgttgcggcgtctgtggcttttttgaacgcgctgaaaacatttttggaaaatccggacgcgctgattcaattaaagccgaaggaggaaaaatgatcgaacccaatttatccaaggaatttagagataatgctgtggatattccgagaaattttgacatcgtcgttgtgggcggcgggattgtcggtattaccgcggcgatcgaagcgagacgggccggctaccagaccgcgctggtcgccggcgatttcggcggaaaatttttaaaagaaggcattccggcaggattttatcacgaaaacgcgcggtttatccgccactgcatgcgctatcgcggccatcacggcatcgtcgtcggcaagctgtccctcgatatgcatcagctggtcaacgaaaaaaatgaagcggtgcgccaggaagaagccaagctgcgccggcagctcgacgacgccggcgtgtacgtctttaatggcgcgggccggccacttaccaacgggatgatcgacgtcaaggaagaggacggcaaccagatccgtctgacctggaagcgcctgatcatcgcgacggggcttaaagcccaggaacgggaaaccctgaagcattacaccgaagtggtcgaagacaacagcgtctgtgagttcaacaagattcccgaagaaatgacgatattgggctccggtgtacgcgcctgcgaagcggcatcgcttttccagaccctcggcacccacgtgtccatcgtcacagacaaatcggcagtgctcaaaaatttagatgcgcagatcgtcggccgcctcgaagaacagatgaaacgccggggcacgaaaatttacctgaaaatgcgtccagtggatatgtacaaggattccttaaaaatgacgcacatcgagctcgcgtctgtcgacgccgagcctgaaaaaaaaggcggccgcccgaaaacggaacacaccgtcatttcctcgacgatttacgtgccgactctttacaaaggcaatctcgctggactcagccagctccgtctggacattgacgacggctttattgtgacggacagcttcaaccgcacctcgatgaagaaggtctacgcggtcggcgggatcaccggccaatgccagatgcctcacgaagggcggattcaggcgaagatgctcgtcgaaaacattgtggcggaggacgaagaaaagccgcgccgcatgatggacgtgtatcagatgcctcactttattcacaccttcccggaagtggcgagcatcgggctgacgacgcaggaagcttctgtggaacacgacgacatcaaggtcgggcttgcgccccttggcgacgaaccaggctccctctttaaaatagacaagcagggttttgtcaaggtcattgtcgacggcaaataccatgaaatcctcggcgtccatattatcggcgaaaacgcctgcgaattgattgcacagattcaggcgctgatggtcatggaagggacgacgatggatttagcacggatcgtccatccgctgccgagcttgtctctcgccatggaagaagccttcgagcagattgaacagtgaagcgactttagagaacaggagaaaaagcatgacgacaaagcaatcggcacagccccgtgaattggtggttgtgctggatttcggcggacagtacaagcagctcattgccagacgagtccgcgaatgccaggtgtactgcgaaatccattcgtacaaaacacccattgacgagctcaaggccatggcgcccaagggcatcatcttgaccggcgggccgaacagcgtttttgaagcgacctcgccgacctaccaaaaagagctctacgaactgggcatcccgattctcgggatctgctacggctctcagctcatggcgcacacactgggcggccaggtaaaaaaggcgccagtcagtgaatacggtcacacggacctcaccatcgacgggcaggacagcctgatcatgaaggatgtggcggcggacactgtctgctggatgagccacacggactatatcgcgaaggcgccggaaggctttaaggtgacggcgcataccgcaaactgtccgatcgctgcgatggaaaatccggaaaagcagctttacgcggtgcagttccatccggaagtggtccacacgccagaaggcaagaagattttaaacaacttcctgaccgaggtctgcggatgttccggcagctggcagatgaacacttttgtgaaagacacggtggcggcgcttaaagaaaaaatcggaagcgaccgggtgctcctcggcctgtccggcggtgtcgactcgaccgttacggctgtgctgctttccaaagccatcggcaagcagctgacctgcgtgttcgtcgatcacggtctgatgcgcaaggatgaaggcgacgaggtcgaagcggtgtttggaccgaagggcgatttcgatttgaacttcatccgggtcaacgccggcgacacctattttgaaaagctcaaaggcgtgaccgatccggaacaaaagcgcaaaatcatcggtgcgctgttcgtcgaaatcttcggcgcggaagcgaagaagctgaccgacgaaggcggctttaaatacatggcgcaggggacgatttacccagacgtcgtggaaagcggcgctggcaacggcggcgcggtgatcaaatcccatcacaatgtcggcggtctgccccaggaaatggtcgtcgagctgggctttgatcagacgccgatcgaaccgcttcgagatttattcaaggatgaagtccgccaggttggtctggagctgggcatcccgcggaatctcgtgttccgtcagcctttcccgggtccaggtctgggcatccgcgttgtcggcgaagtgacgccggaaaaggtgaagatcacccaggaagccgacgccatttaccgcgaggaactcgaaaaggccggcatcgatatgggcaagggccaatttttcgcggcgctgtccaatcttagaagtgtcggcgttatgggcgacgaccggacctacgattacgcggtcgtgctgcgcggtgtgatcacctcagattttatgaccgcagaagcagctgaaatcccgtggtcggtgctgcagacgtgcatgaaccgcatcatcaacgaagtgaaaggggtcaaccgcgtcatgtacgacctgacctctaagccgccaggaacgattgaactggaataaaagcacaaatccctgtaagtcttgaatctaaaagacttacagggattttattttgtttagctttagcgaaggattcgacgagagaaacgaggagaatcaaagaaccaccggctaggccggtgagtttactaaagcttcagcttcaagcaaaaaacctcctatgctaaaatcaaatgattccggttcgcgccaaccgcaacatttcataaaggaggttaaatcattatgaaaaatgataaagatagtttagcacatacaaaatggaatttaagtatatatagtgtttgcaccgatatagacgaagagtaatctaggaaaaaataaaagagatataggaaagattctcaggctgttatgccaaaggaaaggaatagaaataatagaagcagaatgttgtccagatcacatccatatgttagttcacataccaccaaatattcagtatcgcagatagtcggatatttaaaagggaaaagtgcgttgatgatctttgatatatgcgaatctgaaatataaatatggaaataggcatttctggtgtcgcggatactatgtggatacagttgaaagaatacaagaaaatagcagaggatcaaataaatataaaaaatatatagatccatttagtgggaagaaaataagtaacccttagggttagtctgagttacagaagaaagaagtggagcggaaagcgaactatttcgaacatcttaagatgttggtcggtaacaggcccttatagggctaacacaaaccaccggctgagccggtggttatgatttgagcttcatctttctttgaactaaattaaccgaattgacgcaccccccggtccgcgttaaaataggtttatattgtaaaaatgactggggagaggagtccattttgagcagagcatttaacaagcagatcaatacgctgaaccaggagatggttcagatttaccgaaacgacaacgcctatatttcctacacgtcggccgcactgccgcagcgcagcgcgatgatcgagattctcaacgagatccgcaaattgttttacccgcggcattacggtgaccgccagctgttcgactgcacgatccgctactacatcggcaatttgatgatgtccatcgaggaacggctgcaccaccaggtccggctggcgctgctgcgggccaacgacacgaagcccaatgacgcgaaggaggatccggaggccatcgacgaacaggcgtcggttatcagctgcgaattcatgagccggctgcccaaggtgcgccagatgttgacgatggacgttcaggcggcttacgacggcgacccggcggccagcgacctcgacgaaatcgtgctgacctacccgggaatattcacgatgatggtgtaccggctggcccacgagctctacacgatgcacgtgccgattctgccgcggatgatgaccgaatacgctcacagccggacggggatcgatatcaaccccggcgcggtgatcggcaagtacttctttatggatcacggcaccggcatcgtcatcggagaaaccaccgaaattggcgattacgtcaagctgtaccagggcgtgaccctcggcgcgctgtcgacccgcggcggccagcggctgcgcggcaagaagcgccacccgaccatcggcgaccgggtcacgatttattccaacgcgtcggtgctcggcggcgagaccgtcatcggccacgacacgatcatcggcggcaactgtttcatcacggagccgattcccgcgtgctcccgggttttcatcaaaaaccccgatctgaccatcgaaaaggggctggatcaccgcaccgggacggagattcccaatccggatgcagaaccggaattggttgattaaggagaaccacacatgaacgacggcaacaccacgctttacggggtgctcgggcatccgattcaccattccttttcaccggccatccacacggcggccttcgaggccaacggcctcaacgcgacctatctggccttcgacgtggcggaggatcagctggaaaaggcggtcgacggcctggtgacgctggacgccaaggggtggaacctgaccatgccccacaagacgaaaatgtgcggcctgtgcgacgagctgtccgaggcggcggccatcgtcggggcggtgaacaccgtggtcaacgatcacggccatttaaccgggcacatcacagacggcgccggctttaccgcgatgctcagagctcagaatttcgacgtgaagggcaaacgcgtcgtgctcttcggcgcggggggcgcggcccgggcggtcgccgtgcagctggccctcgacggcgcggcggcgctgtcgattgtcaaccgtaccctcagcaaggccggcatgctggccgatttgatctcggcgaacacagcttgtgacgcccgcgccattgcgctgtccgacgaaaaagcggccgccgaacagattttggcggcggatttactggtcaacgggaccaagctcggcatggccccgaatccggacacctgcgtgctgaccgatccggcgctgcttcaaaataagccggtccttgcggatttcgtctacaatccgctcaacacccgtttccttcaaatggggcgtgaggcgggctgccgcaccttcgacggcctgggtatgctgctctggcagggggccctggccttcaagctctggaccggcgaggacatgccggtcgccgcggtccgtcagcgggtttttcaccaataaggtcacaaagttcagatttatcgggctgtcccttgacagtccgtttttttatttgctatgatgaagtggttaaaacgaattcaggaggaatttccattgaaatactggaacgaaacatttgaaaccatgcctcaggatcagctccgggagctgcagttggtccggttaaaacaaacggtggaacgcgtttacgccaacgtgcccttttaccgcaaaaagtttcaggaaatgaacgtcggaccggaaagcatccagagcctggacgatattcggcgtctcccgttcacggaaaaggacgatttgcgcaacaactacccctacggtcttctggcagagcccttgagccagatcgcccgggtgcacgtctcctcagggacgacgggcaaaccggtgtgcgacggctacacccataacgacttgtcgatgtgggcagaatgtgtcgccagaggcctcgctggaatcggcgcagacgcccactcggtgatccacgacgcctacggctacgggctgttcaccggcggcctcgggattcacggcggcgccgaacgcatgggtgcgtcgatcattccgatgtccagcggcaatacccagcgccagatcatgctgatgcaggactttaaggccaccgtcctgacctgtacgccgtcctacgccgaatacctcggggaaacgatgcgcgacgaaggcgtcgacacctcggcattgccactgaaggccggcgtcttcggcgccgaaccctggtcggaaaacatgcgcaaaaacatcgaagccctgctcaacatcaaggcctacgacatttacggcatgtgcgaaatctgcggaccgggcgtggccatcgaatgtccggaacaggacggcctgcatttctgggaagatttcttctacttcgaaatcatcgaccccgaaaccggcgaagtgctgcctgacggggaaaccggggaattggtcatcacgaccctcacgaaggaagggatgccgctgatccgctaccgcacccgcgacttgacctgcatcattccggaaccctgcaaatgcgggcgcacccaccggcgcatcgccagactgaagggccgcaccgacgacatgatggtcatccgcggcgtcaacgtcttcccgtctcaaatcgaacacgccctgctggaaacgggctacgtcgaaccccagtatcagctggtcgtcacccgtgaaggttcgcgggatcagctggaaatcaaggtggaactcaaggatgacttcaacctcgattccatcaacgcccttgaagagctcaaagcgaagatcgaacacgaagtgcattcgatcatcggcatcaaatcgaaaatcacgctggtcgagccgaagagcctggaacgttttgaaggcaaggccaaacgggtcaaagacctgcggaaaatctgaggaggtagtcatatgatcagacaagtatccgtctttatgcaaaatcaggaagggcgattggccaaggttctgcgcactctggccgacgccaaggtcaacatccgttcgctgaccatcgccgaagcagaggatttcggcctgttgcggctgattctccaggattcggacgcgggtgtcgccgcgctgaagcaagcggggatcatggccaatgaaacccaggtgctcgccgtcgaagtaccggacgaacccggcgggatggccagcattgtcgaagtcctcggcggtgcggacatcagcatttcctacgcctattcgtttttgccgaaaaatacagacaacgcgatcatcatcctgaaagtaccggacgccgactacgacaaggcgatcgagctgttcagcggcgacgaaagaaccaacctgctcgccagagatgagctgttgacaagatagggacgcagggttataataagggcaaatagaataacagtctgtttcagggcggggcgcaattccccaccggcagtgatgcgaaaagcgagtctgcgagccattttgggcagatctggtgtgaatccagaaccgacggtatagtccggatgaaagaaacggtcagtgtgtgtttgactcgtcctgaaaatattcatttattttcaggactttttttacgcgcggaagaccccggggcagactcctaaggaggaagcatttacatgaaagcacagcgcaaaacgcattttttggcacatctcgcggtcctggtcgcgatgtcggttctgctggtttatttgatccatttcccgatcatgccggcggctccgtttttggaatacgatccggcggacattccgattctcgtcggcaccttcctgttcgggccggcagccggtctgatcatcaccgccgtggcctgcatcgtccaggggctgacggtttcggcatccagcggtgtcatcgggattctgatgcatttctttgcgacgggcagctacgtcattgtcgcgggcttgatctacgtgaagcaccataccaagggcggtgcggtggccgcgctgatcgccgggaccctgaccatgaccgccgtaatggtggcctggaacctcgtgatgaccccgattttcatgggaacgccgagagccgctgtggcggcgatgatcgtcccggtcatcattccgtttaacctgatcaaggcggcgctcaacggcgcgattacctttgccgtttacaaatccatctcccgggttttcgaccgcgacttcaaccgccgcaaggtgagccacgcgaaggccgacgcgtaatttcgtatcgtatcaaaagagtctgaaaaatttttcggactctttttttaatatggtaaaatgatagacaaaatgaaaaagcgaaacataaagagaggagacgacgatgtcgattcagcagcaagcgaacgttacctgcccggtgtgccgctgtgccagcccttttaccatttggcagagcgtcaacacgacggaaaatccggaaatgaaggaggcttttatgagcggcgccgccttccgtttccgctgtccgaaatgcgggacggagacgccggtgttctacccgtgtctgtaccatcagatggaagatcagattatgatttatcttgtgcccgaggaaagggtgacacagacggctgagatttttgacaagggcaagaccgacccgaagaaccaccactacatctaccggatcgtgacgacgaccaacgatttgatcgaaaagatccgcattttcgacgccggccgggacgaccgcacggttgaggtctacaagcacctgctgacccacacggtcgccgaaacctacccggacttggattacgacgaaatccgctacgacggctacagcgacgacgggaaggaatacctcgacgtgttaaagggcggcgaagtcctgacaagcgcgaacatcgacgacgagctctatcaccgcctcgacgaggcggtaaatgtccagcacggcgccatccgccatggagaagattgggtcatcgacagccattgggccgccggcgtcatcggctgagggccgccgctttaaaattatttccgccatttggcggattttttttgctcgaatcgcccgtggcggatatcgaagatgatttcgtttaaaacttaatgtgtggcaaaatccatttattttggtcttgatcgaaagtataatagaggcactttctaaatatctaacacgctttgcagaaaggagatcatcatgtttagggatgaagaaagtctattcaaagatcaggcctatcgctattttttgttcgggatattcgctattgcggtttcaattttcttgagcgatttgattttgtcggaaatggcaaaatacgtgaaaatgtcaagtgatctgagggaaacgcttggcgaagcttttcgcctcgtcgtactcatggtcgtgatttttttaggccacatgcagggcaggatttatgcttccgatcgggaaagttttgcctacggcctgctgaccggtttgccgatactcgccattgcagctgcccagctggtgctcagtatcgttcaggccgatcctggatatttttcccataccaaactcatcgtttccacgataacgatttacacgctcaccggcatttttgaggaattgctgtttcgcggcgtggtgctgaacgcttttcaggatgcctttgcggcaaagcgtgctgggaccatctgggtgtcactcattttatcggcacttgccttcgggatgatgcatcttgtgaatctggcctcagggcaagatgtggtggggacgctgatgcaagtcatcgaggcgaccgccgtggggctgtgcttcggcgccgtttatctcagatgccgtaatatctgggtagtggtgatcctgcacgcgctgaccgatttgtccagagccatcggcaccaatgcgcagacagctgtcgacgcgcaaaatgcgaacgtcaatgccgcggcgtccatcctcagtattctgccgtcccttgtcatattgctgggtctgaccctgtttctcttgagaaaatccaagatggaagaactggttgaggaaagacaggaaggtggcattgaagcgcgtccaagcctaaattgatgatctgtaaagagataaagtctgagataaaaaataaacgctgaagattgaaaatatcagtcttcagcgttttattttatctgatctcgccggtttagtaggatgcgacgagcgcgtcagaggcggaaagctcaaccgctgcgtctccgatcgggagccgcgtatcggtggggaaggtgaccgccgatgcggcaggcaccttgaccgcgacgtgcctgccggcgtaggcggtccagccgctgccgttcaactttaccaggcgctgggtctggctggacgtcgagcccgaaccgtccgcactttcgccggtgacagttgtcgcctgattaaagatcagcacggcgttttgtgacgaactgaactggctggtgagaccgttgtattcgctttgggaaatttcgccgagatcgacctgcagctgggtcatttcctgatcgtagcggtctttggcagacgtggccttcgacgtcgttttgcttgacgaggtgcttgaacttgatttggcgtttgaatccgaatccttcgaggcatcatcgccgctttcgcccttgagcttgttgagcagcgatcggtcggaaatgtcagtgaatgtgatcgcatcgccgatgtccttcggggcgctggtgctgctcatatccttttcgacgatggcgctgccgtcgaccgtgatggacgtgtagctgatggtgttgttcttctttggatcgctcgcgtcgccggacacagcggtgtcgtagatgcgcttgtacgcgcccttgccgccgtctctggcgtagaggctggtttcagccgttcgggcgctggtgctcgaggggagcgtgaccacaccgtcgagcgttttggccttttttccgctcttgtaggtgacattggatcgtcggctcggatgacgtggtctgcggctggcggaccatgagttctgggtggccgtcgccgtcgatatcctgcagcgcgtattggatggattttgagccgtcagtgaccggtgtcatctcgaattcaaattttgagttggtgaaatcataattgccgttgtccacgtcgtcgaggacggtttcgtaggcactcgccattttggcgtcaaagtcactggtcgacgtcttttggctgctggcagatgatccgcatgcggcaagcggcagcgcgagggccaggcataaaaacagagacgcggcggtgcgggggatacgcattttggtattcatcaataacctctctcaatagattaataaaaatggacggaacggcataaatcaaatacgtccgtaaaaaatatctttaaacttactatagcagatggtgagcaaataggggtattagtttacaccgtttataaaatcggatggattgaaacgaaagccgtttaactgcgttttttggtgaaattatcctcccaggacaccgaaacctgatgatttcgtttaaacttaaagtatgataaaataagaaacaagttttatcatttttcaatagagaggagaccggggaaaagaccttttcccgggaaattatatggcagtgggcaacaacgaacgggaagaactgcaccgcgcgatctgggcgattgccgacgagatgcgcggcgcggtggacggctgggatttcaagaattacgtgctcggcgcgatgttttaccgctacatttcggaggatcttgcggcgtacatcgatcagggcgaagaggaagcgggcaatactggctttcattacgcggagatggcggacgcggacgcggaggaagcgcgccaggacttgatcttgaccaaggggtattttatcctgccaagcgatttgtttgtgaatgtctgcgcccgggcggccgacgacgaaaacctcaacgaaaccctcgagggggtgttccgccgaattgagggttcgactgcaggcagcgagtccgagacggatttccgcggccttttcgacgatttcaacgtgaacagcaaccagctcggcggtacggtgaagctgcgcaacaagcggctagtgaagctgctcgaaggggtccgggatatgcagctcgggacgatcaccgaccatggtatcgacgccttcggggacgcctacgagtatctgatgacgatgtacgcgtcgagcgcaggcaaatccgggggcgagtttttcacgccgtcggacgtgtcgattctgctgacgcgcctcggcaccgtggggaagacctcggtcaacaaggtgtacgacccggcgtgcgggtcgggctcgctgctgctcaagtccctcgaccttttgggcatggacggggtgaagcagggctttttcggccaggagatcaacgtgacgacgtacaacctgtgccggatcaatatgtttcttcacggggtgggcttcgaccggttcgacatcgccctcggggacacgctgacggacccgaagcattgggacgacgagcctttcgagctgatcgtctcaaacccgccctattcgattaagtgggagggcaaggacaacccgaccttgatcaacgacccgcggtttgcgccggccggggtgctggcgccgaagagcaaggcggacctggcgtttatcctgcactgcctgtcgtggctttcgccgagcgggacggcgtcgatcgtctgtttcccgggggtgatgtaccggggcggcgcggaaaagaagattcggaaattcctcgtggataacaattacatcgacgcggtgattcagctgccggcgaatctgttcttcggtacgtcgatcgcgacgtgcatcatggtgctgaagaagaaccggcaggatacggggattttgatgatcgacgcgtcgaaggaatttgtaaaggcgacgaataacaaccgtctgtcggacgacaacatcgcccatattgtcgacgcgtttgaaaaacgggaagcggtcgaacatttcgcccacaccgcttcctacgacgaggtggtcgagaatgaatacaatttgtcggtgtcgacgtacgtggaaccggaggacacccgggagcagattgatattcaggcgctgaacgcggagctgaagacccttgtcgcgaaggaggacgagctgcggcgcgcgattgatgcaattgtcgcggagattgaaggtggcggcgatgagtaagctggacgatctgattcgggagtattgcccgtatggggtggcatataagaagcttgaagaaataggcactaacttctatagaggggctggaatcaaacgaattgagataacagaggaaggaatcccctgtgttaggtatggagaaatatatacaacttacaatatttggtttgataaatgcgtttctcatacacaaataaaagataacatgaaaaaacaatatatagaaaaaggagatatattgtttgctattacaggcgaaaatgtcgaagatattgcaaaatcagtcgcttatattggtgaagaaaaatgtcttgtgggtggagatattgttgtaatgaagcataatcaagatcctcgttatttggcttatgctttatcaacaactgatgctcgctttcaaaaagggaagggaaaagtaaaaagtaaagttgttcattctaatattccgtcaattaagaaaataacaattcccgttccgcccttgccggtgcagcgtgaaattgtccggatcttggatcaatacagcgaaaagatgcaggaattgaaagaaacgctggagaaagaaaaagaagatcgggaaaagcagtataaatattatcgggataaaatattaaagtttgattcaggaagaatagaagctttaggaaatgtatgtaacttacaagcaggaaagagtatccctacatctaatatctttgctgaaaaagacagtaatcataatattccatgctttggtgcaaacggtctaagagggtatgtcgcagaatctaatgagtctggtaataaatcattgattgggcgtcaaggagcactgtgtggaaacgtgagttatgcgactggttcgtattatgcaacagaacatgctgtagtcgtttctgatgaggataataactttaatccaagatttttgtatcatttacttgtccatgcaaatttaaatcagtacaaaactgctggagctcaaccgggactttctgtatctagattaaataaagtaaaagtagtagtaccaaaacgagaaattcaagatagaatagcaaatactcttgataatttcgatgctgtttgttccaatttaaaaattaagcttcctgctgagattaatactcggcagaaacagtatgaattttatcgagatcagttattgacatttgctgagaccggaaatagcatcttaacagacagacagacagacagacagacagacagacagacagacagacagacagacagaacttgattaagcttttccagtatacgtttggatatgcaaatgttcgtctggatgaaatcgcaacgattagtcgaggcggaaatttccaaaagaaggattttgcaaaatccggacatcagtgtattcattatggtcaactgtatacgcatttcggtatttacacagatacctgtattgcatttatatctgatgaagtttataaaaaatcaaaaaaagcgttaccaggagatatagtgatggcagttacgagtgaaaatgtagaagacgtgtgttcttgtacagcttggctaggagatgaaataatcgctgttagtggacatacagcgataattcatcaccatcagaatgctaaatatttatcgtattatttccattcttctgcctttttctcacaaaaaatcaagcgggctcatggtacaaaagttattgaagtaacgccaaagtcattattggatattgttatttctattcctagtatagaaaaacaaggtgaaatcgtatcgaaactagataaactttattcactttgttcgagtataattgttggtcttccagcagaaattgaagcgcggcagaagcaatatgcatattatcgggataagctgttggatttcaagccgctggataagcgggcagaatagaggaggcgtacaatggttcagaaaaaggaaaagccgaagggcgtgaagtgcctgagttttcagcagccctacgcgtcgatgatcgcggcgggcatcaaaaccgtggaatgccggtcgcggaaaatcaagacgccggtgaaaaatctcgtggtctgcgcgtcgaaaacggcgaaaatctttccgaaaattgacggcctggtctacggctatgcggtcgggctcgtcgacgtggtcgactgcgtgcccttcgaggaaaaacacctcaagccggcgatgatgtcgcagatgccggacaaagacagcaacgcgtggatcctcgaaaatccacggatgattgtgccccatcccgtcaaggcgtccgcgggcttcttctacacggatttcacgccggaagtcatcgacaccgacctcgaaacctacgagcagatcgtcctgcccctcgcgcacacctccgacgacacggatgcgttcggcgcgatactgtactgtctgttcgaatatcctgaaggattcaggcagatgcttgagctgtagggcgattgctaggcacctatgaaaaacagtacgcatattatcgggataaattgttgaatttcaagccgctggagtcgtaaattcaaaaataataaggaggaaccgcagatgcctgaaaaacaaaatgtagaatggaaagccaaatggaaggacaattacctggcatggctttgcggttttgccaacgcgcagggcggcagactcgtcatcggatgcgacgacgacggtgagatcatcggcgtgtcaaacgcgaaaaaacttatggaagatattcccaataaaatcaaaaacgcgatgggcatcgttgccgaagtcaatctgcacacaaaagatggcaaatccaccatcaccatcgatgtaccgccgtacccggtcggcatttcctataaaggcgtctattattaccgcagcggcgccaccatgcaggtgctcactggcccagcgctggaatcctttcttctaggcaagcgtggtgtatcctgggataatctgcccttcccgtccttcaaaatggaagacgttgatgaccgtgcggttgaccgctttcggaaactggctgccaaacgcgggcgtatcgatccggaacttttaaacgaaccgaaggacgtactgatgaaaaagctgcacctgaccaacggtgattatctgaccaacgcggcgatgctgcttttcgcagaagaccctcaggattggcagcagggcgcctacatcaaaatcggctatttcaagactgacgccgatttgatttatcaggacgaaattcatgggccgctgctcgagcaggttgacaaggcgttggaagtcatctaccttaaatacatgcgcgccaaaatcggctacgaggggatccagcgcgtcgagcggtatttcgtgccggaggccgcgctgcgggaagcgctcttgaacgctgtttgccacaaacagtacgagatgagcgtgccggtgcagatttcggtttacgacgaccggctctatgttgctaatgtcggccgccttcccgttacttggacgaaggagcacctgctcggcaaacacgagtcgatcccgtataatccgaacatcgcaactgtaatgtacgatgccgggtttatcgaaagctggggacgcggggtcgaaaaaattcgaagtgcctgtgcggcgcaaggtatgcctgaaccggaatatacggtgcatcctggggatatcatgatcaaattctccgcgccggaagcgggcgctgttaacctgaaagaccagatgagtgacgtagtgttagataatctaaccgaaaaagaaaagaaaattcttgaacttttacttgaagatccggggtatactatctcgcagcttgcggaatatataaattgtagtcgaaagacgatttctcaacatttaaataaattaaaaaataatggccttgttcaaagagttggatcaaaacgatatggccattgggaaattatattcgataaaaatcaagtaacacaaaatcatgattaaataagggtgattatgaaggtgattttaaaggtgactttagactcataaattcaccttgattgaacatttgcaaatagcaatatttatctaagatgctttaaaatagcggatgttaagaaattctcttatgaccccaatagggtgaataaagggtgattttaaaggtggctttagactttaaaatcacctcgtttcgaattgaacctgtcccaatttagtatgtaaattgaaatgaaaagaaatggagaggcacacatgtcatactttaatatcgtcgccgagaccaacgagaatacggtcgtgaccgaatacaagcccgagcgccaaaccgacaagggctatcagagcgaggccgacctcgaagccgcgttcattgggcacctcgaggagcaggggtacacctatctgccgattcatcaggaagccgacctgatccgcaacctgcgcgcctgcctcgagcgtctcaacggcgtcaccttttccgacgccgagtggaagcgcttcttcaacgcgtccatcgccaacgccaacgacggcatcgtcgaaaagacccgcaaaattcaggtggactaccttcaggaactgacccgggacgacggcacgcacaagaacatccggctcatcgacaagaaaaatatccacaacaaccgccttcaggtcatcaaccagtacgaaaacggcaaggcggagggcgccaaatacgacaaccgctacgacgtcacgattctcgtcaacggcctgccccttgtccacgtcgagctcaagcgccgaggcgtgccgatccgcgaggccttcaatcagatcgagcgctaccagcgcgattccttctgggccggctccgggcttttcgagtacgtccagattttcgtgatctccaacggcacccacacgaaatactacgccaactccacccggaacaacgccatcaaagagcgcggctcggggaagaggaaaaagaccaagaccagcaacagcttcgagttcacgtcctactgggccgacgcgggcaacaccatcatcccggacctgctcgatttcacgcggacgttcttcgcgcgccacacgctgctcaacatcctgacccggtactgcatctttacgaccgaaaacatcctgatgatcatgcgcccgtaccagatcaccgccaccgagcggatactgaaccgcatcgaaatcgccaacaactacaaaaaatacggcaccgtcgccggcggcggctacatctggcacacgaccggctcgggcaaaaccttgacttcgttcaagaccgcgcgcctcgtgaccgagctgccctacatcgacaaggtgctctttgtcgtcgaccgcaaggacctggactaccagaccatgaaggaatacgaccggttcgaaaagggcgcggccgactccaactcgtccaccgccgtgctcgagcgccagatgcgcgatcccgaggtgaaaattatcatcacgaccattcagaagctttccaccttctgcaagaaatacccaaagcacccggcctacaccgcgcacatcgtcatcatcttcgacgaatgccaccgcagccagttcggggacatgcaccagctcatcgtcaagcggtttaaaaaataccacttattcggcttcaccggcacgccgattttcgcggccaacgccggcagccgccggggcaccgacttcacgacggcgcaggccttcggcgaccagctccatacttacaccattgtcgacgccatcaacgaccacaacgtgctgcccttccgggttgactacatcaagaccatggacgaggacgacgccatcaccgacgaacaggtctgggatatcgaccgggagcgggcgttcatggcgccggggcgcatcgaagtcgtcacgcgctatatcctcgaccatttcgaccaaaagacctaccgcggcggccgaacctacgccttcaacgcgttgacgaatattgccgacgtcgccgccgctgggcgcaagaccatcgacgaaatcaagacgccgatgcggctctcggggttcaactcgattttcgccgtggcctccatcgacgcggccaagctttactacagcgaattcaagcgccagatggccgcggacctgtcgaaacagctgcgcgtcgccgtgatctacagctacgccccgaacgaggaagtcagcggcgggctcctcggcgaggaaaattccgaggacacgaagggtctcgaccagagcagccgggatttcctcgagggcgccattgccgactacaacaaaatgttcggcaccaattacgacacctcgggcgaaaaattccaaaattactacaaggacgtgtccctgcggatgaaaaaccgggagctcgacctgctcatcgtcgtcaacatgtttttgaccgggttcgacgcgacgacgctcaacaccctctgggtcgacaaaaacctgaagatgcacggcctgattcaggccttcagccgcaccaaccgtatcctcaactccgtcaagacctttgggaacatcgtctgcttccgcaatctccaaaaacaggtggatgaggccatcgcgcttttcggcgacaaggacgccggcggcgtcgtgctgattcggaaattcaaggattattacgagggcttcgacgaaggcggccggcactacgacggctacaccgagctgatcgacaagctcgtgaaagggttcccgctggacgagccggcgatcaccggggaagcgcggcaaaaggccttcatccggctcttcggcgcgatactgcgcatgcgcaacctgctgtcggcctttgatgagttcacgggacaggagctcctccccgaacgggactttcagaattacgccagccgctatcaggatctgcaggacatctggcggaagcgcgagaagaaagacaagaaggacatcagcgacgacctggtcttcgagaccgagctgatccgccagatcgagatcaacatcgactacatcctgatgctcgtgcagaaataccacgatcagcacggggcggacaaggaaatcctcgtgacgattcggaacgccgtcgacgccagcccgacccttcggagcaagaaggcgctgatcgaacagtttatcggccagctgagcgagacggacaaggacatcgccgacgcgtggcagcgtttcgtcagcgcacacatacgcgaggacatggacgccctcattcaggccgaacgcctcaagcctgagccggccaagcgtttcatgaccgaggccttcagggaaggggaaatcaaggaaaccggcacggcgatcgaccgcatgatgccgccggtcagccgcttcggtcacagcggccgcggggagaagaaacagcgcatcctcgacgcgctccgggatttctttgataaatattcggggatcgtaaacgccgagggccagaacagcggcctgttcgcgtacaaggtgccggaaactcaggatatgccgctcgcggctgaggaaaaagcggtgttagaggttgtgaagagaaagtaaacgaagcggcgcaggcgcaccgtgctgttgacggtgcattgcgaaaaattagaaaaagtcctacagcaccttcagccccacaatcccggcggcgatcatgacaatgtggcagggctcagcgattcgagaaagagccagtccgccgccaatacaccatctgtaaatggactgaaatttacaaagaaaagattgaaataatttgaaattcatgttttgatagaggtaccagaacagccaccgcggccttcaccgcagtgcacaccgtgccggagagaacgctccggcaaaatatacatcctgaaaatgacaggagaagcagataaaaatgaaaacctacgaaatttcaccggatacacggtcttttttggagaacattccgattccgctggcggtctaccagtacgtcgacgaccagatcagggcccttttggtctcaaaggcgtatcttaaacttttcgggtacgacagcggacaggaggccgtctacggcctgggcaccaacttgtaccgcaacgtccatcccgaagacatcgcccggatggaaaaatacgcttacaattttgcgacccaggaagacggctacgacatcctgttcagaaacaaaagggaagatcagtccaagtatcatatcattcacgccacgggcagacacatctccgtcgacggtgtgaatctggcgtttatcacctacaccgacgagacggccggcaccggaaacgacagcatagtcaaggcggtgctgaccgacgtgtctgaccaatttgcggcctcggacagcacggaattcgcgaagcattacgacgcgctgaccggccttcagaacatgccccgtttcctcgatcacgccatggccgggatcgagaagatctgggcccagggcggggaaccggtgattctgtatttcaatctgcgccacctgaagcagtacaacagccggtacggcttcaaggccggggaccagcagatctgcaccctggccgaatgcatcgccgccgtattcggaagagaacgggcctcccggtttgaaagcgaccattttgtcgtctacgcactgaaggatcaggtcgaatccaagctgacgaccctgttttcgcagatggcggcccagggcgaaaacaatctgcccgtcaaagtcggtattttcaaatttgaaaaggacggcacccggctgaccgacgcctgcgacaaggcgaggctcgcctgcgaatctgtaatgtcgacacctgtctccacctttgtctggttcgatgacaacatccagaagcagaacacattaaaattctacatcatcaggaatttcgaaaaagcgatggaaaagggctggatccaggtctggtatcagcccgtggtgcgcaccatgatccagaccgtgtgcagtgccgaggcgctggtgcggtggatcgatcccgaatacggcatgatttccccgggccagtttgtgcccatcctcgaggagaccggccagatctacaagatggatctctacgtcttcgagcaggcctgccgggattacaagcacttggtaaaaaaaggggatgatgcgatcccggtctcggtgaatctgtcccgaaaggattttctgcacgacgatctgcccgagatcatcgacggcatctcgcggaagtacggcgtcccgagggaattcaccaacctggaaatcaccgagagcgcctttgtcaaaaatatcgacaaggtcgcgccttccattaagcgcttccacgagctgggctacaaggtgtggatggacgacttcggcaccgggtattcgtcgctgggtgtccttaaaaattacgccttcgatgagctcaagctcgacatgtccttcctcaaggacttcgacgaaaaggccaagaccattatcaccgccatcgtcaatatggccaaggcactcaatctctcgacactggcggaaggggtcgagacgaaaaagcagtttttattcttaagagaaatcggatgtgaaaagattcagggctattatttcagcaagccgatgcccatagaagaactcgccccgtattttgaaagcaggggattggctgtggagccgacaaaatggcgggcttattttacgaagctgagccgcaccgtctaccccacggatgcgcccctctgtttggtggacgatgacggggtcaagatgaagattctcttcgccaaccaggcctacaaggcggtgttatcccgggaccatgtgacggatctggaagattgggagcgcaagctcaacaccccgggggatcccattcacattttccacaggcaatacgccgatcagcagctcagaaagctgagcggcccccagaccacggcctatccctcaggcgaccactacatgcagctcaccgggactgtggccgtcagacagggggaccactatctctacagcatgcagatccagtacgtcgccatcgacgtcaaaaacatgcagcaggttcagttcgagaccatgagcgatctgtactacctgtgcaacgacatcgccatctacgacctggcgcacaacacggtagagggggttaaatcctctctgtctgaccagcccatgggcgtgggcgttaaactgaaagatttggcttcagtgatcaatgcctggacaaagaattactgctatctgcccgatcaggagcgctttgccgcgttcatggaggtgtcgacgctgaaatcccgcatggaacaaaatgccagccatgcgctcaccgggctgtttcgaagcatcaccgcatccggcgcgtaccgctggatgctccacatggttgcgccggtgcaacgctcggattataaccgggccctgcacgtcaccttcgatgccggccttgcggaagcggacctcgtcaagcttgtcccggctttaagcggcgcgattgccgatcagaagcgcggggagatcccaacggaggtgctctggagaaatatgatactgaattcaaagcgcatgattttctggaaggacgaccaaaggcggttcctcggcgcgagccggagcttcctcaactatttcggcctgcatgacgagtcggagattatcggcaaaaccgacgaagacatgggctggcacatcgatccgaagccctttaaaaaggacgaggaggctgtccttaagaccggaaaaaagtgctatatgagaagggggaagtgcatcgtcaacggcacgaaccgcgacattctcgcgagcaaaattccggtgtaccgagacggtaaaatcgtcggtcttctgggaaatgtgaccgacgcggacgcgacgcagaagttcctcaacagggaaaaggtgctcacgtccgtcgacccggtgaccggcctggccaacacccgaggggtgtcggacggcgtttatgcctacttgtgcgagcgctggcacagcggcatcgatttcgccatcatggaagtgaccgtgcccgaatacgacgagattgtgaagctttacggtaaaagctccggggacgcgctgctcaaaaacgtcggggcggctctgagagactgcgccggcaccggatgcgtgatcggcagagcgcagggcaacttgttcttcgtcgtgatggatttcgacacgaaggaggacgtgcgcaacgtggcccggaagatccgcgccgccgtcgaatcgatgcgtcaggccggccagtggagcggcaactgcagtgtcaaaatcaatgtgtcctattccgatgcgtccagcaaggacagaagcgcctatatcggcggcttgtccgggatgattttgaacagcaaagattgcgagacactctagaagaaaggaggcgtgctcgtgcgaaatagaatcaaaaggatcgtgcgatcattttacaaagcatatgacagaaccgatctggacattaagatgcgggatccgaggctgaggatcgatttttattatcagaatctgtccctcagcgtgatcgcagcgtttttgatttgcctgctcgccgtgatcggcctgatcgggacgttttcgcccttttcaagtggctacattctcccgcagatcaatgccacgaacgcctacatcgtcatcttagcggtcaacctcgcattcatggtgcgtctcggcgcagagctggaccatttccacgagcgcaaagacgccgcgaaacgggccgtgcgcgttttcaactggtttaccggaatcgacatgatcatggccatcatttccatcttctccacccaggcggattccagctttttcttcgagtacatcctcatcacgagtatcatcttcctcgtgcccaatgcggaggtccgcacccaggtgcgcaacaccgtcatcaacatcgccgcgatggctttggttctggccgctgtgcgccacacagtggcttggcaggatgccgtggatatcgccatccttcacctgctgtgcggcctggtcaattggtttcggctgctgaacttcctgcgcgctgaaaaagccaagtttgcacttgaaaaaaagacagacgagttttatcaggacagccgcaccgacggcctgacggggcttttgaaccggacggcgctgcgcagcgattttccggatttcatcggccagaagctctgcgtcgcgctggtggatttggatcatttcaaacagtacaacgatacctacggccacgcctacggtgacaaggtgctgatcaaaacgagcggcagcatgaagcgcgtgttcaaaggcgaagcagaccattgctaccgctacggcggggacgaattgctcatcatttccgcggagccggaggtgaatcgatttgcccaaaagctgaatgtctttaaggcagactgcactgaggagcgcggcggcgtgcgcgtgacctgcagcatcggctacgcggcggggacaccccacagcgaggccgagctgagggcctttatccagaccgcagacaattacctctaccgcgcgaaaagcgaaggcaccggcgccatcgaaggggacaggcccgagtcccgccaggggccggtgtcttcggcccatcgggcaaagcggaattcatccgaccttcaccagacagaaaatgaaagatcaaaataggagtgactatgattgcaagtgtgttagccggggtgattttcatcctgatgtttatcctcatcatttgggacaagtttgagcgccatctcgtgacgctggcctgcggggcggcgaccctcgtgctcgtgttcggcatcgcgatgcacagcggccgcgcagtgatggagaccctgaatctgaaaagtattttcacgctgggcttctggtacgaaaccagcgcggcggaagaagaagccgccgggatcaactgggcgacgattctgtttttggccgggatgatggtcatggtcgaggggatggcccgggccgggttcttccgctggctgtgcatgacgatcgcgaaggcggtgcattacaaggtcatgtcgatctttctgacctttatggtcatgtccttcgtgctcgcgatgttcatcgacagcatcacggtgattctgtttctcgccgcagtcacggtagaactggcccagctgctcaaattcgatccagtgccgatgatattgtcggaaatcttctgcgccaacctcggcggttcggcgacgatgagcggcgacccgccgaacatcatcatcgggacctcgctgaaatacacgttcacggatttcatcaccaacaccgggctcatcgccctgatttcgctggtcgtcatcgtgatttatttctatttctgctttagaaaggagttatccggtgccggcgagatcgattcggccgaggcagcgcggctctcgccgaaggatgcgattaaaagccggcgggacttcatcgtcagcacggtcatcttccttgccgcggtggtaatgctcatcacccacgcccagacggggctgaccgtcgccttcatcggcgcctttatcgcgctcgtcacgctgattgccgccggccgggacgccgtcgaaatcctgaagcgggtggattacaagacgcttttgtttttcatcgggttgttcctcgtcgtcggcggccttgaagaaacgggccttctggaaatgttcgcgagcgtcatcgggcgcatcagcggcggcaacatggtggtcatggtcgcgatcatcatctggggctcggcaatttgcagcgcctttgtcgacaacattccttttgcggcgacgatgattccggtgatccggaccctggccgcggccaccggcgccgatttgtcgattctcgcctggaccctggccatggggacggacatcggcggcagcgccacacccatcggcgcgtcggccaatgtggtcggcacgtccattgccgcccgggaaggccacccgatcagctggaaaaaatacctgaaatcggcggtgccggcgacggtaatcgtcattttgatttcgatggtgtgcatctatctgcgctacctgtaaaataaaaggggggagagtatggacaaacaactgatgatttcgctggggcgcgagttcggaagcggcggccacgtcatcgcggagaagctggcggacaactacggcattgcgctgtacgacaagaacattctgcgggaactcgccgcggagaaggacgtcggtgagaaaaacctcaggcggtacgacgagcggcccaaaaacccgttattgtcgcgcaccgtccgaggctttacgaactcgccggaggaaaacatcgcccggatgcagtttgactttatccgcgagcgcgccgacgccggggaatcctttgtgatcgtcgggcggtgcgccgagagcgtcctacggggacggcctcatttgatcacgatctttgtcatgggggacatggatcagaaaatacttcggacgatggaaaccgaaaacctgtctgaggaagaagcgaaaaagcgggtggaacaggtgagccggcagcgcaaggcctaccacaaccactactgcaaggaaaagtggggggatgcccgcaactacgacctgacgatcaacagcagccgcctgggcatcgagggcacgacctgcgtgctgatggattacatcgacgcgagacgcgcggccgacaattgggaataaaataagaaaaggagacaatcaatgaaacgtgtactcgccttaatcagtgaagattttgaagatttggaagtgtggtatccggtactcagactgcgggaggccgacgtcgaggtcgtcttcgcagcggaaaagccggggctgtaccacggcaaatacggggtgccctgcgaggtcgagacctcctttaacgatgtggacgccaaggatttcgacggactgctcgtgcccgggggctgggcgccggacaagctgcgccgtttcccgaaggtgctggacctcgtcagagaaatgaacctcgaagggaaagccatcggcgaaatctgccacgccggctgggtgctggcctccgcgggcatccttaaagggcgccgcgtcaccagcacgccgggcatcaaggacgacatgcgcaacgccggtgccgaatgggtcgacaaagcctgcgtcatcgacggcaacatcgtctccggccgacgcccgccggatctgcccgaatacgccgtggccttcctcgacgtgttaaaccggtaaggtgcgcaagaccgcttcggcggtctttttttgtgatttgaggttgtgaaccaaataaaaaaccggcagggcttacccctgccggcagaatcatctggtgtccacggggggagtcgaacccccggcctaccgcttaggaggcggtcgctctatccatctgagctacgtagacttacatgttttcttattataatctttttcatctatgaaatcaaggtgcgggtggctgagaaaaaatagggtcaagttattatttatcttcattattatcattattttctattcaaacgtcacgggtaacgttataatagtacagtagtttagaattgtaaaaaagaagaggaaaaaagaattgaagcggaaagaaggagaatccaaactcaaaggcactgggatgatcgtgctgatcggggtggtgattgcggccctcgtgttaatcggtatcacgatttatcacgcggtgcagatttaccgcgtcagccggtacaccgacgtcaaggtcgacgggacagttaaaacgacttcggggaaaacctcgaaccgtctgctccaaacctaccagaaaagcgcgccggcggacgtccttcagggcgatgtgaacgccggctcaaaatcggtgtgcatcgtcttttcggggctcaccaacgacgagacgatgaacgaaaaggttttaaaaatcgtcaaggaccacaaaattaacgcggcttttgccgtcccggccattctggtgtgctacccgtcaagaggacactgaataattaacaatttttgtaccgccagtcgaacaatcgactggcggtattcttatgctgcagcatagaagttttcatgatattcctcagggtggctaagttggagtttcctctgtatgcgttctttgttgtagtagttgtatatgatctattggtttgacagattcgcttttgaaagaagtttttacataatacatttctcgttttggattccccagaagccttccatagggccattatcaatacaatgggccactggacatgctctgtttatatgatgtttcttaagctttaagaaaatgtctactcgtatattgacagcctctgtcactgtgaaaacggatgcgcatctggtcaagagtcacagcttcatcaaaagtattcatacaagctgattatcattatgttcactgatttataagccacgatctacggtcatacagatctagaaatgcacttaaatatatcttgtggacttctacaccgatgtaatatttgaatctgtcacatctgtcagccatttttcattcggggcatctgcgtgaaagttccggttaagataatttttagcaatgtgagcaggatccgggctgtttctagtacagctcttcggtttccatttgattgtagacggatctttcgctgcggcagatcctcaggattcgtttatcattgacagcgataccgtgatttttgtccagttcgtctctgattcgtcgatatcccatgtccgggtgttgctcatggatgtacttgatcttttcggcaatcttcttgttatatttctcactaaaactgacaggatgattcaaccagcgatagtaagcgctgcgtgaaaggtttaaatatgaacagagtctttgcacgggatagtgcttttcttcagacagttccttgatcgcctgatatttgtacaaatgtcgagtcagagagagcgatctttttctctaactctctgacttttttaacagatcattctccatttgaagatttcggtttttgcgtctagttctgcaatctgttccgcaattcctcttcaggggtcctagaaggttgcgtaccggcgcgatggccacgcgatcttccaaaccggcagatcccatcttctcataacgcagcacccagttacgtaccatgctaggaacaattatattttagtgccatgccaccataattcttatcactagcaaggcaatcctttcgatttcaaggcgttcttccgggttgtttttctagcttttctcatgtagcttccacctccgcttgtgcgtgattgaatatcccatgagtattatacgctttatccatttacgtagttgagttctgatcttaagccatacgaaaagctatttattaaggatccttctccgcaaagataggcattaacagcggccagtttcagctctttcgaataatacttgttgctcgatttgttcaacagtccactaggaccttcgttttgtaaaattgacccagtctttaaaggtgcatagctttttagtccggttgtcttgccgcttccacacagactatcacctcgcagataactttcaactaccgatacttttacggccggatcaatcttgctttttcgtgacatagaaatacccccaagtaggtttttatattttactgtcctacttaggggtagcatatcattcacgctcgggacaacagcgagttcttaaaaaaggtcaaaaagagcggctgtaccgtgatcagcggcggcctcaacggggaagaacagaacaccaagaaaatcaagaccctgtgcggcgatttgtacaaatcccggcagatcctaaacgaagaaaccggcggcagcattcaaaccatttactgcccgggcatgaagggcagcgcctcgacgctgaaggctgtcgcggcgggcggttatcaacaaatggtgctgccggcggatgaagacttgatcaaagccagcacctttgcggacagcggcgaggcggcggcctacgtgcagaacttgaccggcgagcgcattattttgatcagccttgacggcaaggcagacccagtcacgcaggaaccgacggtcgaaccggcgacgccggccatcgataaacaggaagatttggacgacggcaaggcgaaggccgaggagactgcgacaatcgaccaggtgaccaaatggattttggattcgctgagtgtgcagaatgtggacattcagccgttaagcagcttaaaggcgcagaaggcctctgactttatcggcgcaaatcttcaagacaattcggatcaggccgtcttgtaccgcagcgcgctgaccaacgaaaaacgggtggcgctgtgcgtgcgcggtattggcacccgcgcccagtacgaaaagctgaagaagctgttgaagcgctacaaggccgacgccgcctttttcgtgatcgccgccacggacgggaatttgaaaaaacagattcgagcggacggctacgcgctggaaaacgcgggcaagactggaagcgcctccggcgatgtgcacaaaatgtatcaggaaatcgacggcggcgcccaatcgctgcagaaaattggcgccaatccgggggcatatctggtgtacgaaccaaaatacctgtcccagatccgcgcggcctgttttgcagccggacagattccggtggagccgcagaatccaaagcaaatcgcaaagggcgccttttatctctacgacgcccaggatatatctgacattgagaagctgttgaagacggctaagcgcgaagggtatcacgtcgacagcgtgggcgacctcatcgacagcagcggcacgatcccggcattgtctaatgcggatttaaccaagcgcaggaatgccaacgccgggaaaagcgccaaatacacgcagacggtgatgacgacggaaaaagccctcgggctgaccttcggcaatttaagtaatcaggctgtggatttggacgtggccaaccggctcaaaagcagaggagcgaagggcacgttcttcgcgacctttaacgaattgcagacggattcggacactgtcgaaaagctgaccgcgatggggaacgaaatcggcattgcctacaacgaaaacaccggctattcggccgattacgacggcatggcccgttacctccacgattgcctgacctatacaaagtggcggtacgacatgaagccgaaggttatcatgctgccggaggactgcgcgaaaaacaaagggatgttggaggcggttcacgcctaccatttgaaggcggttggcgcctcaagaagcatcatcacgagcgggacggaaaacacgaccgatgccacattgcctcaggttttggggcagctcaagtcggttcggtttacgcgaggcggcctggaatacatcaatttgggctattacgtcaacgaccagaacaaacaaatcggcgacaagaccatcatgggcaatttgatcgatcaggtgatcgatcagcacgtcgacgccatcgcttttgtttcaccgacgaccaaccagattgaggacggcagccgctaccggcttaagacagtgagcagcctgttcgcgtcgaagaaggtgtatcgcctttctgcgaagaaacagaccgcggtcaccagtcataaagacgtgctgggcaggatgggcagttccaaaaaacagtttgcgtacatgaaaaaccactacgtcggcagcaatttcgtcgtcaacgctaagaagctgccaggcttcaatgccggtgaaattagacagctggacaaggtcggccgcctgaccgacgacagggtgctgtttttgacttttgacgactggggcactgaccagtcgatcaataagattctctacgtgctcaaaaaacatcacgtcaaagccactttcttcgtcttgacccagcacgtcgacgagaatcccaatctgctccggtcgatcgctatggacggccacgaaatcgcttgccattccaatacccacgtgcccctttctgacgccaacgcagattacacccagtacacgtcgctgacaaagaaagaacaacaatcgatgcgcaaggatttggtcacgtcctacaacaaattgaatcactacgttggggacgtcaaagtcggcggcaaaaaggcgctgtcccaagatttcagaccgccgaccttggcggtcagcaaggcggggctctacgaggtgttcgacgtgggctttaactacgcgatttcaggcgacgtgtcgacgaacgactacaagcgcacggatctcaacgcctacctgaacgcgatgcgcaacgggtcgccatcagacgaagatgactttaaagtaaaaaacggcagcgtgatcgtcatgcacatgacggaaaacgcgaaatacaccgcgcagatgctggacgaaatgattccgcaatggcagcaggagggctaccattttgcgcgggtggacgattacgtcaatcagtttaaaccaagaggaaagcgggagagaaattgaaaaaagacaatcaagaagaggtgctgacgcagatcaaaaaagaccgccgactgctctcccacgtgccagaccccacgggtgagcggtcggcgtcggatcggcgcggctggaaaggccaagggcagatcacggacgaaaacgcgtggatcgcgcagcaaaagaagggtatccgctatctcggcgatttcaaggtgagggtgattctgagcggcggcacggcattagaagggcggagcgtcgacatctcggacacgggcattttgatccgcttccctgaacaaaaggactacgaatgggtcaaaaaagaaaaacaggttaccctgcagttcaaggtgccgccgggcgccatgccggaagggcacgagatgaagttcaagatcccggcctcgaggattcggcagattgaagacgcccagcagatcgccttccagttcacggaagacctccagacctttaagcagcggcatcgggaccgctacctgctgctgatgtccgcggccagtctgggactggtcagcctgtgcgtggtgctgatgcgcacggagtcggtgatctacttcaaatacaacgcggttttgtacatgtactccttgatcgcggcgatgtttctgctatcaagatatttcttcggcatgctgtacaagccggtgcccatcgatccggacttcacgccgtcggtgactgtcatcattccgtgcttcaacgaagaggaatggattcagaccacgatcttgtcctgcttcgatcaggattacccgtcggacaagctaaaggtcattgtggtagacgactgctcgaccgaccactcggttgaaaaaattaaggaaatcgtcgacgagctgaccgaagaggagggcgctcggtacgacgtggcccatcggctcaagtattacgtccagccgcaaaacgccggcaagcgcgcggcgctggtgcgcggggttgaaaacaccgacaccgatttggtcatgtttgtagacagcgactcctttctcgacccatacgcggtcagaaatctcgtgcagccctttaaggaaccgaaaatgggcggctgcgccggccgctgcgacgtggccaatacctacaccaattccctgacgaagatgcagtcggtgcggtattacatcgcctttcggatcatgaaggcggccgaaggctatttcgacgcggtgacctgtttgagcgggccgctgtcctgctaccgccgggaaattgtcatgcactacaaggaggcgtggatcaatcagcggttccttggccacaaggcgaccttcggtgacgaccgggcgatgaccaattttgtgctccgccatcaccaatgcacctaccaggatacggccgtctgctcgaccatcgtgcctaaggcccatcgggtctttttgaaacagcagatgcggtggaagcgctcgtggctcagagagtcgctgagtgcggggaccttcatgtggcgcaaggagccctttgcgatgatcaatttctacatcgggctggtggtgccgatgctggcgccggctgttgtggtttacaacctgatgattgtgcccttcacccagcatattttcccgaagaccttcttgatggggctgctgttgatgtccttgatgatgacgatcgcccagctgtttttcagaaagagcagcacctggctgtttggcttctggttctgcgtgtattacgaattggtgctgctgtggcagatgccgatcgcgtggttcactttctggaagtccacctggggcactcggatgacgccgagcgacgtgaaggccaaggcgaagcgcgacgaaaagaaaaagaaaaaaataaaaaagagagagcggaaataggcatcatgaagcgtaaaaaaaggaaatttctattttattcgatcgaaacgcgcaaggatgtcgtcaaaatcctgcggacctgcctggaaattttgatcatcgtccttgtggcctggatagtctcgcgggcgctgatcgtctctaaaacttacaagccctacgacaaaacagacccaaagatcgtgtccggaaaggaccatggcttcatcgcgctgtcttacttcggcgtcgcccggaccggcaccagccagctgattgccttgaaacggctcgatgaagagctgacggcgctgaaaaagctcggctacgtgacggtgacccaggaggatgtggaaaattactattactacggcaagcctctgccggacaaagccgtgtttctcttgtttgaggacggccggaaggacacggtgctcttcacggagaagctcctcgaaaagctcaacgacaaagccacgatcttgacctacgccgaaaaatttaaacacgacgacgaaaaattcgtctcgccgaaagatttgaagaaattggaagcggagggcttttgggagctggggaccaacggctaccggctgtcgtacatcaacaccttcgaccgttacaaccgctttttgggtcagatggattcccgggaatttgtcgaaatcaatcaattcatcgaccgggattacaaccattatttgatggactacatccgggataaggaccgcgttccgacggagagcacggatgaaatgaatcaccgcatcacccgggactacgacctgatggaaaagatttacaaaaagcgggtcggctacgtgcccgatctctactgcctgatgcactctaatacgggccgttatggcaacaaccccagcgtgtctgaggcgaacgcggaaaatttggaaggcctgttcaaaatgaacatcaaccgggaaggcttttcctacaacaataaaaagtcgtccatttacgatttgacgcgtttggaacctcagtcgtggtggtacaccaaccatctgttgatgcgcatccgagacgatctgcccaaaaaagataaacacaacattgtcttcgaaaaaggtgacaaaaagggcttttcgaaatggcgtctggtgaagggagctgccgagtttaagcacaatttgatcgcgctgacctcggaatcccgctcgaagggtgtgttgaccctgaagaagacgaagtgtcaggatatgcgcctcagctgccagctgaagggcaacaaaatcggcggccagacgatttatatgcgcaccggcggcgcctataatgcgaagcgcgccttcaagcgctacctgtcggtatcggttgaaaacaacgtgctgtacgtcagagaacgaggcaaaaacggtgtgcgcacgctgctgacccaggacatgtacaagctgcacgacacccatccagtttctatacccgaggacagtcaggacgcccatgtggccgagctcaaggtgcgcggcaagttttcgagagacaacctgaccgcgggcttgtatcggctcaaggcttcgcgggtggcgcgggaaaaggtgccgagcgtcaaagacggcgcgaaggaatacgtaccggagcttcaaatcagcgatcccggcgacgttaaggtcgaagtcaccttgcgggggaaccagatggcaatccgcgtggacaatatcgagctggctgacgacctccgcgtttcggatacggcaaacggcggcatcgcgttggaaagcaagtttggcggctttcagaagagccagcggaacatcgccgacgacgtgtacgacggcgcttttgaaaatctgaccatttcgccggtttctccgggggaaccttattacgactacacctatcacggctttgcgaagctgggccacggcatcagcctcgcctggaacgcgacggtgaattggtttatcgatcatttgtaaagaggagatgttgaaattagaggagtgagcatgaaatcaacgagaaatcataagaagcgtgcaaagatcaaaaggtgcgccgcggcggcattggccgccgccctgtgtttgatgacccttggcgcctgcggcagcaaaagtgagacgacgaccacgtccgcagcgaccgggcgccaggaacagacccaggaaatcaagagtctgagccgcaatggcagaaccctcggaacgtggactgtgtactgggatggcggcggcgcggtgcggacccttgcgaaaaacgccggccgcatcgacagcgtgggcgtgttcgcggccgattacccggacggcaaaaccctgacgctgcccgaaaaatcggccagtacggtcggtcagatcaaggcgtccgagacgttaaagcagatgccggtgtatctgtctgttgtcaacgacacgaaggatgaagaaaagagcgtcactttgctcaatcatttgatcgggacgtcgagtcaggccgaggcgtcggcgaacgccattgtggatatggccaaaagctacaattgtgacggggtcgagatcgactttgaaaaaatccgaaaggatacggcactttgggcgcggttcgtcgattttgaaaaccgtctgatcgctgagtgcaatgaaaacggcttgaaactgcgcatcgtgctggaaacgctgacgccggtggaaagcatcaatctgcccactggaccggaatacgtggtgatgtgctacaacctttacggcaatggcacaaagccgggacccaaggcagaccgcgcatttttgaaaaagactgcaggccgatttgaaaagctcggcaacgtgacctacgcgctggccaacggcggcttcaatttcaagggttcgcagcaggctgaggcggtgacggcggacgaagcggccgcgctgatgaaaaagcacgacgtgaagccgaagcgggacaaggacagcggggcgctgtactttaagtacggcagccacacggtgtggtacgccgatgcgaaaacgctgtcgacctgggcagagaccctggatcaggcggccaaccgaaaagtgccggtcgccctctggcggctttgagtgttttgattgaaatggagagggaatcgtctatgaatctatacgaaaaactgcggcggcgtcaaacccgcctggcggtggtcggattgggctatgtcgggatgccgatcgcgctggcctacgcggccaagggcatcgatgtcgtcggctttgacatcaatgcggaaaaaatcgacttgtacaaaaggggcatcgatccgaccgatgaggtcggcaatcgtgcgatcgccgagacttcggtgcgatttacagctaatgagatagacctgcgctcggcccaattctttattgtcgcggtgccgacaccgatcaatttagaccacacgccggacttgacgccagtcaaggcggcggcggagctggtcggccgcaacctgagctgcgggtcggtcgtcgtgttcgaatccaccgtgtatcccggcgtcacggagaacatctgtacgccgatcatcgagactcagtcggggctgaaatgtggaagtgaatggaaaatcggctacagtccggagcgcatcaatccaggcgacaaggtgcaccgccttgcgaatattaaaaaaattgtatccggcatggacgccgacgctctccgcacgatcgaacaggtttacggcatcgtcatcgaagcggggacttatgcggtttccaatatcaagacggccgaggccgtgaaagtggtcgaaaacagccagcgggatatcaacatcgccttcatgaacgagctggcgatggtgttcgatcggatggggattgacaccaacgaggtggtcgacgggatgaacacaaagtggaacgccctgggcttcaggcctgggctggtcggcggccactgcatcggggtcgacccttattatttcatttacgaggcggaaaagctcggctaccacagccagattgtgctggctggccgggaggtcaacgacgggatggcggcctttgtcgcgcaggcggccattaaacaggcggttctcgccgggctggcggtcaggaagtgccgattcgtgattttgggcttgaccttcaaggaaaactgcccggacatccgcaacagcaaggtgaaggacattgtcaaagagctgcagcagtacggcgtcgaacccctcgtctgcgatccttgggcggatcccgaggcagcgtggcgcgagtacggcgtgacgctgacgccgctggaagcggtcaaagacgcggactgcatcatcgcggcggtggcccacaatgaattcaaagccctcgatgtcgaggctttgaacaaaatgtacaagcccggcggcgaaaagatcttaattgacgtcaaaggtatctacgacagcaaagcgctgacggacgtgggctttagaatttggcggttgtgatttggcgagctgccgctcctgacaatcaacaccaaacaaaacaggctggaagtacagataaatctgcggctttcagtctattttttatgcgacagatcgcgtggattcaggatggaatcaagcacagcaaatcccacttgcgcttttaaaagaaatgcgctacaatattatcgacatatgtcggaaatgaggtgaggatgtggcaagacccacgaaatgcagacggatctgcaggcggccgggctgggcgcggtttgcgccggacggggaaagccccgaaggcgagatcgtgctgaccctggacgaatacgaggccattcggctgatcgaccttgagggccgaacccacgccgaatgtgcgcagcagatgggcatttcccgaacgacagtgacggagatttacgagagtgcccgtcataaaatcgccgaggccatcgtcggcggcatgacgctgaccatcgacggcggccacgtcaaattgtgcgacgggacggccctcggctgctgcggccggcctcattgttggagagcagatactcggctaattaaaaagatcaagcgaaaggaagacaatcagatgagaatagcggtaacgtacgacaacggccagatttttcagcatttcggccggacggaggcctttaaggtttacgacgtcgaggacggcaggatagtcaacgcccaggttgtgggcaccggcggacagggccacggcgcgctggccgggcttttggcccagttggatgcggacgtgctgatctgcggcggcattggcggcggcgcgcagaacgcactggcccagatggggattcagctttacggcggcgtttcaggtgacgcggacgcggcggtggacgctctgatcaagggtgagctcagctacaatccggacgtgcactgcgatcaccacggcgaaggccaccaatgtgggcatcatcacggcggtggtgagggccatcactgcgggcaccatcaccacggcggcggtgaaggccatcactgtgggcatcatcaccaccacgctgacggcgatggtcacacctgctgccactgatacagcgcacaagacagctctgcggggctgtctttttttgcgccgttttttcttgaattttaaaatcaactgtgatagactagccggaaaatttatacaaaaccgaagaagaggcgaataaaaatgaaaaatataaagaaaatcggatggatcgggacgggcgtcatgggcgcgccgatggccggtcggctgatggacgcgggctacaccctgacggtctacaacagaacccaggccaaggcggaagcgctgattcaaaagggcgcgcgctgggcggacagcccgtcggtatgcgccgtgggccaggacgtggtcttcacgatggttggcttcccgaaggacgtcgaagaagtctatttcgggaccgatgacgacgcgggcgcgatcgccgcggcggacgagggcacgatcttcgtcgacatgacaacgactcggccgagcctgtcggtgaaaattgccgaagccgcaggcaagcgcggctgtgcggcggtggacgccccggtttccggcggggatgtcggcgcccagaacggcacgctgtcgatcatggccggtggagacgcggacgcggttgaagccgtccgtccggtgctcgcgcacctgggcacgcagattctgctggaaggcggcccgggcaccggccagcacacgaagatggccaaccagatcgcgctggccggcacggtgaccggcgtctgcgaagcggtgaaatacggccagaccgtcggcctcgacgtcgacaagatgctcaagagcatcggtggcggcgcggcgggcagctggcagatgaccaacctcgggccgaaaatggcggccggcgatttcgcgccgggctttttcgtcaagcatctgatcaaggacttgtccattgccagcgacgaagcggaagaccgggaactgcacctcgaggtgctcaacaccgtgctgtcgatgtacaaggatctgcgccgccagggcatgggcgagctcggcacccaggcgatcatcgcctattacgacgccaagggcgggaaagtggatttcgatgaataaggaacagcgccgccgcctgctcttgattttcgggctgatcctggcggcgattctcgtgccgctgattctcggcatcgtcggcatcgtcctgatccgctcgaccaaggtgctcacggtgctcgtcgtcgtgctgattgcggcggcagccgtcatcgcctggcggggcggcgtcggccgaagcgacagagagcgcggcattcggcgcgaagaagaaaaagaaaagacagaccacaacggacgataagtgtgcatatccgtcatcggcagggccggtggcggattttttataatatttgacataaattcagggtaaaaatttaacaagcggttgattatctcccagtcttcctataatatataaaaccaataggtttaataaatagttattgctacagctgaaaaacgacaaacgaagaggagaatcacatgagtaagcatcaacatcatcatccgcacatttttgatccgaaaaacgaggctgaatatttaaagggccattcccacgccaagggagaccacagccatcgtccgatcattttattcgataaaaacggaattccgaaggtggtggatcacgaacacgatcacacgacggacgccgattatcaggacgactacatgaaggccgtcgcggcgtacaagaaaaccttcccggacaaggcacgccagatggaagaaacgccggacccggccgttcgggaaatggtgcgccggatggacgacctcggcatcgactgcgtctttgaccggttcgacgcccaggagccccagtgcaatttcggcatcgcggggatctgctgcaagaactgcctgatggggccgtgccggatcacgccgaaagcgccgaagggcgtctgcggcgcggacgcggacttgatcgtcgcgcgcaacctctgccgcatggccgcggccggcgtcgcccagcacgggatgcacgcccgcgaagtcattttgaatttgatgtgggcagcggaaggcaagctcgacgtgccgatcgaaggggaatacaaaattaaggcgacggcggaacagttcggcatcaagacgaaaaaccgtcagctgaaaaacatcacgatcgatctctgcaaggtgctcctcgacgatttgtcgacgccttatccgggccagtacaagacgatcgcggcctgcgcgccgccggaacgtcagaaggtctggcaggatctggacatcatcccggtcagcgcttaccacgaagcctttgaatccaaccacatcaccggcgtcggcgtcaacggcgactggaagagcgtcatgcagcagatgctgcgggacggcctggcctttaccttcagcacggtgctcgggacgtccatcgcgacggacgggctgctgggcatcggcgaccgcgcgacggcgaaggtcaacgtcggagcgttaaaaaaggataccgtcaacatcgcggtccacggtcacctgccgatgctggttcgggaaatcgtgcgcaccggtcagactcagaaattcatcgacaaggccaaggcggccggcgccaagggcatccagttctacgggatctgctgctccgggctttcggccatgtaccgctacgacggggtcatcccgctgtccaacgcgatcagcgcggaaatggtcatcaccaccggcgctctcgacctttgggtggccgatgtccaggaagtctacccggcgatcatggacgtggcccactgcttcaagacgacggtcgtcacgacccacgattccggccggctcccgggcgcggaacacatcggctacgaccatcatcacaccaatatcgccgaaacgaaggccattgcggaaaaaatcgtcgaccgggcgatcgaaagctttaagaaccgcagagacgtgccggtgtcgatcccgaattacgaaatcacggcggacgtcggcttctcggtggaatatttccagaaggccttcggcggcctgcaggatttggtcgacgcggtgaaggacgggacgatccgcggcatcgtcaacctcgtcggctgcacgaacccgagagtcgtctacgaaaagacgatcgtcgactacaccgacgtgatgctcaagaacaacttcctgatcctgaccaacggctgcgcgtcctacccgctcatcaagctgggctacgcccaggcggcggatcaggcgtgggataaatgcggcgattcgctgaaggggtggctgaaggcgcacaatctgccgccggtgctccacgtcggcgaatgcatcgacaacgcccgctcgaccgccttcttcggcggcatcgccggggcgctgggcattccgatcaaggatatgccttacgccttcgcgtccccggaatgggccaacgaaaagggcctcgacgcggcgctggccttccgcctgttcggcatcagctcctaccactgtgtcgaagcgccgatttacggctcgaagaacgtaaccgagtacctgaaatacggctcgaaggcggatttagggtcggtcatggtcgtcgacgccgacccggtagccctcggtgaaaaatgcgtccgcgacgtggaggcgaaacgtgaagcgcttggctgggactgaggggctttccattgaacggccggcccaggcggcggggctcgccgccaaggccgtcgtcgggcgggtgccgatcaatttaagcggcgtcatgctcgcggccttcgccctcggcaacctccttcagagcttcggcgagggctggcggattgcctgcggcgccgcggcgggcttcatgctggtgcttttactgctcaagatgatcttgttttcccgggcgctggtagaagatttaaatcagccggtgacggccggggtggccggcactttcacgatggggctgatgttttgcgcggtctatctgacccaatatttcggcgccgcgtccttcgggctgtggctctggcagaccgcggtcggcctgcacgcggtgctgatgatttactacgtcttctggttcatccgccggttcaagctcgaacagatttacacggtgtgcttcatcgtgttcgtcggcttcgccgcggccggcgtcacggcgccggtgtttggctatcaggcgtcggtgggcaccttcgcgttttggttcgggctttgtgccttcgccgtgctgtttggcgtcgtcacggtgcggatgatcaagtacaagccggctcagccgctgaagcccctgacggcgatttacacggcgccgctgtcgctgtgtatcgtggcttacatccagtccgtcgcggccaagaacctgacgctactcctcgtcctgctggtgatcgccagtgcgatttacgtcttcgccttggcctgcgcgctgcgctgcctggcgcatcccttttacccgagctgggcggggatgaccttcccctttgtgatctcggccaacgcgctcaagcagagcgcggcctgggccgccgcctcggggcacccgctgcccctcgcgccggccgtgatgatcgagatcgtggtggccggcttcttcgtcgtctgcgtcgccgtgcgctacatgatgcacattttcgccgataaataacggcgctcccgctgatttttcagcgggattttttattgatttttattttaaaagacgggtgaggccagcccgcaattttgaaatcgtcttaatatcaaatccaaggcgcaaagcgttgcgctttcccgcggttttggatatactaaggccaatatttcaatacgactaataaaacgaccaaaagatcccaagggatctagaaagagaagcacaagcatgatgcacgcagcaaacacagaaccggaggcagcccagatgaagattcgacgctttcgcacagaggacgagcccgccattttatcgattttgaaccagtcgatcgtcgaacgcaaggtgacggcgcagctgacgccggccacgatggaagcgcgccgcggctggttcgcgatgcacagcgcgagacgctacccgattttcgtcgccgaagaaggcggggacgtcctcggctggatggcggtgacgccctaccgcggcggccgcgaaggtttttccaagacctgcgagctcagctattacctcgaccgaaactgccgccaccagggcatcggctcgaagctgatggcccacgctttagacgaatgccgcaagctggggtaccgccacgtcctgctgatcatcttcgaacacaatcagccctcccagggcctcgcccgcaaattcgggtttacggtctggggacggttcccgaatatcgtcgatatcgacgaccacattcaggactgtctgcagatgggccgggatctgtaaaaaatgcaaaaaaggcttgatttttcgggcctgcgttgctataatgaattccataaaggctttccgcctttttttattgtgggcgaaaagctaaatcctacgaaaaaacaagagtcaaaccatacatggaggtcatctgatgagaaccaaagttacattagcctgtacagaatgcaagcagcgcaattacgatacgatgaagaacaaaaagaacaatccggaccgcatcgaattgaagaaatactgcccgttctgcaagaaacacacgttacacaaggaaacacgctaatttcgcgtaaccgagagcacgcagattatggcgaaaaagaaaaagaacagacaggaacgccgggctgaggaagcccgccgggccgaactggcgcaaaaggcagaagccaaagctgcagaaaaacaagaagcgaagatggaagtcgcccgcgcccgcgcgatgcagcgcgaaaccgggaagaaggttgaaggtgctgaaaccggcaccgaaccggtgaaggcgaaggatccgaagtcgacacaatacgacgaaaaggccgtcgcgaaggcttctaaggaaaaacgcgcagctaaaaaagcggctgccaaaaaggaaaagaagcagaagaaacccggtttcttcagaagaatcgggatctttttcggcgaagtcggcgtcgaattgcgcaaggtcaactggttaacccgggatgaactggcgcgttcaagcggcgtggtcttcggcatcgtcgcggttttcaccctgctgacctggctggtcgacagcggtttcggcgcactggccgcatttttcctgggtcgataacccagagggaggcaacagatggaatacgaaaacgcagatcagccgcagtggtatgttgcccatacctattcgggatacgaaaacaaggtcaaggacagcatcgaagcggccgtcgaacaccgcaacatgcaggacgtgatcttcgaagtgcaggtgccggtgcaggacgtcatcgaacagaaggacgggaaaaaggtcgtcaaggaaaagaagcttttcccaggctacgtgatcgtcaaaatgttcatgaccgacgaatcctggtacgtggtgcgcaacacccgtggggtgaccggctttgtcggccccgcgtccaagcccgtgccgctgtctgaagaagaactgagaaagctcggcatccgccgcaccacctacaaggtcgatttcgaagtcggcgacaaggtgaaggtgctgtccgggccctttgaaaactgtgccggcgaggtcacggacatcaacgccgaacagggccggctcacagccaccctggaaatgttcggacgggaaaccccgaccgagctggaattcgaccaggtcgaaaaaatcaacgcataaactattattgttactacgctttattcgctctgattactcagggcgtttaaatataaaatcacttaagggaatccattcttcaaccttacacattttgaccgatcgcaaaggatcgagactaaagaggaggtgtcactatggctaaaaaagtaatcggactgattaaacttcagatcccggcaggcaaagcgtctccagcgccgccagttgggccggctttaggccagcacggtgtcaatattatgggcttctgtaaagaattcaacgcgaaaacagcggatcaggcagggatgatcattcctgttgtcatcaccgttttccaggatcattctttcacgttcattaccaaaacaccgccagcagccgttttgcttaagaaagcggcaggcatcgacaaagcatccggcgaaccgaacaagaacgaggtcgcttccgtgaccatggatcaggttcgtgaaatcgcgcagacgaaaatgccagacctgaatgctgctgatttagacgcagcggccagcatggtagccggaactgcacgttctatgggcatcactgtcgaagaataacgatagataaaattaatttataaacattatttttgaagaagaaccttaagtgggaggattcaatccgttatgaccacaggaggaaagatgaaaaaaggtaagaattaccaggataaagtgaagacttacgataagtctgaactctttgatctggatgccgctgtggctcaggtcaaaaaaatggcaactgccaaattcgatgaaaccatcgaactgcacgcacgcttaggcgtcgactcccgccacgccgaccagcaggtccgcggctctgtcgtgcttccgaacggcaccgggaacactgtccgcgttctggttgtcgcaaagggcgacaagctgaaggaagcggaagaagccggcgcagattacttcggcgaagacgaaatcatcgaaaagattcagaaagaaaactggttcgatttcgacgtcctgatcgccaccccggatatgatgggcaaggtcggccgcttgggccgtatcctcgggccgaagggcttgatgccaaacccgaaatccggcacggttacgatggacatcgcgaaggccgtcaaggacaccaaggctgggaaagtggaataccgtctggacaaggcgaacatcatccacgtcatcatcggcaaggcttccttcaccgaagaacaactgacccagaacttgactgtgctgctcgacgcgctgaaaaaggcgaaaccggctgcagccaaaggtcagtacttcagaagcgtcaccctcgcttcgaccatgggccctggcgtcagaatcaacccggcaagaatttaacaaaaagggcttgacaccctaaagggtttttgataatatactctagtctgaaataggcacaacagaatatcattcatccatagacagcagggactgttcgtttaaaaagcctgccgagggtgtcgcaagcacgaatacatgggctttcttcacctgggtgaaggaagcctttatttttgacagcaaatgtcagaaagccttctgcatctgatttttgtaaaaatctaaaaaaggaggaaaatatgcccaatctggaagcaaaaaaagcgctggtcgctgaaattgcggaaaaattaaaagcatcacagggtacgatcgtcgtcgactaccgcggcctcaacgtcgaagaagtcaccgaactgagagataaagcccgtgaacagggaatcgaatacaaggtttacaagaattcgagcctgcgctttgccgcaaaggaagcgggacaggaaggccttttggaatctctgaagggaccgtccgctatcgcgttttgtgaatcggatccaatcgcaccagccaaattaatggcggatttcgcgaaggatcacgaaaaccttgaaatcaaatccggcgtcgtcgacggcaaagtcgtcagcgtcgatgaaatccaggcactcgcaaaactcccgagccgcgaagaactcgtcgcgatgacattgagaggtctcaacgcaccgatcactggcttcgtcaacgtcctcaacggcaccatcaagggattggtcgtcgcactgtctgcgattgccgacaagaaaaaagaagaagaagctgcctaagcggtttctgcggaacacaaagaattttaattttaacaaattaggagaaataaaatgagcgaaaaagtagaaaagttaattgaagacgtaaaaggcttaactgttctcgaattatcagaattagtatctgcactggaagacgaattcggcgtaagcgctgctgcacctgtcgctgttgctgctgcacctggtgctgctggtggcgatgctgctgctgaaaagactgaattcgacgtcgtcctgaaggaagtcggcgatcagaagatcaaagtcatcaaagttgtccgcgaactcacaggcctgggcctgaaggacgcaaaggctctcgtcgacggcgcaccgaagactgtcaaggaagcggtcgcaaaggacgaagcagaagaaatgaaagccaagatcgaagaagtcggcgctactgtcgaactcaaataattcggtctcgaatttatttttcaaacacggacctgcccatttgggcgggtctttttttgtttttacgccgcctcgccgtaaaattacaggcattttctctaaaaatgctttataatataatcaattacgtaaaattacaaatcacaagaggaggccgacgatggcagacagagataaaacgatccgggaccgcgatcagatcgaaccgaagcagtgggtgaaatgggcgcagacgctccaggccgaagcccagagcggcctggcctacgcgaccaatccctttgatatcgagcgctacgaacggctccgggcgctttcggtggagatcatgaacacctacaccgaggcggggatggacaaggtgcgcacgatgtttgcaagcgaaaccggctaccagacgccgaaaatcgacgtgcggggcgccgtcgtgaaaaacggcaagatcctgctggttcaggaaaagctcaacgaggaccgctggtccctgcccgggggctgggccgacgtgggcctgtccctgaaggaaaacatcgaaaaagaggtgcgggaggaagccggcctcgaggttgtggcgacgcgcctggtcgcgatttacaactggctgaaaagctacgtcgacgcgcctttctcgatgtacaagatggtcatgctctgcgagccgaagggggccggccatttcgtcgacaacgccgagacggaaaacgtcgcctatttcagcctaggggagctgccgcctttgacccgcaaggtcagccgggacttgatcgtccgctgcctttcggcgtccaaggactgggactacgagccctatatcgaataggcgggattcgccctaaaacggcctgaattggcttgacaagtcaattcgctatcgtttataatgactaggcactagacggggaagtagcggctccctgtaacctgaaatccgctatagcagggttgaattccccaatgagggagccgtgctcgatgccgagtcagcgcgtaagtggtgttgaaggctggactctgcgcaataagaccctgtgaaccctgtcagattcggaaggaagcagcagtaagcaggcaaccttatgtgccgcagaaccatctggccggagctaactgcccgaaggacggtcgaaatcggttttcaaagcggggtgtgctttttttatgtgtaaaatccgcgtgaagatacaaaacgggccagaaatggcaaattattgtcaagatattttcatcctcttcaagacctgttataattttagttggataaaactgtgacaatcgttatcatcatggggcctaaccatgatgctgttttctttaaatcgtaaagggggttcttatgagcaaaatgaataccgtccgcggattccaggtgaagccgcaaatttggtacggtattggatcacttaaaaaactcgcggactttcattttaacaaagtctgcatcgtaaccgatgaaggtatggtcaaattcggtcttttggatatggtaacggacgtgctcgacgaagccggcgtgacctatcacattttcgacgacgtcaagccgaacccgacgtctgatattgtcgaaaagggtgtggcccacatgctgacccagcggccgcaggcgttaatcgccttgggcggcggctcgtccatcgataccgcgaagggcatcatctactacaccaacaatttcaagcagattttcctcgatccgcagctggttcagaatccgcatttcatcgcgattccgacgaccgctggaacgggctctgaagtcacggattacgccgtcatcaccgacgtggacaccggcacgaagattcctttaagcgaatcgatgatgatgccggatacggcgattctcgacccgacgctgatcgaatcggtgccggcgggggcgaccgccgcgacgggcatggacgtgctgacccacgccatcgaagcctacgtctccacgggcaataacccgttctcgagatgctactcgtccaaagcgaccgaactcgtgtgcaagagcctgaaagcctgctacgacgacggccacgacctggaaagcaaggccagcatgcagatcgcctcgacgatggccggtatcgcgtttaacagcgcgggcctcggcatggcacacgccatcgcccacaccatcggcgcccagtatcatctgccccacggcttggcctgcgccatcgcgctgccttacgtcattgcctacaacgggatcgacgaacgcgccgaatacctgtacggccgcctgctccacgccctgggcatccacaaggatgaaggacgcacggcatccgcaacctttgtcagaatgatcgtcaagctgatgaagtcgatggatctgccgctctgcctcgacgaaagccgctcggatacgtccgattacgacgaagtccgcagcacgctgatcaaaaaggcgatggccgacgcgacactgaagaccaacccggttcagccgagcgaagaagacatgggcaagatcctcgatctggtctgccacggcgtcttctaaacttaaagttcaaacacattatccttttattggggtccgccctgataaaaggatttttttatgttaaaatattttctcaagcgataattttttaatttgagaaaggaggccgcggcatgcgtcgaatcgaagaggtggaccagtttttaaaacacggcggcattgcgaagcccctggccctcggggaccagcagcttcaagctgtcgcccgcaccgaggggcagacgctgctcctcgcggtgccaggaagcggcaagaccacggtggtcatctgccggctggcctacatgatcggggccctcggcgtgaacccgggggacatcctgaccctgaccttctcccgggccggggccgccgatttggccgagcgctaccgggagctctgcggcgcccatttggctcggccgcggttttcgacgattcacagcttcgcgctgtcggtgatccgcgcttacgagcgcatctacaacaagaaggccttcgacgtcctcgaggacggcactcaggtcgtccgggagatttaccgggggatttaccactcgtggcccacggacagcgacatggcggacatccagtcggcgctgtcgctgatacagaacaagatgctgacccgggcccagatcgccgaggtcaaggtcggggacatgccgatcgagaagctcttcggcgcctacagccgctacaagcgccgccaccacctgatggatttcgacgatatgctggtttacgcctacaggctcctcaaaaagcacaagcggctcctgaactattttaaagaacagtaccattacctcaacgtcgacgaggcccaggacacctcgacgctgcagttcgcgatcatcgggctgctcaccgggcgggacggcaacctgctcgtcgtcggggacgaggaccagagcatctacggcttccggggcgcgagcccgaaggaactcctccagtttcagaagcgctatccgaaggggcaggtgctgctgatggagacgaaccggcgctcgacggccgatctggtggccgcggcggaccagttcatccggctgaacaaggaacgatacccgaagcatatggtcaccgccaaccccaagggccttaaaccggtgcggcgggtggtggcgtcggtggaggcccagtacgactacctcgggacggcggtgcgccaggagggaaagcgcacggccattctctaccgcaacaacgactcggcgatcccgctgatcgaccgcttcgagcgggagcacctgcgctaccgcctgaaggagcacagcccgctgttcttctcccatttcgtcgtccgggacatcgccgacttcttcgccttcgcccaggacatgacggattacgaggtgttcacccgcatttactacaagatggactgcgcgatctcgaaaaagcagatgcagctggtagggcgcaaatcgccggaaacctcggtgttcgacgcgctgttcgcgctgtcggacgtgccggactggatggccgacaaatgggccgacgaggaggcgggctttaaaaagctcgccgcaatgcccccgggccccggcgtgcactacatcgtcgacgagctgggctaccgggagcatttggcctttcgggtgcagaatggctgccgggaggaaaccctggtgcagaagctcaacatcctgcagatcctcgcgggccgggagccgacccaggacgccttcttcgacagactcacggatttgaagtcattaatcgcccaccacgaggtggacaccaccggcgcggtgaccttgtcgacgatccactccagcaaggggctggaattcgacaaggtttacatcatcgacgcggtggagggggaattcccgtcccaggcggccctggaggactccgctgagggccgggccctgtacaacgaggaggtgcgcctgttctacgtcggggtgacccgggcgcgcaccgaggtggagctggtcagcgtccgcgggcggaaggaatcccggttcgtggcggcctatttgggggaaaagaagcagaaaaagcggaaatccgcccataaaaaaacgcccctcggggcggtgaaagcggcgatggaccggcgtcgggagctggagcgtctgcgcggcgccagcgccgaaaaggccaagcgctggcacaccggcgacactctgattcacaagaaattcgggacgggcaaaatcttaaaaatcgacggcgtgacggcggcggtccgcttcgacggggagcagaccccgcggcagatcgatttggcggtctgcgagggccggcatttaatccggcgcgtgcagtgagtgcttgacgacctgaatcatgatcagggcgcagccgacgacgacgaagcagtcggcgacgttgaaaatcgcgaagccgatgagcctgaaatcgaagaaatcgacgacgtagcccaggcggatgcggtcgatcaggttgccgaccgcgccgccgatgaccagcgcgaaggcggtgttcatcgtcagataagccttggttttgggcaggctcaccagcagccagaccagcaccgcgatcagcgccgaggtgaggacgattaagaagatcgacttgccggcgaaaatgctgaaggcggcgccggtgttttcgatgtaggtcaggtgaaagacccgcgggatgatgggcaccgtcgtcaccggggcgagaaaacgcaccgccagggccttgacaatttggtcgaaggcgacgcagacggcgatgactatcgcgtaaaagatcataggaaccctcctgtgagataatttaaattgtgacatttccagtatatcatgaaccgggcaaatcgcccgggttttattgaaatggtctggataaaatgatacactagcaacagtcaaaaaaccaatactttttagaaggaatgaaatagaattatggaaaaaatatcagcaagcccggtccgcggcacccgcgacattctcccagaagaaatgcgcgtccgcgacgagctggaacacaccattgcggggatttatcgggcccacggcttttcgcgcatcgaaacgccggccctggaaaacatcgatctgctgctgggctccgacggcggcgacaacctgaagatgctcttcaccgtgctgaagcgcggcaacaagttcaagccgacggcggactcgaccccccacgacctctgcgaccaggggctgcgctacgatttgacgctgccgctgtcccggttttacgcccacaatgccgaccagctggaatcgccctttaaggcgatccagatcggcaacgtcttccgcgcggaacgcccccagaagggccgcttccgctccttcaagcagtgcgacatcgacatcatcggcgacccgaatgtgacggcggaaattgagctgatcaacacgacggcgacggcgctgatggcggccggcttcgaggatttcacgatcaaggtcaacgaccgcagactcttgacccagtttatcctgcaggcgggctttaaggccgaagacgtcggctcggtgtgcatctcactggacaaggtcgacaagatcggcaccgaaggcatcaagaaagaactcgtcgaaaagggctacgatcaggccatgatcgacaaattcgtcgacgcggtggacgacgtgaatttggacaacgtcggcgacaaggtggacgcgccggaagcggtggccgatctgaagcgggtggtcgacacgattacgcgcctcgcgaaaggacgctttcagatcgaattcgacttcaacctgatccgcggcatgggctattacaccggcgaagtctttgaagtgcgctggggcgacgtgggctactccatcgccgggggcggccgctacgacaacatgatcggcaagtacatgaagcagtcggtgccggcggtgggcttctccatcggcttcgaacgcatcgtgggcctcctgatggaacggggcatccacaagcagggcggggccaagcgcgtcgcgctgttccaccagaagaacgccgacatggtcgacgtgatcgccaaggccgacagcctgaggaacgaaggctacgacgtcaacctgatcgtcgaaaagaagaaggtcggcaagcagatcaatcactgcgaagaacagggctacgccgggttcatggtctacggccgggacacggaagtccgcttcttcgaagacaagtaagatggtcgagctgatcgcgacgacggccttcggcttagaaagcgtcgtcaagcaggaagtgaaggatttaggctacacgatcaccgaggtggaggacggccgggtccatttccagggggatgccggggccatcgcccgggccaacctctggctgcgctgcgccgaccgggtgctcctcaccgtcgggaccttcaaggccgtcaccttcgacgagctatttgagaagacccgggtcctgccctgggaggcctacatcccgaaggacggggccttcccggcggcgaagatttcgtcggtgaagtcccagctgttcagcaaatccgacgggcagcgcatcgtcaaaaaggcggtggcggtgcgcctgggccaggcttacggcctcgaaaagctgccggagaccggggacgcctacccgattttcatcaagctgttaaaagacaaagtgacgctggccatcaacaccagcggcgaggggctcaacaagcggggctaccgcgcccacggcaacggcgcgccgctgaaggagacgatggcggcggcgctggtcaagctctcgaggtggcggccggaccgcttctttttagatccgctgtgcggctcgggcaccattgtcatcgaggcggcgatgatcggccgccggcaggcgccggggatgcaccggcatttcgacgccgaggcctggcccatcgtcgggcaaactgcctgggatcaagcgcgggaagaggctgaagatgtgctcagccgcagcccgaaattccgggtgctgggcagcgacatcgacccggcggccctgaagcaggcccggattaacgccaagttcgccggggtgacggacttcacggccttccagaagctgccggttgaacaggtgcgcacccaccggcgctacggcgtcatcgtgaccaacccgccctacggcgtgcgcctgtcggacaaggccgacgtcgccaagctgacccgcgagatgggccaggtgtttcgggcgatgcccgactggtcctacttcatcctaagcggctacgaggatttcgagcgggatttcggccagaaggcgacgaagaaccgcaagctctacaacagcatgatcaagacgtatttctatcagtattacgggcccctgcccccgagaaagggacgccgggcggcggtggccggagaaagggaaacaaccaatgaaaaataacagaggcccgcacaagggacgcagaacccgctcgcggggggaaagcccccagccggaagcctcgggctttgtgatcgtcgggaagaatccggtgcgcgaggccctcagggaggaccggcagatcgaccgcctgtacgtgatgaaggacaaccgggaccacgtcctcggggacatcgtggcccaggcgaaaaagcgcggcgtcatcgtccactcggtggaaaagcagaagctcaaccagatcgcccgggacgcgggctttgacaacaccaatcaccaggggatcgccgcgatgatggcgccctttgattttcaggcgttagaggacgtgctggacccggaacaggaccagctgatcgtgatcctcgaccacatcctcgacccccacaatttcggggccattgtccgctcggccaatttgtgcggggcgtcggcggtgatcttcccggaccgacgctcggcgtcggtgacggcggtgtcgatgaaggcgtcggccggggcgatgaacgcgacggcgatggtgaaggtggccaacctctcccaggccatcgagaccctgaaagacgccgggttctggatcgcggccgccgatatggacggcgaaccttactacaatctggactggaccgggaagatggccattgtgatcggaagcgaaggcgccggggtcagccccaatgtgcgcaagcactgtgacctgatcgcgtcgatccccaattacgggaccatcgattccttcaacgcgtcggtcgcggcgggggtgctgctctgcgaggcggcccgtcagcgccatgccggctgataagccgacgctgatcgtcgacggctacaacgtgatccacgagcgggcccacgaggcgaaccgcccggtgggcgatttggagagcgagcgggcgcggctgatcgacgagctggcggattacagcggctaccgcggggtgaacacggtggtggtgttcgacgcctacaaccgcaaggatttcgaggagcgggaggtgacggtcagcgggatccgcgtcgtgttcacgaagttcggggagacggcggacacctacatcgaggcgctggtctacgccctgttgggcagccaccgggaggcgcgccgggccaatcggcagcggcgggtcgaggtggtctcgtcggacagcgcggtgcagcagctgatcctcgggggcggcgcgacgcggatgtcctcccgggagctgctcctcgactttaaggcggtgaagaagcgggcggccaaggcgaagctccacaagacccaggcggctccggcccacaaccgcctgtcggaatccatgaacgccgacgtggcggagatcctcgatgggatgcgcaagtcggacgtggacgaataatatacttgagctctgaagggtttcggagctctttttttcgtgaaattttggcatatttccggggatgaaaatgttttcttgttctaaatgtgaaattatgtaaaagtgagaaataattttaaaggggcgtagacaagggcatttgaccggtgtataatacatgtaaaagttgacagggttctaattgctgaaataatgtaaaagaaccgaaaaatgatttgaataaggagaattttatggaagatctgaaagccattgctaaggaaatccgccgtgatatcgtcaaaagcattggaaaagcggcttctggccacccaggcggctcgctgtccgcagtcgaaatgttgaccctcttgtattttgaaaagatgaatgtggatccgaagaatccgaccaaggcagaccgcgaccgcttcgtcctgtccaaggggcacgctgcaccggcgctttacgcgacgctggcgaaccgcggctttttcccgaaggaagagctcgaccatctgcgtcaggtcggcgcgatgctccaggggcatccttcgatgcacaccccgggcgtcgatatggcgaccggctccctcggccaaggattttccacggctgtgggcatggccctcggcgcaaagcaccagggtgcgccttaccacgtgtacacgatcctcggggacggcgaaatcgaagaaggcatcgtctgggaagcggcgatggcggcttccaattacggcctgtccaatctgacggccttcgtcgacaacaacaacctgcagatcgacggccagatttcggacgtcatgaatccgtacccgattgacgaaaaattcgcggccttcggctggaacgtgattgacgtcgccgacggcaacgatttcgatcagctgcgcgacgcgttggctcaggccgaagcctgcaccgacaagccgtcggtcctcgtctgcaagacggtcaagggcaaaggcgtttccttcatggaaaacgaagtgggctggcacggcaagggaccgaatccggaacaggtcgaagaggccctgaaggatttggcataatcgggttccaactgaggagtatatagaatggaaaaaatcgccactagagaagcttacggtaaatatcttgtcgaactgggcaagcaaaatccgaaaatcgtcgtgtttgacggggacttatccggcgcgacgaagacgtcttatttcagagaagctttcccggaccgccatttcaacgccgggatcgccgaagcggatttgatgggcatggccgccgggatttccacgacgggcctgatccccttcgcgtccaccttcgccatcttcggggcagggcgcgcctttgaaatcatccgcaacagcatctgctattcgaatttaaacgtgaatatctgctgcacccacgcggggctgtcggtcggggaagacggcggctctcaccagtcgatcgaagacatcgcgctgatgcgtgtcctcccgaatatgcacgtatttgtgccggcggacgcggtggaaacccgccgcatgctcgacgcggcgctgaccatcgacgggccggtttacatccgcctgtgccgtctggcgaccaacgtcgtcctgcctgaagattacgaattcgtcccgggcaaggcggtggaactcaaatccggcaatgacgtgacgatcatggccatcggcctgatggtcgaacgggcgctggaagcggcggaagccctgaaggcggaaggcatcgacgcccgggtgctcaacatgggttcgatcaagccgattgacaaggcggccatcgaagcggcagccaaggaaaccggcgcgattgtcaccgcggaagaacactcgatcatcggcggcctggctggcgcggtctgcgaaaccctcgcggaaacgaccccgtgcccggtggaaaaggtcggcgtgaacgacgtcttcggccagtccggcaaggcgccggaagtgctggaagcctacggcttgactgcggatcacatcgtgtcggccgcgaaggctgcgattgcccgcaaataaatggtttttcggcggctgcctgacacaggcggctgcctttaatttgcaaattttttaagaggagtgtcatattatgaaattttttctcgataccgcgaatgtagatgatatccgccgcgccaacgatatgggcgtgattcagggcgtcacgaccaacccgtcgctgatcgcgaaggaaggccgcgacttcaacgaagtcatcaaggaaatcacgtcgatcgtcgacgggccgatttccggcgaagtcaaggcgacgaccaccgacgccgaaggcatgatcgccgaagggcgcgaaatcgccaaaatccacccgaatatggtcgtcaaaatcccgatgaccgaagaaggcctgaaggcgacgaaggtgctctcttctgaaggcatcaagtgcaacgtgaccctgatcttctcaccggctcaggcgatcctcgcggcgctggccggcgcggcttacgtctcaccgttcctcggccgcctcgacgacatcgcaacccctgggatcgaattggtccagaccatcgcggaagtcttcgaagtccagggcatcgagacggaaatcatcgcggcgtcgatccgcaacccgatccacgtggtcgactgcgcggcggccggcgcggacatctgcacgatcccgatgaaggtcgtcgaacagatgacccatcatccgctgaccgatatcggcatcaagaatttccagcgggattacatcgcggttttcggcgataagtaagggatagccttttgatcttgcttcagcattcgggccggccagccgccggctcgatttttttaaaaatttcccttgactttataagcgatattcggtaaactatagaagttctcaagcgaggggaaatgcccgagtggctaaagggggcggactgtaaatccgttgacttagtctacgatggttcgaatccatctttccccaccatctgctattgtagctcagtaggtagagcaccacctcggtaaggtgggggtcaccggttcaaatccggtcaatagctccattgatgattcaagcccgaagcgatgcttcgggtttttttgttacaaaaaataattatagatttaataaaattttagaagattattaacatattccatatatcgtagtaaaatataaataaaagagagagaaataaaaatgtaggggggcagaaaatgaaacgtaatggacagcaacaagcagttgagcagacgaaaggcaagaaagggaagaagaaaaaagttcttctgattgtcggtattgtgtttgttgcgatgatcattattggcatgatttccaattcggtagacccagctccgccaagtgtcaagtctgatgatctggccgggtgctggaaggcaacgatcaacggcaacacggtttatgccgattttaacgacacgaaagaaaaaggcaacgaagacggcagttataaacaacttgttactattctcgttatgaaagatggtcagctattaaagtatgaggaagcgggctacgatatcggcgataaaaataacgatacggacacgatggatgaaatttcatcatcgttccttgtggaaggtacagagttggttaaaaagggtaagtttactgaattcagcgacaaggcgttcacattcaaaactggcaaaaaaacatatcattttaaacgcctgagcaagaaatcatcggaatataagactacagtaacaaacgtatataagaccatatttacagaacaagaaatacaagcaatgcaaagctaagatgacaaaacccaaagcgataaggcttcgggttttttttgcgtgaaaattatttctaaaaaaatgtgcccccattggacacgtctttgagaggtgtgggggctcctgttggaaatagtatacgcgctgtgcggctgattgtcaatgtcgctcgctattttggatttacgcgtaggaaatcgtctgaatttcgtcgatttcaggctgcattttctgcttcaggttgcggatgtcgatatcgttttgaatatcgagaaaatagcggtctgacacgccgaagagcttcgcgaggcgcagggaggtgtccaccgacaccttgcggcggccgtggagaatgtcctgaatgcgggaaaccggcacgtgggtgtcctgcgccactttgtaggcggagaggcccagcgggtccataaactcttcttttaggatgtcgccgacagtcggcgttggtatcatttgtctcatgattttcaccttttttaatgataatatacccggatttcatgtacctgtcaaatgggtatttatcattaattaagcataacaaaagccagcttcatattccattgtagaaataatccccaaccgccccaaaatatgtcataatataaataaaaaccaaaggagccgccatgctgtttctcatcgctggggtgattctcatcctcttcctcttttacctcttggcccgtttgttcgtccgctcaaaggttttccgcatcatcctcgtcggggtgatcgcctttctcatctttcattattggtttagttaaacgcaaaaaaggcggcgtcaaaccgccgcctcgtgccgctttcgttcgattcggtccgcggagctcgcggccccgtagtccaaatccccgcgcctgaagtgcgcgagctcgtgctccaggcacgcccgcttcatctcgagggacagggcctcgttgatgaaaatcgccacatcgccctcgtcgttctttgaaatcaagctgtgaatccgcggcggcagggccaccacgtgcaccgggatatcttcttcccaaatcgtcatgcatctcatgtcctttcgtgaaaaaaattgatctatattcaagggcgggggcggatcgtgggacatcctttggcccgtgttttacttgatttaaattctacttgattttatttctttttgttgcgttcggtcagccggcggatcatctcggccgccatctgaatgtcctcgggggccgcgccgcggctcgcgtcaaagagcatccgcaggttgtcgtcctcgtagacctgctgggcgattttccgggtgcccgggtcgatgtagtacacgtcgtcgtcgggtgcgttgttttccggatcggcgaaatcgtggctgatcaggtcgttgagcgtgacgccgaagatgtcggccaggccctcgagggtgcgcacgttgggctccgagtcgccggattcccatttttgcaccgtcgtgaaggagcggtagccgagcatatcggcgatatcgtcctgggacaggccgcattcgcggcgcagaaaccgtatgtttttggataaggtggacatggtcaccactcactttctaggttcttattttttgagttgcacttattttacactatttcagatcgcctttcaagccaaattttaaaattttttcgaataatcttcaagaaaacccttgacacatgaatttgattctcgtataatgaacgatgttaaactgtattggtctgagacgttgaatatgatgcaagtggaacttgctgaaagggggcgcaggcgattttttttggctgacggcttgaacaattatcaagctataataggaaatatacatgataaggaggcattttttggcaaataaacgcggcaggccccggaaaatggggctggactggtttccctttgacgtgaccttgctcaccgaccgcaagctcaggcggccccgggcccagttcggcagcgcggcggtgctgacctacatcgcgctgctctcgctgatttaccgcgacaaagggtattatctggagtacgcgggcgacggccgggaggacgtggccctggacgtggcggatttgatcggcggggccctggcgccggacgccctggcccaggcggatcagattcagaaaatcatccgcgcgctggtggatcgggggctgttcgaccgggcctgctttgaggccggggtgctgaccagcagacggattcagcggacgtattacaacgcggtggtcgacaggatcaacgtgaagattaaatgggagatttggttgttaagtgaaagtgagatggagcagattcaaccgacaaatccaatcttgaaaatgtttcgcgaagatcgggaattatgtgataaaccgatttttccgacgggaaaatcgaatattccgacgggaaaatgcatttttccgacgggaaattcatataagataggagaggagaagagagaagaggagatgagagaagatgagatgagagaagagaacggggtggtgccgcttcgcggcatttcaggcgctgacgcgccgcagttcaattaccaactctacgccgattattggaatcaccacatcgcagcgggcacgaagctcaccaaggtcagagaccctgagcgctggagcgccaagcggaagaagcgggtgcgggatttggtgcaccgggaaggggaggccggcgtgctggccggcttcgaccgggtgtcggcgtcggattttctgaccgggcggtcgggcaaatggctggtcgatttcgactgggtggtgacggccgatcattttcagaaaatctgtgaaggccgctacgacaacggccaggttgacgagcagacgggctcgttttacgacaaactcgcgcgaggtgacctatgaatctaaacgaaaccggccgcatcatgaagatgatcaaggcggcctacccgaattttgacaagagcggcaatgccaaggacatcgcgacgctgtgggcgtggcggttcaaagagacggatttccgcaccgtcctcgaggccgtgggcgcctacatcgacggcgaccacgccttcgcgccgacggtggggcagatcaaggcggtgatccgcgcttcccagccgaccctctccgccgccgacggctgggctgagatcgcccacgcgctcaaggattccctggccaacgccgagcgggaatttgaccggctctcgccgccggtgcgcgcctacgtcaaaagccccgcgaccctccgggccctggcgggcagcgacgtcgccgggcggttctttagtgactaccaggcccagtttttcgcgcgcttcaccgccgcccaggccgacgagacgcccgattacgccgcccttaattccccgggaaataatcagaaggcgatcgagagcggggaggataaaggggtgaaatccgattgatttgcggcgtgaattccgttataatgagacaaatttaagtaagatgaacgaattgatgatagcaaaaatcatgataatagaaaggacattcatgaaacacaacaaaatcctcacccgcatcgccatcgcccttttcgcggtgtccgcggcgatctacgcggcccagatcctgatcttccgcgacccgcgcaccaccgccttctacatcttccaggacttcgccttcctgccggcgtccatcgccatcgccaccgtcgccgtcggggccatcctcgacgagcacgaccgccagcgggccctggcctcgacccggatgctccgcagccagttcttcaccggcgtcggcgcgccgatgctgatgcagatcgagtactgcgccaaatgcgggacaaatttgggccagctcaccgccatcgacgggccgatggacaccctccgccagcgccggagagtccagcgggaaatcgaagcgaggcaggcgaagatcgagggcatcgacctgcgggtcaacctcacccaatccgcctacgacggcatccgcgagattctggagcacaaccggctggatctcttgatcctcggctcgacccacaatttaaacgaggccgagcgcttcgccgaaatgctctgggggatcttccacctgatggacgagtaccggctccggggcgcctgggaaaacctgagccccgcggacatcgcccacttggaggcggatttcgcccaggtgctcaggctgatgctcgccaacagcgtcgccaacaacttctacctgcgcaccacctacccgaatttctacggcgccgcccaggccaagttccaggcgcaccgcgccgacgggcgggaggacgacgcgtaaacgaattgacgattttacgatttgattaacctgcggcctaagccgcgggtttttttatttgagaaaaatcgggcgcggttataagctttcggcataactgattctatcaaatccatataacctattttataaataggaattgacaggttttgggggctgggttacaatgaacacataatcatactaaacatacagacacactatgtatttaaaggagttcaccatgaaattacgcacccattcatcatcggcacagccgcacaccgccgacaaggcgggaaaagggtcctttttcatgtgtatgctcaagatcggcatcatcggcttcggcggcgggaccgcgctgatcccggtgatcgaggacgccgtcacccgggaacaccccttcgtctccaaggaggactacgaccgggacgtggtcgccgcggcgatcaccccgggcgccctgccggtggaaatcgcggcgggcctgggcaaatctgtcgccggccccggggggatgctcctctcggcgctgctgatggcgctgcccggctgcctgctcacgctggtgattctggccgtgctctccggcgtcaacaaagcggtgctgaccctgaccgactgcctgtccatcgggatcaccgccttcatcctcacattactcatcgcctacgtcgtccggacctatcgggaaggcgggggggaccgccgcaccgccgcggtcatcgccggggtcttcgcgctgacctgcggcaagaacttatttacaattcttgggatcaagggcgtcccggccgtgtccctcgacacgctgtcggtcctggggctggccttcttcgtgatcttcttcaccaagggcaaattcgatttaaagaagggattggccgtcgccggcgtcgccgctgccttcttatttggcaaaggggcggtgcggttcgcggcgattggcgcgatggtcgtcctcggcggctggggcttcgtctccgatatccgctcggctcaaggcgcgatcgccaagcccggccagttcggccgcaaatgggcgctggaaatggccatctggggcagcctgctcgccgtggccgcggcgctgaccttcgccgtcaccggccgctcgcccctcttcgtgctccgggggctgctctcgtcgctgatctctttcggcggcggcgacgcctacctgtcggtggccgaagggatgttcgtccagagcgggaccatctccgccggccatttctacggcaatctgatcccggtgtcgaacctgctgcccgggtcgatcctctgcaaggtcctcgccggcaccggctactacgtcggatacggcgtgcggcattcgctcgtcgacgcggggctgctctggctcgccggctttctcgtcgcggtggccggcagcggcatgaccttcggcaccgtccgcctgatttacgacgcgctggaacgtctggacaccttcgcctgcctgtcccggtggatccgccccatcgtcgccgggctgctgctcaacatctgcctgtccctgatcagccagaacctgaccaccggcgtcaccttgggcatctccgccggcgccgccgcgggcatcaccgccgcgatcctcgccgtcaacctggtgctgctctacagccgccgggccaaatccggcgcgatgatcgccttctcggccttagccagcgtcctcaccgccggctccctggtcttattataagaatgagaaacctgcatagattatgcgtttgaatagaaaggaaatccgatgactgcacacaacccgatcacctggcagaccctgaccaccgacgtcctgatcgtcggcgggggcaccgccggctgcttcgcggccgccaccctcggcgcaaatcccgacgtgtcggtgctgatcgccgaaaaagccaacatcacccgaagcggctgtctcgccgccggggtcaacgccctcaacgcctacattaccgagggccacgaccccgaattttacgtcgattactgcctgcgcgacgccgacggcatcgcccggcgcgacctgcttgccaccatggccgagcgcctcaacgccgtgaccgccgacctggaggacgtcggcctcgtcatcctcagggatgcagacggcaaaatcgtcaaccgcggcccccggaatatcaagatcaacggggaaaacatcaagccgctgctggccgctcaggcggaagcccagcccaacgtgacggtcctcaatcacgtgaacatcaccgatttgatgatccaggacggccgggtggtcggcgcctacggcttttcggttggcgcgcctgtggcctacgcgatccgcgcccgggccgtcttcgtcgccaccggcggcgccgccgggctctaccgccccaacaacccgggcttctcccggcacaaaatgtggtacccgccctttaacaccggagccggctacgcgatgggcatccgcgccggcgccgaaatgaccaccttcgagatgcgcttcatcgccctgcgctgtaaggacaccatcgctccgacgggcaccatcgcccagggggtcggcgcgccccagcacaacgccaggggagaggactacgaagggcggtacgggcacaccacctcggagcggctctacggcaccgtctcggaaaaccgcgccggccgggggccctgcgtcctcgccacccggggcatcggggaagccgccgagcaggatctctacaaggcctacctgaacatggcgccgagccagaccctgcgctggctggaaaacggccaggggcctgacgccgaggacgtcgagatcgagggcaccgagccctacatcgtcggcggccacaccgcttcgggctattggatcgacgccggccgccgcaccaccctgccagggctctacgccggcggcgacgccgccgggggcgccccacagaaatacgtcaccggggcgttggccgaagggcagatcgccgcggaatcgattctcaaggatttgccggatttagattacgccgacgaagacgaaggggcccggcccgactacggcgcttattttaaacgcgatgatttgccggatttagattacgccgacgaagacgaaggggcccggcccgactacggcgcttattttaaacgcgatccccagcacgtggacaccgagcagctcgaggaagcgatgcagaaggtgatggacgagtacgccgggggcatctcccaggggtatcagtacaacgaagcgcgccttgaaaccgcccgccgccgcatcgccgagctcacggatttaagcgccaccctgtcggctaagtcgatggacgacctgcttcggatttacgagctcaccgaccggctcaccgtctgtccggtgctcatcgcccacctcgaggcccggaaggaaaccaggtggcacagcttcgccgagaacgccgactacccggacaaggacccggcctacgcctgttacatcaactcggtcacaaagaacggggagacccaaatcatcaaacggaagctgaggtaaatcatgagcattgcaatcaacaccaacaaatgcgtcggctgcggccggtgcgtcgaggtctgcccgggcaatttgatcaaaatggacggcgggggacacgcccgccagatgcacccccgggactgctggggctgcaccgcctgcctgaaggcttgcccggccggggccgtggatttcttcctcggcgcggacatcggcggccggggcgccaccctgagctatcgggaggacgggcccatcgtcacctggacggtcaataaacccgacggcacgacgcgcgccatcaccctgaacaagcaagacgccaaccgctactagaacaacaaagaaggagaacattatggcgaaattatcacatctagacgccctcgaggcggaagccatttacatcatccgggaagtcgccgcggaatgcgaaaacccggtgatgctttattcgatcggaaaggacagctcggtgatgctgcacctggccctgaaagccttctatcccgaaaagccgcctttcccgttcctgcacatcgacaccacgtggaaattccacgaaatgatcgaattcagagaccgcatggccaaggaaaagggcatcacgatgctcacctacaccaacatggacggcgtgcgcaagggggtcaatcccttcgactacggcagcgcctacaccgacatcatgaagacccaggccctgaaggcggctttgaagaaatacgggttcaccgcggccttcggcggcgggcgccgggacgaagaaaaatcccgggccaaggaacgcatcttctcgttcagaaacgaggcccaggcctgggatccgaaaaatcagcgccccgaaatgtggcagctctacaacacgcgcctgcacaaaggcgaatccatccgcgtctttccgatctctaactggaccgaaaaggacatctgggaatacatccgccgcgaacacatcgagatcgtcgatctctacttcgccaaggaacgtccggtggtctaccgcgacggcaacatcatcatggtggacgacgaccggatgcgcctcaaccccggcgaaaaaccggagatgaagaagatccgattcaggaccctcggctgctacccgctgaccggcggcatcgaatccgacgccgacaccctggacaaaatcatcgacgaaaccctggccgctgtcgaaagcgaacggaccagccgggtcatcgaccacgaggaaacgggcagcatggaacgacggaagaaagaaggctatttctaaaatgaacgatttactcaaatttatcacctgcggcagcgtcgacgacggcaaatcgacgctgatcggccatatcctgtacgactcgaagctgctctacgccgaccaggaacgggcgctggagctggactccaaggtcggctcccggggcggcgccatcgactactcgctcctcctcgacgggctcaccgaagaacgggaacagggcatcaccatcgacgtcgcctaccgctacttcaccaccgacgcccgctccttcatcgtcgccgacaccccgggccacgaggaatacacccggaacatggccgtcggcgcctccttcgccgatctcgccgtgatcctgaccgacgcctcccagggcgtcttgatccagaccaagcgccacgcccgcatctgcgcgctgatggggatcaaatatttcgtcttcgccgtcaacaagatggacttggtggattacgatcaggcccggtttgacgccatcgcccaggacatccaggccctcgccggcgagctcggcctggaacacgtcgtcatcatcccggtgtccgccaccgaaggggacaacgtcacgaagcaaagcgccaacatgccgtggtacaccggcccgaccattctcggcgagctggaaaccgtggacgtggccgccgacaaggaagtgggcttcgtgatgccggtgcagcgggtctgccgcccgaatcacgccttccgcggcttccaggggcagatcgcttctggggacatcgccgtcggcgacaccgtcgagaccctgccgtccaaggaaaaggccgaagtcaagaccattctcgtcggcgacaaagaggtggatcacgccgttaccggccagccggtcaccatctgtttgaataaagaagtggacgtctcccgcggctgcgtcctcgtcggggaaggggccgacctgaaggtctcctccggcgtcaccgccgaaatgctgtggatggacgaccagcccctgaccccgggcaccggcttcttcgtcaagctgggcaccaagctgatccccggggaagtcagcgccatcgactacaaaatcgacatcaacaccggcgaacaccagagcgccgacaccctcaagaaaaacgaaatcgccgtggctagactgcgcttcgccgacaacgtcgtcgtcgacaccttcgaccggcaccagaccctcggcgaattcatcctgatcgaccgggtcaccaacgccacctcggcctgcggcgtcgtccagagcgtcgctcaggaggcctggaaggaaacgaccatcaaccccgaactcagacggctgcagaagggccagaacgccatcaccgtggccttcccgctgcgccgcgacgggatcaccgagggcctgattcaggatgtggaaaagcggctctaccacgccggacgccacacctatctctacaagcccaactttgaagacgcgcccaacgtcgtgcgccacttaaaccgcgccggcattgtcgtgctcctggccgtcgacgccgaaaccgtcccgaccgaatccttcgccgaaatcccgggctttgtcgccgggtgggaagacgaagtcgaactcaccgccggggccatcgccgacttcatcctggaaaaatccgacctcgacctgtccaccagcgctgcctaccgcgaacccgcgattttgatctaagcttatgacgcttcagcaaatgcattacctgctcgaggtggccaagagcggctcgatgaacaaggcggcggagcagctcttcatctcccagccgaccctcaccaaggccatcaaggaggcggaggaggagctgggcttcacgatttttatccgcaacaaccgcggcgtcaccctgaccaagcggggggacgacttcgtggccgatatccgccgggtgtaccagcagtaccaggcgctgatggacaagtacgccgatccggacagcttgagccgcaagcgcttcggcgtctcgacccagcactactctttcgcggccaaggccttcgtcgagatggtgcgccagttcggcaccctgaactacgacttcgcctaccgcgaaaccaccaccgcccgggtcatcgaggacgtcgcgtcggggaagagcgagctgggcattctctaccgctcgccctacaacgagcgggtcatcgaccgccacctggtcgacaacaacctgaaattcacgcccatcgtcaagagccaggcctacgtctacctgtggaagggccacccgctggcggacaaggacgcgatccgcttcgccgatctggaggactacccgtgcctgtgcttcgagcaggacggcgacgacacctcctacatggccgaagagatcttaagcgaccgcctttacccgagacgcgtcgtcgtccgggaccgcggctcgatgctcaatttgatggtgggcttgggcggctacaccctgtgctccggcatcatccacgaggcctacaacggggaagactaccgctgcattcccttcaagcccgagccgggattccccaaccaggacatggaaatcgggctgatcgcgcgcatcgacaacgtgcccagcgcgtcggcggaggtcttcgtgaagaccatcaagaactactttaaataatctattcttttatatatttttttaatctcactttgacctaaatcttttagcaataaagctgatgctgggcatcggctttatttttttgtttcactttcgtaagccgccttaactaactttcgtttgtttttcttttaagcgataaaaagaaaataaaaaagaaagaataagaaagaaattagtaaaaaataaataaaaatagcttgacaaacgttatgaaacgctttactatagacacataaagcaagttatatacaaacaaaagaaaacaaaacgaaaataaacgaaagggatttatcattatggaagcacaattcaaaccagttatggccatcacgatgggcgacccggcagggatcggaccggaaaccgtcatcggcacgatgctcgcagacgaaattcacgcctgctgcaagccctttgtcatcggcagcgaagccattctcgaaaaggcggcgaaggttttgaaccaagacgtgaaattcaacaagatttcagaccccgctgaagcgaaattcgaaaagggcgtcatcgacgtgatggaaaccggcgactacgacaccgactccatcgaatggggcaaggtccagaagctggcgggccagatggccgtcgatttcatcatgaaatccatcgaactgggtatggccggcaaggtcgacgcggtgtccaccaccccaatcaacaaacaggccatcaagctcatcggcgtcaaggaaccgggccacactgaaatctatcagcacgcgaccaactcgccctacgcgctgaccatgttctcctgccacaagctgcgcgtcttcttcgtcagccgccacatgtcactgatcgacgcggtgcactacgcgaccaaggacgtcgtcctcgactacatcaaaaacatcgacaaggaactccgcggcgtcggcatcgacaatccgctgatcgcggtcgccggcatcaacccgcacaacggcgacaacggcctcttcggtagagaagaaatcgacgaaatcgaaccggcggtcaaggcagctcaggcagaaggcatcaatgccgtcggcccaatcccagcggactcgatcttcaacatcggcaagagcggcaaattcgacgccatcctgtctgaataccacgatcagggccacatcgcctgcaagaccttagacttcgaaaaatctgtcaccatcacctggggcctgccgttcatccgcggctcggtcgaccacggcaccgccttcgacatcgcgggcaagggcatcgcgaacgacgtcagcctgatcgaatccaccaaggtctgcgccgaatacgcgatccgcaagcacaacatgaacaagtaatgcatccgtgagaataaagggggaaatatggcaaagataggagtagtcgccgacgatttaaccggcgcgacgaccacgggcgtgctgctcgcgagatccaaggccaagacggccgtgttcttcgacgataccgcggcggcccagtacgaaggcttaaaggatctggacgcggttttgatcagcagcaactcgcgcccgctgtccaaggaagacgcgtaccagcgcgtcagcaaggcgacctcggtgctcaagggcgccggcgttcagtatttttctaagcgcatcgacacgaccctgcgcggcaacgtcggcaccgaaatcgacgcgatgcttgacaccatcggcgacaacgccatcgcggtgatggtcccggcgatgccccagtcccgccgcattttggtcggcggctattcggtcatcgacaacgtcgcgctgatccgcacaccggtggcccaggacgtgcgtacaccggttaaggaaaattacatcccgaaactgattcagtctcagagcaagcgcaaggtcgcgctgatcgagctcgaagacgtgctggacggggaagcccagatcgccggcgcgatgcgcagggccatcgacggcggtgccgaaatcctcgtcgtcgacgcgatttccatcgacgacgtcgagctcatcgccaaagcggccatcagcttaggccgcacgatgatcgccgtcgacccaggtcccttcaccgcaaaggtggccttctgccacggcttaatcgaaaccgaacagacgaacatcccggacgtcaagccggtgaccggcaaaaccgtgctcatcgcggccggcagcgccacaccagtgaccaagcgccagatggaagtgctgtgtgaagacgatcaggtccgccgcatcgaagtcgatccgctggccctgatccacggcgccgattccgccaacgcggaaatcgaccgcaccgtcaaacaggcggtggccatgctcggcgaaacgccgcagcctaaagccatcctgatggaaaccgccctccacggcgatctcctcgatttggacgaagaagacaaacgccacggctacgccaagggcatgagcgctgaaagtatcaacggcggtctcggcgccatcgtcgccgccgtcatcgaaaaagccgggcgggacaagatcgccggactttacgccacagggggcgacacgatggtcaacgtctgctaccacctgggcgtcggctgcctggaaatgatcgattacgtcattccgcagacagacttaagcttcatcaccggcaaatacgcgggtctgcccatcgtcggcaagggcggcctgaccggggacgatcacattgccgaaaaaattatcgaacgcctgtgcctcgaagccgcgcgggaacggtaatccaaccgggttaacaaacatgttgttaaaatataatcattatttaggagagtaggagaaaatgaacgaaaacgaagtgaaaacaccggcaaacggcgagcagtcgccggaaacagaaacgaaaagaagggatttcccaatccttcagaagatgagcgagctgccagggggcctcgtcatcatcccattggtcatcgctgtggtgctgtccacgctggtgccgcagttcttccagatcggcggctacgtcactgcgctgttctacgaaggcaacgcctgcatgatgggcttcttcctgatcgtctgcgggtccatgatcgacattaagcaagtcgggatgccgctgtacaaaggggttgcgatgaccggtgtcaaatttgtactcggcgtcatcgtcggcctgctcgtcggcaagctcgctggcccagccggcttcctcggcatcgcgccgttcgtctggatcgctgcgatcaccaactccaacggttcactgtacatctcattgtcctctcagtttgggaacgccaccgataccggcgcgatttccatcctgtccttaaacgacggcccgttcttcacgctggtcgccctcggcgccaccggcctggcgagcattccgtttatgtccttagtcgccgtcatcatcccaatcttaatcggctttgtctgggggaacctcgacagccacttcagagcagcctgcaagaccgcacagccaatcgtcaccttctttatgacgatctccatcggtgccaaaaccgacctgaagaccattctgaccgccggcgcttccgggatcgtcctcggtctcgtctccgccgcaaccgccgtcatcttcttctttgtcatcaacctgcttctgccgaagaaggaaagaaacgccatgggtgctgccatcgggaccaccgcgctgaactccgcgatgacaccggcagccgtcgccgaagccgacccgaccatgaagaaatacaccggcatggccaccgcacagtgcgccaccgcgtcgattatcaccctgttcatctgcccgttcatcaccgcagcctttgaccgctacatgatgaaacaccagaagggcatctacagtccggaaggctgggcctacgaaaaaggtgtcgaaaccctcgcggatttggctaaataattcacttacaaaaggaacatccaatcatgaaatcatctcccactggaaagaacgcggatcagattcccatccccgaacacatcgaagacgtgacctttaccgtcaagatggaagaacagtatctattcgatttctttctgtaccatgcctattccaagctcagcggcttcttagtgaacctgctgggcctggccgtgggcttcaccggcctgtttcagtacgcgaatcaccgcatctcccccctcgcttgcgtgatttacgtcgcggccgccgtcgtcttcctcggctacacgccgctgaccctaaaactgcgcgcgaaaaaagccatgaaggcgatggaccaaacagaaacgcaggtgacactttcggaaaaatgtggtatgataaaaaaacaaggtgaagaagaaaaacaatatcagtgggacgaaatggaacgggctgtggtcaccccgaagaccatcggcatttacctaaagaacgatgaggccatcatcattccgaagccgagttttggggaccagttcgtgccggcattcatgatgatcaccaaacaattgggactcaagaatgtcagaatgagataggaaggcttaacaagcggcagaggtggatttggacgacaagaaattaagcatcatgcgggaattggaaaaagcgggccgcgtcagtgtcaacgacctcagcgaacagttggggtgctccaaggtcacaattcgcacgaagatccgggagctggcagacgagggcaagctggaacgggtccgcggcggcgccgttctcaaatccgaatcgaccggcagcagctttcaaaccaaatacaacagtcagcatctggatcagaatgtggacgaaaaaaaggccatcgcgatacaagcctatcagcacatcgcggaccgggacgtcgtcctgctcgacgattcgaccacgagcttctatttggccgtgtacatcaaaaatcatccggaaaagcgcatcgtggcggtgaccaactcactgccggcagccaacgagctgtccagcgcggaccacgttgaattgtacatgatcggcggatacgtcgacggcttcctcgccgcctcgatgggcgacacggcagcggacagcatccggggcttcaaaatcgacaaggccttcatcggcgtccacagcatcaacttcgatgtcggcctgacgtcgatcgcgaccccgcagatgcagatcaagcaggccattctgcaggcctccaaccacgtcatcgtgctggcggacagcagcaaattcgaaaacggctacctcgccgtcatttgcccgattaacgcggtggatctgatcatcaccgatgacaagatccccgaaaagtaccgcgagcgggcggaatcggaaagggttccctttgaaattgcgaaaaccgatcaactctgacacacaccaacgcggcatctcgttttgagatgccgtcagactgtagacaaacgaggctctgagaaaatactcagagcctcatttgatttaatatcaagctgcaatttgtagatttataaattgaaatcgaaatatagggacccgatttgggccagggtggttttttaaataatatttttgctagtttttttagattcatgcatgcgaaagtaagcccgactttcatttcatgcgggctttaccatacatttgtgtgtagcggaatccctgcgcttctttcgcagttccgaaaattctctcgatggtttcttttctgcgattataaattgctttcattccgttgtgtgtcggatgtcctcgcagatttccatgtagtgtgcccataggtgtcggctgaccactttgacatgatttttactatgggtgcactggttaagataaggacagtctttacattttcagaacggcttttgtattccctgaaaccttcgggttggtggttgaatattttaaaatttgattatggggacagatgtaacagtcaaaagcttcatcgtagacgtactcatattttttgaaaaatccctttttcgtcattggtcgtttatacgggaaaacgggtttgataccgtcgtctatgagcagcttagcaatggcaggggttttataacctgcatctgcaactatcatttccggatatgctctctttgtcataaaggcctttaaaggttcggctgtcgtgcagatttcctgcgttgacgtcatagccgatgatcatccgtttcggtcgcaggccgtttgaaccgcgtaggcgaagacttgtttatgttcgcctttgtgaaaccagccgctctccgggtcggttgtacttactttgatttcccgtgtctttttgagcctgggtgatgtttcgtctcttgatcgtctttattttcaacggttttttgtggtgggcttcccggtctcttgaatctcttggtttaactgcgtttcataaaacatcgcttcatttctggcaatttcttttgtttctttttattattggctcttgcttacatgtgtggcatctacgagatttctctggatcgatcaacttgtgtttgtagcatcttggaggatatgtgcgaagatttcttcgaaaagatcggtatctttaatcggcgcgtgtagttcttgccaaaggtggaaaaatgcggaactttatcgtgcatatctaatccaagaaaccaacgataggcacattgacctcgattctttgatggtctgacgcagcttttgatgccgtaaaggtattggataaatggaattttaatcaacacaactggatcgatgcttggacggccctgatctgccgatacttttcctcaaccagttcatagataatgaccagtcaatggcctcatcgatcattcgaagaagatgatcttttggaactagtcgcatacaaaatatttgaattgatctcgtttcttttcaccgttttggtcagcacttttatacggcttaactgaatgcatggcctgtttctattattgctattttaccacgtttgtattgcgacaggtgaaaaatgactgactgctataaaaaaacaaagcctagagcgtttccctctagactttgtcgacagtctggcggcatctcgttttgagatgccgttttttgtgttataataaacaaaacggttcgaccgacaggggagtgctatgaaagaatccttatccgcagacgagatccaaaggctcgtcgcccgcgtccgcgccctttcggacaaaacagaagcgcggcttgccaaaaatccatacaacttcttttatcagggcaaatccgtcgcctacgcggaagtcatggccctgttggcccgggagctggagacctcatcccacgaaaaaaagggctgaaccctcagcccttaaagatttttaacaacgcggctccaccgcaatcaatttaaaataaattaaaaaaaggaggaaccatgcagccagattataaaaagcgcagaaagattttgttcatcttctgcatcattttatttgtggcgctcatcggcctggcggccttccgccacttcacgcacacgtcgaaaaacgcgtcgaagtcggcgatggcgccggtaccggccgtcacgcgcacaattcagagttaaacgcgcaggagcgattcagctgtggtgaccacccagctgattttttttgcgttaatcgccgtcgccagcccgaagaccaggaacaccagcgtcagcatcagcgacaccagccagatgatcccgcaggtgcggaagaccttgttgtcgttctcgttgcggctcgagatgaacagccacagcatgcccatcgcgacaacggcggcgacgaagacgaagcccaggacgattagcgggcggtttaccgcgcggatctgcgagtaggtgaaggccccgccgagcaccgagagcacgcccaaaagggccgaaacaggaatagatttcgatttcataacaacctcgttcatttgttttttaaaggatttgattacagccattatacacaaaagcggggcggccggcttaaaaaaattaaaattggcctttgacaaaccgaaaaaatcgtgctatattgtatacaaaattaaataaagcaacaccaaaccgttgagacggagataacgtcagtgatgctcatacagagacttcggggagctgagagccgaggagaaaacaagctgaacaaatggaccgttgagggcgcagtgaaaggcagtgccgagtattctgcgacgtgtgggcatacgtcagttgccgggagtatgttggtacttcgctaagggcacagggtcatacctgtgaatcaaggtggcaacgcggatagtgtatttagaatatctagaattattcgtccttgacagatggatctgtcagggacttttttattacaaaaaaatcttctcggacagaaagttgatcagaaaatacaagagaaggagaacgaacatggaagtttacccaaagctatcggaagtcaaagccgtcgcggcctccgggaaataccgggtctgcccggtgaaaacggagatcctcgccgaccgctgcacgcccatcgaggcgctgaagatcctcaaaaacgtgtcggctcactgctacgtgctggaatcggtggtccaccgggaaaactggggacaatacaccttcctcggatttgacccgaagctggccatcacctgcaaggacggccagatgcaggtcggcgacgtcagcctgaccaccgacgacccgtcggcggtgctaagagacgtgctctccaaatacaaaagcccgaagctcgaagggttcccgcccttcaccggcggcctggtcggttacttcgcctttgaaagcttcggctacgccgaaccgacgatccgcaccgcccaggacgatcccgaaaatttcaatgacatcgacgtgatgctcttcgacaaagtcatcgccttcgaccacatcgcccagaagatcgtgctgatcgccaacgccgatttgaaagatcctgaaacgggttaccgcaaggccgaaatggacgtgaagaacttggccgagctcatcaagcacggcgtcaagaaggaagagccggccggccatcttaaaggcgagctcaccccgatgttcgacaagaatcagtactgcgcgatggtcgaaaagaccaagaactacatccgggaaggagacatcttccaggcggtcatcggcaacggcctcgttgccccctacgaaggcagcctgctcaacacctaccgggtgctgcgcgcgaccaacccttcgccctacatgttctacttctccggcaccgacgtcgaaatcgccggcgcctccccggaaaccctggtcaagctcaaggacggcgtgctgcacaccttccccctcgccggcacccgtccccggggcgcgaccgaggatgaggatcaggccctcgaggcggatttacggcaggacgaaaaggagctggccgaacacgacatgctcgtcgacctcggccgcaacgatttgggccgcatcagccagttcggcaccgtccaggtcgaaaagctccacgtgatcgagcgctactcccacgtcatgcacattgggtccaccgtccgcggcagaatccaggacgggaaggacgccctggacgccatctcggcggccctgccggccggcaccctgtcgggcgcgccgaaaattagagcctgccagatcatcggcgagctcgaagggcagaagcgcggcatctacggcggcgccatcggctacatcgattttaccggcaacatggacgtcggcatcgcgatccgcctggcctacaagcggggcggcaaggtcttcgtcagaagcggtgccggcatcgtcgccgattccgtcccggaaaaggaatatcaggaatgcttgaacaaggccaaggcggtcgtcgaggccctgaagctggctgaggaggtagacgcatgattttactcatcgataattacgacagcttttcctacaatctgtaccaggtggtcgggagcctcgacccgtcgatcgaagtcatccgcaacgacgacaaaaccgtcgccgagatcgaagccatggccccggacgcgatcatcctctcgcccgggccgggccgcccgaaggacgccggcgtcatcgaggacgtcgtccgggagctcggcggcaagatcccgatcctcggcatctgcctcggccatcaggccatcggcgaggcctgtggcgccaccgtcacctacgcggccaagctgatgcacggcaaggcctcggccgtcactctggatcaagccagtccgctgtttgcggactgcccaaaggtgatccaggccgggcgctaccactcgctggccgtcgaccgggacaccttgccggacaatctcaaggtcatcgccgaaaccgacgacggcgaggtcatggccatcgccgacgaggcgaaaaaaatctacggcattcaattccatccggagtcgatcttgacccccaagggcaaacagattttgaagaattttttagcgattgcagaacagtaaaggagaccccatgataaaagaagccattatcaaaatcgtcagcaaagaagatttaacctacgacgaagcctacgccgtgatgaacgaaatcatgagcgggaagaccaccccgacccagaacgcggccttcctcgcggcgctgtccaccaagagcacccgggccgaaaccatcgcggaaatttccggctgcgcggcggcgatgcgcgaacacgcgacaccggtccacttcgacgaaccggtgctggaaatcgtcggcaccggcggcgacaacgcccagagcttcaacatctcgacgacggcggccatcatctcggcggccggtggggtcaaggtcgccaagcacggcaaccgcgccgcctcctccaaatgcgggacggccgactgcctcgaagccctcggcgtcaacatcgaacaggacccggacaaggtgaaggacatgatcgcgaaggcgaacatgtgcttcttcttcgcccagaaataccacacgtcgatgaaatacgtcggcgcgatccgcaaggagctgggcttccgcaccgtgttcaatatcttggggcctttgaccaacccgtgccggccggacatgcagctcctcggcgtgtacgacggctacctggtcgaacccctggcccaagtcatgacccagctgggtgtcaagcggggcatggtcgtctacggcaccgacaagctcgacgaaatctcgatttcggcgccgactcaggtctgcgaatttaaggacggctggtaccggacgacgaccatcgcgccggaagatttcggcctcgaaaggggcacgaaggccgacatccgcggcggcagccccgaagaaaacgcccagatcttaagagacatcctcgcggggaaggaaagagggccgaagcgcggcgcggcggtgctcaacgcggcggccgccctgaccatcgcggaaaagaccgacacgatagccgacggcgtcaagcacgcggaagcactgatcgactccggcgcggcggcggctcagcttgaaaccattatcgaaacgagccaggcataagatgaaaaacattctggaccaattagcggaccacgcccgggaacgggtcgccgcggcgaaacaacaggtcagcgccgacgcgatgcgggcggcggccgacagcctggaacccggcaacttcgaatttgagcgggccctcaaaaagccgggcctgtccttcatctgcgagtgcaaaaaggcctccccctcaaagggcctgatcgcaccggacttcccgtatcttgaaatcacgaaggactacgaaagggccggcgccgacgccatctcctgcttgaccgagcccaaatggttcctcggaaaagacgtctacctccaggcgatcgcgaatcaggtgcgtattccggtgctccggaaggatttcaccgtcgacgcctacatgatcgatcaggcgaaggtcctcggcgcgtcggcagtgctgctcatcgtcgcgatcaccgcgcctgaggatttgaggcgatacctcgcccgctgcgacgccctcggcctctcggcggtggtcgaagcccacgatgcggacgaaatcgccacggccctctccgccggggcgcggatcgtcggcgtcaacaaccgcaacctgaaggatttcaccgtcgacaccggcaacagcgcggcgctgcgggacctggtgccgccggaggtggtcttcatttccgaatccggcgtcaagacggcggcagacgtccaggccatccgcgataccggcgccgacgcggtgctcgtcggcgaggcgctgatgcgcgccgaggacaagaccgcggccctcaaggcgctcaaaagcgaggcgtgacatgtcgacccacatcaagctctgcggcatgatgcgcccagaggatatcgaaacggccaacggcctcaagcccgattttatcggcttcgtgttcgcgaagaagagtaagcggtccgtcactcccgatcaggcggcggcgctcaaggcggccctcgatcggcacatcaaggccgtcggcgtcttcgtcgacgaggacccggcggtgatcgccaagctgtttgcagacggcgtgatcgacgccgcccagcttcacggcggcgagacggacgacgtcgtcgcccaggtcaaagccctcaccggcggaaaatgcccggtcattcaggccgtggcgatgcgcggggcaggggacatcgcccgagcggccgccagcccggcggaccacatcctcctcgacgccaagggcggcggcaccggccaccccttcaactgggacctcgccaaggcggtcagccggccttacctcttagccggcggcctctccccggacaacatcgccgaggccctcgaaaccctccacccctggggcgtcgacgtcagctccggtattgaaaccgacggcagaaaagacggcgaaaagatgcggcactttgtcgaacaggtccgccgctttgacgctaatatataaagaagaaaaaattaatttgaatttttaaattttgaaagaaaggacacaatcatgacgaatccaaagggacgcttcggcattcacggcggccagtacattccggaaacgctgatgaacgcagtcatcgaactcgaagcggcatacaatcactacaaggacgacccggaattcaatcgggagctgaacgatttgatggtcaactacgccggccggccgtccatgctctacgaagccaaacacatgacggaagacctcggcggcgcaaagatctacctgaagcgggaggatctgaaccacaccggcgcccacaaaatcaacaacgtgctggggcaggcgctgctggctaagaaaatgggcaagacccggctgattgccgaaaccggcgcgggccagcacggcgtcgcgacggcgacggtggcggcgctcctcggtatggaatgcgtcgtcttcatgggcatcgaggacacgaagcgccaggccctcaatgtctaccggatgcgcctcctcggcgcggacgtcgtgcctgtcacctccggcaccggcactttgaaggacgcggtgtccgaagcgatgcgcgaatggacgagccggatcgccgacacccattactgcctcggctcggtgatggggccccatccgttcccgaccatcgtccgggatttccaggcggtgatctccagggaaatcaagacgcagatcctcgaaaaggaaggccggctgcctgacgccgtcatcgcctgtgtcggcggcggctccaacgccatcggctccttctacaatttcatcgacgacaaggacgtcaagctcatcggctgcgaagcggcgggccgcggcatcgacaccttcgaaacggcggcgacgatcaacaccggccgcctcggcatcttccacggtatgaagtcctatttctgccaggataaatacgggcagatcgcgccggtctactcgatctcggcggggctggattacccgggtatcgggccggaacacgcccacctccacgacatcggccgcgcccagtacgtcgcgatcaccgacgaggaagccgtcgaagccttcgaatacctgtcgaagatcgaaggcatcatcccggccatcgaatcggctcacgcggtggcctacgcgatgaaaatcgcgccgaagatggacaaggatcagattatcgtcgtcacgctttcaggacgcggggacaaggacgtcgccgccatcgcacgctacagaggggaggatctccatgactgaaaaacacaccaaccgcattgccaaggcctttgatcacggcaaggccttcgtcgccttcatcacctgcggcgacccggatctcgaaaccaccggcaaagtcgttcgccaggcggctgccaacggcgccgatttgatcgagctcggcattccgttctcggacccgaccgctgaagggccggtcattcagggcgccaatatccgggccctttccggcggcgtcaccaccgacaagatctttgaatttgttaaagaactcagaaaagacgtggacatcccgatggtcttcatgacctacgccaatgtcgtcttttcctacggcaccgaaaaattcgtcaaaatctgcagcgaaatcggcatcgacgggctgatcctgccggacgtcccctacgaagaaaaggcggacttccagccgacctgccagaaatacggcctgagcctgatttcgatgatcgcgccgacctctcacgaccgcatcgcgatgatcgccaaggaggcggagggctttctctacatcgtctccagcctcggcgtcaccggggaacggcaggccattaccaccgacgtcggcgccatcgtggacgtcgtcagacagaacaccgacatcccctgcgccatcggcttcggcatctcgacgccggatcaggccagcacaatggcccagaaggccgatggcgtcatcgtcggctcggccatcgtccgaagactcgccgaatacggcaaggacgcggcggaaccggtgggcgcctacgtcaaatcgatgaaggacgccatcgcggatctttaaataaaacgccttcgattcttaaaacaaaacgcgctttctggggaagtggatttcccggaagcgcttttttggtataatgaaatctcaagaatgtacgcgaaaggagcggcgctgtggggaatgtcttcgattatctgaaatggcggggtgatatcccgatggaggtggacggttttaacgccgttgacaacctgatcttttccgagctggtttacgtcgatctcgaaaaggcggtacccgagagctgggaccccggcgttacgattgccgaggcggcggcgcgctaccaggccgccgaggacccagagcaggccgcggccttttcggtctacaagcgcaaatccgtggcgctgctcgcggcggcggccgagacccggcggtttcgggacgtcaagatgcacgcctttatcaatcgggtgagccattcggcggaggggcagatggcggcggtgaccttcgagatgccccatcaccgctattacacggccttccgcggcactgacgactcttttgtcggctggaaagaggatttcaacatctcctacctcccggaaaccgagggccagcgccagtcagcgacctatttaaaccgccactttgtcggacgaagagggacgcttatgaccggcggccactccaagggcggcaatttcgcggtgtacgcggcggcgatggccgcgccgggcgttagagagcggatccaccgaatctacaacaacgacggcccgggttttcgggaggccttcgtcagccgggcaggctacctctcggtgcgggacaaaattgtcagcatcattcccgccgggtcggtcatcggcgtgctgctggccaacgtgccgcctcacgtcgtcgtcgcaagcgacgcccagggcatcgtccagcacgacggcttcagctggcaggtcctggggacggacttcgtgcccggggcgcgcacggccttgagcctgtacatcgaggacaccctgagccgctggatcgagggcgagagcgacgccgaccggcgccacttcgtcgacggccttttcgacatctttaacgaaggcctcgaccagatggacgatctgtccaacaagcgcctcgtttctctggccaaatgcgtgcgggcgctgaaaaacctgcccctggacgaacgccagcagttcatcaaggtgaccctcgacctgctgcgccagggcggcgccgtggccggcgaaaaatccgagacttggctcaaaggaatcgaggaaaaactcccggaaatcaagctttctctgcccgataaacttaaaaaattataaaaataaagggcaagatattgtctttttacgataaaattaatataatatataacaagatcatgaaaaaataacggttgagtcattaaggagactacaaaggaagcgcaacatgaaaacaagtgaaacaatagattggacactgagtgatgaatggccgggattgatcgaacaaatcagccagggcattatcaacagtcggcacgcactgggaatgacccagaaggagctctcaaaattgaccggcatttcgcagagcgatatcagccggatcgaaaacggcaacgcgaacccgtcggcgaagaccttgatgcggctcgcgaaggcattgaaccgagacatccatcttacctttgaaatgaagacggacgaaggccaatgaaccactcgaaatagcatcagacagcaaaacccgctttgagacaggcgttagattcgccttgtcctcgaagcgggttttattttttggcttattatattatcatgtaaattttctaaaaacgattttcatcctttgacgatgccgccgcggatttccatgttgatttcggcgatttccttttcacccgcgaaatagggctcgtacatcgactcgagccgcccgctgccgagactgccgcagccgttgcagaaattgcaggacccgccacagacactcagcgctcgggccacaatgcgttcccgttcttcccgggtggtgtctttaatcaggatggatttgggctgtttcaaacgaatcacctccttaagaattctattttcaattataccagcttttcggtaggtaataaagatttaaacgattttattttatacgtcaaaacttaatttataatgattttaaactagaaaaaataagtttgataattcaaacaaaaatgtttgttatgccttgacaaacaaaataaggggtgataaactcgcattgtcgttagggaaaacgaacatagttctgattaacaaattgtgtttgcgaagccaaacgactggacttatatttttaaatttaaacatctgatgaaggaggcatgtcaatggcaacgctcaaagatgccaaggtagggagcaccgtaaagattaaaaagattcacggcgccggcccgattaaaaagcggatcatggatatgggcctgacgaagggtcaggacatttacatccgcaaggtcgcaccccttggcgatccgattgaaatcacggtacgcaattacgaactgagtcttcgaaaagaagacgcagggatggtcgaagtggaataaagaggaaaaaaaggagaaaacatgtcaaagattattgccttggccggcaacccgaactgtgggaagacgacactgttcaactcactgacaggcgccaaccagtacgtcgggaactggccaggagttacggttgaaaagaaggaaggccgactgaagggccacaaggacatcacgattacggacctgccggggatttactcactgtctccgtacacattggaagaagtggtcgctcgggattacatcattcaggaaagaccggacgccatcatcaatatcatcgacggctccaacctggaacgcaacctgtacttgacgacacaggttctggaatgcggcattccaacagtcatcgccgtcaatatgctcgacttgatcgaaaaagccggcgacaaggtggactacaaaaaattgtccaagatcacaggctgcccagtggtgccgatttcagcgctgaagggccgtggggtcaacgaactggtcgaaacggccgtcaaccttgccaattcaggtgaaacatacctgccaccgcaccgcttctccggcccggtagaacattgcttggcccatatcgaagaagccctgctccacgatatgccggaagaagaacagcgctggtacgccgtcaaggtttttgaaaacgaccaaaaggcgctggccaaccttcacctcgatccgaagatggtcgcccacgcgagagaagacgtcatcgcctgcgaaaaggaaatggacgacgacgccgaatccattatcacgagcgaacgctacgacatcatcggcgactgggtgaaagatacttacgtcaagaaaaacgccggaaagctctccgtctccgataaaatcgaccgcattgtcaccaaccgaatcctggggctcccgattttcgtcgggattatgttcttggtttactacatctccattacgacaatcgggacgatggccacagactgggtcaacgacgtgttggtcggcgactggatcaccaacggggtccgcggcgcgatggaagccgcctcggttgccccatggctgaccggcctcgtcgtcgatgggatcatcgccggggtcggcgcggtcatcggtttcttaccgcagatgatggttttcttcttcttcctggccctgctggaaagctgcggctacatggcaagaatcgccttcgtcctcgaccgtgtatttagaaaattcggcttgtccggtaaatcctttattccgattttgatcgggaccggctgcggcgtccctggggttatggggacgagaaccatcgaaaacgaacgtgaccgccgcatgaccatcatgacgacgacgttcatgccgtgttcagcgaaactgccgatcatcgcattgatctcaggcgctgtgttcggcggcagcggtgctgttgccacctccgcttatttcatggggatcgcggccatcatctgctccgggatcattttaaagaaaaccaaatggttcgcaggcgatccggccccattcgtcatggaactgccggcttatcactggccgcgtccagttgacgtgctcagatcggtttgggaaagagcttctcacttcctgaaaaaagcgggcaccatcattacgttagctaccatcctgatttggttcctccaggcgtttggcgtcgaaggcggatccttcggaatggttcaaaatatcaacaactccatgttggcagggattggcaacgccatcgccttcatcttcatgccactgggctgggggacatggaaaccagttgtcgcaaccgtcaccggtttaatcgccaaggaaaacgtcgtcggcaccttcgggattctgtaccacgctgtatctgacgcagaagccggcagcgcacacctgtgggcgagagtcgcacagtcctacaccccgattaccgcgtactcattcttagctttcaacctgctctgcgcaccttgcttcgcagcgatcggcgctatccgcaccgaaatgaactctggcaagtggaccgcaagagcaatcggctacgaatgcctgctcgcttatttagtcgcactggtcatcaatcagttcggcggctggattgcaggcgaacacggctttggcatcggcccagttgtcgccatcgtgattatgatcggatttgtctatctgctcgtcagaccagacccgaacaagaagctgatggatgcggctcgggcacaagatgtgtcgatcaactaaatgattacagcattattacaacacaacagattagaggtggatttaaatgttaggttcaatcattgtgggtttcatcgtcgttctgatcgtggtcgccgcggtgaggtccctgcataaatccgtcaaaaacggcggcaccattcagtgcggggactgccccagcgcgggtgcctgccacggcggctgcaagagcggtccgacgcccgaacagcgggaatggatcaacacctacagcagccgaaaacacaaagcaaattagctttccctgtggattctccacatgatataaatatgcaggcggctccgccgtctgtcctccttctttgatgattattaaaaagggaaagaccgctgaatcgacgaaaaatgcgtttagagcacgcatggtctggcgcgggttttatttcatcgatgtgagtgatcactcgattcctcttctttcagctaaccgcggcagcccgaggggtctgaaacgttcaaacacctatttgatctatccatagatccgagacctcagttggtcccagcgaagaaatggccggtctgacctgaaataacgccgaagggaattagtgcctcccggacgcagtcaggaggatcggtcgttttttattggtcaatcgaatcaaagtaaaaaaggagtttaatatgccgttatcacttgcagaactcaatcaggaatatacgattaaattcatccgcggcaacgacaagatcatgaagcacatgaacgatttaggttttgtcgtcggcgcgacggtcaaaccggtccagaaattgggcggcaacctcatcgtcgccatcaaggacagccgggtcgccattgacgaatcgatggcaaataagattattgtgtaaaacgaaaaaggtggcaaataaaaaggaagaacggtattgatgggcgacggcatcaacgattcgccagccctctctgaagcggacgtcggcatcgccattgcagaaggcgccgacatcgccagagaaatcgcagacgtgaccatttcggaaaacgatctgaacgagctggtgacgctgaagcagtgcgccgatgcgctgatgaaacggctgaagcacaaccgcaacttcatcgtgaccttcaacacaggggtcattgtggcgggtgccttcgggctcttcacaccgggattgtccgcgattttacacaacacgtcgaccatcgcgatttgtctgcacagcatgcgcaacttattaccagaagcgtaagattccaggcgctcccggcgaaagccgggtccgcctgtgtgattctacaagcacgttaccatcgtgccagccttagggaaggcggcaggattgtggggtgctaaaaaaaccataaaaagttagacaattctaataaaaggagaaacattatggcaaagtatgcagtagtattttggagcggaaccggcaacacagaagcaatggcagacgcggtggcagacggcattaaaggcgccgacggcgacgtcgatgtcatccaggccagcgacttctcagccgatcaggtcggtggttacgacggcatcgcgttcggctgcccgtcgatgggcgttgaacagctggaagacagcgaattcgaaccgatgttcgacgacgtcaaagggagtctgaagggcaaaaacatcgtgctgtttggctcctacggctggggcgacggcgaatggatgcgcaattgggaagacgactgcgacgacatcggcgcaaaacgcgcagcggattcggtgatctgcaacgaaacaccggacgacgaagcgactgaatcctgcaaggcgttgggcaaggcattggtcgaagcgtaatttaaaaacgataaagccatgtctgatctgcagttgattcgaaattgtgcgccgacgctggcgggaatgaaaatcggaagcctgttcaacgcgagggaaagggaagaagctcaggtgaacttatggcttaagcgttggaacgcgcttttaaatgagaaaggggtttacgtccggtgtctgcgttacaacggccgggctgcgttaatgtacgtctaccgggaggcggcgttaaatgaacggatgcgtgagccggaggtgcaggcgctgatgcggcggctgcgctacccggcgggcgggatcgcgggtaaaatcgatcatttgtccgcgcatctgaatgcgcatcccgaatttccccacgaaatcggcctgtttctcggttatccgctggaggacgtctgtggctttatccagaaaaaagggagagattacaagtgttcaggatgctggaaggtgtacggtgacgcggaaaaggcaaaggcgtgctttaagaagtaccaccgctgcaccgcccattacgtgaagcattatcaaaagggcggcaccctgtgccagctgacggtttaagcatttggtgagcaccggctctgtattttttataaaatgcagggccggcttttttgcgtttaaatgagcggctgaaggaaaacaataaaaaagcttatcccacttaaagtaaaggcggaataagccgttattttattgctgccagacggtgtcgatgtgatcgctgatgtcctgggtccggctcgacggcgtgtagtcgtgctcgtagatgaactggtgcagggtctgcacgttttcgcttaaggacgtcgggaagacgtaggactggccctggagatagccaaggctcagctggttcgcgtcaggaatctgctgctgctgaagggtggcgttccggaccagcgcgagattaaagaggaatttaaaaatcttggcgttggacatgttggtcttgatgtagggcttgactgtcttgtagaggcggtactgcttcgacaggctcatctttttggccttgttcaaaaccttctgcatgacggtgcgctggcgctgggtgcgcccgaaatccccgttgccgacgtagcggatgcgcgagtaggccagggcctggacgccgttcaaatgcttggtgccgctgccggtcacgtgcttcgcgtttttgttgttggtccggttaatgttgtcgacgtaatcgttgaggacgctgacttcgtcggacgagaggtcgacgtcgacgccgcccaccgcgttgaccactttaatggtgcagtcaaagttgatggtgatgtagtcggtgatcgccgtgtcgaaattcgtgttgatggtcttgagggcgagggacggcccgccgtaggcgtaggcagcgttgagcttgccgtaattgtgcccgggaatttggacgtaagtatcgcgcatcaacgacgtcgccttgattttcttgtgcttgttgtcgctggtcacgatcatgatcgagtcggaacgggcgcccgcaacgtcggagcgcgagtcgatgccgaagaccgcgacgttcatgatccgcttgccgctggcctcactggcggccttgaggctgatgccccgggaggggctgacggttacgaaaacaggccagatcagcacgacgtaggcggcggcgatcagcgccgcgacgatggcgatcagcgaaatccagagttttttgcggctctttttgtgagcagctggagctgccgggctgccggtccggcgtccagtgctgcgccgcgggatttgcccggtcgggcggacacggtggcgctggctgccatcggacgggcgccggtttgtgccagaggtgcgccgcctaatcggctgtcggctctggccggaagcgtcggggcgttgaatgcggccagtggtccggtggacgatccgctgaccctcatttcggggctggcgtctttgcggctggccgctcgttcgacgcgcggagccgggtgacgccgcggttcgcgtggttctcttctgcggcgggcggctgacgccctgcgcagaagctgtccggcgtttttggggctgggccgtccggctggcagggcgcctttgagcctgcgacgtgctgggccgcttcggcggcttcgacgaaaggtttcggacagggcgggcagcacggctcgacgggcgggctgattgggccgttctatggacggttgaagatctttgagctgatcggttcgctcggttcgcgccggaacgctcagccagccgtctttgacgggccagttcagcgcgttcgctttcggttaaaggtcttcgctgttttgatcgatgattcaagatacttctccctaacgttaaaatttaactgacttattatatcacgacctgtcaagtgtggccctgaattgcaaaaaattatataaattgtgaattacaatgataaaaaatatacatttgaaggaacatttgttataataacactatcataaactgaggagttgaatttatgacagatcaaaaaagccggagatggcttttatatatctttgattgtatcgcgctggcggtcggcaacttcggcatgctgggcatatccaaattcatttttaatgcggaggtcaggactgatctggcgacgatcgtgctgttcatgctctgtatccgcctgttgattgtggcgctgggcgatttcacaggcttttgcgacaagctctggcacaccgtgatgatcgtcgccatcgaagaagcggccgtcgtgatcgtcgagtacgtgatggtctacggcctgtctcagcgctttctgatcatgacggcggcggcggacctgattctcgtgatgctggtccacattctctggcggcgcagacagcgcaaggctgtgccggcggacgcagcaggtgacgccgtccagaccgatacaggcggcgaagcgctggaaggggtgcttgcggccgaagaagaagcggccgcggatgaagcagcagcagctgaagatgacaaagatcacaaggtcagctggctgctcagaggcagcgtgttggatgacgctgacgaagcagacgaagcctccgaagcatcggacgcggcggatcagaccgaagcatcaggcagcggcacagccctcgattggctggacgacgacgatgaagattttggatcagaaggatccgggctgttcacacctgaagacgatgacctcgaagcagatgaaggcgctgaagatagccaagaggatgagccggaagcggcaatagacgaaggcgcgcccgaacaggaaacagcgtctgaacaaagcgcagcaccggtgttcgacgacagcgaagcggcatctgaaaccgccgagatcgaagacgccgaagaggaagaaccggcctctgagccgaccacaaccgaagctgagtctgaagcaccggcagcagaggaaactgcagcgccggaaaccgaaaaagtgcttgatgagcctgaacaagctgagtcagaatcggcggcgcctgaagttgaagcggcacctgaacctgaggaccagacggcgcagcaggaagccacgtatcgggacgtcgaagacgacctcaacgattttatcgacgtgttaagtgcagaggtttccgacgacgtgtacaccgaagtgtccgcccggctcaaggcctcccttgaaaggctcctcgccttcaggacagacgagccctttgtttcgacgagccgcgagctgatcggtcagctggacggcaccaaaagcaaaggcgatttgaccactgcggcgatcgacaacgtcattgccgtggcccagcagatcgaatccattgaccaagtcgaaaacgtgatcgaagcgccggcggcgacggccgaaaagccggttgaagcgcaccgcgtgaaaaagtcggactacaacattcaggacgacgaaattctcctcgacagcggcgattcggaaatcatcatctcaaaagaagatctcgaacacatccgcaattacatgaaaaaccaccgcaaatcgaagtaaatctttatagcgtctatcttctctcttgaataaaagggaataggcgcttttttaatgcttaaacgcgcctcactgtaaataatgcaaataaaataatacgataaaaaaggcacagccgattgatttagctgtgcctttgaacttgtcaatagatatttttagaagatttaattagaagaattttcgatctgcagattcgatttaagctgcgacaaggtgaaactttcagtgtgtgcgatcggttcccaggtggtcagcggcttgaggatgcaggcgaaattgatgaccgtccacgatacgataaagaaccaccaggtgaaataagacgacgtcttgaccgagctgtttttgtgatgttcgtggcggacgagccagtgggtgaactgaatcgtcagcagaatgcccacagcgcttccggcgattgagaggtaattctgcgtctgcggaatctgcaggttgatcgaaatcatcatgatgataatgaacgacacgaagctgtaaatcgtggagatgacctgaagcagcggcgccgacaggtagagaatcatgtcgatgcagccgaagcggtgcgtttctttaaagctctgccagagcttcggcgtgtagtaggagaagcactggatcgtgccggtggaccagcgtttgcgctgcttccacgaggtcttgaaatcgatcgggtgttcgtcgtaggtccgggcgtccggcacccaggagacgtactgccctttgatgatgttctgcgtggtgaattcgatgtcttcagtcaggctgaaggttctgaagcccgaattgtctttctttaagaccttggccgaaaccatgaagcccgtgccgttgagggcggcggagaggccgacgttctggcgggcttggttgatgaaccggttgaccgtgtagtagaaaatcgtctggcagcctgaaacccacgaggttttcgggttcttgctttcgcggtagccctggccgatttcgacgccggcacacatcgcgttgttcatggcctggaagaaatcctgctgaacgaggttatcggcatcgaagatgcagaagccgtcgtaaatgtcgttgtgagcgaaggtgtcgtcgaagaattcttcgagggcgccgccctttgaatgcactgccgaggagcagtggaacgttttggcaccgtgggccagtgccacttcttcggtgttgtcggtgcagttgttcggcagcacgtaaatgtcgtagagttccttcgggtaatgctgttccttgagagagtcgatcaaattgccgacgactccggcttcgttgcgcgcggcgatgaccgcggcgaattttttctgcggcggcgcctggggatattcctttgatttgaacaatcccatgacgccgatgatgacgtaatacacaccgtaaatcgtaaaaggcagacccagaatgattagcgcagtccggatcgcatcttgtaccatcatagacaaccttccttttatatccttattttatttatacaaaaattcgtaaatcattggaaaaatcgtatttccaaaaattccggtgttattttatcatcatttccggattttgacaagaaagccggcaaaatctagggaaaacattaagattgacagaagggacgccgtgtaataaaatagatctgtttttaaaatacacactttattcggagagaccgaaaaggtagtgaggagtttaatatgaaaaaacagaatagttcaaagcagaagacccgttggctggtcacgttggcgatgttcgccgcaatcatcgtattgctggctttcacgccgttgggattgatcccgcttccgtttatcaaggcgacgacgattcaaataccggtcgtcatcggtgccattctgctggggcccttggccggcgccattttaggcggcgtctttggcatttgctcgatggtcaacgcaaccgttgcgccgacaccgatgagctttgccttttctccggcactcgcgatgaacgcggccggtgcggtcaaggccgtttggatcgctctcggatgccgcatctgcatcggtatcgtcgccggatggctctggcgcgggctgaaaaacgtcaagatgaacgacattccagcgctcgcgattaccggcgcggctggcgcgatgacgaacaccgcccttgtgatgggcagcatttacctgctgctggctcaggaatatgccaagagcatcggcagttccatgagcgcagtatttaaggtgatcatgggtgtggtagccggcaacggcgttccagaagccatcgtcaccgcgattctcgtaaccgtcatcggcaaggcgcttttagcgctgacgaagcggtcggcaaaataacttcataatatattggcaaggcgtcaggcgtttgtctggcgtctatttttttaatttaaaggagatttatgaaattcagcacattggctattcgggaaacgacccttcaggcggtcgatcaaatgggaattgtagagatgacgccgattcaggaacgggcgattcccgtattattagagggaaaagacgtcatcggccgttcccagaccgggacaggcaagaccctcgccttcgcggtgcccgctgtcacggcaatcgacggtgcagaaagacacccccaggtgctcgtgctgctgccgacccgggagctggctattcaggtcgccggcgaattcgacaagctcacagcctttgacgacgccctctccgtggccctgctttacggcggcgaacgctttgaccgccagcttgcagccctgcgcggcggcgcgcagatcgtcgtcggcacgccggggcgcaccctggaccatctgcgccgcggcaccctgaagctcgatcagttgaaaaccgccgtactggatgaagccgacgaaatgctcgacatgggcttccgggaggacatcgaagggattttgtctcagatcggccatccggttcagacggcgctgttctcggcgaccatgccgaagccgattctcgagctggccggacgtttccagcacggtcctgtcaaaatcgaggtggcgccgaagcgcgtcgtcgcctcgggcatcgaccagaaggtctttatcgtgaaaaaagggatgaagcttgaagcgctgatgcgcctcctcgaggtgtttgaaatgcagaagaccctcattttttgtaacacgaaacgcgccgtggacaccgttgcgatgcagctgatcgaccagggatatccggtaagcaagctccacggcgacatcgaccaatcggccagacaggcggtgctcagacgcttcacccgctcaaagcacggcgctctcgtcgcgacggatgtggccgctcggggtatcgacatcgacgacatcgacctcgtcatcaattacgacgtgccggaaaacgcggaggattacgtccatcggatcggccggactggccgcgccgggcgcaagggcacgtcgctgaccctggcccagaaccgcgaccgcttccaccttgaaaagatcgaggcctacacaaaaaagaaaatgacccgggagccgattccgacggggtcggaaattcaggtgctcaagagctgccagatgacggaaaagctcgctgcggcctgcgaagacatgcgcaccaatccggaaggcagcgctgcggacagcatttacagcggcattttagccgccctcagagacaagggcttttcggacgatcaaatcgctacggcgctgctcaggcagtgcatgccgatcaccgattacgccgagaccgatctcaacgaccagattaagacggtcggcgcggggaaaaagggcggcggccggaaaagcaggaagggccgtggccatcgggatccgcagtccggtgtgcggatcatgatcagcgcgggaaagaaggacggcgcgaagaagggcgacattctcggcgcgatctgcggtgaatcggggatttccagcgatgaggtcggggacatcgccgtgttcgggcatttctcgacggcggtggtggccgacgatcaggtagctaaggtcatcgcgggcctggacggcgcgcggatcaagcgcaccgtcgtgtcggcgtcgatcgcgggcaagaagaaagataaaaagaaaaaagggcatcacgcccgaaaaggccagcatcacggtaagaagaaaaaagtcgaaaagaaaaagtcgaagtgaagttcacttcgacttttttagtgcgcttttttgattaagcttcagccttccacagtccatggagattgcagaattcgtaagcagcgattagtttgtcatccgcggtcaattcaaaagaagccttcggcgcttcgcctggttttaagtatttgacctgaacgccctgagcggtttccagtgcgatccactgaatgtagtgtttttcgagcatcgggtgttcgacggagccgaccacgacgtcgacgtgagtgccgttctgagtaatgaccggaacgtgtttttctgttgcagcatctgtggtgttagcggttaattcgtccatatccacgccgcagcaaactggggtgcacggtgaatcctgaagtacataaaccatctgtccacatttcgagcatttgtaaattttcatattggcctccttctttgtgcctgtaatacgatttcatagctttattatagagcttgattttcattttgtaaagtgagttcggcgaaataaatcccgtcttaagataagatttaccttatttaatattagaatgaatcaaaataaaggcttaattaatcgtaataatcctttgcctttttccgccttttgagttcggccttcagccacgcgaaggttgcgtcctcgccctcgtcccgaagttttttgagcagaaactcgagctcctgatgggtggtggggtgcatgtagggcgaatccttcatgtgctggtaatagtcccaggggtgatgctcggtgtattgatcctttaaataaattttactcgcggcgacgcggtcgcagaacatttccgccacgtatttgtagggcatgcggaagccgaccattttggtgtgatctttgagatccaagtcgatccagtactcgaaatggtgcttgttgcggcccttgtggtgcagccaggcccgggagatgcccgtttgcttgcgggcctcggcgttgggactgtgggtgccggtgaaaaagcggacgcccgtcgaaaaatccgtccagctgtatttgctcatgtcgtggagcagcccctgcttataaagcccaaccttgaagcagtgcttcatcacgagccatttgtggtgggtgatggtcttgaaatggccccagcccatagataatgcgtttttcatgataaaccttcttttataattgcacgatttgattttttggcgatgtcacggtacatccagataaaaatcagaatagacatgatcccggcgagcagccacgcggccgggtcgcacgcgcaggacacggcgtaggaatgcaggtggatgccgagaacggcggtgccgccccgcgcggccagctcggtcaggccgcagatcagcggcagcatcgcgtagccgcagccctccatgctgcttctgaagatgaagatcatcgccagcgggatgtagcacggaatcgaaattttcgcgtaggtcagcgcccagggcatcattcgggacagttctttgcccgaggagaaaaacaggcccatgaacgtgcgcagcggcagcaccatcagcgccatcgcggcgatggaatagatcacctcgataatcaccgatattttaatcccctcgcggattcggccgaggtcccgcgcgccggcgttctgtccgcagaaggtcgccatcgtctgacccattgcgatcatgccctgcatcaaaatgttttgtattttcgacgcggcggtgaaggacgcgacggcgtcggcaccaaacaaattgatcgccgcctgcatgatcatgatgccggaatcggtgatcgcgtactgcagggccatcggaatgcccattcggatttcaaaggcgacggcccagcgcttcggccgccagtgatcgcggctgggaatcagcaccggcacgcgaagcaccgtgtacaccgcgcagagcaccgccgagatgccttgggagagcaccgtcgcggtggcggcaccgccgacaccggcgtgaaaggtgatgatgaacaacaggtcgagcccgacgttgagacacgcggaaaagacgaggaaatacagcggcgcgcggctgttgccgacggcgcgcagaaaagcggaaaacagattgtagaacaccgtgcagagcgtgccgaggcagatgatgcggatgtaggcgagggcatcgcggtagactgagactggcgtgttcatcagcttaagaatctgcggggcgaaggcccagaacagcacggttaaaattgcagacagggcaaagccgagctcgatgcctgtcgcgacggagaccttgacgccgccacggtccccggcgccgtagcgctgagaggtcagcaccgtgaagccggcagtgatgccgatggcaaagccgccgatcaaatacatcaacccgccggtggagccgacagccgccaaggcgtcggcgccgacgaagcggccgacgatgatcgtgtccaccatgttgtaaagcatctggaagacgtcgccgatcaaaagcggaatcataaatttgatgatgagcgggagaattctccccttggtcatatcctgttccattgcgtcctcctttgatttggtttttgacaatgttcattattatatcacacgcttgaaaaatgccaatgataaaagcgcggcctggggtttgacagtcgctgggggagttattataataggtgtgcaaataaggaaatggttaaattttagaacgaattatattttacggcggcaatatgcaaaaatcacaaaaaaaatcagacattaagattaaatcggcaaaaacctaccttcccggattggacgggctgcgggcccttgccatcatcggcgtcacctttttccacctgatcccgaatgttttcgcgggcggctatctgggcgtcctcctctttttcgtcatcaccgggtttcttttggcctacactacggctgagcgggaccaccgtggcacgtttacggtgccgaacttttacgccaagcgggtcaagcggctgtatccggagctcattctcgtcgtcttcttttcagtcggcgtcattcggtttcttgtgccctgggcggtgcaaggcatccggctcgaggtcgcgagtgtttttctcggcgtcaacaactggtggcagattgcccagaacgcggattattttaagcggatcgcgagcgcttcgccctttacccatctgtggtttctcggcatcgaaatacaatacattttaatttggccactgattttttggggcggcaagcaaataaagaagcggcgcggttttttcgcggcgtggtgctttgtgctgcttttatccctcgtcagcgcggtgtggatgccgatctgctaccagatcacccacaacgtcacccgggtctactacggcaccgatacccgcgccttcgcccttcttttcggggcctgtctcggactccttaaatacgaaagggacgcctcgagaaagcgcaggccgaggccacgcagggcgggaataaaaatcacggcggcgttctgggggattatcgcgcttgtggttgtcagctacgtcttcatcaaagggcgttacgcctttgtttacgacggcggcatggcgctgtataccctggctttcggcgcgctgctggcgatgaccgtggacagccgtctgactttcggcaggcgtctcgaccgcagccgcgtgctcaagtggatcggcagccacagctacggcttgtttctttggcagtatccggtgattttcgtctttaataacaagggctggctcgatcatgccgcgggcggcgtcctcgctctcgtgctgatcggtgcgctttcggcgtggtcggcgtggctcgtcgactttgtcgaaaaaaggagatggcagaagcctttcaaaaagcgcgggtttaaaatcgcggcggttgcagtggcctgcgctgcagcggcagtctgcggactgggcctttacacgacgctgacttcaaagaacagccgagcggaggtgcagcaggcgctgaaatcccggctggaaaagaatcaaaaggcgatttcaaaaacgaaggacgggacgccgatttatccttggacggatccgccgaaggccaaagccaattacaagggaacgggcaacgcggcgcgcgcctcggttaaaaacgtgacgattatcggcgattccgtgacgctggacgcggcgccggatctaaaggcgaaattcaacaacagtgtgacgatcaacgcgaaacagtcccgccacatcggcgacgagctggattgggtaaaaaaacagcgaaagcatcaccacctcggccgcaccgttgtgatctctctcggtaccaacggcgaactttacgagaaagcagtcaaggcgcttttgaaggtcctcgggccgaaccgctccgtattctgggtcaacgtctacgggccggagctggattggacccgcgccaacaacgactatctaaaccagctggccgcagcaacccccaatttgacgatcatcgattggaacagcaccctttccgcccatcccgaatggctctgggaagacggcatccacccgaatcccgacggctcgaaggcttacgcggatcagatttacaatgcgatcgaacaggtgcagacgaagtagcaggcggttgaccgggcacggcgtcagcacataaataagaaataaataaaacaaatgtaatcactgaaaattgtgatgaaaataacaaacggcaatttctatcaacttacatgcaaattttcaaaaaaagcttgaaaaaaataattttaggcttataataagcacagttcaaatcgaacagaattgaaataatgataaatagttcttctaccgagggccaacgagggcacgcaggcatgatgtcggtgtgcccttttatcattatttggaagaaaggaagtggtcatttgtcaaatctttcgaaagatctgagcgaagcgctgacgattaaaacggcattcagctttaaaatcgccggtcacacgattgcggtgtctgaatccgtcgtggtcacgtggatcatcatggcgatcctcatcgctctggcaattttcctgacgcacgggctcaaggttaaaaaccctgggaaaaagcagatctttctcgaatcggtcatgtccgccgggtacaacttgttttacggcatcctcggggacaatggcgccgggtacatcccttatttgctgacggtgatgttttatctcggctttgccaatttaatcgggattatcggctttacgcccccgactaaggatttgaacgtcactttggcgttggcgttgatgtccattgtgctcattgagtattccaatgcgcatcacaacggcggcaagaaatttttcaagagttttgccgaaccgcttccgctgatgacgccgtttaacatcatggaaatcggaattcggccgctgtccttgtgtatgcggcttttcggcaacgtgctgggttcctttgttgtcatggaacttttgaaggccgtctgtccgctgttcctgccggttccgttcagcatgtatttcgacatcttcgacggattgattcagatgatcgtgttcgtcttcttgacggcgctgtttatgcaggaaggcttaatcgacgactgacggcgcagtcagtttttggaaaaaacagtttgattcagaaattttaaaatctatatttaaggagaaattatcatgggtacacttattgcaattggtgcaggtattgcggttttaacagggatcggcgccggtattgggatcggcattgcgacagggaaggcgacagaagcgatcgctcgtcagccggaagcagaaggcaaaatcatgagaaacctgcttttgggatgtgcgctggctgaagcaaccgctatttatgggttcgtcatcggtcttctgatcatcatcatgttgaaataatgaaagcgcggtgacacactgtgctgaaagtagacattaatttggtcttcaccgtgattaatgtcattgtcctgtatttgattttaaggaaattcctattcaagccctttaacaacatgctggcgaagcggaaaaaactgattcaggacgatttcgacacggccgcggcagcgaaaacctctgccgaggacatgaagacccagtacgaaaaacagctgcaacagattcaaattgaacgcgaacagattttatctgacgcgaaaaagcaggccgatcaggtctatcagaagcgcatggcggaggcaaaagccgacgcgaaggcgctggctgaaaagacacggcgtcagctcgaggaagaacgcagacagaccgaacgggaactgcaggatgctgtcgcggatcttgccatgaaggcgacgaagaaagcgctggaaagcggtgcacctttatcggagggccgttatggaacgcttcgttagtcagacggtgatcgacggtgcaaaggtgattcgcagccagcatttatcgagcgacacgctcaaggaatgtcaggctattctcaatcagaatccggctctcattcagattctgtcagacccgacgaagcacacccgcgcgaaagcggacgtcattgagcagatcttcccgaaggaagtcgtgccgacctttgcggtgctgtgccggcacggacaatttaagaacatccgcaaaattttagacgcctgtgaagatctggcggacatcgaaaacggtacgggccacgggacactgtggtacgccggcgagatgccggaccgcgaggcgctggaaaagctggtgttcaataaattcggcgtccgcaacatcaaatggaaggtcgttcgtgacgacgcattgatcggcggcttccgcatccgaatccgcgatttcgtgtacgaccattcggtggcgggcagctttaaggaattgaacgcattgattaaaacacacaaacggaggtgagaacatgaactcagaacatatcgtccgcgtattagaggacgaaattgaaaactttagaaaagacgacagcgttcaggaaatcgggacagttctcaccgtcggcgacggcattgtttccgtgtacggaatgcgccgcgctttttacggcgaaattgtgaccttcgaatccggcgaccgcggtatggtccaggatatcggagaagatttgacacgctgtatcttattcggcagagacgccgatatctcagaaggtatggaagttcatcgcaccggacaggaaatgtcggtgccggtcggcgacgattttttaggccgcgtggtcaacgccttgggcgacccaatcgacggcaaagggcccatcgaatccagtgaacggcgcccgatcgaatcgccggcgccggggattctcgaccgtcaggccgtcgataccccgatggaaacggggatcttgtccatcgatacgatgttcccgatcggccgcggacagcgtgagctcatcatcggcgaccgccagacggggaagacctcgatcgcggtggacaccatgctcaaccaaaagggaaaggacactatctgtatttacgtggccatcggtcagaaggcgtcatcagtcgctcagctggccagaactctcgaaaattacggggcgatggattactcgatcatcgtcaacgcgtcggcggccaatacggcctcagaacagtacatcgcgccttattcaggcacggccatcgcagaatacttcatgcacaagggcaaggacgtgctgatcgtctacgacgatttgtccaagcacgcggtggcttaccgtgcgctttccctgctgctcggacgttcgccagggcgtgaagcttatcctggggacgttttttatctgcactccagactgctcgaacggtcgagccatttgaacgacgccctcggcggcggctccatcacggcgctgccaatcgtcgaaacccaggccggagacgtctccgcctacattccgacgaacatcatttcgatcaccgacgggcagatcttcctcgaatcgtcactgttccactcggggatgcggccggcggtcaacgtcgggctgtcagtttcccgtgtcggcggggacgcccagaccaaggcgacgaagaaggccacagggacgatccgaatcgatttgtcccagtaccgcgaactcgaaaccttcacgcagttctcgtccgatttggacgatgaaacccaggcccagctggcctacggcgaacggctgatggaaatgctcaagcagccggtacaccagccgatgtcaatggccgatcaggtcatctcattggttgctgcggaaaacggcgctttcaataagattccggtcgcggatctgaaggctgttcagaagacattgctcgaagatttcaaggtgcagcatccggaaatcatcgatcagctcaacaccaccaaggatttggatgacgaactgaagcagcagattgtcgacgctgcgaaacaaattgtcgcgggaatggatcaaaaaacagcgaggtagggatcatggcttcactcaatgaactgaaaacccgaatcgcctcggttcaggacacgatgaagatcaccaacgccatgtacatgatctcgaacaacaagatgcgcaaggcgagaaaggcctggcaggataccctgccgtatttcgatacgctggaatccgtactggccttggcgctgcgccatctgccggacgaggatgccgaacatccgttcttcgacagccggccggaaattccagccgaagagcggaagacgggctacatcgtgatcacaggggataaagggctggccggcgcctatcaccagaacatcttcaagcttctggaaaaatcgttaaagtcgacgccgaacaaccagatctttgtcgtcggccaggtcggcgtacattatctgcgccagcggaaaatccccttcgatgtcaacttcatgtacacggctcaggatccgactttgggccgggcccgggacatggcttaccgcgtttttcaggccttccatcatcacatgctggacgatgtgtacatcatttatacgaaaatgatcaactcggtcacgatggagacgacgaagacgaaggtcctgccgctggaaccgaaggacgtgctcgaaacggccgatccgattcatacggagtttgaactgtacccgacaccgcgagcggttgtaaacaccgtcgttccggattacaccgtcggcgaaatttacagcgcgatggtcgaggcttactgctccgaacagaattccagggtcatggccatggaaaacgcgacggattcggcgaaagacattctgtcggatctcaaactcgagtacaaccgcgtccgccaggccagcattactcaggaaatcacggaaatcgcggcaggcgcgagggcacagcagaaaggaaagagctaaagaatagatgaaagggaaaatcacacaggtgatgggcgctgtcatcgacgtgacctttgaaggcggggaactgccaaaggtcaaaaacgcgctgatggcttcccataacggtaaacaatacacaatggaagtttcccagcatattggcgacgacaccgttcgctgcatcctgcttaacgccgcagaagggctgtgcaggggcatcgacgtcgaagacaccggcgccagcattgccgttcccgtcggggaacaggtcctgggcagacttttcaacgtcacaggggacgcgatcgatggcggtgaagacctcagcgacgcgccccattgggaaattcacagagaaccgccggcattcgaagaccagagtccggccgtcgaaatgtttgaaacgggcatcaaggtcgtcgacctgctcgcaccgtacgctaagggcggcaagatcggcctgttcggcggcgccggcgtcggcaagaccgttttgattcaggaactgattcacaacatcgcgacggaacacggcggctactccattttcaccggggtcggcgaacgctcccgtgaagggaatgaactttacacggaaatgaaggcctccggcgttctggacaagaccgccttggtctttggtcagatgaacgaaccgccaggatcccgtatgctggtcccggaaacggggctgacgatggccgaatatttcagagatcagatgaatcagaacgtgctgctcttcatcgacaacatctatcgattcacccaggccggttcagaagtttcggccctgctcggccgaatgccgtcagccgtcggttatcagccgacgctggccaacgaaatgggcgcgctgcaggaacgcatcgcctcgacgaagaagggctcgatcacgtcggttcaggcggtttacgtaccggccgacgacattaccgacccggcgccggcgacgacgttcacccacctcgacgcgacgaccgtgttgtcccgtaaaatcgtcgaacaagggatttacccagctgtcgatccgctggaatcctcctcgcgtattctcgaaccggacgtcgtcggggaagaacactacaacgtggccagacgggttcagtctgtgcttcagaagtacaaggaacttcaggacatcattgccatcctcgggatggaagaattatccgacgaagacaaggtcaccgtcatgcgcgcccgcaagattcaacgtttcctgtcgcagccgttccacgtcgccgaaaaattcaccggtgtggccggtgcgtatgtgccagtcgcggaaacggtcaagggcttcaagatgatcctcgacggcgaattggacgatttgtccgaagcggccttcttcaatgtcgggaccatcgaagacgcgatcgaaaaagacaagcagcttaaagcagaagcgtcgaaataagcaggtgatctgatggcgttatttgatttgaaaattgtggccagcaaccgcttgttctacgaaggcaaatgccagtccctcacgattccgtgtaccgacggcgaaaaacaggtgttggcccatcactcggcgatgctgatggcgatgaccaacggcacgctgcgctttaccgacgaatccggcgccgaaacgatcgccgtttcaggcacaggctttgccgaagtggtcgacaatcaggtgacggtaatcgtcgatacggtcgaacggccggaagaaatcgacgcgaaccgcgccaaggcagcggccgaacgtgcggaagaacgcctgcgccagcgcaagagcctgcaggaatactacaaaggccaggcggctctgtcccgtgcggtggcccgtctgaaggtcaaacggtagaaaaatttaaaaataatacgagtctccgaatccagagcgctatttctggtgacggcggctcttttttatttaagacaacggcgggaagggcacaaaagtagtgttatccgtttattttttcgagctgattcgttataataaaaccatgaaactgacaattgtccggcatgcccagaccttgggcaatgccgaaaaacgttatttagggatgacggaatccgagttgaccgagaggggaagggcccagcaggcccagaccttagcgcggctttcggggacgaccttcgacgccgtgtacgcgagcccttccgggcggacgatggcgatggccgagcagctagcccgcgccagtcacgtgcgtgtccgacaggacgaccggctcagggaaatgcatttcggcattttcgacggcttgaccgcggcagaggccgaagctcaatatcaagagatctggcaggcctggctcgccgatttcgaccgctaccgtctgccggagggcgaaggctttcaagatgtcaaggcgcggttcgccgcattctggaaagagattaaaggcgcgtacgacgacagcgctcaccttgcgctggtcacccacggcggcgtggtccgcgcggcccttgcggtgctctgcgggatgcccgacgcgctgacctggcacgtcgagacccagcccgcgtcaattgtgcaaatcaaaatgatcggcgattacggcgtactctgcgggctcattccgtccgaaacattacaataattttttataggagagttatttggaaaaagtaaaacgtgaaatcttaatcgattcggcggacgtgctgacgccgcttttcggcgaatacgacgccaacgtcaagcagattgaaaagagcttcggcgtgcacatcaatgtccgggactcaaaattgacggtgaccggtgaagcccccggcgtcgaaggggcgctggccgtcatcggcgacatggtcggtgtgatcaagaaggacaagggcatcagcgcggacacgacccattatctgatcgaaatgcgcatgaagggcatcaacagccaatacgcggagatgatggacgacatcatctgcttcacgactcggggcaagccgattaaggcgaagaccctcggccagcaccgctacatcgacgccattcggcacaacgatatcgtcttcgggatcggcccggccggcaccggcaagacctacctcgcgatggcgatggccatcaccgcctttaaaaacggggacgtgagccgtttgattttgacccggcctgcggtcgaagccggcgaaaagctcggctttctgcccggcgacctgcaggacaaggtcgacccgtacctgcgcccgctttacgacgcgctgtttgaaatcatggggccggaggctttcgagcgcaatatggaaaaggggctcatcgaagtggcgccgctggcctacatgcgcggccgcacccttgaaaatgcgtacatcattttggacgaagcccagaacacgacgccggcccagatgaagatgttcttgacccgcttcggcgcgggctccaaggtcatcgtcaccggggacgtcacccaaatcgacctgccctccggaaaacgctcggggctcatcgaagcccagcgcgtgctgaagggcatcaagggcatcgacttcatcgaattcgattattcggatgtggtgcgccaccgcctcgtgcagcgcatcatcgaagcctacgaaaagtacgaccagacgcgtgcggcccatcaagaatcggaagcggacagcgaagaaaaagacgcgccccgccggagaaaacaccatgatcaccattgattttgaaaaccaaaccgcgtacaaggccgaagagaaatggctgcctgaaatcgaagcctacatccagaagactttggttacagaaggcattgatctcgacctcaacacctacgaaatttcgctgacctgggtcgagccggagacgattcacagactgaacgcggagtaccgcggcatcgaccgggaaaccgacgtgctgtccttcccgatgtacaacttccctgaggatcaggccgtgctgacgacaccgtcggagataccggtgctcctcggcgatattgtgctcaatccagcccgcgccaaggcgcagggcgcggaatacggcaccggaatggagcgggaaatgtgctacctgtcggtgcattcgacgctgcacctgctcggctacgatcacatggagcctgaggataagaagcagatgcgcgcccgggaaaagaccgtcatcggtgacgtgggtacgccgctgaaatcacaggaaaatcaagaaggagcaaaccagtgaaacgcctgagaaaaagctttcattacgcctttgaagggctcggctacgtcatcaagacccagcccaatatgcgcattcactcggtgatggcgctgatcgccatcgccctcggtttcatttttcacgtcagccacgccgaatggctcgctctggttctggtcattggttttgtcatgattctcgaggtcatcaacacggcggttgaaacgctggtggatctctacaccgaggaattcaaccatttggctaagatcgcgaaggacacggccgcggcggccgtcctgtgcatggcgatcgtgtcagtgatcgtcggcgtgatcattttcgcgccgaaggtgctggcgctgttctgaatcaaaacaaagtgaggtaaatgtgagtcaatttaaatcgggatttgtcgcgctgatcggccgccccaacgtgggcaaatcgacgctgctcaacgcgctgatcggggaaaagctggtcatcacgtcgccgcggccgcagaccacgcgcaacgccatccgctgtatccggacggacgacacgagccagatggtctttgtggatacgccggggattcaccagccccaaaacaagctcgacgaggcgatgaaacaggcgatcaaggataccctcgaggatgtggacgtggtgctctacttgatcgacggttccgcgaagaaaacctatccggaggatcaatacatccaacgcattgtccgcaagatgaagacgccggtgatcctcgtgatcaacaaaatcgaccagttctcaaaaccggcgctgctcgaaaaaatcgatcaggcgaaatcccaagacatctatcgggaaatcattccgatttccgcggttaagcgcgacggcgtcgacacgctgatcgaacggattcaggcgatcctgcccgaggggccgatgtatttccctgacgatatggtcatcgatcagagcgagcgcttcatcgtctccgaaatcattcgggaaaaggcgctgaatcatctcagagacgaggtgccccacggcattgcagtggaggtcacaaagatgcacccgcgcaagggcaagcacggcaagaccgtcgtcgacatcgaggcggacattcaatgcgaaaagaagagccacaagggcattgtcatcggcaagggcggcagcatgctcaaggccattggcagcgacgcgcggcaggacattgaagcctttttgtctcagaaggtcaacctgcagctgtgggtcaaggtgcgtcagaaatggcgcgaggacgacatggccctcaaggatttggggtaccggtattaaatggcgtcggtcaagacgaaggccctcgtcattcgggagtcgccctatcaggacaacgacaagctgctgacgctgttcaccgaaaaatacggcaagcagcgggccatcgcccgaggcgcgagacggcgcaaaggcgcgctgaggagtgtgacccagctcttcacctacggcgatttcatgtatttcgagggcaagaattttgcgaacatttccgacgcgacactaattgagtctttttataagctaagaggcgacattgtcaaggtgacgctggcgtcctacgtcgcggagcttttggacgccttttacgatttttatcagggtgatccggaaatgctcaaggcggtgacccacattttttattattggtcggaacacctggctgaaaacgacgaggcattggccgcctgctttcaacttaagctgacgcgcattcaagggcttgggccggaactgtcgcgctgcgtgcggtgcggcgaaagggaacagctgactggattttcgcttcaggacggcggcaccgtctgcgaaagctgcctgaagccgggcgatctgccagtcaatcccgacttgatcgccgatatgcgccggtggatgggggaaccgatcaaaaccatctgccacaccaaatgggacgccgaccgcgtccgtcagggactcgatctgatggaccgctacattaccgttcagcttggacggcagaccaaaagctatcaattttacaaggaattatctgctcagagcagcaggcagtgaaatccaataaaggagggcaaccatgatagagaatctttccgcacccggtgaattggcacaatggtccgagggctgtgttgaagcgctgcagaatggggatttcacccgaatccgcgtgcgcaaccaccgtcggctcatcctggccgagtacggcgctgacgatattctaattgatttgtcagaaaaagggcccggccgggtttatctgcacatcgaatccacctcgaaggaggtgctccggtggtttaaatcctgtgtgaccgaggcgatgctgagtgtccggcccaacgtcaacccaaacgctggacaggcccagaacagccatgtacagcacacgccgcagagcagtgcgaatgcggcagccccgcacagcggccagagcgccttcgatcaggcttaccgcaaggcgcaggcggcccgccgtcaggcctcccaggaggaacagatggcgcagacgccaggtcctgatgccacgcggatcgcgccagacacgtaccgggaagaacccttcgatccggacgccacccgcattgcgaaaagccccttcgagcgggcgagagaccgccaactttcgatgggggatgccgctcaggcacaggacgatgttccaacagctgacgacaccgcctttgacacgccctacgatgatgacgcggggtacgacgattacgatgacggctacgcagatgccgaaggctacgacgatggctacgcggacgattatgaggaagagccgacagcggagatcgaccccgtcgattacggcgatgaagcgccagagggtgacacgcagtatctcgaatatccggaggacgggctgtacgaaacgggcgacgtttacgcgccggaggattacgacgatgccccttacgatgacggttacacggatgacaccgcgtacgatggggaagacggcgcctacgaggatgactacgccgacggcccttacggcgattacgatgacggctacaccgatgccgaaggctacgcggacgacgataaagcccttgagcctgcggcccctcaaaccttcaaagaaaaatgggaggcgttgacagaaaagacctggtttttacttttgatgctcgcggtcttcccgccgctgggcctgtatttgatctggcattacagacgttggaccggcggcaaacgcgtgctcgcgacggccatcggccttttgtacttcctatttgtttggctcggttttctcggcgtgaacaccggcatcaaccgcgacacctttacaagtctgcggagccgaacgagccagtccaccggcagcaacgtccagaacacgccggataccagctcggattcaacggacacgtcaaacagtaccgattcgacgacctctgattccaccactgattccactgcaaattcggcggacagcaccagcggcagcaacaccgtgctggagcaggccgtcagccagttcaacaattgggtctccaatcttgtgccgtaaaaaaatctccaacctttgagtgtatctcagagattggagattttttattgcggggatgctgtgattttacgccagcgcttcgacagccgcctttaaaaacgcgtaggtccgtttgaaagacgggatcgacatgtgttcgttggccgtgtggatgtcgatgttgtccggaccgatggagacaatgtcgaggtccggcagggcgtgggcaaagagggcgcattcgagaccgccgtggataaccatcggcgtaagggctttgccggtttgtgcctgccaaatagcagacatcgtgtcgagcaggggagaagtctctcttgccggccacgccgggtaggagctgggcgcgccggtggtgccgccgaggaggtcgatcagccgggtcacccgtccgcagagcatgtctctggcggcgtcgtggtcgcttcggatgaggaagacgagggacagtgccttgtcggaagtcgctgcgacgccgaggttcagagaagtattgactgcgccggggacagagcggttcatcgcgacgacgccggtcggcgctgcggaaagggcgccgagcacgcgggcttcggaatcggggtcgaggacggacgcttcgaccgcgtcggcctgaggaaaatcgagagcgagggtcatgccctgatcccgcttcccggcgatggcgcggaaggtgtgctgcagtgcgttgacggtctgatcgagggtcacgcgttcgctcggcgcgatgagcagggtggcttcggccgaggttggaatcgcgttgtcccgttcgccgccctttaagtcgacgatggagaaatcgacgtccttggcgatggcgcagagcgcgtcggcgagcaccttgaccgcgttcaagccgaattggtcgatttcgtcgccagagtggccgccggccagacccgaaacactcagcaccgcggcaaggcccttggccttcacgcggcggatcggcagcgtgctcttcatgtgggtgccgccggcgcagccgacggtcgccgtgccttcgtcctcagagtccaggttgatcatgaatttggcgtcggcaaactgctgatagtccaacgcgtaggccccgtccatgccgacttcctcttccgtcgtgaaaacgaggtagagcttcgggtggacgaaatccggctcgtcgagcagcgccagcgccatggccacgcccgcgccgtcgtcggcgccgagggtggtgccgtcggcgtagaggtcgtcgcccttgagcacaagggtgatcggatcgatgtcaaaatcgtgaatcacgccgggcttggccaccgtgaccatgtcgagatggccctggagaatgaccggcgcagcgtcctcgtggccgggggtggccgggacggtaatgacgacgttgccgacgtcgtcccgttcggcgttcaggtgtttttcttcggcaaaggccaaaatggcgttcgagagcttttctgtatgataagagccgtggggaatatccgcaatcgctttgaaatgcttaaataaatgttcagactgtaaatttttaagtggatcagacatgttgatccctcccttcaagtcattgcggccattataccaaatgcggcgcgcgtccgcttgcttttaccccctatttttcttataataaaggaaatttaatttatgggagaaattcaatgttttcaaaaaataaagatcaaaagcagaacttaagcttttttgaccgcttgttcggtcattggtggatgatgctcatcgaagggattttgatgatcgccgtcgggatcgtgatcgcagtggtgccgggccttcggacactgacgattttgattcggattgtcgggatcgaacggctgatcgtcggctttttctatctgattttaagcctgcgcgatccgattgccggcgtgctgatttcaggacaggcctttgtgaacttgattctcggctttttcctggcactgatgccgggcttcttcttaagcatctttatttttttggttgcgatttgggcgtttatctctgggatcggcatgctcgttcaaaaccgcgggccgcagcacctgacgagccgcaccgtcgtcgggattctgctgatcgccttcgggcttttcgccgggatcagtccggggcacaccgctgacgcgctcgtgctggtgttcgccgtgatgattatcattttcggcggttacctgctgaaccgttccagtgaaatgcacaagactgaaaagaaaattgccgaagaagaaaagggctacgacgattacacgattgaataagacaggagtgagcacattatgaaaatagtagtcgggatgtccggcggggtcgattcgtctgtcgcggcgctgctgctgaagcaggccggacacgacgtgatcggcatttttatgaaaaattgggacgaaacggacgaaaacggcgtctgcaccgcgaccgaggattacgaggacgtgcgccgcgtctgtgaaaaaatcggtattccctattatacggtaaatttcgaaaaggaatatcaggagcgggtctttcaggatttcttagaggaatacaagcgcggccggacgccgaatccagacgttttgtgcaacaaggaaatcaagttcaaggcctttctcgactacgcgatgaaggtggcgggtgcggacaagctcgcaactggacattacgcgcagattcggaaaaacgaggcgaccggccgctacgaaatgctcaagggggcggacggcaacaaggatcagacctattttctctgccagcttgggcaggcacagttgtcgaagacgctgtttccaatcggcgatctcgacaagcgggaggtgcgccgcctcgcggaacaatacgatttgtcgacagccgggaaaaaggattccaccgggatctgtttcatcggcgaacgcaatttcggtcagttcctccaccagtacatggccaatgagcccggcgagatcaaggacttggacggtaacgtcaagggccatcacaacgggctgatgtattacaccctggggcagcggcgcggcctcggcatcggcggacaggggacgggcgagccctggttcgttgtcgaaaaggatttagcgaccaacacgctctacgtcgtgcagggcgacgatcatccggaactctactcgaaggcactgaccgcgtcgaagatgagctgggtcgccgacgtgccgccagaggccaaacagttcaaatgtcaggcgaagttcagataccgccagccagaccaaggtgtcgaggtcaatgtcgtcgacgcgacccacatcgaggtccgcttcgacaagcctcagcgcgctgtgactccgggccaggaagtggtgctctacgacggcgaggtctgcctcggcggcggcaccatcgacgcgatcaccaagctcgacggacgcgtccaaacccattgatcggagtcggcgatgacaaaaaatatacgcacgagtctgtcgaccctcgtttacattgaggaccctgcgacacacaaaattctgatgctccaccgcgtgaagaaagaccacgacgtcaaccacggtaagtggattggcgtcggcggtcatttcgaggccgacgaaagccctgaagaatgcctgctgcgcgaggtgtgggaggaaacgggcctgacgctgaaaagttggcgctttcagggcattgtgacctttgtctccggcgacggcgtgacggaatacatgcacctgttcacctcggacgcatttaccgggacgccccatccctgcgatgaaggggtgctcgaatgggtcgacaaggatcaggtcttgaatctcaatctctgggaaggcgaccggatctttttccgattgattttagaggatccggcatttttttcgctcaagctggtgtacgacggcaatggcggccttgtcgaagcggttcaggacggtcatccccttgaattgttcgatgtgttagacgaagatggccggccgacgggtgttgtccgggaacggggtgtctgccatcgggacggcagtctccacgggacggtgcacatctggatgctgcgccgccatcacggcagatggcaggtgctcctccagaagcgggcgtcctgcaaggattccaacccgggctgctacgatatttcctcggctggacacatttcggccggcgacatgccgctgccctcggcgctgcgcgaggttggcgaggagctcggcctggagatcacggcgtctgatctcgtggaaatcggccggcaccgcgctgggttttcggcgcattttcacggcaagcccttcgtcgaccaggaactgagcaccgtgtatctgtgcacgaagcctttcgatatcgaagatctcaaacttcaggcgtcagaggtggcatcggtcaaatggttcgactttgacgaagcggcagccggaatccgggacggccgcattcccaactgcatctacgtcgacgagttcgacatggtggcggaagcgctgaagaagcgcaatatgatgaaataatacgggaattggcaaagactttagcagaaagccgcagccgattctcgtataatgaagataaagaattaaaatggaaaggtggcggtagaaatgaaaaagaatcctattggcagaatcgtcgtccgccgcggcagtgtggcggaattggctgtgccctgcatcgtcgatcccacggatcctgaactttcgggcaagggcctgaccgaccaggcggtgcagaaagccggcgggagaaagctcgtcgaggcctgccgcaaaatcggacatctggacgtgggcgaggttgcgatgaccgacggctatcagagcgatgcggaccatatcatcttcacggtcggcccgcagtatacgggtaagcctcaggatctcaaggatttggccgcatgctatatcaacatcctcgagctggtcaaggaaaaggacatccatcaggtggtcattccggcgatcagctgcggcggtgggaacttcccgatagaaaaggcggcgccgttggccatagaaaccatccgaggctggttgaaactcaatccggattattcgattatcgtgtttgtcatcggcattatcccagtcgtctacgaagcctattggcagtatttaatggaccatccgtattgagataaaggacagaacaatgacgaaaatcatctgttatggggattcaaacacctacgggtacgatccgagaatgggcggcagcggccgctacgacgaggcgcaccggtggcctgaagtgatggcggaggcgcttaccgccgcggggaaggatgtcgacgtcgtcaacgccggtttcccagggcggacgctttcgacggtgctctacccggattattatggccacggcgtggatttgttcacgacgtctatgcgcgggtacgcgcccttcgattggctgttcgtcatgctgggcagcaacgactgcctgagaccggattcgatcgaacgtgtggtcggccggatgtcggatttgatcgatgaagctgccgcctccgactggtggacgaaggcgccgcagatgcttctaatggcgccgccgcagatcggcagagagctggacgtgccggccgacgcctttttaagcggctactgcgcaacgctcggcgagacaaccctcgacggatttgcgaagaaaagtaggaaactcagagcggcgtaccgcgaactggctgaaaagaaaaacgtccgctttttcgacgcgggcgaagtggcagaagcgggccaggtcgattacatccacttgaccgaggaaagccagcggcaattggggcaggcgatggctcaaactgccttggcgtggatttaagcaagagtgagtgcctcaaatgaggggacagcggtgtccgcgatgcgcgcaatttccggccagtcctctcgattggccgggtcgtagaccgcaagcgtcggaaagcccgcggtgtgggccgtcgtgaccgccgtcaggttgtcctcgacgacaagggtcgaggtcggctttgaatgaagggcgtcggcggtggcgagaaaaattttcggtgaggatttgccggcgcggatttccgggtcttggtcggtgagcaccgccgaaaagcagtctaaaatattcagccgggaaaaggcggcgcggatcagcgtgcggtcgccgacagaggccaccgcgaggggcatctgcgcggaaagggtgcgcacaaaagccagagccccgggcttgagcggcgcggtgttgcggtaaaaggccgcgatttcatctaaaatcgtctgctgaatttcttcgatagatagcgttaagtggtagtgcgtcttgagataggagctgctctgatcgagggtcatattaaacaaaagatctccgagcccgggctccggcgtgacgccaagggcggtcagcacacgggcaccggcgtcgtaccagatgggcatcgagtcgaggagcgtgccgtccacgtccagaatcgcgccggtgaaacagtttaaatttattttctttttcatgatttccttttttttcttgaacttttgcggtaaggtatacacatacagtttatcagaaaaaaacacaatagagtaggttaccatcatgaaaacacttgaagaaaataaacccgatatcaatgaattgaggagaattctcgaaattcgaaataaggagaatttattttccgtccaaatgggaattcagggcaccgtcatcgaagaaggctacgcggaaaccgagctcgtcattgagccgaagcacttaaacttgaatcattccgtgcacggcggctgcctctacaccttggcagacaacgccggcggcgcctgcgcgtcgtcccacgggcaccgggtgagcacgttgagcggcgatctgcaattcatgcgcccggctatcaactgcaaaaaattgaaggctgttgcgaaggaaaagaaggcaggcaagcgtattgtcgtcgtggacatcagcatttacgacgaaaagggcactgaactcgcttgcggcctgtttgattacgcgaaaatgaaaatgaaatactgaaagaagaggaaaaattatgttatatcgaaattttcaaaatgtttccttatcggcactgggatttggcggtatgcgcctgccggtcgttgacggtgatgacgcccggatcgacggcctgaaaggggccgaaatggtcgattccgcgattcgctcgggcatcaattatttcgacacggcctggggctaccatcacggaaaatccgaaaagtttttcggcaatgtgctgatcaactatcccagagacagttattttctggcttcaaaattcccgggatacgacacgagcaatttcccgaaggtgcgcgaaatttttgaagaacagctgaaaaaatgccagacgaaatacttcgatttttatttattccacaacgtcaatgaaagcaacatcgattattatttagatccccaatacggcattcgggattatttggtcgaacagcgccgcgccgggcggatccgccatctgggcttttcggcgcacggcgaactgccgacgctgaagcgcttcctcgaagcgtacggggacgacatggaattcatgcagattcagctcaactggatcgactggaccttccagggggcgaaggaaaaggttgaactggcccgggaatacgacctgccgatttgggtcatggaaccgctgcgcggcggcaagctggctcagctgtcagacgaagccatggctaagctagacgcgctgcgcccaggcgtttcggctgcggaatggggattccgtttcctgcagaccattcctgaggtcgacatcgtcctctccgggatgagcaccctgggccagctggaacgcaactgcgcgattttctccgacgaaaaaccgttaaacgaagaagaatggcagacccttcagcagatcgcgcgggaaatgatcgaaaaggaagaggttccgtgcacggcatgccattactgcgtcgaccactgcccgaaggggctcgatattccgaagctcatcgaactctacaacgaacagcattttacaggcggtggcttcattgcgccgatgcgcctgtcgacgatgggcgaagggcacctgccctgcgactgcatcgcctgccacagctgtgaaaaagtctgtccgcagaatatcaagatttccgaagtgatgaagcagtttaacgacgagctgcttcaaaatgacagggcctaagcgcggggtcaacatcgcaaaaattgtcacaagctccagttttggggcttgtttttttttccagcataagggtacaatattcagagaaaattatgtgaatttttgataaagattaaacaattattgtgaattgtggtaaactatgaaaagtgaaaaaacggaggtgaagcaatgccgacgggaagaagaaaacccacactggtgccgcctaaagggcgctatcgcagaggactgatcctgaaaagcacggcaggcggccttctcgtcggactggtggcaggcggcgtatcgatcatctatcgattcgcgagcacattgttccagggcggccaggcctatatcctggaccacgtcacgaacgttccgctcattgtgatgtatttcatcatgctcgcggtgctggcctttctcgtgcgaaaggtaatcacctgggagcccttcacggccggttccggcattgcggaggtgcgcggcgaggtgcagggctatttcgacatgaactgggtcaaggtgctcgtcggcaaattcgtcggctgccttctgtcgatggctggcgggctgtccctcggccgggaagggccgtcggttcagctcggcgcaatggctgggaagggcctttccagattgactcaccgcggcaagaaggcggaacattatctgatcacctgcggcgcgagcgccgggctgtccgcggcctttaactgtccgctgactggcgtgatgttcgctctggaaaccttcaacgcggagtattcggtgaatctgctgttcaccgcgctgatcgcgtcggtcacggcggattttgtgtcgaaggtgtttttcggaatgagtccggtgttctctgtgcccctcgatctgtttctgcccctttcgacggtgggcttcgtgatcgccctcggcgtgatctgcggtgtgacgggtcagatcttttatcggtcgatgcagcttgcgcagaaattctacgacaagctgccccttcctgaaaacaccgaaccgatcgtcccctttttattggcaggggtgctcgggctgacgcttccgggcgtgctcggtgacggccatttgattttggaacagctggttcagggccagatcgcggtgcggatgatcgcgttgctgctggtcgtgaaatttgcctattcaatgctctgcttcacctcgaaatcgccgggcgggtccctcgcaccgatgatcgtgctgggtgcctttgtcggtgggctgtacggccatctcgcggtccgcgccctcgggctggacatgatgctgatcaacaacttcatcattctcgcgatggccggttattttgcggcgattgtgaggacgccgctgacggccgtagcactggcctgtgaactgacgggcagtttcagccacctgatttattttggcatcgtggtgaccgtagctgaggtcgtctcgtccatgatgaaaacagaaccgatgtacgaagcgggaatgaagaatctgatgattaagcatcatatcgtcagtaaacaataaataacgacaataaagaaagacaaatggaggtaagtgatgcaaggctataagtttcttttagatttggcactcatactcttgtcgacgaaggttttgggcctcttgaccaagcgggtgcagatgcctcaggtggtcggcgcgcttctggccgggctgatcctcgggccggcgatgctgaatgtcatttccgaaacgcagtttattaaggattcggcggaaatcggcgtcatcgtgctgatgtttaccgcaggactggaaacggatgttcacgaattgaagcgcaccgggaaggcatctttcgtcatcgccttgatcggcgtcatcgtgccgctgatcggcgggtatttcgttgcgaagtacttcaaccggccgggaatgatgagctcgggtctgtcggcgccgttgtacctgcagaacctgttcatcggggtcattctgacggcgacctcggtttcaatcacggtggaaaccctgaaggaaatcggcaagctcaatacccactcgggcaacgcgattctcggcgctgcgatcatcgacgacgtcctcggcatcatcgcgctgacgattgtcacgtcgatggcggatacgtcggtttcgattgtgatggtgctcctcaagatcgccggctttttcgtctttgccggtgtggcgggctatttcttcctgaaatttttccgttggtggacacagaaatcggaaaagggcctgagacgccacacgatcatcgccttcgttttctgtctgctgatttcttattgtgctgaaaaattcttcggcgtggccgatattaccggggccttcatcgcggggctggtcatttcgatgacgccaaaacgggaatatgtagccaatcgattcagcacgctgtcgtatctctacctttcgccgatcttcttcgcgagcattggcctggaagtggaactgccgtcgatgaactcgaccgtgatcatgttctcggtgattctcgtgctggtggccattgtgactaaaattgtcggctgcggtgtcggtgcattggtctgtcattataaaaaatatcaaagcctgcgcatcggcgtcggtatgatctccagaggggaagtcgcgctgatcgtcgcgagcaagggacaagctctggggctgatctccaaagcctttatcgggccggtgatcctcgtcgtcatcatcacgacgattgtcacgccgatcatgctcaaatcggtatttgcccggacgatgaaatacacgccgcagggacttgccgcacaggcagcggcggctggcgtccaaaacgacgactttcaggaaaacaagttcgcccgaacctacgaaaatgtctccgcgatgcaggacagcggcaaagggcttccggacgatgccaaggattcagacaaagaaaattaagatcgttaacgtcaaaaactccggctctgcagtcggagttttttgacgaggtttaaaaaaacccttgcttttttgatggtcctttgttattataatctagtcagcaatgccgaagtgatggaattggcagacttggcggactcaaaatccgttggtagcgataccgtgtgggttcgaatcccaccttcggcaccagattaaaaataaaaagtgcttctgatgaattttcagaagcactcagactgtagacaaacgaggctctgagaaaatactcagagcctcatttgatttaatatcaagctgcaatttgtagatttataaattgaaatcgaaatataggacgattcggtcccgggtgttttttctaaaaaatatttttgctagttttttagattcatgcatgcgaaagtaagcccgactttcattttcatgcgggctttaccatacatttgtgtgtagcggaatccatgcgcttcttcgcagttccgaaaattctctcgatggtgtcttttctgcgattataaattgctttcattccgtttgtgtgtcggatgtcctcgcagatttccatgtagtgtgccataggtgtcggctgaccactttgacatgatttttactatgggtgcactggttaagataaggacagtctttacatatttcagaacggcttttgattccctgaaaccttcgcggttggtggttgaatattttaaaatttgattatggggacagatgtaacagtcaaaagcttcatcgtagacgtactatattttttgaaaaaacctttttcgtcattggtcgtttttacgggaaaacgggtttgataccgtcgtctatgagcagcttagcaatggcaggggttttataactgcatctgcaaacataattccggattatgctctttatcttcataaaggcctttaaaggttcggctggcgtgcagatttcctgcgttgacgtcatagccgatgatccatccgtttcggtcgcaggccgtttgaaccgcgtaggcgaagactgtttatgttcgccttgtgaaaccagccgctctccgggtcggttgtactcttgattcccgtgtcttttttgagcctgggtgatgttcatcgtcttcttgatcgtctttatctttcaacggttttttgtggtgggcttcccggtctctttgaatctcttggtttaatgtcgtttcataaaaaatcgcttcatttctggcaattcttttgtttcttttattattggctcttgcctttacatgtgtggcatctacgaagatttctctgggatcgatcaacttgtgtttgtagcattctgagaggatatgtgcgaagatttcttcgaaaagatcggtatctttaaatcggcgcgtgtagttcttgccaaaggtggaaaaatgcggaactttatcgtgcatatctaatccaagaaaccaacgataggcaacattgacctcgatttctttgatggtctgacgcatgcttttgatgccgtaaaggtattggataaatggaattttaatcaacacaaactggtcgatgcttggacggcctggatctgccgaatacttttcctcaaccagttcatagataaatgaccagtcaatggcctcatcgatcattcgaagaagatgatcttttggaactaagtcgtccatacaaaatatttgaattgatctcggttctttcaccgttttgtgtcagcatctttttttcctgcttactcatggcctgtttctattattgctattttaccacgtttgtattgcgacaggtgaaaaatgactgactgctataaaaaaacaaagcctagagcgtttccctctagactttgtcgacagtctgagtgcttctgatgaattttcagaagcacttttttgtttgtcaaaaattaagactgcgcgatgcgttcctggcggtcctgccacatttcggcaaatatggaaatcgaatcgatcacatcttcaagggaaagcacgtcggtttcggttttgatgtccgacgcggcgtcgtaatacgctttgcgtttgagtttcataacgccgatttttttaagaagttcttcgtgagtcggcgcgtcagcaagcagtgggcgcacgttattttcgtctttttcgagacggtctgcgaggacgtcgtcggcgcagatcagctcaacggtgaagcagttgtcctttaacagcttctggttttcttcagaaaggggcaggccgccgccgcaggcgatgacacagcccttcgggtgagatgcgtccaaaatgtcctttaaggtctgagtttccattttgcggaaagccggttcaccgtcttctttaaaaatgttttcaatggttttgccggcggtttgagcgatgatcgcgtcggtgtcgtagaatccgtagtggagctcgtgggataacgcccgtccgaccgtggttttgccgacgcccatgtagccgatcaatgcaatattttttggcatggtcatgattgagtagcctcctattttgataagttttctattgataataccgaagaaggcttaaaggtgcaagtcttttctgaaatgacgaatcgcgtcgggcgtaagctgtccaggcgctgtggcgtcggattcagataatgccgcgtaggtcaggctgccgccgaagtattccggcgcgatgcgcagcagcttgccgggttcgcccatcatgatgaaaatgatcggctttttccaatgtcctttctggagaaagcggagcagaacagaggccgactgcagaatgtcgcttttatcttcggcccacatggcgactttgatgacgtcggggcccagctcagcgatgtcgtagagcttttgcttaaaagccttgggcttcagcgttttcttgaaattgtggtaggacagaatcagccgtttatcctgtttgtgagcttccttgcgaagggttttgatgactttttcagaattgccagcttcagcgtcgatgtaggcgacggccgggtgtgcgagcgccttcaatgccgcgtggctgcggacggcttcgtcggcctcggcacaggcgccgccttcttcaaagctccggaaggtgtagagaatcggaacttgtttttcggccagtgcgtcgagacacgcggcctgttcgtcgtcgctgatcatgccgagggcgtcccggcgccattcgatcagatcgggctttaaagccgcggcctgttcggcgtaatcggacagtgcgtctttctgagtgggaccgattgggatacagagcgcgaaagtataaggctctaaaataaaggattgacttaaagatttcataatttaagtttacgcttcatcggttaaattttcaagttgtgctataataaaaacgaatttacaagcatcacgtacagcgcgggaggaggcaagtcaaatgacaggtttatcgtcgaagcaggctgcgcaattaatggctgacggcaagggcaatacgcaggttgccaagtcagctaaaaccgtcaaacagatcgtcaaggaaaatacgctgacctacttcaacttgattttcgtcgtattggctttgcttttaattgtgagcggcgcctggaattcgctgacttttctgccagtgatcattgcgaatacgttaattgggatcattcaggagattcaagcgaaaaaggtgctggacaagctgacgattatgaacgccccggtgtcggtcgtgtaccgcgacggcaggccgaagaaaatgcgcacggaacaattggtgctgggtgatgtggtggtgctggaaggcggcacgcagattccggcggacgccgaagtgatctccggcgagatcgcggtaaacgaagcgttattgactggggaagccgacgaaatcacgaaacagcccggcgatgagctgatgtccggctcgttcgtggtgtcggggaaatgcgcggcgcggctgacccacgtcggcgccgacgcctacatcaacaagctgaccttgaaggctaaggctgtggaaaccgacgaccgctccgaaatggtgcgcgccatcgacggaatcgtcaaactcgctgggattgtgatcattcccatcgggatcctgctgctttaccagagcattggcacggcgggcagctccttcaccagtgcggtaccgtcgatggtcgccgcggtcatcggcatgattccagaagggctctacctcttgctctcggtgacgctggcggtgtcagcgatgcgcctggcccgcaagcaggtcatgcttcacgatatgaagagcatcgagtcgctggcgcgggtcgacgtggtctgcgtcgacaagaccggaacgattacggacaacgcaatgctcgtcgccgacgccgtgccggtgcggcagatgaaccgggcgcagatggagcgcgcgggggatttggtaagccgttatttaggcgccctcgacgacagcaacgcgacctccgaggcgatgatcgattattttggcgagatgaagagtggggacgcgctcgagacgctgcccttttcgtcgcgctacaaatattcggcggtgcgtttcagagagggcgtttttgtgctcggggcgcccgaaatcgtactgaagcgccatttcaatctgtatcaggatgaagtcaaccattacgcggccaagggctaccgcgtcgtcgtattcggacaggccgtgaacgcgggtgccattccccaaaacggtctggatcaatgcgatgtcgatccgatatttttcgtcatgctccagaatccgatccgggaaaacgcggctgaaaccttcaaatactttgcgagccagggcgtggcggtcaaggtgatttccggggacaatccggtgacagtgtcggaggtcgccaagcgggcgggcattgccggcgcggaccactacgtcaacgcgcagacgctgaattctaaacaagatattgacgacgccgttaaaaccacgacggtgtttggccgggtaacgccggaacaaaagcgcgagatcgtccacgcactgcaggcccagggccacaccgtggcgatgacgggcgatggcgtcaacgatatcctcgcgatgaaggattcagactgttccatcgcgatggcgtctggctcagaggcagccgttcaggcggcacaggtcgcattgctcgactctgatttttcccatatgccccagattgtttcggaagggcggcgggtcatcaacaacatcgagcgctccgcaacgctgtttttggtgaagaatatcttttcgtttttactctcgatctttacgatcgtcagtattatcaaatacccgctgacgccgtcgcagatctcgctggtgtcgatgttcaacatcggtatcccggcgttcttcctcgcgatggaacccaacaatcggcgcatcgaggggcatttcatccagcgggtcatgctccgagccatgccagccgcgctgacggacttcttcatgatcgccgcgatggttgtttttgggcagacctttggcgtcggcaaccaggacatttcggtggcctcgacgtttttgctggctattgtcggatttatcatcctgtacaatatctcgaagccgcttaatccgttccgcgccatcgtcatcgcaggctgtattgccggactcgtcgttttggcggtgacgatgaattcgctgtttgatattcagttcgtttcggtcaaatgtgtgatgctgttcgtgctctttgcggtcgcaacggtgccgtgtatgcaggttttgacgaaattttttatctttatcgatcatttggccgcgaaacggacgggcaagaaaaccatcgcgtatgaaaattttgaataaaatgtaaaaaagggaggcatagataatgaaaatgattggaccatcggcagacgcgcttttgaaaatgtgtgtcattgcgaaatctgacgaagaaaaagaggaattggaaagcaaggggcaggtcgatcccaagaccctcgaagcgtcgcccctcgacaaacattacagcagcatgaatcagaatcgctacaccctcgaagtaggggtggatccaaacctcgaatacgatattaccggcgtgatgcagacgctggaaaatttaggggacgccccggattatcacgtggtggactggaacagcgcccaggtgttcatggcgactgtcatgcggattgcgacgcagaacgcgctggtggatttcgcgcagggcgattcgagcaagctgatgctgactgaaaaagaagatctgtctgatgtcgttcagaaggtgccggaaatttgggttatgaagcagttttacgacgcgtgcttcgacgatttagaccgcgacttttcggacaacacctttgcggtgtcgctgaagactatcgaagaagattaagaaataaaatccgtataaaaataagagctttccgaaaggtgtcggtttgacgccttgggaaagctcttatttaatatttcattattacattttcgataaaaaccagtcccgtttccagagcatgaagagaatcaatgcgatttgagcggcaaaggaaaggacgacgaatccgaattgcccgcggattaaaaaggatccggccagacagtttaagataatttgaatccaactggttgcggcgacggctgcgccaaatccgatggcggaaatggtcgtcgacgaggcgatgtacgggatgatgccgttgggaatgccgggaatgagacaggccataccgaacacaaattcggggttagctgaattgattttgctcatgatccagctgtttttcgtctttttctgaaaccatccagagaatttgcggctcaccgctgttttttccgagagacggctgccgactcgtctggcgaagacgaagaccatgcagttgccggcgacgaaaccgacgtagcacaaaataaaagcaacccaccatttataaatcagtcccgcggcgacctgaatggccataccagggaaaacgatgctgatcacctggataattgagaagagaataatcgtgaggtatccgcgccaccggccctgcttcgagagataggcggcgatttctttttcatctcccttttgcagcagtttaaccagcatcgggaaggattttgcggcattgccgaacgcgatataaatcatccagataaaaacggcgaaggctgcgatcacgacaagatttttccaatgcctttgtaaaaaagacttgaacgaatgattcatacgcgcatcctttaaaatatgatgtttttatctaatttgtaaagtctagatcaaccaaatataaatattcattataatatctcaatcctttaaggattgtcaagccaaggcgaaaaataaacggcgctggattgacggaatcgcccaggccatttataattaaattgactaacgtgaaaagaatccgttttcttgacagggaagtcagcacaaatggcattgcactgacttttattttagttgagaaattaaaataaaagtcttttttattttagaaggagcgtttatgttaaagatagccgtatatggaaagggaggcattggcaaatcgacagtgaccagcaatttggccgccgcctttgccacgagaggaaaaaaggtcatacaaatcggctgcgatccgaaggcggactcgacgatcaatctgctgcacaatcatccggtgacgccggtgatgacgctgctgcgggaaggtaaagagccggagcgcctcgaagacttgtcggcgatcggctacggcggcgtcgtctgtatcgaaacgggcggcccgacgccggggctgggctgcgccggccgggggattatcgcgacctttcagctcctcgaagatctcgaactcatcgaaactgtgaaacccgacgtcattttgtacgacgtgctcggcgacgtggtctgtggcggatttgccgccccgatccgtgagggctacgccgaaaaggtgttgatcgtaacctccggcgagaagatggcgctgtacgcggcgaacaatatcaacacggcagtcgacaattttgaagaccgcggctacgcgtcggtagaggggttgattctcaatcggcgcaacgtaccagacgagcggcagaaggttgaggcctttgccgaaagctgcggcctgccgattgtggcagacctgccacggagcgacgcgatcaaccgctgcgaggatcaaggcatgacggttgtcgaaggagatccggccctcgacatctctcaaaaattcatcgccctctccaaacgtctggaggcggaagcatgagcgccggccgcatagttcaatcgatcgtcgacgcgggaaaggacgcccttcagtcacggattgccgacacgaggcagttgatttattcttcgccggcgacattggcctacaattcaccgggggcggagggctacggcgtcaagcgggctgggctggccattccagactcgatcatgctcatcgtgtcgcctgggtgctgcggacgcaatacctcggcgctctcggaacggccggcatatcacaaccgctttttttatttgacgatggacgaaaccgacttgatcacgggccgccatttgacgaaaattccagaggcggtgcaggaggtcgtggattttcttccgacaaaaccgtcggtggtgatgatctgcatcacctgtgtcgacgcgctgctggggacagatatggaacgggtctgccggaaggcggaggaagccgtcgggattcccgttcggccgtgctacatgtacgcgttgactcgggagggcaggcggccgccaatggtgcacgtccggcagtcgctttattcgctgcttgaaaaacggcagcgccaggtcgactgcgtcaatctgctcggctatttcggcggcgtggatcgagacagcgaaattttcaatttgttaaaaggggtcggtgttcaccaaattaggcagatcgccgagtgtcaaaatatggccgattttcaggagatggcggcggctaatttcaacttggtgctgaacgcagaggcgctgccggcagctgaggacttgcacaaacgcttgggcattccgctcattcaaatgcagcggctgtatcagatcgacaagatcgcggcgcagtaccgggcctttggccaggtgctcggcgtcacctttgagaccgacgcgtttcggcagaacgccgaggcagctgtggacagactcgtgaaacggacggtgggctggtcctttgcagttggcgaggtcgccgacgccaatcctttcgagctggcgctggcgctgctcagagcgggctgtgaagtccaggcggtttacggcacaaccgccgcggaatattggccgtggctcgaaaagctcgcggtcctgaagccagagctcgagatttacgacaatgccgacccacagatggtgcattatcacccggatgagaacgggccggtggttgccatcggtgaggacgccgtgtattattacagtggatatcaaaaagccgcactggtgccgtggcgtgggaagacccagccctttggatttgacggcgtaatcaagctgtcgcaggcggtctgcgaggcggtcgaccgggccgaacagaaaggaagcacgcgatgaaaggactcagaaaagtgctgacacccttcgcgccggatcagtcgggcgcggtttcagtactctacgctttgggcggcgcggtgattatcgtcgacgctggcggctgtacgggcaatatctgcggatttgacgagccccgatttgaaacccaggctgcggcggttttcagcgcaggccttcgggatatggacgcgattctcgggcgcgaccagcttttggtcgacaaggcggtcgaaatcgccgagtcccttcatccgaaattcgcggccctcgtcggcacgccggtgccggctgtaatcggcaccgatttgaaatcgctgtgccgtttaattgagaaaaaaagcggcgtgccggccttcgccgtggcaacgaacggcttcaagctctacgacgccggctgcgaacaggccttttggacgctgtttaagaaattttgcaccgatcgattccagacctctcgaaagggcatcggcgtattgggcgcgacgcccttcgactgcgatttggacgcgctggacgctttcctagaggcgcatccggcgtgcacggcctacggctggtcgcaggacgagggactggacgcttttgccgatggggcgtcggccgaacgcaatcttgttgtggcgccggatggactcaaggcggcaaaatggctggaccggcatttcggcgtgccgtacaaactttacgatccgatggcggcgcagtttgccgagtcggttcctgacgtttcgggcaagcgcatcttagctgtgcaccagcaggtggcggtggattcagccagacaggtctggctcgcccgcggtgcggcttctgtgacaggcgcgacctggttcatgagcctcaaggagctggcgcagcccggtgatctcaaattaaaagaagaagacgattttgaacgggcagctgctgaggggggctgcgacatcatcgcggcggacccgacgctcaagcccttggccaagcgttttgcgggacagtggatcgactggccccactttgcgatttcaggaaagcggttgaatccccatgaatgatgtgcaaattacacaccgcatccggctgtacggcatcgttcagggcgtcgggttcaggccgacggtcagccgatatgccgaagccttcgggatctgcggacaggtgagcaaccgcggtgcctgggtggaaattctcgctcagggcacaccagaacaggtcgcggcttttgaaaatcagatcgagaacgccccgccagagcgggccgttgtgctgaagaccgaaatcaaatcggtggacgcccccgatcagttcgacgactttcagattgtcgacagcgaaaaggtgaaaggcgcgattttcgtctcgccggacatcgccatttgcgaccaatgcaaggcggagcttttcgatccggacaatcggcgttatctgcacccgtttatcaactgtacggactgcggtccgaggctgacgattctcgacgagctgccctacgacagggagcggacgagtatgaaggattttccgatgtgtccggaatgcgctgaggaatacacgaatccggcgtcccggcgctacgacgcccagccggtctgctgcccggactgcgggcccgaactctacctgctcgaccgcccggaacggggtcatgctgcaatgtctgagacccgtcggattatcgccgaaggcggcatcgcggcggtcaagggcatcggcggctttcacctgtgctgtgacgcggagaacgcggcagcagtcgcccgattgcggcggctgaaaaatcggccccacaagcccttggctgtgatgatgcgggacgagaagaccgtgcgccgggaatgtgtcatcgatgcggatcaggcgcgtattttgacggggcatcaaaagccaattctgctgcttgagaaaaaaataggcggccgcttgtgcgagagtatcgcgcctggccagtccaccgtcggcgttatgctgccctacgcgccggtgcagtgtctgctgttcgactacgacgacggcatcgacatgccggacagcctggtgatgaccagcggcaacgcggcaggggcggccatttgtcacaacgacgaggaggcgcggcaggaactggcccattttgccgacgtgatcctctccaacgaccggccgattgtcacccgtgccgacgactcggtgatggattttatcaccgtcgacggcaggcgggcgccctacatgattcggcgctcccgcgggtacgcgccgatgccttatatcgtctccgcgccgatgcgcggacaggtcctggccgccggcggcgaactcaaaaacacgttctgcatcgggcacgatcagcttttctacccctcggcctacgtcggcgatttggcggacgtgcggacgcttcaggccctcagggagagcacggcccggatgctgaccctcttaaaggtgaagcctgaggctgtggcctgcgacctgcacccgcggtatcaatcgacgcagttcgccgagacgctgggactgccgctcatccccattcagcaccattacgcgcacatcgtgtcctgcaccgcggagaacgatgtggatcgcccggttatcggcctgtcctttgacgggacgggttacggggacgacggcacgatctggggcggtgagattttaattgcagactggcagtattatgaaagggtcggccacatcgagcccttctggcagctgggcggcgacgccgcgtcaaaagagggctggcggattgccgcggccttgctgatggcgcagcagccagatccccaaaagtgggaaacgctggtgttgtccctcgggctgtgcagcgccaaacaggctcgggtgctcaggatgatggccgacagaaaaatcaacgcagtgcgctcgaccagtgccggacggctgtttgacggcgcggcggcgggctttggcatctgccgggaatcgacctttgagggcgaggcggcgatggcgttagagacggccgctgaaagctacgaggccgcccatcctgacgccacgtgccgcagggcgccggccgtgacggaaaacgcagacgggcagatggtgctgccgacgactgcttggtttaacgacctaatggccaggaggcttgcgggagaagaagcggggcagctggcttacattttccaccgggaattgtcggagatgatgatttccgcatgctgtcagattagagataaggttcaaatcaacacggtcgcgctgagcggcggcgtgttccaaaacaagctgttgacgcggctgaccgccgagggcttaaaggcccgcggctttgaggtgctgcttcacaggctggtgccgcccaacgacggcggcatcgcgctgggacaggctgtggcggcgatgagccggctgcaagatacaaatattcaataaaaacatcaatagaaagaagagaaaggaatcaatatgtgtgtaggattatcagcaagagttgtcaaattaaccgataaggggacggcggtcgtcgacgcgtcgggcgccaagcgggaaatctcggcgaagctgctcgacgggttggaaccgggcgattacgtcatggttcacgctgggacggcgatcgctaaaattaccgacgacgacggtcacgaaacggaaaatctgctggatcatctgctatgacaaaggcaagacacacgctttcggagccgcttaaaaaagcgatccaatatctcaaaacatacgatggaccgccagtgcgcatcatggaggtctgcggcacccacacccacgaaattttcagacagggcatccgccagattctgtcgccaaacatcacgctgatttctgggccgggctgtccggtttgtgtcacgccaggcgggtatatcgatcgggccgtcgccttagcggaggaccgcggcgcgaccgtctgtaccttcggcgatttgatgcgggtgccggggacggataaaagcttaagccaggcccgagccgacggcgccgacgttcggattgtgtacgcaccggacgacgcagaaaaaatcgcggtggacaatccggatcgacaggtggtctttctcgcggtgggctttgaaacgacgactccgtcggcctgtctcgcggtcgatcacgcgatcgcggacggcgcgaacaatttttcgattctgacggccaacaaaacgatgcccgccgcctacgaggcgatgaaagacagcacggatttgtttttgtatcccggtcacgtgcacgcgattactggaatggcggactgccgtaaaatggaagcggagggcgtcagcggcgttgtagccgggtttacggccggcgagttaatcagcgcgctgaccatcgccgtcaaaaagtttgaagcgggcgagaccttctgcgtcaacgcttatccccgggtcgtgacggaatcggggagcccggaggctcagcagctcgtcaaaaagtacatggaaccctgtgacgcctggtggcggggcatcggcaaaattccaaattcagggatgaagctgcgggaagcctacgcccattacgacgcggcggtgcgcttcgatctgcctgaaactgtcgggaaagatcaccccggctgccgctgcggcgacgtccttcaggggaactgccggccggtggactgtccgctgtttggcaaggtgtgcacgccggaacatccgacgggcgcttgtatggtgtccagtgagggcacgtgctcggcttattatttgtatggaggtataaaatgagagaaacactgccggatcagattacgctggcccacggggccggcggcaagcagacttcagcgctgattcacgatattttcaagaaatattttgacaatccctttttgacggcggacgacgcggcggtgctgccgcggcccgaccggaagatcgcgatgtcgaccgacggtttcgtcgtatcgccggcctttttcccgggcggcaacatcggcgagctgtcggtctgcgggacggtcaacgatttgtcctgcatgggcgcgaagccgctgtatttgacctgctcctttatcattgaggaaggccttgaaacggcgaagctcgaccagatcgcccagtcgatggcgcagaccgctgaaaaagtcggtgtggccctcgtggctggggataccaaggtcgtcggcaagggccaggcggaccaggtctttatcacgacgacgggggtcggtgagctgatgcctggggttcatctggccggcgcggacgccaagccaggggatgccgttttggtcaccggcgatgtgggccggcacggctgtgcggtgctgctcgccagagatgaatacggcatcgacgctcacgtgaccagcgactgtgcgccgctgtggcatccgatttcggcggccctcgaggcggcgccggatatccacgtgatccgagacgcgacccgaggcggcgtcggcaccgtattgtacgaaattgcccaccagagccacgtgggcattcagttaaacgccgaagatatcccggtggacccggctgtcgccggcgtctgcggaatgctcggtctggaaccgctgtatctggcctgtgaagggcgcatggtgatgatcatgccccaggaacgcgctgatgcggtgatcgacgcgctgtcggcttatccggacacccagggcatctgcaaaatcggcgtggtcaccgaggacaatccggaacgggtcgtgatggaaacggcgatcggcgctcagaccttcctgccggaaccggggaccgagctgctgccgaggatttgttaaggagtcaatttatgaaaacgagagttgcggtgatttcgatcatcattcgagataaaaacgaagtagaaaaaattaacgaaatgcttcacgaagcgtcagactatatcatcgggcgcatgggcattccctatcgtcagaaaaacatcaatctgatcagcgtcgcggtggacgcgccggaaggcgtgatttcggcgctgtccggcagcatcggccagctccctggcgtcacggtgaagaccgcttattcagacgtcatcacggaaaccccatgatccagctggcgttttacggaaagggcggcatcggcaaatcgacgacggtgtccaatatcgcggcggcgctggctgagcgtggcctgcgcgtcgtccagatcggctgcgacccgaaggcggattcgacgatgaacctgtgccacggtcagaaaattccgacagtgatggacatgtgccggaaagtcaacgacgccttcgatttagaggatgtggtcgtacagagcgcaagcggcgtatactgtgccgagaccggggggccgctgcccggtgtcggctgcgccgggcggggtgtgatcacggctctcgaaaagctgaccgaaaaaggcctttacgaaaagctcgcgccggacgtcgtgctttacgacgtgctgggggatgtggtctgcggcggattcgcgatgccgatgcggaaaaaatacgcccagtcggtttacattctgacctccggcgaggccatgccaatttatgcggcggccaacatcgcgatggccgtcgatcatttcaaagcgcggcattacgcgaggctcggcggctttatcttaaaccgcagacagaacgcggatgaaacccagcgcgtcgaacagctggctcaagattttcacagcaccatcgttggcattttggccgattccgagatggtcagagccgcggacaatgctcaccgcattgtgctcgagacggcggccgattcggaaatggcggcagcctaccggcatctggccgagacgatttacgcccgcgagacgggaggtgcgccatgttaaagcgcgtgggggctgatttttcagaagccagccttccgatttctcaggcgcattttcccgtgccctttgcggccggtttggaatttaacacgccggaacacagccactggaatattgtgcacattgggatgcagctgcccgaaagccggcagatttacatctgcggcgacaactgtatgcgcggcgtcgtgatgaccgcggacgaaatggatgcgggcgaccgcttcggcatggtgctgctcgaggacaaggacttgatggacagcgacctgactgaggtgacgctgcagggcatcatcggctgcatcaaaaaatggcagacgcgcccgaaggcggtgttggtttttcccgtttgtctgcaccattttatggggaccgacatggatcgggtttacgaggtgctcgaggccaaatacccggatattttctggctgaggtgctggatggacccgatcatgcagaaacgcggcacgacgccggacgagcgggagcgcctggaaatgacgcggccgctgtacgatctgccggcggatcccgctcaggtgaatttaatcggcgcggatacgccgctgggctcagaacagaccaacgattatgccgcgctgtttgcgcatcacggcgttcgggtcaacaccacaggcgcctgcccagactttgaagcgtaccgaaagaccggcgcagccgctgtggaagtttatgtgtcgcccatggcgaggctggcggcagaaggggtggccgcgcggttgaaccgcccgagcttttatttgagcgcgggctggcgggacgccgagatcgaggcatcgctggcgcccgttgcagcccattacggctggaacgtagccgacttccttaagacccgaaagacggccgctgaaaaggcggtggcggcagtgaggacacgtgtcggccggatgccgattgccattgacaccgtcggcgtcttcagacctttgagcctggcgcggttcttaatcgaagcgggattcaacgtggtgcgcctctacgcggacggctttttagacgaagaaaaagcagattttgactggctgcgcacccacgcgccgggcgtcaccgtctgttcgacgctgcgccctgaaatgcggcggtggccggcgcctgacgaaaaggttttggccatcggcccgagagcggcctggtttgaaaagagccgctatttcgttcagatggtcgccaacggcggtctctggggttacagcggccaggcggccctaatgcaggaaatgtgcagcgcactggactgtccgaaggatccgaagccggtgatcggtcagaagggatgggggtgtacctgcgtactatgagacaagtttatacccaagtaccctgttacgccggagatgtgtccggcgcggcctctgcgctctacgagcttggcggcatggtcgtgattcacgatccttctggatgcaattcgacctacaatacccacgacgaaaccagatggtacgataaagaaagcctgattttcatctcggggctcaacgacatggacgcgattgtcggcaacgacgaaaaattggtcgacgacgtggtcgaggcggcacaaaacctgcatccacggtttattgcgctgtgcaattcgccgatcccgtacattatcgggacggattttgaaggtcttgccgaaatgatcgcggatcaaaccggcgtgccggtgttctacattccgaccaatgggctgcacgactacgttgacggcgcgggacgggcctttgaagccgtggccgagatgctggtcgacgattcgagcgaggcgaagcgggcccacagcgtgaacattctcgggctgacacccctcgattttgacgcgccagatagcgctgcctctcttgagcagaggctcatcgatgccggatggcagattcaatccaactgggcgctggactgcgatcccgaggcgattcgagacgcaggctgcgcggcggtcaacctggtggtgtcctcgaccggatggcgcgcagccaaggtgcttaaggcacggtttggaacgccggcagtggcgggctgtccagtcgacggttttggagaaacactctttgacgcccttgaacgcagcgccagagacggccagacgcggctgccttatttggacgggatacagagtcaaacgtccgatgaagtgcagactgccgtcattggcgaagtcgttcaggccggttctatcgccgcggcgtgcgcggtcaaacagcgcggaccggtccgcgtggtggtgccgacggaatgctcgaaggcgttgtgcgcgggacaggttatttccgtgaatggggaggcggcagtcaagacggcggttggcggcgcgcaaaccgtgatggcagatcggctttacgccccgctgataccggatcgggcgaagttgatccccctgcatcattttgctttttctgggaggatcggctatgaccgcgcggtgaatctttttgacaacggtgaattcagcaatttagcgaaggagatcaaaaatggcaacactcaatgaaacgccggcgggcgaacggctccacattacctttttcggaaagcgcaacgctggaaaatccagcgtcgtcaacgcggtgacaggacaggatctggcggtggtgtcggaaaaagcggggacgacgaccgacccggtggaaaagacgatggaaattctgccgttgggtccggtgctgattgtggataccccaggaaccgacgacgtcggcgagctcggcgctaaacgcgtcgcgagaagctaccgggaaatggaacgcacggatatcgcggttctggtcgttgacggcggaaagggcctgtccgaagaagacaaggcgctgatcagccgctttaaagaaaaagatctgccctatctggtggtgtacaataaggctgacctcagagaaaatctgccggatcgcggtgacaacgaaatcgacgtgtcggcgaaaaccggctggcatatcgacgaactcaaggaaaaaatcgcggcgatgcagccgaaatctgaggacaagccgatcatcagcgatttggtcgccatgggcgacgtggtggtacttgtgattccgatcgacgaatcggcgccgaaggggcggctgattctgccgcagcagcaagtcctccgcgaactgctcgacatcggcgcgatgggcatctgctgccgggaaacggagctgcctgaaacgctggcctctctgcaaaacccgccggcactggtcgtgacggactcccaggcctttaagaaggtggcttcggtcgtgccgcggtcggtgctgctgacgtctttctcgattttaatggcgcggcacaagggctttttaaagacggccgtcgatggcgtacattatttggatcatttgcaggacggcgacaagattctgatggccgaaggctgcacccatcacagacagtgctacgatatcgggactgtcaagctgccccactggattcaaaagaaaacagggaagcagctcgtctttgaaacgtcgtcgggcaagagtttcccgtcggatttaaatccatacgcgatggtggtgcactgcggcgggtgcatgcagagcgggacggaaatcaaatcgagaatggcaagggctgtgcgccagcacgtgccctttacgaattacggcacggtcatcgccgaaatcaacggcattttagaccgcagcctcgaggtgctggatggccacgaaaaatgaggaacggatcaaacggctgaccgagacccacaatcttccgcgggaggattttaagcagctgctgagcacgctcaccgacgatgaagctgaaatactttacgccgcggcccgccgtgtccgggaagcggtatacggcaaggccgtttacctccgcggcctcatcgaatttaccaacgtctgcaaaaacaactgctattactgcggcattcggcgggacaacgcgcgtatttcccgctaccgtttagacgacgaaaccattttagactgctgtgatcaaggctacgatctcgatttcagaacctttgtgcttcagggcggagaggacccggcctattccgacgcgcggatctgcaatttggtccgcgagatcaaggcgcgccacccggactgtgcggtgacgctgtcgatcggagagaaatccgaggccagctaccgcgcctatttcgaagccggcgccgatcggtatctgctgcgccacgagacggccaatcccgagcattacaggatgctgcatccgccggaactgtccggcgaaaatcgaaagcgctgtctcaagacgctgaaggccattggctatcaggtcggcgccggtatgatggtgggttcacccggccagactctcgattatctggtcgacgaccttatgttcatgcgcgagcttcagccggaaatgatcggcatcgggccgttcattccccagaaggacacaccctttggcacccaagcgcaggggagcctcgaaatgacgctgcacctattggcgatcatccggctgatgcagccagacgtgctgctgccggcgacgacagcccttgggaccatcgacccgattggacgggaaaagggcatattggccggcgccaacgtcgtcatgcccaatctttcgccgaccagtgtccgcggcaaatacctgctctacgatgggaagatctgtacgggcgacgaggcggccgaatgcaggcggtgcatggcgctgcggatcgaacggaccggctattacgtcgcggtcgaccggggcgatcacatcgcagtgcagcaatcataaaaaatagaaaaggaatttaaaatgtctacacctgaaatgacccactgtatgttttgcggctcaccgctgctgcaccgctatctgaaagacgagggcatcgtaccctactgccccgtctgcgaggaataccgttttccggtgtttaatacggccatcagcaccattgtgatgaatgaggatcaggaccatattctgctgatccagcagtacggccggccgagctacattttggtagcgggctacgtcaaccgaggcgaggacgctgagcacgcggtgcgccgagaagtgaacgaagagatgcatttagaggttcaaaagctgaagttcaaccggtcccattactttaagcccacgaatactttgatgctcaattttacggcgattgtgaagggcaagcccgagccgaattgggaagtcgacaagtggaaatggttcactgttgacgaggccagagaggccatccgccccaacagcctggccaaggattttttaatcggctatctggacgggacttatcccttttaattttttgaatcagcggaggcggacatgcggctttttatcggtatccatttgtcaaaatcacagcgccgggccattgcccgggcacaggcggatttaaaacgtcagggggtgactggccgttttacaccggaggaaaacctgcatttgacgctggcgtttttgggtgagtgtgatccaaatcagcgcgataccgcagtgcacgtgctgaaaaagatgcgttttgcgtcttttcatctcaagctttcccagagcgggcgttttggcgacacgatctgggcggccccggacagtcagccaaagcttgccgaattggccggacgcctcagacaggccctcgaacgagcgggcattgcctacgatcgtaagcccttcaggccgcatatcacgatgctgcgcagagcgaaaagcgcggcgcccttcgacgtgcatctggatcgggccgacggcgtggtgacgcgcatcgctctgattcagtctgagctgggggcgaacggcccgcgctataccgacattttcaccgtcgacgaccgcggccggacctggcgccggaagccggacaccccggccaaacggatgacccgcgacagcaaatttttaagtctcgtcctccggcaccatccggaaaaaatcggcatcaccttggaccgccacggctgggcggatgtggacgcgctgatcgccggtatggccagaacccgcacctttgaccggccttatcttgaaaaaattgtccgcaccgacgcgaagcagcgctacgcgttcaacgccgatcacaccaaaattcgggcgaatcaaggccattcgatccctgtggatgtggagcccgagcagctgacgccgccggatattttgtggcacggcaccggcgaaaaatcggtggcggccattttaagcgaggggattcggccgatgggacggctttacgtgcacctgtcgaaggatcccgagacggcgaaaaaggtcggcagccgtcacggcaggccggtcgtctttcagatcgacgccggacggatggccaaggacggtctggtcttttacctctcggccaacggcatttggatgacgaaggtggtgccgccggcgtatctgaaaattttctcgcgtccgtcttgacagatgacggcgttttctctatacttttttgtgtaaaaaaataaatatttcaatcttcagggttgggtgaaattccctatcggcggtaaagtccgcgagccatttggcatgatccggtgaaattccgggaccgacggttatagtccggatgaaagaagatcgaaccgttttgttgagctcgacgccctgatttttcagggcgtttttttattggcgtcctggtagaaaggaagctgcatgacagaaaaagaaacatcagacagagaagcctacatgcggagggccttggcgctggcgcgccaggcagacggccgcacgtcgcccaacccgatggtgggctgcgtggtcgtcaaagacggacggattatctccgaaggctttcacgagcatatcggcggctatcacgcagagcgcaacgccctgattcactgccaggaggatccggcaggcgcagatttgtacgtcacccttgaaccgtgctgccacaccggccgcacgccgccgtgcaccgacatcatcatcgaaaagaaaatcgcccgggtctttgtcggggcgatggatgtcaatccgatcgtcgccggcaaaggggttcagattttaagagacgccggcatcgaagtcacaaccggtatacttgaggacgactgccgaaaactcaatgaggtctttgaatattacatgacagcgcatcggccctttgtcgacgcgaaatacgcgatgacattggatggcaagatcgcgacagcgtcgggtgactccaaatgggtcagcggcgaggcgtcgcgcaaagcggtccatcggctgcgtcggcattacaaagggatcatgtgcggcctcggcactgtgctcagtgacgatccgatgctcaactgccgcatcgcagacggcgtcgatcccgtccgcatcgtctgcgacacccatctgcgcatgccggcaaacgcggccctcgtgaagacggcaaaggacatcccgacgtgggtgctcgccggagcggacgcggatgcggacaagcgggctgcgctggaggcgcagggtgttcagatcatcccctctgagttggacacatcgggagagatcgatcttaaaaaggcgctggcggttttggctgaacgcgaaatcgacggcatccttctcgaaggcggcgggacgctgatgggatcgatgttgaaagcgaaactgatcaacaaggttcacgcctttgtcgcgccgaaaatcgtcggcggcagcggcgcgccctcgccggtcggcggcgttggcgtcgacaaaatgagccaggcggtgcagctgaacggcgtcgcagtcgcctcttacgaccgcgatctctgcatcaccggctatccggtttacacggaataagagagaggagcatttatgtttacaggcattgtggaagaaatcggcacgattcaaggcattaaaaaaggcgcgcgctcctgcattttgaccgttggctgcagcacagtacttgacggcacgcagatcggcgacagcatcatgaccgacggcgtctgtctgacggcgacgacggttggcagccggtattttacggcggacgtcatggccgaaaccctcaaccgcagcgcgctggcgaaacttaaagttggagacggcgtcaatctcgaacgggcgatgcccgcggacggccgcttcaacggccacatggtcgccggtcacatcgacggcgtcggcatcattaccgacaggcggcgggacgacaacgcggtgtggttcacggtcaagacgccgaaggatattttgaattacatcgtcgaaaaggggtccatcgcgatgtccggcatcagcctgacggtagcggacgtagacgacacatcttttaaagtgtcgatcatcccgcacacgctggaggtgacggcgctgggacagaaggaggtcggcgacgcggtcaatctcgaatgcgatatggttgggaagtacatcgaaaaatggtgtgaccggatgctgacaggcgatgaaaacaaaccaaaggacagcggcttaagccttgaatttttaaagaaatacggcttttaatcatacagagtatagaaggatagaaaagagacaacaaatggcaaaatcaataggtacaatcgaacaggcagcgcaggatttaagagatggcaagatcatcctgtgcatcgacgacccggaccgtgaaaacgaaggggatatgatctgcgcggcggaattcgcaacaccggaaaacgtgaatatgatggccagtgaggccaaggggctgatctgcatgccgatgagcgaagtgtggtgtcagaagctggatctgccgcagatggtcgacgaaaattcggacaaccacagcacagcctttaccgtttccatcgaccatgtcgacacgacgaccggcatttcagcttacgaacggtcgtacacggcgatgaaaaccgtcgccgatgacgtgaagcccgaagcctttagacggccgggccatatgtttccgctccaggccagacgcggcggggttttgacccgaggcggtcacaccgaagcgacggtcgacctgatgaacattgcaggactgaaaccggtggggctgtgctgcgaagtgatgcgggacgacggcacgatgatgcgtacctccgaattattggaattagccgaaaaacacgatttcactgtagtgactatcgacgatttgattaaataccgcgtcaagaacgacacgatcatggtccgggaagccgaagctaatctgccgacagcctacggcaatttcaaaatctacggctaccgcaataaaatcaacggggaacaccacgtcgcgctgacgatgggcgacgtagccaacggcgaaccggtgctctgccgcgtgcactccgaatgtttgaccggggacgttttcggttcctcacgctgcgactgcggcgatcagctgcaccaggccatgcgccagatcgccagagaaggcaggggcgtgctggtttatttgagacaggaaggccgaggcatcgggctcatcaacaaaatcaaagcctacgcccttcaggaacagggctacgacacggttgaagccaatatcaagctgggctttccgccggatttaagagattacggcgtcggcgcgcagattctccgagacatcggcgcgaagcggctgcgcctgttgacgaacaacccgcagaaaatcacagggctttccggctacggtattacgatcgaagaacgggtgccgattgaaatcgaggctcagccttacgattacaactacttaatgacgaagcagaatcgaatgaaccacatgacccattatgaacacgaccgtcacgtgcacgcttatccaatcagctacagcaaggcggaaaaagcgaaaaagaacgataatttaaagaataaaaagaattgagaaagaaggcaaaatcatgaacaaattagaaggtaaggttgttgcacaacagattaaggtggccattgtggcggcgcgtttcaacgaatttatcgtgtcgaagctggtttccggcgcacaggacgcgttgatccgccacggcgtcaacgacgatgacatcgacatcgcttgggtgccaggtgcctttgaaattccgctgatcgcccagaaattcgcccagtccggcaaatacgacgcggtgatctgcctcggggcggtcattcgcggcgcaaccagccattacgattacgtctgcaacgaagccagcaagggcatcgcgcaggtcagcctgaacacaggcattccggtgctctttggcgtcctgacgaccgaaaacatcgaacaggctgtcgaacgtgcggggaccaaggcgggcaacaagggctacgatgtagcctgctccgcgatcgaaatggtcaacctgatcaagaacatcgaaaaataatttggcgcaataaaaaacagagcgatttgaaattttcaaaccgctctgtttttttatgcgcttagtcgatggttttatcggtgagcagatgataggcttctttgtatttatcgatggtcttgtcgatgacgtcctggggcagattgtaatcggaatccgggttggccttgagccagtcgcggacgtactgtttgtcgaaggacggctgtccctgacctggcttgtagccttccagcggccagaagcggctgctgtccggtgtgagcatttcgtcgccgataacgaggttgccgttttcgtcgaggccaaattcaaacttggtgtcggcgatgatgatacctttagagagcgcataatcagcgcattttttgtacagcgcgatcgtgttgtcgcggagtgccttggcataggcttcgccgtggcccgggaagtgtttttccaggacgtcgatgctctgttcaaagctgatgttttcgtcgtggtcgccgagatccgccttggtgctcggagtgtaaatgggttctggaagcttgtcgcattcgatcaggccgtcaggcagcttgatgccgcagaccgtgccgttttcctggtagcttttccagccgctgccggtgatgtagccgcggacaatgcattcgatcgggagcatggtcagctttttgcagagcatgctgttgccgtcgtatttttcattctggaaaaattccggcatatcggccacgtcgacggaaatcatgtgattggggatgatgtcttcggtgtagtcaaaccagaatttggacatctgggtcaataccgtgccctttttgacaattttatttttcaagatgacgtcgaacgcggagatacggtcggttgccaccatgactaaggcgtcgccgatatcgtaaatttcccgaaccttgccttctttgaccggttgataagttttcatgaaaagcctcctgtaaattttcaagaatacgttgattatatcagaaagaacggggaagaactatactcgaattcacaaattcttcccaactcttgtacaaaattcagatcataaatcgacttcaacgttgaaatcgatggtcgtgccttcgttgtcaggcgacaagtcgtaatactgccaattgggctctttcttgcttaaataatcccgcatgtgttcagaaaatgcggacagattgtttttctgggtgatggccagaatggtcggaccggcaccggagatgcagacgcccaaagcgccgtagtgcagcgcggtgcgttttaccgcgtcgaaggagcggatcaaatgcttgcggtagggttcgtgcagcttgtcgttcatgctgttcttcaggacgtccggccggccttctgcaagggcgaggtaggtcatcgtcgcgtgggcgacgttgaagacgccgtccgttctcggaatcttgtcgggcagtgcggcgcgggcagccttggtcgaaagctcaaaatccggcacaatcagatggaaagcgaaggtatccgccacttcctttctgatgtattgataatgatgatgactgccgatggagcagacgagaccgccgaacatggccggcgcgatattgtcgggatggccttccatgtcgaccgcgatgtcgaaaagctcgtcttgtgtgagggggctgccgcagagggcattggctccgaccaggccgccgacaatgcaggtggcggaggagccgagccctcggctgaccgggacaccggtttccgtgtagatgtagaggccctttgggtagtagtgcacgcgcttaaagacgcgctgcatcgcgcggtaaaccagattatttgtgccctgatattttcgggatacgccgcgaatggtcagcttgccgtcgtctttttccataaaagtaaaagaattgtagaggttaaacgcgagaccgaaagcgtcaaagcccggaccgatgttggcggaggtgccgggaaccttgacctgaatcccgcggttgtgaagcattggatgatcagtcattttcgattccttttatttcttttctataattatataaagattatctcagtcgatttaaaaagttctgaaggctgtcggccatatcgtcgacaccgcagatgtgatcgtgaaggtttggacgatcggcgaggccggccagcggctttggaatatcggttgatgtggcgtcggacaaagcggtcagcacgtcgaaatcgttgagattttcaggaatatcgccgtaaatgcttttgtacacattggtggcgaatttgtaagggcttgccgtggacagcacgatggttggagtcgtgtcgccggtttcgtccttgtactggtcgtacacgcaactcgcgacagcggtgtgcgggtcgatcaggtagccgtggtttttgaacatgtcggcgatggccgctgaggtttgcgcttcatcggcaaagccgccccagaaggcctttttcgtctgcgccttgatggcgtcggggacggcgtagctgccgtcgctctggagagcgcgcatccactgtgcgacttcctccggatccctggagacgtcgtagagcaggcgttccaaattgctggagatcagaatgtccatcgacggcgacatcgtcttgtagaacgggcgcttgcggttgtactcgccggtttcaaagaaatccgtcaggacgcggttggcattggacgcacagacaagccgattgaccggaagcccagttagtgccgcgtagtagccagccagaatatcgccgaagttgcctgtcggcacgacgaagttgaccggatcgccgcaggcgatggcgccctggcgcaccaaatcgcagtagctgtagaaatagtaaacgacttggggcagcaggcggccaatgttgatggaattggccgaggaaagctggtagcctttggcgttgatgtcggcgttgagcgcctgatctgaaaagatggtcttgacgccgttctgagtgtcgtcaaaattgccgcggacgccgacgacgcaggtgttctttccggtctgggtcagcatctgcttttcctgaaccggagatacaccgtccttcgggtaatagacgatgatgtcgatgcccggcacatcgcagaaaccggacagcgcggccttgccggtgtcgccggaggtggcggtcaggatgacgatttcccgtccgatgttctggatcttgacggagttggtcatgaaatggggcagaatggtcagcgccatatccttaaaggcacaggtcgggccgtggtagagttctaagaagtagcggtcggccgccttctgaacgtgaaccgggcaggtgttgtcttcgaacagccctgtctggtaggcgtcgtggacgcactgttcaatctgttcaggcgtgaaatcgtcgagaaaggcgttaaagatcgtctgcgcgacttcgctgtaggattggttcagcatgctgttaatatcaaaatgacagtcccgtataaaggaaggcacgtacagtccgccgtcttttgccaggccggcgataatggcctgagaggcagtgatattctgttcgcttccgcgggtactgacatagtggtctcggtagtcgattggcataaagctcctccaagttttaaaaaatcgtagaatgcgcaataaaaaattgcgacgcaatctatttctatgatagaatgatttaaattgaattacaagaaaaaattgtatttgaaatcaagaaatgaggtcatatcgtgaatattgcactactcggatttggaacgatcggtacaggagtttacgaattaatcaacctgcacaagggtcgttttgctgacaatttagatgaacctgtatatatcactaaaattttggataaaaacccgaacaaaaaggtcgatccgtccgatcatcactgcgaaatcgtgaccgatcccgatttgatcatgaacgatcctgaaatcaagattgtggtttccctcctgggtgggatggattttgaacacaagatgatcaaaaccgcgctggaacacgataaaaacgtcgtgacggcgagcaaggccgtgctgtctgaatattttgcagagctcaacgccattgccgacgaacaccacgttttcttaagatacgaagcggcagtcggcggcgggattccgattatcggctcgctgaacgaagaattgaaaatcaaccacatcgatgaaatcatggggatcctcaacgggacgaccaatttcatcctgtcgaatatgacggaaaataacgccgatttcgacgaaaccctgaagctggctcagaaaatcggctttgccgaagcggacccgacggccgatatcgaaggctacgacgtctcgagaaagctcgccatcctgtcaactttggcttacggcggcatcatccgcgacgaagacatcaaaaaacgcggcctgtctgacgttgaagctgtcgacgtggaaatggtcaaatccatcggctacgtcatcaaatatctcggccactctaagctgctcaacaaaaatcaagtgtacacgacagtcgaaccggtgcttttcccgaatgaatcgatgatgggtcatgtcgattcggaatttaacatcatttccattaaaggggacgtcatcggcgaattgcagttttacggcaaaggcgccggcaaggacgcgacagccaatgcggtcgtcggcgacgtgctctacatcatcaacagcctgaaggaagaacgcaacccccattacaaaaagctcgacaaggatctgcacaagatgggcaattccggcttctccggccgctactacctgcgcgtccacgtgacgaacaacgacgaactggcttacgtcatgtccgtgatgaacgcggataagggcagaggacagatcgtggtgagcggcgacgacgtgttctttacgacatccgaaatccaggcggacgttttcgattcactggtcgaacgccttaaggaacgaacaccgaagctgttctacgcgcgcatttacgaataagaaggctgccgatggaaaatttaatcgtacaaaaatacggcggcacctcagtcggatcagtagaccgcattaaacgcgtcgcgaagcgcattgtcgaccgggcggacgaaggcaagaaaatggtcgtcgtcgtttcggccatgggcaagcagaccgaccatctggtagaaatggccaagtcgatcaaccccaatcccccaagccgggaattggacgtcttgatggcgacgggcgaacaggaaagtatcgcgcttctggcaatggccattcaggccctcggccactctgtcatttctctgaccggtgcccagtgcggcattaaaacctcagaagtgcacaaaaaagcgcgcatcgaaggcatcgatacgagccgactgcagcgggaaatcgaaacccatcaggtggtcatcgtcgcgggcttccagggcatcgacgatcgggacgaagtcacaaccctcggccggggcggctcagacacgtccgctgtggcgttggccgcggcgctcaaggcggaaagctgcgaaatttacaccgacgtggacggagtttacgacgcggacccgcgcatcgtgccggacgcgaagaaaatcgacgaaatttcatatcaggaagtattggaaatggcgagtctcggggccggcgtgctgcatacccgttctgtcgagctggctgaaaagtataaactgccgctggttgttcggtcatcctttaacgacaacccgggcacattgatcaaggaggaagtcaatcgcatggaaaaggtgttaattcgaggcattgcgctcgacgaagatattgcaaaaatttcaattctggaagtgccggacaaaccggggatcgcttttcggctgttctcgtttttggccgctcagaacattcacgtcgatatgatcgttcagaatgtcaaccggaccgcggtcaacgacatttcgtttactgtcaatgtcgatgagctccagaaggctgtcgaagtgtcgcagaaatttgcctttgatgtcggcgctcagaaggttgaattcgatcagggcgtggccaagctttccattgtcggcacaggtgtcgtcgccaatgcggaaattgcgagccagttttttgaagcgctctacgaattgggcatcaacatcctgacgatttcaacctctgaaatcaaaatcagctgcttgatcgacaaggaaagagccaaggaagcgatggttcacattcacaagaaatttgaaatgtaaagtttgatttgattcaagcatacaaaaagggctcctttcacaggagctctttttgattggtggttttatagatttttgaaggcttcgcgcacacccttgatgtcgccgcagtacatcgcgccctcagggcagggcccttcgaggcaggaggggccggccgacgcgaaaagggtcggcgcgacgggcttgacgagtttcagcatctgcgtggcgcaggctctgatttcccactgggcgcgccggcagcaacgcagattgaaaaagtgcagcagttcccgggcgttcatggtcacgataattttggtttcacaggcgttgggcaggacgtagcgcgcgtcctcaaaagcttttttctgagcggcggcctgggcgtccttttcggattttccctgatccatcaatgcggccttgtggtgtgcggtcaagcggtcgaccaattcgtcgtaagcccgttggtccgcttccatcgtcttcaggtagagggccttcgcttcgggaatgtcggcgattgccggcgggacgatgtaatcgaactggccctcagtgacgtagcgctgggatttttggctgtagctggccaggcggtggcgcaccagctggtgggtcagggagcggctgaccccttcgatgccgaaggtgaagctgatgtgctcaacaggggacatgtgtccgtaattggagagccgttccaaaaaggctttcaccttttcaggcgtctgtttttcggtcagagcttgaatatccgacgcggagtagcagagctttgcggcggaagcgactactttttcagggtctggggtgtgtgacagcaggattacatttaattttgattccatataggttcctcttttatctttcgtacaataatttatcggcatcagccaattatttgagtccgttttggtttataattataacatgaaacttgaacaaactaaatttccatataaaattattccggaacacgaaaaaaaatatcggttcaccacaggtgaactccacaaataccgcggccgctactacccgctggttgtgaagctgaccgccgatccatcagaggatacggcggaaatctgtcagggccatctcgtgctgcattcatccaacccaaagagtcccgtgaccaacgcggcggtgctcgatgaatggtactacaatcaggcgaaggcgctttttgcgggcatggtcgccaaggcgatgctcaacgccgcaccctacgtcaagggaaaaatgcccaggctcagaatcaaacgcatgctggaccaatggggcgcgtgcaacccgagaacggggcttttgatcttaaacctcgagctgatcaaagtaccggacgcgtgcacagcctttgtcgcgcagcacgaagtgatgcacttaaaatatccgagccacaacaacgcatttttcgcggcgatgaaaagcgtgatgcccgattgggtcgaacgggaaaagattctcaagacctattatcctgtttaatatttttgcgattaaaaaacagcgtgtctcaaagtcgatttgattttgaggcacgctgttgttttttatgtcaatcagaaaaatttaatttggataaatcagccggctgtcgtcaatgtggtcgagaacttcggttaaaaatttcttcgattcgtatttggccatgttgaggttttggtcgaggtagttgccgcagtctctggccgcggcgcctgggacgtccccttcaaaatctgccatgaatttgtagagatctgtcaccagcggcacgacgtccttcgattcgaggtcgcccttcatgacgaggtagtagccggtgcggcagcccatcggcccgaaatagatgatctgatcggaaattttcgggtcgttgcgcaggtatgtcgcgccgagatgttcgatggtgtggcattccgcggtgttgagcaccggttcacggtttggcgccttcatgcggatgtcaaaggtcgtgacgatttgatcgccgacctggtccttgcgggacacgtaaatgcctcgttttaatttcagatgattgacggtaaaacttggaatttttttcatttctgccatttattggcctcctttgttcaaattaactaaatagcggttgagcgcttcgaggtagtgcagctgaatgccgccctccgaatgaattaagtattgaggatcaaaagctgaaagcgggatcgatttgcgcccgccctttttggcgccgttccaatactgcatcaacacctcgaagggcagcagaaaatattgatcggtctgtttaaaatagacgattaaaaaggtcagaccgtcctgcttctggaaggcatccataaacgcgacctggtgctcgtggatgttgtagagcggcagattcttcaggttggtttccttggcgtcgaagcacaccggaatgccctggacgttgccgacgtaatcgaccgtgcttttcgcgtcgaaatacgcgagcttgatgacgcccttctgctgatcgagctccaccggcgtgatcgccgttggaattttctgcatcacggctaggccgtgggtcatgtagtaatgattgctttgattgattaaatcctcaagaacggatccccggagtcctcgggaatgccagtaacccataaaatgctctctttctactgcttatattgctttgttgaaattcagcgcgtgcaggatcgccagaaaagccggatcttcaatcggcgcctggatgtcgaagcttaacgtcggtgcgctcagcgtgtaatgcgccgcgtgaagcaggggatggtttaagtgatagcggtcccgaaatgtttgattcgccttttttgagccgtacttgacgtcgccgacaatcgggtggccgatgtgggcgagctgagcgcggatctggtgggttttcccggtaaacagctcgatttcgagcagcgtaaagccgccgttcgattgaattggccggtagcgcagggcggcgtgaaccccattcccggagtctgagacgcgggtcttgttgtgctcgcggagaagctggtcgtcgcagcggccaggctgtgtgagtgcgccgaagactaaagcgaggtaagtcttgtgcgtcttccgttcccggatcgatcggatcagggttttctgcgtctcgtaatttttcggaatcagcacgacgccggaggtgccgcggtcgaggcggttagctggcgccgcgtgaaaggtgccgtcggcatacaccgcggcgagatcggcaatcgaggggtcgccggtgtgatccggctgggtcaacagccctgccggcttgttgacggcaaggatctgcgcgtcttcgtacagcggcgggtgaattagcgcgctgagggaatcgggaaggggcttctttttcggagcttcatcagcggacgcgcctctgaatttggcgtaggtctcgtctgaaaaatagaaggtcagcgtatctccctcctgaatggtgtctttgggttcggcacggcggccgttgagcttgatgcgctttttccgcgtcattttcattaaaagccccttgccggcttcgggcataaatttgacgagaaatcggtcaaggcgctgaccggacgcattggccggaatgcggtacgtgatcatcgcttaaagcctcttgctgcagccgaggacttggcgcattttgtggatgaccattgaacggatcgccctgcggcccggtccgaggtattcgtgagggtcgtaggcttcgggatgctcgacaaagaactggcggatacaagccgtcatcacgagatttaaatccgtttcgatgttgattttgcatatccccatccgcgcagcgtcgcggagcagatcctcagggacgccctgtgcgcgttcgatggcggcgccgtattggttgttgagatcgacaaattccttcggcacagaggacgcgccgtgcagcaccagaggcagattatcgagataagaagtcaaatccttcagacggtcgaaggccagcgttggctccgtcttgaatttgtacgggccgtagcaggtgccgatggcgacggcgagggaatcgacgccggtgtcgtggacgaattccgccgcctgttccgggttggtcaaggcagagggaatatccgaatcggtatcgccgtgaatatcgccaaggcccccttccacgacgacgccgtgatcgtgggcgtaggtcacaacctgtttcgtcagcttcacattgtctgcgtagggcaggcgcgagccgtcaatcatcacagaagtgaagcccgagtcaatacaggcgacacaggtgtcgtaatccggtccgtcgtcgaggtgaaggcagatgtcgatgttggaggtttcgacagcagcttcaaccatttttaaaacgtagacaggatttgtataaattcgagatttttcagagacctgtaaaataacgggacagcgctcgtgttctgcggcagcgacgatgccctggatgatttccatgttgttggcgttaaatgccccgatggcgtaatgcccttccaaggcgtctttaaacatttgagtggatgtcactaaaggcatgtgtctcctcctttttctttttctatctttattatagaatcaatttattattataagattaagttttaaggatttcaataaaaaaaagaattggaaaaggtcttgcaaataggaccggctttcggtataatagcaaagtattcaggctgggatggcacagttggtagcgcaactgattcgtaatcagtaggtcgccggttcaaatccggctctcagctccatttaaaatcaaagcaggcttttacggcctgctctttttatataccagaatatcatcttagaaatttgaggagagaggtatgcagatcaagaaaataagatccggggcgaaactgccccttcggggttcagaatacgcggcgggctcagatttattcgcctgcctggacgcgccgatgacgattgcgccccacgaaacggctatgattccgacggggctcgccatcgccctgccgccgaacacgtttggcgcggtctttgccagaagcggtttggctgtgcgagaaggtctccgcccggcgaactgcgtcggcgtaatcgacgaagactaccgcggcgagctgacagtcgccctttacaacgacagcgattcggaccggatcatccaaccagaggaacggattgcccagctggttgtgatcccttacgtcatgccgaattttgaactggtggacgaactggatcagaccgcgcgtggaaaagatggatttggatctacaggaaaatgacagaacaggatattcgagaaaaattatcggcgccgttaattgattttatcggcaggaaaattgaaccggcggatttagaggcgcggctgaggcagaccttggacgcgacagaaaatgcccacttgacgtatttcggttatttatatgaaaatcgggcgattaaagccgcctcgcgttttataaatggacaggatatgccagaggatttgctgcggcgggaaatcatcgacattctcctcgagtttcgggagtacgcttaccattcagatgaagacgaggaggcatacatcgatcccgaaccgaccgatcagccggtttggaaaatttactattacgacgtcgtcggactctattaccataggacgcagcttcaaacgctcagtcggattaatccggattacgaattgagcggggcacagctggttgaagacgatcaggtggatgtggagattcccaaatactgcttcgattgtactgaggcggagctgattccggagccggagaatctgcacgatccccacgcgatccgtgtcgagatggcgggggagacgatcggctacatcaaaaaggggcagacgcaggaaattcaggagctgctcgacgaggaccgcatcgggaacatgagctgtcagatcacgggtgggcccttccgcattttgtacagcggctacagcccggcgagagacaaggcgatctacgaaaatgttgaaaaggaacaggcggcctataaaggtgaactcaggctctgcgtcggtcctaagctcgaaatgagcagtctggtcggcagacgggtggccatcaacagcgaagagcacgaaaaatggttcggccgcgtgtacttgtatttggaatcggaagacgacatcaaaggacaggaatcgctgctgcttgatgttgaaggcgtgccgacgatttaccgcattccattgcacgacatcctgcgcattgaggtgctcgacggtgaataatcaggcgtgtaggctttacaatccagactgagcttcggctcagtctttttttatgctgataaagttagcatatattttaaatctatacgataatatgtaaaattaaatacaaataaaattttcagaaaaataatacatttcaatgtcacaatattatctatctttaagcaaaaatccctcgtatactaagattaaattaagttaagaaaactttaagggggttaatcgatgaaaaaacagttagcatgtgtaggtttagcggcagcattggcgctgacaacattagccggatgcggctcgagttcatcctcgagctcaagttcaagtttaaaagcatcgagcaaaaactacaagccggtcaccattgaaatgaatttggaacgcagcggacttgggaagaattacaaacatacctttaagaaaatgccgacaaaggtcgtcgccgacggcgaccagatggctgatattttctttgacctcggtttagcggacaacatggccggctacaccaagggcgcctgtgtcgataccgtcaaacagtatccaggcgaaaagaaagtcaaacagctggcgaaaccgggcgtcaatttgcgtacggtttccaaagaaaaagtgctggccactggatgtgatttcctcgtcggctgggatgatttattctcagacaaaaacttcagcctgagcttctgcaagaagaacggcatcaccccgtacttcccgtacgtctgctcagacagtgcgaccttcgaagagctgtacaaggattacgaaaccctcggcaagatcttccaggtggaagacaccgctcagaagcgcattgacaagatgaaaagcacgctggattcagtccacaagactttaggtgacgaagcttaccaaaatccggtcaaggtatttgtttacgactccggtgaagatgcaccgttcacggcttgccaggggatgccaggcgatacccttaaaaaggctggcgcgatctcgatcttcaacgacatcaacaaaggctgggcaaccccatcttgggaacaagtggccgaaagagatcctgatgcgatcatcattctcgaatacaaccacgatgtcaacaaaaagaagaaattcctgaagaccaacaaatacaccaagaacctgcgcgcggttaaagaaaacaagatttactctgccaactgtgccatcatgcagggctctgcaggatcggctgatttggtcaagagcattgctaaacagctttatccagacaaattctaagagggtttgaaatcaaaacagggagagactttcaccggagattttcagtgaaagtctctcttttgatgaaaaaagaggtgaatctatgaaactcagtttacacctgccaattcgaaagagaggggcctttgtgctgttctgcatcggcctgttcgtgcttctcgttttggctgtcattctggctgtcttttccggcagtgtctccattccgccggatgtggtctgcaaggtattgctcaaccacctgaccggccacgaaattttcgagccgacctggaacgcgtcccttgaaaccatcatttggaccatgcgttttccgcgggtgctgatggcgatgatggtcggcgccgggctgtccctctgcgggattttgatgcaggccatgacgcgtaactccttggcggatccgtacgtgctcgggatttcctcaggggcatccgctggggctgttgcggttatcatgtacggctggtttggttttatgggccagttccatatcgtatttggtgcggcgatcggtgccttcatcgcgatcttcatcgcgatgaaagtctcgtcagtcagcaaccgcatcacgtcgacgcagctggtcttggccgggatcgccgtgtccacgctctttcaggccattaccaactttatgatttattacagacagaccggcgacgataaagtcaagacggcgatttactggatgatgggctccctcagcggcgccaattggagcacggtgctgtatctcttcatcatcgtgatgatctgtacagtcatcctgtttttctttacggacagcttagacgtgctgatgctcggcgacgacgccgcgacgaccctcggcgtcaatctaatgcgcatcaaggtgtcgatcatcatcttgtgtacgattatgaccggcgcgatcgtatcggtttccggggtcattggctttatcgggctgatcatcccgcatatcaccagatctctcgtcggctcgaagcacagccgtttaatgccggcttcgattctgctcggcgggctcttcacgattctgtgcgactggatttcccgcatcgtcgtcattccggaagaactgccgattggcgttttgaccgcattatttggcgcgccgttcttcctgttcctgattcggaagagccgttcgaaattcggaggtgcatgatggcgaaattaaaggttgaacatttagacttttcgatcgacaaggcgcagattttaaaggctattgatctggaaattcaaaaaggagaattcgtcggtctggttgggccaaatggctgcggcaaatcgacgctgctgaaaaacatttaccggatttatcagccggaccgcggcaaaatttacttggacggccagctggtcgatcaggtcaacgacaaggaattcgctaaaaaaatggccgtgatggttcaggaaaatacagtggaattcgatttgaccgttatcgatatggtcatgctcggacgctacgcccacaagcggctgctccaggactcatccgaaaaggaccacgcaatcgcggaaaagtacctcgaagaagtcgggatgaagggctacgaggaacgcagctttttaagcctgtcaggcggggaaaaacagcgtgtgctgctcgcacgggcgctgtcccaggaagcggagctgatcgtcctcgacgaaccgaccaaccatctggatattaagtatcaatatcagatcatgaatattctgaagcggcaggatatgactgtctttacctctgtgcacgatttaaacatcgcgtcgctgtactgcgaccgcatcgtcgtgctcaagaagggcgatttggttaaaatcggcacccctgaagaagtcattacgccggagatgatccattatttatacggcatcgacagcgaggtgcgcatcaacaagacgacggggcggcctcagattcaatttttgccgaattttaacgtgtaaaacggagagaacaaaaaaataccagaacaaaactaaatggtgtgctacccgtcaagaggacactgaataattaacaatttttgtaccgccagtcgaacaatcgactggcggtattcttatgctgcagcatagaagttttcatgatattcctcaggtgtcatagcataagttggagttctctgtatgcgttctttgttgtagtgagttgatatatgatctattgcgtttgacagattcgcttttgaagtaaagtgtttacataatacatttctcgttttaggatccccagaagccttccatagggccattatcaatacaatgggccactctggacatgctctgttcatatgatgtttcttaagctttaaagaaaattgtctactcgtatattgcagcctctgtcactgtgaaataacggatgcgcatctggttcaagagtcacagcttcatcaaagtattcattacaagtgattatcattatgttcactgattttataagcacgatcctacggtcatacagattagaatagcacttaaattatatctgtggacttctacaccgatgtaatattgagactctgtccatctgtcagccatttttcattcggtgcatctggtgaaagttccggttataatttttagcaatgtgagcaggatccgggctgtttctagtacagctttcggttccatttgattttagactggatcttttcgctgcggcagaatcctcaggattcgttatcattgacagcgataccgtgatttttgtccagttcgtctctgattcgtcgatatcccatgtccgggtgttgctcatggatgtacttgatcttttcgcaacttcttgttatattctcactaaaactgacaggatgattcaaccagcgatagtaagcgctgcgtgaaaggttaaatatgaacagagtctttgcacgggtagtgcttttcttcagacagttccttgatcgcctgatatttgtacaaatgtcgagtcagagagagcgatctttcttctctaactctctgactttttttaacagatcattctccatttgaagatttcggtttttgcgtctagttctgcaatcttgttccgcaattcctctcaggggtcctagaaggttgcgtaccggcgcgatggcacgccgatcttccaaaccggcagatcccatcttctcataaagcagcacccagttacgtaactgctgataggaacaattatattttagtgccatcgcaccataattcttatcactagcaaggcaatcctttacgatttcaagggttcttccggcgttgtttttctagcttttctcatgtagcttccactctccgtgtgcgtgattgaatatctccatagtatatatacgcctatccatttacgtagttgagtttctgatcttaagccataacgaaaagctatttcattaaggatcttctccgcaaagataggcattaacagcggccagtttcagctctttcgaataatacttgttgctcgatttgttcaacagtccactaggaccttcgtttttgtaatattgacccgtctttaaaagtgcatagcttttagtggttggtttgccgcttccaaacaggctatttcacctcgcagataactttcaactaccgatacttttacggccggatcaatcttgctttttcgtgacatagaaatacccccaagtaggtttttatattttactgtcctacttaggggtagcatatcaaaaaataacggttcttttttatctgttaaaataagaattaaggtttcatttaataatctgctgtataattgaaatgacgagtgaaaaatgagcaattgtaaagattgatttttttcacgagtgtctctctcttttttccttggcctcccaaacgggaggcttcttttgtttatcaaatattgaacggaaaggaggtcggcatgggcgaagaacggctgatctatcatgtggacgtcaattcggcatatctgtcctggtcgtctgtggaccggctgtcctggggcgaatcggatttgcgtctcgttccggcggtcgtgggcggcgacgcggcgaaacgccacggcgtggtgctcgccaaatcggttccggcgaaggccttcggcattcacaccggcgagcccctttccgacgcggtgagaaaatgcccggatcttatcgccattccgccggattttaaaatttaccagcgttacagccgcgcgtttaaggccatctgcagaacctacgccaccgctgttcaggatttttcaatcgacgagtgcttcctcgacgtcacccagacgacggcctattaccatcccgtcgagacggcctgcgaacttaaggaccgcatcaaggcggagctcggctttaccgtgaacgtgggcgttggacccaataagcttttggcgaagatggctggggattttgaaaagccggacaaggtgcacaccctctggaccgaggaaatcccggagaaaatgtggcccctgccagtcaggcggctcctctctgtcgggcggaagaccgccgaaaagctaaacctgtacggcatccggacaattggggatttggcccattgcgagcccgctaatttacaacaggtgctgggcaataaacaggggggacacctttaccgttacgccaacggattggacgatagcccggttttggctgagcctcaagaggaaaagggatactcggtgtcaattacgctgcccaaggacgtgaggaccgcggcagaagcccgaaaagtgattaaaagactggtggactctgtggcgatgcgccttcgcagcaaacaccggcgggccaagcgcatcagcgtccagatccgctcgtccagcttcgtcgaccggtcccaccagcggacgctggatcacgcgacggacatcacgcgggaaatcgaggccacggctgatcagcttttcgatgagctctgggacggggtgaccccgctgcggctcatcggcgtcgcgctgacgcagattgaaaccggaagcgtgtcgcagatttcgatgttcgacacaaaagatctcgagcgggagcgccatatcgatcaggccattgacgcgatcagaaagcggttcgggaccgatgcggtcagccggggcgttgacgacaaaaagctgccgagggtcgggaaaaagtacgaggcccgttttgaaatcgacagggatcaatgaaaattgtacatcgtaaaaagaaagtgatataatgctagccatgaaatttaaaaccttcttatctattgtaatggcgaaaatgaccaaatcgctgctgcgcctgatggggcggggcggcacggattttccaggtcgtgtcgcgatgaaattggatcacaaagttctggctcaatgtgcgaaaggagtcaaatgtattgtggtgacaggaaccaatggcaagaccaccagttccagaatgattgaacagactttgaatgatctcggcctatcctttttctgcaacaaatccggtgccaatctgattaccggaattacagcggaattcattaccaattcgaccttaagcggacactgcaagtacgactacgccttaatcgaatgtgacgaggcggcctttaaggaagtgtcgacgatgatcgacgccagggcgattgtggtcaccaatattttcagagatcaattggaccgctacggtgaagtgacccacaccctcgaaagcattaaaatcggcatcagccacagcccgaaggcgacgctctgcctcaatgcggacgattctatggtcgcgtcgatcgccgacgattttgacaataaagtcctgttttacggggtcaacgtgccgatctacaaaaagcgcgttcaggaagtgtcggacgcgccgttctgtatcaaatgtaagcacgagtacgtctatgattacgtcacctacggccatttaggcggctaccgctgcccgaactgcggctatcacagaccggatccggatattgcggtgacgaatgttatccaaagcgacgcggcaaaatccgtcgtcgatattttagttgacggtcagacttatcggacaacgatcaatctgccggggggctacaacatttataacgcctgcggaaccgttgccgtcggcaaggcccttaaattcgatattccgacggtgatccgctccctttctgaatttgcgccgggctttggacgaatggaaaagctcgtcctcaacggcacgccgatccgcatgatcctggtgaaaaatccggcaggctgcaatcaagtcctgaatttcgtcaccaacgtcaccgacccgtccgtctttgtggtctgcctcaatgaccgcgacgccgacggcaccgacgtgtcctggatctgggacgtcgatttcgaacaaattgccgaaatgggcgataagcttaaaggactctacctgtcaggcatacgcgcagaggatatggcgctgcgcttcaaatacgccggtattccggaagacaagatgaaagtcattaaggattacgaaaccttgatgaagacctgtgcggcgcaggattatcccgtttacatcatgccgacttacacggcgatgatggacctgcggaataagatcacgaaaatgtacgacgtgaaaaatttctgggaataaggaggacaagatcatggaacaaccacttaaaatttgtcatttgtacccggatattttaaatctttacggcgatcgcggcaatgtgctgtgcctgagccgccgcctcgaatggcggcacatccctgtggaagtggaccgcgtctgcgtcggagaacctttaaaggctgcggactacgatttgttttttatcggcggcggccaggattttgaccaggaagtgctgctgcccgaccttttttccggaaaggacaaggagctgaaggctgcaatcgaagacggcaaaacggtcttggccatttgcggaggctatcagatgctcggccaatattacaagacttgggacggcaagcagatcgattttaccggcgcgttgaatttttacaccgagggcgtcaaaaaacggatgatcggcaattatgtgtttacctttgacgacaaaccgggggtcaacattatcggattcgaaaatcattccgggaagacctatctgcagaatggtgtgagaccgatgggcaaagtgcttaagggctacggcaacaacggtgaagacggcacggaaggcgttcggtacaagaacgtgtacgggacgtacagccacggctgcctgctgcccaaaaacccgactgtagccgacgccattttatcggccgcgctggaacgcaagacaggccatggaaccctgccgccgctgccggatcactttgaaaaacaggcacacgacacgatggaaaagcggcttttaggttaaaaagcgagagggggagtattgtgtacgaagactttgctaaagtttacgatgaattgatgcaggaaatcaattacgacgaatgggccgattacatcttcagaatgaccctaaattcgaccaagccgattaaaaaaatcttggagttcggctgtgggaccggcaacatcacgctgcggctggctaaaaaagggtttgacatgacggctgtggatctatctgaggatatgctgacagtggccgatgaaaaggcagaggcccagggaattgaaaacgtccgctttttcaagggagacatgagcaattttcagatcggcgaaacctttgacgcggtgatcgtctgctgcgacagcttcaattatttgaaaagcctggacgaaatcgagtccttcttaagctgctcggcagaggcgttaaaacccggcgggcttttaatgttcgatatgaacacgccggaaaaatacaaggaaacgatcggcgacaacaccttcgtctacaattttgacaatgtctactgcgtgtgggaaaataccctgcatccggacgacgacaaggtcgattttgatttgtccttctttgtgcgccgcgaagacgatttgtacgaacgctacgaagaagagcagagccagtactattatcctgtggaagatatttttaaactcttaaaggtgccagctttcaagaatcagaagatttacgacttcggaacttttctggctggcggcgcgctgagcgaccgtgttcagtacgttgcagagaaaagataaaaaaattgtaaaaaaatcgaaaaaaaggtttgacaagcacaggaatctagcgtataataatgcctgtgcttgagatttggtcgcttagctcagctgggagagcatctgccttacaagcagggggtcacaggttcgagccctgtagcgaccaccagatagcaacattatttattggccaggtagttcagttggttagaatgccagcctgtcacgctggaggtcgtgagttcgagcctcatcctggtcgccatgcccagatagctcagtcggtagagcaggggactgaaaatccccgtgtcggtggttcaattccgcctctgggcaccatttaaacggtgcggaagtggctcagtggtagagcatcgccttgccatggcgagggtcgcgagttcaaatctcgtcttccgctccattttattttgcggtggcatagccaagcggtaaggcaaaggtctgcaaaacctctattccccagttcgattctgggtgccacctccatataagaaggcaaacgctaaaccagacattgtgttgggtttagcgtttttttaataggaggacaattttgttcgaatacatcaagggcgtattggaagcggaacgcgccgacggcgtggtcgtcgaagccggcgggtttgggtattggatccgtacatcgatgacgactaacgcggcactgccggcgctgcacgagccggtgaagcttttgctttatccggcctttagggaagacgacgtgacgctctacggcttttcgaccgaggaagagcgccggctgttcgtgacactgatcggcatttccggcattgggccgaaggcggcgatgagtctgctgtcgcaattcgacgaggcgacgttcatccgccacattcaaaacgcggacgacaaggcgatttcaaaaacgccgggcatcggtaaaaaaacggcggcgcgcatcatcctcgagctgaaggacaagtacaaggactttgaagcgccggaaacggaagccacgggcggcgcgaccgagcgcatgcaggcggccgacgccttgtacaacgaaggcatcaacggtcttttgggtttgggctacgcctacagagaagcctcggatctcatcgaccaggtgattgagccgggcatgagcattgaagcgctcttaaaggcggcgctgacggctgcttcaaaatcataaagggacattatgaaggatcggattatcacaacagaattttcagagccggatgtggagatcgagcattcgctgagacctcaaaatctggacgagtacattggccagaagcgggttaaaaagcagatgggcatctttatcaacgcggcgaaaaagcggggagaaccgctggatcacgtgctgctttacggcccgccgggcttgggcaagacgacgttagccaacatcatcgccaacgagatgggcacgaagatccgcatcacctcgggcccggccatcgaaaaaccgggggatcttgcgtcgattctgacgacgttgaaggccggtgacgtgctgtttatcgatgaaatccatcggatgcagcgccaggttgaagaagtgctttatccggcgatggaggattttgcccttgacattattatcgggaagggcccgggtgccaaaagcattcgaatcgatctgccgaagtttaccctggtcggtgcgaccactcgagccggacagctgacggcgccgctccgcgatcgttttggcgtcgtgcagcgcctggagctgtactcgccggacgagctggcggatatcgtcaagcgctccgctggcatcttgggcatcggcatcgacgatgcaggggcgagagagctggcccgacgttctcgaggaaccccgcgtgtggcgaatcggctgctcaagcgggtgcgggattacgcggaaatggaaagcgagggcgtgatcgacctcgaaacagccaaaaaggccctgactttattcgaagtggacgacgtgggcctggatgaaaacgaccgattgatgctcaggacgatcgccgagaaatttgacggcggcccggtggggctcaacacgctggccgcgtccatcggggaagaatccaacacgattgaagaagtgtacgagccctatctgctgcagctggggtttttggccaggacgcccagcgggcgcgtgatcacgtcggcgggctgtgcccacttggggctgaaggccgcacaggcaccggccaatcaaattagtctggaggaattgacgaagcatgatgaagaaatctgatttttattacgatctgccggaagcgttaatcgcccagacgccggcagaaaagcgagatatgtcccgcctgatggtcatcgaccggaagaccgacaaaatcgaggatcggcattttcacgacattgtcgattatttaaaacccggcgatcttttggtgatgaacgacacgaaggtgatgccggtccgtatttacggtcacaagaaagaaacgggcggaaaagtggaactgctcctcttaaaacgtctcgacgacaaccgttgggaaacgatggtcaagccagggcggaaggctaagcccggcgcggttctggaatttacggattcggacgataaggtcgtcctcgaagggacgattgaaaagaccatcgacaacggcctgcgcgtcattgcttttgaatacgacggggtgttcgaggaaatcctgaaccaaatcggcaccatgccgctgccgccgtacatccacgaaaaattaagcgatccgtctcggtatcagacggtctacgcgaagtacaacggctctgccgcggcgccgacagccggtctgcatttcaccgaagcgctgctcgatcagatccgtgcgatgggcgtgaagacggcggctgtgaccctgcacgtcggcctcgggacctttagaccggtcaaggaagacaatattctagatcaccagatgcattcagagcagtacagcgtttctcaggaaacggcggatttgatcgaaaagacgaaggctgaaggcggccgggtcattgcggtgggtacgacgacggttcggacactggaaagcgtcgcctcccgccacgacggcaaagtggtcgcggaacacgggtcgacgtcgattttcatttatccgggcttccactggaacgtgatcgacgcgttgatcaccaatttccacctgcccgaatcgacgcttttgatgctcgtctcgtctttctacgacagagaaaaaatcctggcggcctaccgtcacgcggttgaagaaaaataccgtttcttcagcttcggcgacgcgatgttcattcaataggagaatcatgtttcgatacgaactcatccatcaggaaaaatacacaggcgcacgcctcggccggatcatcaccgatcacggcgaaatccagacgccgatttttatgccggtgggcacccaggcgaccgtcaagtcgatggacaacgacgatctgcaccgcatgaacgcgcagatcatcctcggcaatacttatcatctctatttaagacccggtgaagaggtcatgaaggaagccggcggcctgcaccgctttatgaattgggaccgcccgattttaaccgattccggcggatttcaggtgttttccctcggcgcgatccgaaagatcacggaagaaggcgtcaagttcatttcatatttggacggatctcggcatttcatgcggccggaggattccatccgtctccaaaacgtcatcggtgcggacatcatcatgtgctttgacgaatgcgcgccggcagacgccgactacgcctacacgaagcattcgatggaaatgacgacccgctgggcgaagcggtgccagcaggcccacgccaatccggagcatcaggccttgttcggcattgtgcagggcggcatgtttgacgatttgagacgcaagagcgctcaggacctgatcgcgatggacttccctgggtacgcgatcggcgggctttccgtcggggaaacccacgaaaaaatgtaccacatgctcgacgtgaccacaccgctgcttcccaaggaaaagccgcggtatttgatgggcgtcggttccgtcgacgcactgtttgaaggagtcctccgcggcatcgacatgttcgactgcgtgctccagactcgcatcgcgagaaacggcacggccatgacctccgagggcaaaaaggtcatccgaaacgccacttacgaacgggatttttcgcccattgaccccaattgcgactgcccagtttgtcgaaatcacacccgcgcctacgtcagacatttgatcaaatgtaaggaaatattgggcgccagattattgacatatcacaatttatattttacactatccctaatggaaaaaatgcgggaggcaattgcgcaggacgccctgctcgatttgcggaccgacgtttttaaaaactatggaataaaaaagattggagcttatcagaatgattaatcagattttgggcctgacccttcaggcatcacaatcatcgagaaacaatatggccagcatcgcctcggtcatcatcttgtttgtatttctgtacttcttgatgattcgtccgcagcgcaaacgccagaaacaggcagatgaaatgcacaacaatatgaaaatcggcgacgaagttctgacagccggcggtttttatggtataatcagtgcattggatgacaaaaacgtcgtcatcgaaatgcttccggatttcaacaagatgatgatccgcaaggaatccatcgtccgcgtcattaaaccagatgatgttgaagcggaagaagctgctgaagcagaaaccgcagaagcagcggaaccggctgaaaagccagaacaggctgaaacagaagcaccagcggcctcaaaaaccgatgatgccgaagctcagacaaaggatgagtaattcgaaaggggaagattccaatgaaacatattcaagttgtcaacaaaggccgtttgtgtgaaaccaaaaataagggctgcggcgaatgccagacctcatgccagtcagcatgcaagacttcttgcacggttggtaatcagcactgcaaacaggctcaggccaaatagttaacacacagaaacgggcaggcgctaagcctgcctgtttttttactaaagaaaaatatgaaaaatacacattctcaaattcacaagttttatctcaacgaccattacattgtcctcgacgtggccagcgaatcgcttttcaatatcgaccgcatgacttacgatattttagacgattaccacgaaaagcccgacagcgaagtgatcgcaaaatggcaggacacctacgcgaaggccgacatcgaggaagtcctcgaagagctgcacgagctggaagatcagggcatgctctacgcgccagacgattacgatccgatggtgtacaagaactacgacctgattaaatcgatgtgtctgaacgtggcccacgactgcaatttaagatgcagatactgcttcgcttctcagggcgattttaacagcaagcgcgaagtgatgccctacgaagtcgggaaaaaggcgctggattttctggtcgcgcagtccaagaaccgccacaatctggaagtggacttcttcggcggcgaaccgatgatgaatttcgacgtcgtcaagcgcctggtcgcttacggccggagtctcgaagggccgaaaaacaagaaattcaaatttacgatgacgaccaacggcatgcttttgaacgatgaaaacatgaaatggatcgacgaaaatatgggcaacgtcgtgttgagccttgacgggcgcaaagaagtcaacgatcggatgcggccgacggtttccggcaagggctcctacgatatcattttcaaccacatcaaaaaaatgtgcgacatccgcgaagcgagcggcggggaatattacgtccgcggcacctacacgaaaaacaatctagacttcggacgggacgtcgaggatttagcgaagaaaggtttcaagagtatttcagtggagcctgtggtgacggacgcgtccaagccttacgcgattctggaagaagatgtcgacgcgatcaagaaggaatacgacagactggccattgcttatttgaatcaaaaggacgaaggcgtggattacctgttctatcactttatggtcgatttaaacggcggcccctgcgtgtacaagcgcctttccggctgcggcgcaggccgagattacgtcgcggtgacgccaaagggcaatatttacccctgccaccaatttgttggtcagccggaatttatcatgggcaacgtcgatgaaggcatcaccaagccggaaatcaaagatcagttcatggaagcggggctgctcaacaagccgtcgtgccgggactgctggtgccgttatttctgcggcggcggctgtcatgcgaacgcgtggaatttcaatcacactgtgatgaagccctacgaagtgtcctgtgaaatcgaacgccgccgggttgaaaacgcgttgatgatcaaaatcgttcaggatgaacgggctgacgctgattgacagaaatctcaatattttttataatgaaagtgttccgagctgtggttgcaagtcgaggccagtcgcaggcaaaacgatccacgtaaggtatttaataatataataatcgatcatggtgcgacctagatgtaagtccagccggcaaaaagccgagaggaggaaaagtgagatgatatcaggcgaaactcccagctggcgggtgtgggggcaaagaccaggtcagtcggaacgcatggattcatttgtttacgaatgaatccttttttgtttaatagacgaggagaagtaagatgatttacacaccgatgacgaaaaaagcgatggtgctgatgtttcaagtgcaccaaaaccagcgggacaagggcggtgtgccctacgtctttcacccgtggcacgtcgcggaacagatgagcgacgaaattgcgacgacggtggcgctgcttcacgatgttgtagaggatggtgcggtgagcttggatgatttaagaaaatcaggttatccagagactgtcgtcgatgcggtggcgctgttgacccgtcagaaggggcagagttattttgactacattgaaaaattggcgctcaatgcggctgctaggcgcgtgaagctcgccgatttggcccacaatcaggacctcacccgcctcgaaaaaatagacgcctcggcgcggaaacgcgtcgaaaaataccgtaaagcgcagcattatctcgaacaatttgagaaaaataatccgattcaataatatttttatcgcttgatcttaacggcccgatgacagcgtcgttaagatctttttttattttgcgcctcgaaaagctcaaagaaatgataagcgttttgggaaatcggcgcgtttttccgccgaaccaggcgcagctccgagtccagtgccggcgtctcaaggggcgctgcctttaagtctgagaaagacgtcgcgatggaaaggggcaccagcgctacgccaattccagaggcggcccactggagtgatgttcgcgcgtcgtcgttgatgcagacgatattcggaacgatctgagtctgttgaaagacctgacggatcgcgttttcccaccttctgtagaggatcagcggacaatcgcgcaggtcttcgattttaatttgggagcacgctttcagatgattcgcgaaaagcgcagaagtcgcgacggcggcaaaggggtcttttctcaacgttaaggcttccaaatcctgacgatggtagggagtgcggatgactgcgagctcaatgcggctgttgtcgagttgggcgagcagatcaaaggtattgctttccatgacgtcgaagacgacaccggggtagtgctgatgaaaggtctgaatgccgttgaaaagttcttttgaagcgcaggaagagatcagcccgatgcggatggagccctgcttgccggtgcgcagattctgcatttccgcttcggcggccttttccatctcgagaatttgaacggcgcgtcgatacaaaagacggccggcctctgtcaaagcaatgtgtctggcgccgcgttcgaagagcgtcacaccgcattccgattccagcgctttgatttgtgtagacaacggaggctgagaaatgtgcaacttgcgcgctgcttccgagattgtgccgttttcaacgactgctgtaaaatattgaagttgacgaatatccatcgtttctccttatatacattatcgatatggttattaaattattcaatataattcatatggttttttcatgatatcataaaatcacgaaaggaaggggaccttatgaagaaattgtttgagtatttgaaagactatcggcgtgacgcgattctggcgccgaccttcaaattattggaggcgttttttgatttgctggtgccgctggttgtggcccgaattatcgatgtgggtatcgcccaagacaatcactcctatatcgtgcacatggtgatcgtgatgctgttgctggccgtggcggggctggcgagcagcattaccgcgcagttttttgcggcgcgttccagcgtcggctgcgtgaccgacatgcgtcagggactgtttgatcacattcaaaaattttcctacagcgaattggatcaggtcggcacggatacgctgatcacgcgtatgaccagcgatatgcagcaggttcaaaacgggttgaacatggcgctcagacttctgctcagaagcccgatcgtcgtgctgggctcgatgattatggcctttacgatcgatgtgaaatgcgccctcgtctttgtcgtggccattccgattttgagtctggtcgttttcggcattatgcgcgtttcgattccgatgttccgtcgcgttcagaaaaagctggaccggctcctcggcagcacccgtgaaaatttgaccggtgtgcgcgtggtgagggcctttggccaggaaaaggatgcggtcaaggcctttgacgataacaacgacgcgctgacgcgctggaatgaaaaggttggcagatggtcggcggcgctcaatccgttaacctacgccattgtcaatatcgcgacgattgtgctgattcaggtaggcgcgatccgcgtcaacatgggcggcattcaacagggccaggtcgtcgcgctgtacaattatatggcgcagatgatcatcgaattgatcaagttggcgcagttgatcgtgctgattaaccgttccatcgcctgcgccgaacggatccaatcggtttttgaaatcaaaccgggtatggctttcccgaaggattgggcagacggcacagatgcgaacgatacagcggtggtcttcgatcacgtgacctttacctacgaaaacggcggggcgccggctttgagtgacatcagctttaaggcgaaaaaaggcgaaaccgtcgggattatcggcgggacaggctccggcaaatcgacgcttgtaagcttgattccgcggttttacgacgcgggagacggcgcggtgacggtgttcggggaagacgttcgggattaccccaaagggaagctcaacgaaaaaatcggctttgtgccccagcgcgtcacgttatttgaaggctccatccgagataatttgagctgggggaaagcggatgcggacagcgacgaaatgaaccgcgccctcgcgacggctcaagtgaaggatgtggtcgatcaaaagccagagggcctcgattttcaccttcagcagaacggacacaacctttccggcggccagcggcagcgtctgacgattgcgcgggcgctggtgagaaagcctgaaattttgatcatggacgacagcgccagcgccttggactttgcgacggacgcggcccttcgtcaggccattcacagcctgcaccgcgacatgacggtgtttattgtctctcagcggacggccagcgtcatgagcgccgatcagattctcgttttggatcaaggacagcttgtcgggcagggcacgcacgaagaactgctcgcacacaatcaggtttatcaggaaatttattactcgcaatttccaaaggaagacggcgcggataacgccacagcacaggaggcatgatcagatgaaaaagaagaatcaagattcgaagagctggcagacgctcaaggaagtgctgaattacgtggcgcgttacaaggtgctgcttattttgtctctggtgacggcggcggtgagcgtcgtgcttcagctttacattccaattttgtttggccggatgattgacggcattattggcaaaggacacgtcaaattcgcactgatcgcccatatcgccgtgcgcgtcggggtggctgtgctcatcgccagcgcggcgacctggatcatgaatttggtcaacaataaattgtcctacggtgtggttcgggacattcgggcccgggcgatccgccaaattcaggacctgccgttgtcttatctcgacagccacccgtccggcgacattgtcagccgggtcattaccgatgtggaccagctttcagatggcctgctcctcgggctgacgcagctgttctccggcattgtgatgatcgcggtgaccattggcttcatgctcagcatcaacgtgccaattacgctttttgtcgtcgcgatgacgccggtcagctttctcgtggcgcggtttatcgcgtcccgctcctttacgatgttcagaaatgtgagcgacacgcggggacgccaaacttcgctgatcgaagaattgataggcggcgaaaaggtggtgaaggccttcgggtacgaaaaacggggatcggcccgtttcgccgaagtcaaccgggaaatgcagcaatacagccagcaggccgttttttactcgagcctgaccaatccgtccacccgctttgtcaacggcatcatttacgcctttgtggccttaatcggtgcgtttaccgtgccgggcggggcactgacagtcggcggactggcggcccttctgacttacgcgaaccagtacatgaaacccttcaacgacatctcgagcgtcgtaaccgaatttcaaaacgcccttgcctgcgcggcccgggttcttgaatttatcgacgccccgcctcaaacgccggacccggaaaaggccctgccgaaggcatcggggaaaatcgatatcaataatttgtatttcagctacgatccgtccaaaaaattgattcaggatttttcccttcaggcgaagcccggcacgcgtatcgctattgtcgggccgaccggctgcggtaaaacgacgctgatcaatttattgatgcgcttttacgacgcggacagcggcaccatcgcgatcgacgatcaaaacgtgtacgcggtttccagatcgtccctcagacagaatttcggcatggtgcttcaggacacctggctgatgcacggcaccgttcgggacaacatcgcctttggcaaaccggacgcgtcagatgacgaaatctggcaggtcgcggcggcgtctcattgcgatacctttattcatcagatgccgaaggggctggatacggtcattgacgacggcgacctcagccaagggcagaagcagctgctctgcatcgctagagtcatgctggtcgatcccccgatgctgattctcgacgaagccacgtccaacatcgacacccgtacagagctcaagattcaggcggccttcgacaaattgatgacgggcaagaccagtttcattgtcgcgcaccggctgtcgacgatccgcgacgcggacatcattcttgtgatgcgggacggccaaatcgtcgagcagggcaatcacaaaagcctgctcgcgaaaaacggtttttacgccaagctctacaacgcgcagtttgaattgacaaaataatataaaagatatccctttttcgtgaattgtgatgatttttacgaaaaagggattttttatgattttgacatttcgtctcgagtatgcgctgagtgcaatctgcttttacgatttgatattgtactttttagaaaacccgccataaaattgaatcatcaaataaaaatgaataatgagtaagaggacaatgcaatgaattctaaatttattcagatttaaaggtctttaccatgggtttggtcttggagaaggcacggtggctgaaggctgggttgatcatgcggtcgcgttctggcagaggcatatgacgacaagggacatcacgcagcgcatatagtagacggcagcaggaataggcgcttcttataaaatggcaattgataagggccttaagcaaaataataatagggtcaatcaggtcagattggcctttttgccgaaagactgaccttaaaaaatgagtgcggattgaatcttttaccgaggaatttaatgggcgataatagaggcagactaagagagacaaaggagcaacttatgaaaaatacgaaattacacgatttagtcatcacagctgcttttattgcgctgacctatgtatttacctttattaatgtacgtctgccgattgccgctaatggcggactggtccatttgggcaatattcctcttttcatcggtgcgattattttcggtaaacgcgtcggtggcttggccggcggcgtcggtatgggacttttcgacctgctgggcggctggacagcctgggcaccctttacctttgtgatttgcggtttgatgggcattgcggttggcgcgatttgcgaaaatcatcacgattatctccactacgtgctggcgcttattgccgcctgcgcgattaaaatcgtcggctactacatcgccgaaggtattatttacggcaactgggtcgcaccggtttcttcgattccgggcaatctcgttcaggtcggcctcggcgccgcagtgaccttggccgttgtggaccgtctgtacaaactggccaatcatatgggcctgacccatcataaaaagagccagcagcccgcgtaatagaagatttgaaattctagaaaaataaaaatgcagtggatcgcagaacgcaatccactgcatttttttatcgcggcgataaaacggtgttggcgacgagctgggtgttaaattcggcgtcattggtgaggttgatgacggtgcactgcccggccatcgcttcggtttgttttttggcttcagtggaaagcaggcagtggatcgcgccagagcccgcgccattgccgacggggacgattttcatccgaccggtcgggagaaggccgatcttttgcgcggaggtgaccgaaatataattgccgaaagcgccggcgagataaatcgtgtcaatatcctcgatggaaagggacgccgcttttaacagcaggtcgacggcggtttgaatcgcagctttggccaattggatcgcgcggatgtctttttgagaaagcacgaccgctggagccccgttgttttcttccgaggtgagcagcacgaactgccggatttttcccgagcgggtcagacggctgccattgggatgcgctgctgcagcctcgtctgagatgaaactgccgtcaggtttgataagaccgctgtccagcagcgccgcgatggtgtcaatcacgcccgaaccgcagagcccggtggccggcggatcgccgatcatttggcagtgaaagcgctttgtgcccgggtcgtagacggttttttcgattgcgccgtcagccgcgcgcatgcccatcgtgaggccgtcaccttcgagggctggcccacagggggcggaacagacggtgtaatggccgttttgtccgacggcgatttccgcatttgtcccgaggtcgatgacgaggcgggtttcctttcggcggggcagcgccgcgagcagcgcgctggtatccgagccgatataggacgcaatcggcgtcagcagcgtcatctgcgcggcgggatgaaggtcgaggtgccaacgactggccggcccttcaatcggggcgtcgatctgcgagacaaagggcgctgcgccgagggatttgggcgagatgccggcgagcagatgcagcatcgtcgtgttgccgcagcagacgacggagatgatctgatgcttgtccagagatccgcctttctgacaaagttcctggatcaaatcggcaagggtttcacagaccgcgtcgttgagggcggtgagcttgccgtcatcggcagctgcgattcgggagatgacgtcggcgccgtaagcggcctggcggtttttagctgaggctgttgcgcacaaatcaccgctttcgaggttgtacagatagccgacgacagtggtcgtgccgacgtcaaaggcggcgccgtattcaggaaatccgtctgtttctggggtgacgccgaggagcgtgccggatcgggcgacaaaggcggacgggtcggtttcgtgcacggccgcgatgacgtcgacgatcggaacgggggttttgcgcacagcctcgaagccgtcaattaaaatatcgggattgccgcaggtcaaatcgaggggcagcaccgcgttgatggagccgaggaaggcgttggcattctgcagattaaggctttcgaagctgacaggaaaacaacggactggcggatccagaatcagcggatcaaaatcgacgtgacggtcgagaatctgctgacgagcttcggcgccggtcagaatttccatctcgtcaaaaacgggatattggcaggccagcacttccagcgtgatgccgtgatttttgatgagaatcttgcactgcccgcagcgccccgtcccgccgcagaccagatcgaggggatggccggctctggcgcaggcctctgcgacggtttcgcgggtgtctaagcattcaagatcgagatgttcgttgggaaaatggatcataaagaagacctttcgtgtggattttacttcagtttatcataaacaggcacaaaaaaatacagctccgtcctattgagacaaagctgtaaaagcgttcagcctttgtttacgcgacagaaggctgcggcagggacactgtctcaggcgcatcttcttcagaggctgagaggtcctgcatatttctgaggcacaatccgatggttgaggcgttgtgaagcaccgcgccgattctcggcacaatcaggccgctgatgccgaagaccaggatcgcgccgtttaagacgttgccgatgacgtaggtcgaatgcatacgcttcatcagcttgtctgagagtcttctcagattgactagctggttcaggtcggagcctgagatcgtgacgtcagcaatttcctgagcgatgtcggccccttctttaatggcgatgccgacgtcggcagcggagagggccggcgaatcgttgatgccgtcgccaatcatgatgaccttttcgccccggtccttgatcttttcgacgtaatgggccttatcttccggcagcacttcggagtaatattccgtgatgccggcctgggcagcgatggccttcgccgtcttttcgctgtcgcctgtcatcatgacaatgttcttaaagccagcggccttcagatcgcgaatgacgtccggtgtgttttctttgatcgggtcagagatggcaatgaccgcgacgagtttgccgccgatggccatgtagaggtgagagtattccgcgggaatttcacctaggcgcgcccggtcggcttcgttttcaaaggtgaccccttcatcttcaaagacgaaatggtaggagccgatgacgacgcggtcttcgccgatattagatgcgatgccgtgggcgacaatgtattcagccttggttttgatgtcgtaatgtgaaaggcctctttccttcgcagcgcgaaccacagcgttggccagagagtgcgggaactgttcttcgagacaggccgcgatgcgcagcatttcgtcgggatcctgcccgtcgaaggtgacaatctcttgaacgaccggtgtcgcccgcgtcagcgttccggttttgtcgaagacgatggtgtcggcttcagagatggcttcgaggaatttgccgcccttgacggtaatgtcgtgcttgccggcttcgcgcatggctgaaagcacggcgataggcatggccacctcgactgcgcacgagaagtctgccatcaaaacagacgcagccttcatcacgttgcgggtcagcacaaaggcgagcagtgacgcgccaaaggtccaggggaccaggcggtcggcgacagacacggctttcatttgagtcaatgccgcgaggttttcggaattttcgatcatattgacgattttgtcgtaccgggtttcgccagaggaggaacggacctcgacgatgagttcgccctcttcgagcaccgttccggcgtagacgatgaccccgtcgtgcttgcgcaccgccagcggttcgccggtcagtgcggcctgattgaccatcgcttcgccggaaacgaccttcccgtcgaggggaatcatgttgcccatcgtgaccttgaagcggtcgccgttgtgcatatggttcagggaaacttgcgacacagtgccgtcgtccgcgactttccagaccttttcgacgttgagagatagagactgcgctaaatcgtcgaccgactttttgtacgtccattcttcgagaatgtcgccgatttcggtcaggaagacgaccgacgctgcggtatcgaattcgccggtcagcagtgcagcgagaacggccgccgcgtggatgatttccgcagaaacgtttttgttgaacaaatcctttaggccgcgccagacaaaaggaacggcttgatagatggtcacaacggtgcggatcggcagcgggaggaagagccatttcccgattcggagcataaccttgttgagaattttattcttgtacatttcgtttgtggctctggccgaaatggtcggcacgttgtcctgcagcgccgggtcagaaaggtccatatcggaaatgtaatcgagaatggccgattcaacgccgacgtagcgcacagcgagctgtgccgtgcgctgataaactttgacattttcgatgccgggaagttcgatcagtgtgtagtagagaacgtccgcttcggtttcactcagacgccgctgcatcaaatccaaatgaaaccgattgggcgttcgctgaataatgcgataaatcaaaacagcatcctttcagaatacgcaaaatacagacttacgcgtcagcgttttgattttcttcttctacaattttttcgtaggctggtttgatcgcttcgtattcagctttgattttttcgcggtaattttcatcctttttggtgaaatgtttttctttgatgacatccgcttctgcggccgcgttgctgcagctggcctggcatttttcaaagccgtctttgatcgtgttgcctgcgattttggcaccggcaatgatgtgcacgcccgcagattttgctgctttcgttttaaggaatttgccgccaaaagcaccaactaagatgccgccgccgatttttaaaatattggattttactgacatgagattgacctcctaaatttaaaacatgaacgtatgctcatttgttggtttcattatacccccataggtataatgcgtaaagggtaaaatgcaatacttttaattatttttaaagcgaaatttgacgaattcaaaacaaaataggcttttgaacgaaaaaaacagccgattgctcggctgcgaaaagaaaaaatttatagcaaaccgccgattgaagcgatgagcggtgcgaaaacgagggaaacaatggtcatgagcttgatcagaatattgatcgacgggccggaagtgtctttgaacggatcgccgacggtatcgccgacaacggccgccttgtgggcttcgctgccctttccgccgtgagcgcccgattcaatgtatttcttcgcgttatcccaggcgccgccggagttggccataaagatcgcgatggcaacgccggaaaccagtgcgccgcagagtaagccgccaagggcatccgggccaaggagcaggccgatgacaatcggggaagcaacagccataatgccgggaacgagcatctgtttcagcgcagaattggtcgcgatgccgacacaggtcttgtaatccgggcgggtggtgccttcaaggatgccgggcatttcgtggaactgacgtctgacttcttcaatcattttgaacgccgccttagaaaccgaagacatcgtgaaggcggagaacaggaacggcagcatgccgccgatgagcaggccgatggtgacgcggttgttcaaaatatcgatggatttcagatggaccgcctgcgcgtaggagacaaagagcgcgagagcagtcagggcagctgaaccgatcgcgaaacctttgcccatagccgcggtagtattgccgacggagtcgaggcggtctgtcgtatcgcgaaccgattcgtccaagtgggacatttccgcgatgccgcctgcgttatcggcgattgggccgtaggcgtcgacggcgaccgtaattgcggtggtggaaagcatcccgacagctgcgagagcgatgccgtagagccctgccgtctggtaggcgataaagatcgcgacgcagattaacagaattggaaaagcagtggacttcatgccgacagcaatcccactgatgacggtcgtaccggcaccggtttcagattcttctgcgatttcgcggacgggctgatattcatcagaggtgtaatattcggtgagtaagccgatcagcacaccgacgacgagcccggagacgatggcaatcgcctgtttgaagccgccgaagaacaatttactgagaataaaggaaatgacgataatgagtccgcttgagacgtaggtcccggtctgcagcgcgcgctgcggatttttatttcggctggtgcggacgatgagggtgccgataatggaagcgagcagcccgagtccggctaaaagaagcggaaaaacaatccctttaagctgatacagcacgacaccgagggtcaaagcggaaaccagtgcgccgacgtaggattcgtacagatcggcgcccatcccggcgacgtcaccgacattatcgccgacgttgtccgcgatgactgctggattgcgcgggtcgtcttccggaataccggcttcgaccttgccgacgaggtccgcgccgacatctgccgctttggtgtaaatgccgccgccgactctggcgaaaagcgcaatcgaggaagcgccgagactaaagccggccagcacatcgacattctttgtcagaatgtaaatcagactgacaccgaaaacaccgaagcctgccacgcagaggcccatgacagaaccgcccgaaaaggcaattttaagcgcctgtgacatccctttttccttggccgcattggtggttcttacgttcgcctttgtcgcgacattcatgccgaaatacccagccagcgtcgagaacaagccgccgacgatgaagctgacagcagtgagccagttgccaagaaagacgccgatcaatacgaataagacggccacaaagacgatcagtatgcggtattcagagaatagaaaggcgtgggcgccttcactgatcgcggaggcaatttcctgcatacggtcgttgcctgcatcctgcttatcgatccacgcagcgtaacagaacgcgacgattaatgcgataagaccaaaaatcggaatgagaagtaaataatgtgacatcagaaaacctcctttagcactaaattttactcaatcaatgtattacgattacatttataattccagctttattataacaccttttacaaaaaaggcaacaacgaaattacaaatcattaagaaaaaagcccatcgagaaaagttctcgatgggcagaagtgaaattgaaattagaatttgatgtgttcttcgatgtaagctttaacctggtcgatcggcattctgacctgttccatggtgtcgcggtcgcggacggttacagaatggtcttcctgggtgtcgaaatcgacggtaatgcagaacggggtgccgatttcgtcctgacggcggtagcgtttgccgatgctgccagtctggtcgtagtcgacgttgaagtactgagcgaggtcggtgtacacagcttcagcctgatcagcaagcttctttgagagcggcagaacagcggctttgtaggcggacaggaacggatgaatcttcatgaccgtacgggtatcgccgttttcaagctcttcgtgctgcagtgcgtcgcagaggaaggcgaggaacatccggtctgccccgagtgatggttcgatgacgtacgggatgtatttttcgtgtgagacaggatcctgataacgcatgtctttgccggatacgttctggtgctgggtcaagtcgaagtcagtgcggtcggcgatgccccagagttcgccccagccgaacgggaatttgtattccacgtcggttgtcgcgttggagtaatgggagagttcttccggagagtgatcgcggaagcgcagattttctgtggtcatgccaagatcagccagccattttttgcactgatccttccaataagcgaaccattttaaatcggttcccggttcgcagaagaattcaagttccatctgttcgaattcgcgggttctgaaaatgaagtttcccggcgtgatttcgtttctgaaggatttcccgatctgaccaatcccaaatgggacgcgtttgcgggtcgtccgctgaacatttttgaagttgacgaaaatcccctgggcggtttccggtctcagatagagctgagaggtggagtcttccgtgacaccctggaaggttttgaacatcaggttgaactgacggatttcggtgaagtcagattttccgcattccgggcaaggaatttctttttctttgatgaaagcttccatcttttcgttggaccagccgtcgacgacgacttcttcaccgtgcgccttgaaataatcttcgatgagcttgtcagcgcggaagcgggacttgcagtgcttgcagtccatcagcggatcgttgaatccaccgacgtggccagaagcgacccaggttttcgggttcatcagtatggcggcatccaagccgacgttgtagggagactgctggacaaattttttccaccaagcgcgtttgacgttatttttcatttcaacgccaatcgggccgtaatcccaactattggctagaccatcgtatatttccgaacctggaaaaacgatgccgcgcattttggccagactgacgatttcgttcatagtgaactgcgacatgtgtaatcctcctgatttttacaattcaatttgttaatattttaatattctatcacacttgatcttattccgcagttttattttttggaaattagttaatcatagcaattgactcaaaatagcgattgtgataaattgctagatggttttctgagatactttacactatctttatatagattttacattttgcacgtgataaaataaaaagagaccatttgcgaaattgaatatcaatattaaataataagctgaaggagtgcgtatgtttgagattatagtaggcttgatcggcgggttaggtctgttcatttacgggatgcagattatgagcaacagcctgaaggttgttgcgggcgaccgcatgaagcatctgctcgaggtattgacgagcaaccgctttaaagccattatctgcgggatcgtcgtcacgatcatggttcagagctcgagtacgacgacggttatggtggtcggttttgtcaacgcatcgctgatgaacttaacccaggctgccggcattattctcggagcgaacatcgggacgactgtgatggctcagctcatcgcgttcaatttcgatgccatcgcgccgattttgatcggaattggcacggtcatgtccgtctttgggaataagaaaaagacccgggatatcggtacgattttacttgggatcgggattctcttcttcggaatttcgacgatgagcagcacgatggaaccgctcaaagacaatccggttttcaagagatggctcattacctacgggcgcaacccgattttaggccttctgatcgggacagtcatcactgggatcatgcagagctccggcgcgacactggccatgctgcaggcgctggcgatttccggtatttttgcagatgtatcgggaacggccgcgattcaaatttgtatcccgatgatgatcggcaccaacatcgggacttgtgtgacggcactgctgtcgagtatcggtacgtctaaagcggctaaaaacgcggccatcattcacttgagtgtcaatatcttcggcgcgatttgggtcatgacactgctcgcgatctttaatgcggtgctgccggtcaacccgatttatcaattcctagtggatatttccgggacgatgaaaacctcatcgggtgcagtaattccaaacgttgcgagacaaatcgctatgtcccacacgttcttcaacgtcgcgaacatgtttgtgatgctgccgtttatcgacaagctcgtgaacttcctggaaacgcatatcaaggacgacgaagaagaaagcgataagggacttcagctggacgaccgcctgctcaacaacccagcggttgccattggccaagtcggcagagaattggttcacatggctgaaatggccgaaaaaaatttgaaactcgcgggtaaagccttggtcgaaggtgatgaaaaagcgatcgaaaaggtgtatcagcgcgaagaccgcatcgacgaacacgaaaaagggattatcgacttcgtgatacggctctccaatttaaacgtgtctcaggaagaaaacgaccgtttagccagctacctgcagattgcccacgatatcgaacgcatcggggatcacgcagaaaatattgtcgaattggcggaagataaaatcgaaaaagacgtcaaaatgacggaagcagcccgaaatgaacttttggaactgctcgatctgacctattcgattgtccagcacgtcaaggaagcgcttgacagcgaagacgacgccatctgtatgaagatctacgaagaagaagaacgctccgacgatctgaccgacgaatacaaggacaagcacatcaagcggctttccgaaggtacatgtcaggtgaattcatctgcgatctatttcgacctgctcgtcgatttggaacgtgttggcgaccacgccgcgaacatcgccgaacatattcagagcctgcacccgagaaagcaggttaacgaattgcagggcgttgtccattaaaaaaattaagcagcttcggctgctttttttgttagaataaataaaacgcaaagcagtaaattgtaaaggagtgaaatgatgccaatcgatggatttttaatcggaacagcggaaaatcaaaaggccggaaccggcgtgacggcgatcatctgcccggacggtgccacggccggtgtggatgtccggggcggcggtccagccacccgggaaacggatctgctgaggccggagaacatggtccagaccatccacagcgtgaccctatccggcggcagcgccttcggcctgacggcggcttcgggcgtgatggcggttctcgaggaaaagcacattgggtttgagacgggatacggcaaggtgccaatcgtctgcggtgcgtccttattcgacctgccggtcggcgacggaaaaatcaggccggatatcgcaatgggccgggccgcggctgaaaatgcctttaaaaatcagaaactattatctggaaatgtcggcgcgggaaccggcgcgaccgtcggcaaataccgtgggccggcgcgcatgatgaaaagcgggcagggcgtgagcacagccgcctttggggatctccaaatcggcgcggttgtggcggtcaacgccctcggcgacgtgttcgacggcgagtctaaaattgcagggctgctcgacgaatccggcgcacactttggcaaaacgacatacgaggaaatgctcgaggacgtcaagcgggatcatccaatctttccaggcaacacgaccattgcctgcgtgatgacgaacgcgaagctgaccaaggcgcagtgcctgaaaatcgcgtcgattgcgcacgacggctacgctcgggcgatttcgccggtacacacgtctggcgacggcgacacgatttttgtcatggcgtctggcaaaaccgaaggggatttcgatgccattgcggcggttgcagcggagcagattcggctggccattttagacggcgtgcgctcggcgacgcctttgtttggcctgaaaaccgccggtgaattgaattgacatcgcttacctgcgatgatagactaaacacaagtattcactcgaaaatgatcaaagcaaaatgggaggataatatgaaaatcaaatcggatattgaaattgcgcagagctgtacgccaaagccgatcagcgaaattgccgatgcactgaacatcgatccgaaatacgtcgaacagtacggaccgattaaggcaaaaattgactacaattatttgacggatcacccagctgaagacggcaaattgatcctcgtgacggcgattaacccgacaccagccggcgaaggcaaaacgacgacgaccatcggcctcgcagatgggatgaaaaaaatcgggaaaaacgtcgtggtcgctcttcgcgaaccgtccctcggaccggtattcggcattaaaggcggtgcggccggcggcggctacgcgcaggtcattccgatggaagatatcaaccttcatttcactggcgatttccacgccatcggtgcggcgaacaacctgctggcggccatgatcgacaaccacattcaccagggcaatgaactgaacatcgacccgcgcaaaatcacctggaagcgtgcggtagacatgaacgaccgtcagctgagaaacatcgtcgacggtctcggcggaaagaaaaacggcgtgcctcgcgaagacggcttcgatatcaccgtcgcctcagaaatcatggcggtgctctgcctggcaacgtctattccggatttgaaggcgcgtttgggccggatgattatcggctacacccgtgacgacaagccggttaccgccgcagatttgaaggcgcagggcgcaatgacagcgcttttgaaggatgccctcaaaccaaacttggtgcagtctctcgaaggcacaccggcctttatccacggcggcccgtttgccaacatcgcccacggctgcaacagtgtcatggcgacgagaatggcgatgaacttaggcgattacgccattacggaagccggattcggcgcagacctcggcgctgaaaaattctttgatatcaagtgccgcgcggctggcctccacccgagtgctgtggtcgtcgtcgcgacagtccgcgctctcaaacaccacggcggcgttgcggtcaaagatctcaacgaagaaaacctcgacgccctcaaaaaaggcctgccgaacctgcttcagcatgtggcgaatattaaggatgtctatcatctgccctgtgtggtggcgatcaacgctttcccgacagacacgagggcagagctggatctggtcgaagcggaatgcaagcagctcggcgtcaacgcggtcttatccgaagtctgggctaaaggcggagaaggcggcatcgcgctggccgaagaagtggtcaagctctgtgaagaaccgaacgatttttcatatgcctacgacaccaacgattcaatcgaagataaactcgacgccattgccaagaagatttaccacgcagacggcgtcgatttgactgcggatgcccgtcagcagatggaacagcttgaagcgctcggcttttctaatctgccaatctgcatggcgaaaacccaatactcattctcagacgatgcgtctctgcttggcgcaccgaagggctttagaatcactgtccgcaatattaaggtctcctcgggcgctggctttatcgtcgcgctgaccggcgacattatgacgatgccagggctaccgaaggtgccggccgcagaaaacattgacgtcgatgaaaccggcaaaatcacgggactgttctaagatggccgttgagtacacagcaaaggccgtgaacgccggcattcaggaaagctggcagtcggatttgaaagccttggccgaccgcggtatcaagcctactctggcgacagtgcgcatcggccacaagggcgcggacatttcctacgaaaagggtgctacgaaaacaatgcagaagtacgggatcggcgtcaagaacatcgtgctggatccccagccgtcagaagaggcggtcatcgcacagatcgaggcgctcaatcaggatccgacggttcacggcattctgctgtttcagccgctgccggagggttacgacgacaagcgggtcattcaagcgatcgatccgaaaaaggacgtcgacggcgcaaccgatcagaatctgtcggacaccttgtccggcagattggacggctttgcgtactgcgcgccggaggcggtgatggcattgctcgaccattatcaaatcgacgtgtacggcaagcgcgtagtcatcatcgggtgcggcattgtggtgggccgccctctggcgagtatactgctcaaacggcgtgcgacagtgacgatgtgcaataccgggacccgcgatttagcaggtgtcgccagaggcgcggagatcttgatcgcggcgacgggccgcatccacatggtcacaaaggatttcgtcagccccgggcagatcgtcatcgacgtagggacaacctttcaggacggtaagctctacggcgatgtggatctcgatgaggtggcgccgatcgtcgatgcggtgaccccgacgccgggcggtgtcagcgggatcacatctacaattttggcgaagcacgtcattactgcggcagtaaaacttaataaagcgtgacgattggagaatagtttttgtcagaagaaaaagaattaattcaaagaagctgcgcgtcttttgcggatattctggcctcaaaatcagcagttcctggcggcggtggtgcggcggcactggtcggcgccctcgggtctgccctcgggatgatgtatttaaatttaagcatcggcaagaaaaagtacgcacagcacgaagctgattttcagaagaaggttgaggatctcggcgccatcaaagacgagctgctgagctgtgtcgaagaggatgcggcggcctttaggccgctggccaaggcgtacagcatgccgaaagacacagaagttgaacgggaacgctaccgggaaacgctggaaaccgcgttgtacacggcctgcggtgtccctgaaaaaatcatggatttgtgcgaagaggcgctggacgcgatcgaagctgtcgcagggaagggcagcgagttagcgaaaagcgacgcggcagctgcggcgatgctctgcatggcggcactcaacgccgcccatttgaatgtgctcatcaacacgaccagcatgtccaatcgcgtggaagcagaggccatcaccgaccgatgcgacagcaaattgatgcgcaacaatattaaagcctcggagctgattgacgaactccgggatgaaatcagacagtccaaataaagcaggggatgtttatggatcaaaaggaagtttataagctcctcgaacaggtgaaatccggggagatatcgattgatcaggcggttctggatttgaaagaagcgccctatcaggatatcggttacgcgaaaatagacacacaccgcggtttgagacaggggatcccggaggtcatttacggtgccggcaagacggccgatcaaattatcgggatcgtcaaagaaatgacgtcgcaccatcagaagaacgtcatgatcacccgggtgagcccggaaaaggctcagcgcatttgcgaagaagtcccgatgatttaccacgagctggcgcgatttggccaggtcggcgaaatgcctgaaaagaccggcaaaggccgcatcttggtggtgaccggcgggaccagcgatctgccagtatccgaagaggcggcgctgactgctgaaatgctcggcaatacggtggatcggctttacgacgtcggcgtttccggcctgcaccgtctgctcgatcatctcgacgacattatgaacgcgcgggtcattgtggcggccgccggcatggaaggggctttggccagcgtcgtcggcggactggcagactgcccggtcattgccgtcccgacttcggtggggtacggcgcctcgttcggcggattgtcggcgcttttgtcgatgctcaactcctgcgcgagcggtgtcagtgtggtgaatatcgacaatggctttggcgccggctatttggccagcatgatcaatcatatataaaaatatacgctgacaattcttaaagagccgtaattcaaactttacggctttttatttttgcattaaaataatggggccattaatctgtggtataatgttttaataattttcaatttttggagctgaaagatgaaatcaaaggaccaacatatcagcgtactgctcaacgaaaccatcgacgccttaaacgtgaagcccgacggctgttacgtcgactgcacgctgggcggcggcggacattcggagcagatcgccgggcgtttgtccgatcaaggccggctgatcggcatcgatcaggacgattacgccatcgccagagccgagaagcgtctttcgagctatccgtgccgtaaggatttcgtccgagataatttcgtccaccttccggccattctcgatgcacttcagatttcggctgtggacggtgtcgtctttgacctcggcgtgtcgtcttttcagttcgaccagccggagcgaggcttttcctatcaccatgacggtcccctcgatatgcggatggaccggcagcaggcattaaccgccgcggatgtggtcaatacctactcggaacaggcgctcaagcaggtgattttcgaatacggagaagataaattggccggccgtatcgcgagagcgattgtcagccggagaaagacgcagccgtttcggcggacgctggatttagccgatgtgattcgggatgccacgcctgaaaaattcagacgaaagggtcatccggctaaaaagacatttcaagcgctgcgcatcgaagtcaacggcgagctgagaattttgacccaggccgtcaaaaatgcgatcgaccggacgaaaccgggcggacgcatctgtgtcattacctttcactcgctggaggaccggcagatcaagcagctgttcaacgagcaggccgacccctgcatttgtccgccggaatttccggtgtgcgtctgcggcagaaaacctacaataaaaaagataacgcgcaagcctatcgccccatcagctgaagaagtgcaggacaacaggcgggcgagaagcgccaagctcagggtcgcagagcgtctggaacgcgaagaaactaaaggataaatatgccaaacgcgaatcaaagtcatccgaaaagatcccgatcaaaatctcaaacagtgaaatcccggggaaaacagacacagacaaagccgccccgcgcatcccatcggcgcagaaaatctggaaaaaggcgccgctctggcagaaagctcaggccagatgtgctgatcattattgtggtctttgccattgcctttggggcattgattcagcaggccgctattttgagactcgatcggcagatcagtaatcttcaagatcaggtcaacacccagaaatccctcaacgattcgaaggaagggaaaatcgtcagctctcacaatcttgcgaaaattgaaaaaaaggcgcgaagctacgggatgagcgagccgaaggcagatcaatacgtctacatggtcccgaagcatcagaaaaaacagaaaacaaatttcgattatctaatcgattggtttaaggcgaaactttcgaaatatggaatcatcaagaaataaaaaaaccactcacaaatcaaaaaaaagtggccaggagccgctgacaccagccgcgaagcagcggcgcctgcaaaatagacgcgtggcctttatcttggtcatttttctcattctcgcggcggtcattgtcggcaaactggtttatctgcagatcatcgattcgtcagatcaatacgcaagacaagtcgatcaggttgtcgatcaggttcaggtgcaggcctcccgcggcaacatctacgaccgcaacgggaacatcctggctcaggattcgtcggcgaaagccgtctacattatcccgtctgaaatcacagacgaagataaactggttaaggaattggccaaaaagctcgacttgaaggaagagagcctgaggaaaaaagcggaaaagcttgagaatgactacgttatcgtcaagaacagcatctcggcgagtgaaggacagcgcgcccacgccctcgaccgcgacggcttgaaataccgggacggcacgctctacgcttatccggacaaaatcgacgacgcgaagtccacggcgaaggcgctggcggcgatttttgacaacctgtcctacaaaacagcccttggctacttgacggaaaaagaaaattcagcggttttgatcaaaagccaggtggacaattcgctggcgaacaaaattctcaaggacatgaccgtgaagaaaaacggcgaggttcagtcgaccaatggggttgagctcatcgacgacagccgccgctattacaccaacggtaattttgcgtcctacgttctgggatttacaaaccaaaactatcaaggcgtcagcggtgtggaaagcacgtacaacagctggctctcaggtcaaaatggtctggcttatctccagaaggacgcgtcaggcaacacactgccgtccttgaccaaggtggtcaagcagccgaaaaagggcaaggatctggtcctgaccatcgacagcaatattcagatcatggctgaaaaggctctgaacgaatcgatcaaggaatggaaggccaaacgcggcacggcgatcgtcatggatgtggatacgggtgaaatcctggcgatggcgacgaagccggattacgatttaaacaacccttacacgttaaacaaaacctacgccaagaattacagcgaccagctcgacggcaagtccaatgccgacaagctgaatctcatgtggagcaatccggctgtcagctttacttacgagccgggctcgaccttcaagccgatcacggcttcatccgcctttgaagaaggggcgatttcgccgtcggacaaggtggtctgcaatggatcaattaacatcgacggtgtgacgatcaattgtactgcgacccacggcgttcaaactgcggctgaagcggtttcaaattcgtgcaaccctggtctggtgcagatcattcagaagcttgatcctacgctgttctaccgttacgcctacgattatggctttggtaagaccaccgggatcgaactgccgggtgaagaagccggtgtgatgacgcgtgtatttaaatcgggcaattcgattaatctactcgactattcaaacctgtcctttggacaggggttgatgacgacgccaattcagctattgagtgcgctgaacagcgtcatcaataacgggcattatatgcgcccgacggtgatctcgtctcaaaataagggcatcagctctaatgcgtcgacgagcgcttcaaagcagattatttccaaggcgacgtcaaaggaaatgcgtcagatcatggaaaaggtggtcaccaataacccggaactcgcgtcattggctggtgattacagcatcggcggaaagaccgggacggcacagaaagttgaaaacggcgaatactcccactcgaaacacgtgacatccttctttggatttacgccggtcaagaacccgaaatacgcagtcctggtggtcatcgatgaagcccagagcggcgcgtacggcgcccagtcggcggcgccggcggcgatcaagatcctgcagcagacgtcagattacatgaacccgagcagcaaatcgtcgaccaagatgacgaaaaacacggtgacggttccggacgtcacaggacaggaagtggaatttgccaaagaaatcctgaaggaaaagggcatcacttacaaagtggacgacagtgccggcggcagtgttgtggtttcccaaagcttgaaggctaaatcgacgtacaagagcggcaagacgatggtactggtgaccgggaagagcgcggacgacaccaacgcgaaggtcaccgttccggatttatccggcatgaatattcaggaggccaatgaaattttgacgggacttggcctgaaaataaaagtcaaaggctcaggctttgcggtgagccagaacccgaaagcagggacgaaggtcaaccgtaattcgaaggttaccgtgacctttaaacaaaaataatcacaaggaaagaaggcagatgtaatgggatttaaaccatggacagcagaagaggctgcgcagattgtaggcggaaaaataacagaaggtgacggcacgcagccgattaccggcgtggtgatcgacagtcggattgtgaaagctggcgatctttacgtgccgattatcggagaaaacaacgacggccaccgttttattaaagcggcctgcgcagctggcgcatcggcgtatctgtgcgacacagatcatcaggatcagatcagcgtagcgggtgccgttaaaattgtcgtggcctccacgatggaagcgcttagacagctggcggcggccaaccgcgcacggtacgatattccagtcgtcgcggtgactggctccgccggaaaaacgacgacgaaggatttgatcgcctcggtgcttggcgtaaagaagcacgtcatgaagacgcaggggaatttcaacaacgagatcggcgtaccgctgacactttttcagctcacacctgaacacgaggctgcagtcgtcgaaatggggatgaaccatttaaaggaaattcaccgttcaatttttgaagtgaagccccacattggggtcattaccaatattggctcggcccatctggaaaatctcggttccaaggacaacacccttaaagcgaaaaaggaaatcctcgagaccatgggaccagacgatattgcactggtcaatggcgacgatccttacctccggaaagttgtgtccgatccttaccgcgtgatgcgcatcgggattcatcaggcggatgtggatttcctcgctgaaaacatcagccaggacgcggcgggatcgacctttacggtccgcggcagccagtatcatttcagatatcccggcgaacacaacatctacaactgtctaatggccattggcgtcggactgatctaccattacacgccagaagaaattcaggcagggatggacgcctttgtaccgagcggcaaccggatgaagcgggaagaaatcgccggccttcacgtgattgacgattcttacaacgccaatccggaatcggtcaaagcggcgctgaacaccatatcggcacaggcggacggccgcgtcgttgccgttttgggcgatatgctcgaaatcgggaaggacagtgcggcaaaacaccgggaagtcggtgcgtacgcagcgaaaaaggcggccgtcgtcattgccgttgggccgctttctgaaaatacggcacagggcgcggaaaataacggcgcggaagtttaccgtgcggaaaacgctgacgcggcagctgaaattttgaaggctgtagcaaagccgagggataccgttttgctgaaggcctcccacagcatgaacatcggcagtgtcgcagatcgattaaaatcaaattaagaccagtcaaaccaaagaataaggagtatttatattatggaaagcatacacgctgcgtttatttcgttgattatcagctttgtgctggtctggattggtacaaaattgtttctgccagttctgcataagctcaatttcggccaggccattcgcgaggaagggccgaagagccatcagaaaaaatccggcacgccgacgatgggcggcatcgtgattcagggcggcattctgatcgcgatgatcgtttttacattcatcgttgggaaagatctgctgtttccgctgctcggcatgattgcctttggagtgatcggctttatcgatgactttatcaaagtcacggcacaccacaatctggggctgcgtgcctggcagaagctggtgctccaaatcgccgcggcaattgtcatcgcggtttacgcggggaccaatcccgacattggcacacagctggtggtgcctttcagccacaaacttgtcgatttgggctggggattctatccctttacggtctttgtcatcgtagcggtgaccaacgcggttaatctgacggacggtcttgacgggctgtgcgccggggtgacggcctttgtgatgattttcttcatgacggtggccattgtcgtcaaggatgcggaaatcgccgcctttgccggtgcggtcgtaggcggctgctttggatttttgcgctggaattccaatccggccaatattttcatgggcgataccggttcattggcattgggcgcagcggtcacgatgaccgcgatcacgctgagacttcagatatttattctgatcgcgggcttcatttatttcctagaagccctttccgtcattatgcaggtgacctatttcaaagcgacccacggcaagcggatttttaaaatgacgccgattcatcatcattttgaattatccggttggagtgaaacccgcgtggtgaccgtattctggattgtaacggtaatttgcgtcagcgtcgccatgctggccattttctaaaattaatattgaggaggaagattcaatatgaagacgtatttagtgattggagcggaacgcagcggcattgcagtgacgcgggcgcttctattaaatagacaatcggttattttgacggacacgaaggattttaatgtgatcgccaaagcttctccagccattgcggaagcttttgaagcgctgccgaaaacccatctgtcctgctttttcggaagccaagtcccgaaaagcgtcgtcaacggcgtttccgcggtcattcccagtccaggtgtgccgttgaccattccggttattcaggaagcttacaaaaaaaacattccggtcatcagcgaggtagaagcagcgtaccggatgacctccacgccttttgtcggcattaccggtacaaacggcaaaacaacgaccacatcactgaccggtgaaattttcaagctggacgatcgttatcccaatgtctacgtggtcggcaacatcggcaatgcggtgacgcattacgtcaacacgtctacgccgtctgatctttatgtcgctgagctttcgagcttccagctggaaaccacggatacgttcagaccgaaggcagctgcgattttgaacctttcgccagaccatcttgatcgccacggcaccctcgacaattattacaaggccaaggcgaagattttccaaaatcaaacgccggatgatattctcgtcgtcaacgccgacgacgacaatgtgttgaagtacacagcggacgcaaaatccaaaaagatcagcttcagtctggaaaaacgcgtggcgccggggatttatcaaaaggacggcaaggtctacgtcgccgaaggggacgacccggaaaaggatgtaatggtcagtgccgtttcggacatcacgatcaaagggccgcacaatgtgatgaatgcgatggcggcgatcggactgacctatttcacaggggtttccttaagcaatatccgcaaagggctgaaggacttcaagggcgttgaacatcgtcaggaatttgtcgcgacgattgacggcgtcgactacatcaacgattccaagggcaccaacaccgatgcgacgattacggcactgaaagcgatggaaaagccgacgatactcattgcaggcggatacgacaagaaagaagattacaccaagctgatgggctacgttaaggataaggtgaagctgatgattctgctcggtgcaacagcgaagaatattgcagccacagcagatcagtgcggattcagcgactatatcttcgtcaaggattatccagaagccgtgaaaactgccaaggaaaaagctgtctccggcgatgtcgtgctgctctcgccggcctgcgcaagctgggatatgtttgccaattacgaagaccgcggcgacttgttcaagcagctcgttaaagcgtaatggcggatcgacagcaacaaggggggcgccgccagtctggccgccgttattggagcaaaccagaccgcgcctttacactggcactgctcgtcttgaccggctttgggctgctgatggttttttcggccagcatgtacacgtcgtcggtttcgagtgcaaccggaagcggctacgcgcagtttatcaaacaggccgtttatgtgatcggcgggctgtttgtactttggtttgccagtcgaatcgattaccgaaaatttaataatgtccatgtggcgttggtcgcacttgtaatcactgcggctctgctggggttcgttctggtcgcgggatcagaggtcaacggcgcaaagcggtggctcgcaatcggatccatcaccttccagccttcggaattcgcgaagctgaccggcatcatttacgccagcagcattgtctgccagaaaaaagaagtctacagcaatttttggaaattcacattatattgtattttgccgatggtggtgctctgcggactcgcggcaatagaaccgtcgctttccgcggcgatggcgatcggctttgggatgctgtgcgtctatttcttttcgggaattaaattcaggtattttatcccgtacattctgctaattgttgcggcggttggtctcgctttgattctgcagccctttcgcctcgaccgcatccgcgtgtttatgggaaagggcggcgcggattaccagatcagacagtcaattttggccattggctccggcggcatctttggcaaaggtcttggcaacggcagacagaagatgctgtttctgccggaacttcagaacgattttatctttgccaacatcggcgaagaatgcggacttgtcggttgtgtactgcttctgattctgtacggatttatcatttacagagggattcgaatcgcgaaggcgtccaaaacgaaattcggctacgtttacggctgttcgattatggcgctgctgggctttcaggtgattgtcaatgtggcggtcgcgacgaatatcatgccggttaccgggatggcactaccctttatcagcgccggcggcacatcgatgatcatcctcttcttcatgatgagcttgattgtcaatatgtcgagaaagcctggaagaaaagtgacggcgggggcgccgaagacgaagcggcgcaaacgccagaaaacggaggaaaaaacagcatgacaacagttttcattgcagcagggggaaccggcggacacatttatcctggtctggccattgctgcctgtctaaaaaaacgcatgccggacgtcaagatcgtgttcatcggttcacacgtcggcatggaaaaaaacattgtgccgcgttacggctacccgatggaattcatcaacgcgtcgggttttcaacgcggttttgtcaagaaagtgattgcggcgaaaaatctgctcaaaagcgcccgcgactccagaaagcttttgaaccgctacaagccggcgctcgtcatcggcaccggcgggtttacgtcgggcattattttaagagaagcggcgaaaaagggcatcccgacattgattcacgaacagaatgccttccctggaaaatccaaccgatgggcggcccagaaggccgatactgtctgcctgacctttaatgaggcggctaaatattttccagcgaagaagaccgtgctctgcggcaatccggtccgggatgcctttaagaacgtcgaccgcgcggccatgcggcagaaaatgaagcttgcgccgggtgaaaaaatggtgctggcgatgggcggcagtcaaggggcagccgccatcaaccgagcgatgcagacggtcatgaaggaatggggcggccgcgaggacattcaaatctatcagattaccggcccgaaacagatcgacacggtttgtgcggcgctggacgaagcgggcatcgtgtacgacaaagaatatttcggcccgacccattgccacgcgatcgcctattccaacgaaatggaaatgctgatgggcgccgcggacgtcatcatcggacgctcaggggcgtcgtcgatttgcgaaatggccgcgtccggtacgccgtccattctcattccgtacccctacgcagcaggggatcatcagcgtttcaatgcgatggcaatgcaaaatgccggggcggcggaagtcattgatgaggatgatttaagcggtgaacggctgttaaaagaattgtccgcgcttttggatgacccggcacatctcaaggccatgtcggaaaacgcgaaggcttacgcaaaaatcgatgcagacgaaagaatcgtcgatcaggctgtggctttaatgcagcaataagcaagatagaggagttaaccgcgtgaaggatgaacaaaaaagtcaaaagatatccaaaacactaaagagacgaaaacgcagacgcattgcgcgccgcatcacggcggttatcctgattgctgcgattatctgtgtgggcggctactatctttcgcgtgtgatgacagatcaaaggctgaacattaaacaggttgaagttaccggcaatgcttcggcagatactcaccttttggatcaagtcacagatgcattaattggacagaatatcttagcggttgacgtgaacagcctgtccaatcaggctaaaaagatcctgcagaccgatcaagtcagtgtctacagaaaatggccggataccttgattattaaagtggggcgcatcgaagcccttggtgcagtcatgacggggaacaaggtgctgtatatcgatcaaaacgcccgcgtcgtcaaccgggcggattatctgactaacgtcaacctgccgattattaccggaatcaaaggaacgaacgcgcttcaaagcggcagtcacctttcctcgaacagcagggaaagactgattgacgcgctggatattttggcacgcattcaggacaagggactgctcgatcgcgtttcggaaattcactggacaaaatacaatacttaccgcattattacgaaaaataattctgtcttcgaggtgagcggtatcgacaattttaagaaaaacgaaagctacgtcgaaacgtttttgattgaaaatcgttccaatgtcgaagtggaccttcaaatcgacggtcaggcctttttgaagaatcggtcttgactaataatatgggttataatcatcaaagctgagaacttaaaaaaattgaaaacaaagattttttattgcaatgttgtgaaataaagggtatcatattataaagttgtaagaatgctatgagaagatgaaaccatcttcgctttattatttatgaataaaaacatataccctatatagagtagtctatgtgagaaccaggaggaagaaaagtgatagaactggacaactacaacgataattttgcgcagattcgtgtagtcggtgtcggtggcggtggcaacaacgctgtgaacagaatgattgaatcgggcctgaagggggtcgattttgtctcgattaatacagataatcaggctctggccctgactttggcagaaaaaagactgcagatcggcgaaaagacgaccggcggtctcggcgcaggcggcaacccagaaatgggtcagcgctccgctgaagaaagccgcgacgcgatttctgaagtgattcagggcacggaccttttgtttgtgacggccggtatgggcggcggaacaggctctggtgcagcgccgattatcgcaaaaatcgcgcaggaaatgggcattctgaccattggtgtcgtcacgaagccgttctcttttgaaggacgcgttcgtatgcgcaacgcgcagatcgcctgcgatttcctccaggaaaatgttgacgctttggtgacgattccgaacgaccgtctgctccgcatggccgataaatccacgtcgctgcgggaagctttcaaacttgctgatgacgtcctgcttcaaggggtcaagagtatttccgacttgatttctatgcctggtctggtcagcttggactttgccgatgtcaagacgatcatgcaggatgcaggcctcgcacacatgggtgttggccgcgcaaccggggaaaaccgtgcagaagaagcggcgaaggaagccatcctgagcccactgctcgaaacggaaattaccggcgcaacgggtgttctgctgaacatcacagctggcgacgatttgtcactgtttgaagtcgacaaggcggcgacgatcgcacgtgaagcctgcgacgaagacgccaacgtcatcttcggggcgaccatcgatgaaaacatgggcgacgaaatccagatcacggtcatcgcgacggggttccttcccgctgaagaaagcgaagacgtcagagatatgaaagaaaagatgtcagcgcgtccagcgagaagcagagcgccaaaggacgcaccagctcagtccgcaggtacggctaagcctaaaacagattcaaacgatttgtttaccattccgacatttttaaacaaagaagactaattctgcgatgaaatgtccgttttgtaatcataatggcagcaaggtagtcgattccagaccggttaacgatcagaccatgatccgcagacgccgcgaatgcgaaaagtgcaaaaaacgcttcacgacttacgaacgaattgaaaagattccactgatggtggtcaagcgaaacggtcagcgggaatcctacgaccgaaataaaatttacagcggcatcttaaaggcttgtgaaaagcggccgatttcagtcgagcagattgaggctatggtcgatcaaatcgaaaaacagctttatcagctcgaatataaagaaatttcttctgtatatatcggcgaaagggttatggaagccctgaagccggtcgatgaagtggcctatgtgcgctttgcgtctgtctaccgacgctttaaagatgcaggcgcgtttattgaagaactcaacaaattgattaaggagtaaggattggccaataaggttctagattcgaatcgcatttacgagggtaaaattttaaatttgcgggttgattcggttgaacttcccgatggcgggcataccaagcgcgaaatcgtcgagcacaaaaacggcgtcggcattctgccggtcgaccacgcgatgatgattttcgtgcagcagtaccgtgacgcggtaggatcagatttgctagaaattccggcaggtcttgtcgaagcgggcgaggatccgaagatgaccgcatcccgtgagctgcaggaggaaatcggcctcaaaccgctgaatttaacgccctgtggattcgtttatccaacgcctggctgctgcgatgaaaagacgtatctttttatcgccaatcaatttgaagcccaccgcctcgaggcggacgacgacgagtttattcatgtggtcagacttccgatcgagactgttagaaaaatgtacgatcatcacgaattcatcgacgccaagacggtcagcacattgggctactatttctcacatcagcatacaaacgaataaagtcaagggtgattttttgcaggctttgcagggaatcactcttttgtatttttaaaccattacaacaagtttaggaaggattaacaggaaaatcaaaatggaaaatattcaattttcaggacacgacacagtcgcattggcagaacagtacggtacgccactgtacgtcatgagtgaagacatcattcgtgaccgtatcgagtccgttaaaaaagcttttgaagaagctggcgcagattacgaagtcaatttcgcaggaaaggcatttaccaatgtggcgatgtgtaaaatcgttgcctcagaaggaatcgcgctggacgcggtttcaaaaggggaaatcatgactgcgctggcagctgattttccaatggaccgcgtctgctaccacggcaataacaaaaaagtcagcgaactgaaatacgcgctggaaaacggcgttggcctcatcgtcgtcgacagcgaagacgaattgaaaaaactgcttcaggtgaccgacgaattggatcaggatgttaacatcatgttccgcgtttctccaggcgttgaagcccacacgcatgagctgattcaaaccggcacccaggacacgaaattcggcctgccctacagtctggcgaaggatattgtggttaaggccaacgcgcagccacacattacagttgtcggcattcactgccatatcggctctcagattgtcgatgaagtgccgttcattgcggcggctgacaagatgatcgcgttgtatcaggatattcgaaatgaaggcgtcgatctgcgcgccattaatttaggcggcggcttcggtattccgtaccttgaaggggatgaatacttcgaaaccttaaaatacattccaaagctggttgatcacgtccgcaaaatctgtgcggaccgcgatgtgccgatgccaaagcttatcgtcgaaccgggacgtttcttggtctgcgaagccggtgcgacgctgtacaccattggcaccgtcaaggaaattcctggcgtgcgcaaatacatcagcgtggacggcggcatgaacgataatccgcgcccggcgttgtacggcgcggaatacgaagcggtcgtctgcaacggcaaggactccgaaaaactggaaccctaccgcgtcagcggccgtgcctgcgaaaccgatacgttaatcgattcagcgatgctcaatcagcctcaggtcggcgatattctgatggtgaagaatacaggtgcctacaattattcaatggccagccgctacaaccgttatccgattccggcagttgtgctgctgtcgggagaccgctcagcgatcatggtcgaacgggaaagctacgaagaactcctcagccacgaccgcgtaccggattggttgaaataatcttataggcttgcgatgacgtactcatctaactattttctgtcgctgctgctgagtctgccgggcattctcatcgcgattacctttcacgaggcggctcacggctatgcggcggaggcgatgggcgatgacacgccaaggctttctggacggctgtccctcaatcccttccggcacattgactggatcggctttctggcgatgatctttctgcatttcggatgggccaagccggtaccgatcaatccgaataactttacggatcgaaagaaggggatgatccgggtggcgctgtctgggtgtctgaccaatctgctgctcgggttcatcggttacggcgcctacctaatttgtctgccgctcaacaacctcgtgctgtcgattgtgctgcagtatattttcgaatacaacgtagttttcgcgatctttaatttgatcccgattccgcctttggacgggtatcatattttgtacgaatttctgccctatcgcggcaaaatgcggttggaagcgatgtcccggtatgggtttatcattctgttgattctgatgtttgcgggtgttttcggatgggtgatcacaccgctgtccaacggggtgatccggctttacgatttgattctttcgcccctcgcgaaattgattgtgtcatgatggcaaaccagcccattcaatacgacgttggcgattttgaagggccgctggacctgctgctgagcctcgttcaaaggcatcaggtcgacatttacgacgtctcgatttcagaaattatcgatcagtatctggcgacgattgaaaaatgggagcaggaccggatggcaattgccagcgaatttatcgtgatggcctcgcggctgatcaagatcaaatccaaacgactgctgccgtcggtcaatcaagagagcgaagatgaggtggacgacgaggcggtcctcattcgtcagctggcggattacaagcagatcaaggcggccagcctagtcattgagaaaagatacgaacaaaaaagcggatccgtttatcgcgatccgctttatttgccggaattatcgcagaaaaaatgggatccggagctgaaaatcaagcctgaaaagctcggaagcacctttgcccgcatgatgcggcgctatcaggaagcccacacctataggacgataccacggcccgaaccggatcgctatactgttgaacatcaagaagccgtcatcacccgttccttaaaggaacacgctgaacttacgtttagaaatgtgattcaacatcatgaagctagtgaagtgacgacttctttttttgcggtattggagctctacaagaagggccgcattgaaatggcacagcagcgtaatttcggtgagatgcaattaaagaaaaaggagtgcgatggagacaaaaaccaataatcggtcagacgcagcttccttcgagccggaaattttcggctggctggaagcgctgctttttgcgtccggcgacgggctgacgacgaaggcgctgtcaggcgtcgtcgggctgaacgagaaagaaacggaggcctacctcaaggcgctgtctgaatcctaccagagtgtgcgccatggtcttcgcctggtccgcacggcaggcgtttggcagctgtcgaccaagccttcactgtatcccgttttgacaaaatggaagcagctcgacaaaggccacggtctgtcgcgcgcggcctttgaaaccctcgcgattgtggcctacaagcagccggtgacccgagttgatattgaggcgattcgcggggtggcgtcgtccagctcgattcacgtattgctggatcgggaactgattgcggaggcggggcgcaaggatgcgccgggccgccctttttattacaagacgacgccggcgtttttaaagtcgctcgatattgaggatttgtcggagcttcccgatttcgattcgtttaaacagaaggaacagcaaaaggattctgcagcagaggacgaaagctaatgagattacaaaaatacatggcccattgcggcgtcgcgtcgcgtcggaaggcggaacagatgattgcagaaggccgcgttcaggtcaacggcgaggttgtgacctttcccggcactcaggtgagcgaggcggacgaggtcaaagttgacggtaaatccattgcgccggagcagcacgtctacatccttttgaataaaccgaagggtgtggtttcgacttcatcggaccgccacgcggaccagacgttattagatttgattcattccaaggaacgcctttattctgtcggcaggctcgataaagaaacttcagggctgttgattttgaccaacgacggcgacttgacttttcaactgacgcacccaagccggcacgtcaccaaaacctatcggtgtacggtgcgggggaaggtaagtgcgtctgaagtgaaacagcttcgcgacggcgtttcgattccgatggacgacggcagccggtatcagacgcaaagcgctgaggtcaaggttgtcaaggaaaaccgcggctcaacggtactgacgatccgcatttcggagggtaaaaaacgccaggttcggaaaatgtgcgcggaggtcggccacccggttattcacctggaacgcaaggcgatcggcagtttgaccgatccgtcgcttaaacctggtcagtggcgctatttaacgaaagaagaaattgaaaggctgaaggcggaacattaaatgattgaaacattcagacgccaaaccgcgtttatcaaggcctgcattcaagatgtgcttaagcccggagattcagccatcgacgcgaccgttggcacaggagaggacacggtgtttttggctgaatgtgtcggcagcgcggggcacgtttacggttttgatattcaaagggcggcgattgaggaggcgaaagcgctggcaaaacagcagggtgttttggagcgcatcacgtggctttgcgatggtcacgagcacatggatacctatcccgacatcgtgcacaacccgaaaattggtgcggtgacttttaatttgggctactggcccgatggggatcctgcggtgacgacccagcctgaaacaacgctcgaggctcttgaacaaagtgctgagctcttgagatccggcggtattttgacagtttgtgcgtattcccacttgacgggacaggcggaaaaagagaaaattgaggcgtggattcaaaatctggggcgcgggtacgatgcttacagttttgaagtgaaaaatcaccgaaaggccccaacggcttttattgtcctcaaaaaataagacaggaaaataatttaagatatttatgagtgaacaagtcattgtaattggcggcggccccgccggcatgatggcggcgtacactgccgcgtcaggcggcgatgccgtcatcctctgcgaaaaaaatgaaaagctgggaaaaaagctgtacatcaccggaaaagggcgctgtaacctgaccaatttctgcgatcaggaaacttttttgaaaaatgttgtgcatcatccgcgatttttgtactcgtcgatttcccgattcgaccgtgaggacttgatggattttatcacacgctacggctgcaggctgaaggttgagcggggacagcgggtttttccggaatcggataaatcgagcgacatcatcaaagccttcagaagggcgttggaatcggcaggtgttgaggttcggctgaacacaccggtgacatcgatcgtcacgcgggagaatgaagcggtcggcgtcaagcttgcggacggtactgtgctcgaaggggataaaatcattgcggcaaccggcggactcagctaccgttcgaccggctcagacggctggggactggacgctgcagaaaagttgggccacagggtgagcccgtgtcggccatctctggttgggcttaaaacaaaagaaacctggccggctcaggttcagggcctcgccttgaaaaacgtcgacgtgacgctgacccacaagggcaagaaggtgcggacagagcggggcgagatgctgttaacccatttcggcgtctcagggcctttgattttgaccgattcggcttacatggacgacgcaccggaaacctaccgtctcattttagatttaaaaccggcactgtcggatcaaacgcttgaccagcggattcagcgggagcttaaggcaaatgaccgcaagcaggtcgtgcacgcgctggcgtcgctgcttccgaaaaagctgatgccgattatgttggatttagctggtgtcgacagaaccaaaaccgcgaatcagatcacgaaaacggagcgccgagcgattgtcgacgcgctgaaacggcagccccttcagatcagcgatttcttagatatcaacacggcgatcgtcacctccggcggcgtgaacatcaaagagattgatcccaagacgatggcgtccaaacggatccgccatctgtattttgcgggggaaatgatcgatgtcgatgggctgaccggcggatttaatattcaaattgctgcgacgacaggattcgtggcgggaacaaggagtgaataaagtgcaaattgcgatggacggacctgcaggcgcagggaaaagtacaattgcgaaacagatagccaaggcattacacatcacctatctagataccggggcgatgtaccgcgcgatcaccaagggcgtgatcgaccataaaattgattttgcagatcaagaggccattgcccggtacgccgagggcgcagtcattgcatttaaagggcagcgggtttttctggacggtgaagaagtcaccgaagcgatccgcacgccggaggtcagccagcatacgagcgatgtggcgccgattccagcggtgcggaaagtgctcgtgcagcagcagcgcagaatagccgaaggcacggacgtcatcatggacggacgggacatcggctcggcggtactgcccaatgcggattacaaattttatttggacgcagcagtgtccgaaagagcgaagcgccgctacgctgagcttaaagaaaagggcggacttgacgggaaaaccctcgaggatatcgaagccgacattgccaaacgggattacaacgacagccacagggcggccgatccgctggtctgctgcgacgacgccgtgcgcattgacacgacgcacatgacgattccagaggttgtggcctgtgtcatcgatcacgtcaaagccggtaaggcgaaataacggagggtgagatgatttatcgaatcgcacacgttttatttaacattgtcaattttttctggcttaacatcaccgttgaaggggtggaaaatgtgccgaagaacagccgggcagtgatttgcccgaaccacatgtactggtacgatccgctgctcatcgacacgctgctcaagcacccggtcaggccagtcaattttatggcaaaggcggaaatcttttccaataaattcgttaattggatactcaaagaggtgcacgttttcccagttgaacgccacaaggtgtcgatgacgacgctgagaacggcgatgggcattttaaacgacgacaagcttttggggattttccccgaagggacacgggtcaagccgggacaaaaggtcaagccggcggacggcttcattttcttcgcgctgaagacccattcgccgattgtgccggtgcacattcaaggcagctacaaattccgcggaaaaattaaggtggtcttcggcaaacccatcgaattgacggaatattacggcaagcgcctgaccgcaaaagaaaacgaagcccttgggcagcagattctcgatcaaatctacagcctgtgatgggttttggggcttggtcttaaaaaaattaagaaaaataaaaaaaaagatagacaacgagcattttatcaaataaaataatggagatagtatatgaagatcattatagcggagaaggctggttactgttttgggattaccaacgcgatgaaactcgcggatgatacactgaaacagaaagacaatcaaccgatctactgtctgggcgatctgtctcacaaccgccaggaaatgaaacgcctggagcaacggggcatcattaaggtcgatcgaattgaagatattccaaagggaacggtcatcattaggtcccacggtgtgagtaaagacgtcattgatcaggcgaaggccaaaaacttaaaaatcgtcaatgcgacctgtccttttgtcggggccatgcagcacaaagtgtatgactacgaccgcaaaggctatcagatcgtcatcgtcggtgatgccgcgcatccagaggtccaaggggcagtcggctggtgcgacggacgggccatcgtgatcaatacgcctgaagaagcggaggccttgcctcacttcgagaaaatgtgtgtcgtggctcagacgacagctatcgaatcgaaattcaatgccatcacatcgattctgcagaaaaaagcagacgaatgtttgatatttaacacgatttgttcggcgaccgcagaacgccaatcggctgcagttgaaacggcaaaacgtgtggaatatatgattgttgtgggcggctaccactcgtcaaatacgcgaaagctgtttgaggtctgcaaggcgcactgcagcaatacatgtcacatagagacagccggagaattaaatctcgctgaggtgaaaaaatacaacgtcatcggtataacagcgggagcgtccacgccggactggatcgttaaggaggtaacggaaagaatggaagaaaacaaaacggaaaacacacaagttcaggatcaggcagtcgaagaaacagttgatgaaaatgattttgccgcaatgctggaccagtcactgcaggataagccaatccacagagggtcgacagttgaaggtgaagtaattgaagtcactgacgatgaaatcatcctgaacattaaatataaagcagatggtgtcatcaaaaagagcgattattcctggaaagacgacatcgatctgaaggaagaagtcaaaaaaggcgacatgatcaacgcggttgtcaccaacatgaacgacgacaacggcgcagtcagactgtcaaagattaaatacgacaatcagaagattcagcgtcagctcgaagaagcgtacaaagacgaaaccgtcctcgacggcaaaatcaagagcgtttccggcagcggcctgattgtcgatatcggattcactgacatctttatgcctgcttctcagtacagcgtccgctatatcaaggatttaaataccctggtcggcaaagaagtccgcggtaaaatcattgactacaacgcaagacgccgccgtgcaattttctcacagcgtgtcatcctcgaaaaggaaatgaaagaacgccagaaggaacagcgcgcaagaaaagaagaacgctacaacgaaattcagatggacgatgtcgtaaccggcaaggtcaagacgatcaccaacttcgggatctttatcgatttagacggtatcgacggatttgttcaccgttcagatttaacctggtctcgcgctaacgaaccgaagaacctggtcgaaaagggacaggaaatcgaagcaaaggtcatccagaagaatgacgaagaaaagaagatcaaattaagcgtcaaggcccttcagccaaaaccatgggatacctttgtcgaacagtataaagaaggggacattgtcgaagtcaaaatcaccaatgttctggatttcggtgcatttgctgaaatcattccaggtgttgaaggcttgattcacatttctgaaatttcctaccgccgtgtcgaatctgtcgcatcagaattgaatcctggcgatgtggtcaaggtcaagatcatcggcatcaaccgcgaaaaagaaaagatcagcctgagtatcaaagcaactcagaaagcaccggaacgtgctcagagacgtcaccgcaagagcggcgaaggcttccagggccgccaaggcggacgcaagccgcgtaaacgtcagccgcagcacaacaccaccgtatatgaagacaacgccaacttcacattgggtgattccttcggcgatctgctgggtaaacttgatttcggcgatgctgaaactgaagaaaccaaagacgacgaagaataattcacgtcattttgagctcctatttcaaataggggctcttttttttgattctgaaacgctgaacacgacgacgattaaaagttctggtttacggtatttcagcctgcggatacttttcgaagcatctgcaggctttttctattggcagaccgcgaaaatgcgagtataataagaaaaacgttatcatcaaaagcgacggcacagcagcattgaaataaggagaagaaaatgttagcgaaaatattcagctgcggtcttttaggagtagagggcgtgatcgtgacggtggaggtggatttaaattacggtctgccgggtttcattgtcgtcggcctgccggatgcgggtgtcaaggaatcccgggatcgggtgttctctgcgattaaaaacaatgggtacgcctatccggacaagaaagtgactgtcaatttggcgccggccgatcttaaaaaagaagggccgtcttacgatctgcccatcgccatcgggctgctcgcggcctccaatcagctggaagaggatttttcggacacgctgtttttcggtgagctgtccctcaatggcgatctgcggccggtccggggtgtgctgccgatggtgctggcggccaaacgcgagggctttaaaaaggtcgtgctgcctcaggcgaataaaaccgagggtgcagtggtggacggcatggacattctgccggctgataacctcaagcaggtgatcaatcacttaaaaggcaaggcgccgattgcgccttaccagattgattctcaggcgctgcttaacgagggccaggcgtcgtaccgcgtggatttttcagaaatcaagggacaggacaacgcaaagcgcgctctcgaaatcgcggcggcaggcggccacaatgtgttaatgagtggcccaccgggcagcgggaagagcatgctggccaaggcttttccgtcgattctgccggcgttgacgttaagcgaggcgctcgaaatcacgaagatctattcgattgcgggactgctaaaagacaatattatgacccatcggccgttcaggtcaccccaccacacgctgtccaatgtcgccattgtcggcggcgggtcggtgccgaaaccgggtgaagtgtcgctggcgcacctcggcgtgctgtttctcgacgagctgcccgaatttcagaagacggccctcgaagtgctcagacagccgatggaagatcacgaggtgacgatttccagagtcaacgcgacgctgacttatccggcgtccttcatgctgatcgcgagcatgaatccctgcccctgtgggtattatggcgatccgacccacaaatgcacgtgtacgaagaacgaaatcaggcggtacaacagccgcatttccggcccgttgctggaccgcatcgacatacgcgtcgaggtgccggcggtggacatcaaggagctcgagagccgggcgcctggggaatcctcaaagtgcatccgcaagcgggtcaacctagcgcgggaaatccaaaatgagcgctttcaaaacgacgaggggatttacttcaacgcgcagctggaaccccatctcattgaccgctattgcgtgttggaccgggaaggccaggattttatcgagatgatttacgacaagctcaagctctccgggcggggctaccaccgcattttaaagctggcccgaacgatcgccgatttggacggcgcggagcagatcggattgattcacctgtcagaggcgacgtcctaccgttcagggcagtagcttgaaggaggacggcatggaaaacgcgatgatttacgatatttggctttcatcgattacaaatgtgtcgaatatcaagaaaaacacactgctgacggtttttaaaaccgcggagcagatttatacggcatccgcgtcagacattcgcgcgacgggattactccgcgaaaaggacattcaaaaaattgaggatcagaaaagcttggcgctgacggaacgagccatgcgatttatcgaaaaaaataagattgtctgcatcccgaaaaatagtccccattatccgaggcggcttgaaaaaatatacaatccgccggtgatgctctacgcgttgggaaacgtcgggcttactgaacgggatttgaccattggcatggtcgggtcaagaaaatcaagccctggagcgatgaaaacggcgcggcagttcggcaggcggttttccgaaataggcatgacggtgatttccggcatggcggacggggtcgacagcgcggcggctgagggtgcccttgacggtatcggctcgacggtggccgttttcggttcaggcatcgacgtctgttatccggcgggtaatcgcgaactttacgagcgcatccgggagaagggactgctattgagcgagtttttcatcgggcagccgccgaaagccgggcattttccgatgcgcaaccggatcatcgcgggtctctccgacggcgtcgtcgtggtcgaggcgcggcttaaaagcggggcgttaatcacagcggatcacgccctcgagcagggcaagacggtttacgcgatgccccagagcatcggggtaaaatctgcggaaggctctaaccagctgctcaaggaaggggccaagcttgtcacggagccggaggatgtgctcgaggattttgtcgagttaaaggctgttaaaaaaacaaagcctgcgccgtctgagaaccctcagaaatcggcacaggctgaaaaacaattatcgttatcggaagacgaaaaagaggtattagacgcagtaataaagggcgtagataccgttgacgggctggtccagagactggacacgcccatcgcgaagctcaacgcagtgttgatgatgatggagctcaaacaccttgtgaaggtttcctacggccaaattacgcttttaatttaatatttttattgctggccgttctgtgcttctaagatggcgtcgaggatgcagtgggccacctgggatttcggcatcagcggcagggcaacgttgccgtttttggtgatcagggtgaccacgttggtgtcgccctgaaaaccagcgccgctcacccgcagattgttggcgacgaccatgtcgatttttttcttttccagctttttccggctgttttcaattaaattttccgtttccatcgaaaagccgcagataaactggttggcctttttgatttcgcccaaactctttaaaatatcggtcgtgcgctttaattcaatggctgggacgcccttatcctttttgattttttcggcagccgtcgtttttggcgtgtagtcggcgaccgcagcggctttgatgatgacgtcctgttctggcgcggcggagagcacagcttcggccatgtcctcagcggattgaatgggaataaaattgacaaagggcacaggctttaaacacgtcggcccggaaacgagggtgacctccgcgccacgcagcatcgcgtcgtaggcgatggcgtagcccattttgccgctggaatggttggtgatgtagcgcaccgggtcgatggcttcatgagttggaccggcggtgattaaaatctttttcccagtcaaatccttttcgtaggcgatttcgcggtagatgtaatccaaaagcacgtcgggctgcggaagcttgccggcaccgttgtccttgcaggcgagaataccggaatccggcgtgatgacgtgccagccgtagtccttcagaacgctgaggttgtgctggacgatcggattgttgtacatcgcggtattcattgccggcgcgatatatttgggacaggtacaggccagagcggttgtggtcagcatgtcgtcggcgaggccgtaggccagtttcgcgatgatgtcggcggtggccggtgcgatgaatagaatatccgcctttttggccagcgcgacgtgtgcgacgttatattgaattgtcttatcaaaagtatctgtgatacaattatttccagtcagcgtggaaaaggtcatcggctggatgatttcggtggcgttcggcgtcatgatgacgtgaacgtcacatttctgtttagccagggccgacgcgacatcggccattttgtaggcggcgatgctcgcagaaacgccgagaatcaccgtacgattttctaaattcatgttgccctttctccaatattttggcattattcatttttcagtattatagcaaaaaggcggggcgtatacaagattggcacggtgaatccgcattgagaggaggttttgggcatgtacacattaatacgcagcagccgaaaaaccatcgcgctgaaggttttgaaggacggcacgctgcaggtcaaggcacctaagcaggtcagtcagagcgaaatcgagcgttttatagaagaaaaatcagattggattgcgaaacggaccgcacaggttaaatctgccgaagattttgaaatttcagacggttcctggattcgggtgctcggtgtcgatattccggttttggctgtgccagacggccggtttgaatttaaacgcgctgtgaagctggaccattctgtcattacgattccagccggcgctgatctcaaaaccgtcaagcgcggaatcgtcgacatttataggaagctggcagaggacatcattctccagcgggccgcctggtatgaggcggtaatggacctgcatccgtccaaggttcggatcaataacgcggccagccggtggggctcctgctcgtcaaagaagagcatcaatttttcgtggcggctggttatggcggacggcaaggccatagattctgtcgtgattcacgagctggcgcacattaagtatatgaaccactcgaaggcattttggaacctggtcgaacaatattgtcctgattacaaaacacagcggaaaaagctcaatcggctgtctgaaaaattgatggctgaaaattgggatgtttaaaaaaaacataaaatgacaaattcaatttgcatttttactcatcctatcatataataccttgtatacacgatgaaaatattacaagaaaagccgattgtatctctgtttttccgaaaaataaccgaaactaaacagaaatcgctcggttgtaatgaaaaaacttgaaaatatgacgtgtatttttatgtatgtgattaaataaatataaatctgaaaggaagacttatgtacgattgtgatttatcttttttgggattagacggaaaaaaagcactcgtgaatgcaaaagcatcagtgttgacggaaaaggcactctcccgcggtgaagggcatttgtccgataccggcgccatcgtcgtcaacactggcaaatacactgggcgttcgcctaaggaccgtttcatcgtcgacgatgaagtcagccacgataaggttgcatggggtccaattaatatgccctttgacgaagataaatttgaagctttatacaaaaagatgacggcttacgtcggcaccttagatgaagtttacgtctttaatggctacgctggcgcggacaaagattatcagctgccgatccgcgttattaaccagtacgcgagccagaatctttttgttcaaaatctgttcatcgaaccgaaggacgatgaagaatcgaaacgcatcgatccgcagttcactgtgatcgcggttccgggattccattgcgatccggaagttgacggcaccaacagtgaagcggcgatcatcatcagcttcaaaaagcgcgtcgttttgattgcgggctcccgctactgcggagaaatcaaaaaatcgattttctctgtcatgaatttcctgctgccgcagaaggatgttttgacgatgcactgttcggccaatatggacgacgacggccggaccgcattgttcttcggcctttccggtacgggcaaaacgacgctatccgccaatcctgaacgcggtctgatcggcgatgacgaacacggctggagcgacaacggcattttcaactttgaaggcggatgctttgcaaaatgcatcgacctcgaagaagaaagtgaacctgaaatctatcacgccatccgttttggtacagtcgtcgaaaacgttgtgctggacgaaaacggcaaaccggattacagcgacgacaaatacacacagaacacccgtgcgggctatcagctcagctatattccaaacgcggtgattccgagtatcggcggccatccgaacacgatcattttcttgacagctgacgcctttggtgttttgcctccggtcgcaaaactcaacaaatatcaggcgatgttccacttcgtttctggctataccagcaaactcgctggaacggaacgcggcgtcactgaaccgcagacgacattctccacctgcttcggcgaaccctttatgccattgccggcatcccgttacgccgaacttttaggtgaaaaaatcgataaatatcactgcaatgtttacttggtcaacacaggctggtccggcggcccttacggcgtcggcagccgcttcaagctgaaatacacccgcgcgatcgtttccgcagcgacggcagggaagctggaagacattccgacggttcacgacgatttgttcaatatcgaaattccgacgagctgcccgggcgtgccttcagaacttttgatgccgaagaatacatgggaagacaaggaagcctacgacaagaccgcaaaagatttggctgctcatttcgtcgaaaacttcaagaaatacgacaccatgccgcaggaaatcatcgacgcaggtccgaatgtcaagtaattgaatcgctttttccaaaggccggatatccccagacggggttgtccggtctttttctttaaataaaactgaagcgccttgacaatcagaatcagaatgtttatactaacatcgaaatttaggtaaaaccaaactaatttttgagatggttcgatgtttgataggagcgagtatggcatgtagaaggcaagatttaattcaggcattgggtcatttaatgacactgggaacccattgcaatgacgcggcgaaggatgagtgtcggacgatgctcacgcagcgccaagtcgagtgcctgcacattattgatgagcgtcagaacattactttttctgatttggcgcatacttttagtttatcgaaaccgaccatcacggaaatgatcgacaaattgtcggatcaaggctgtgtggtccgggaaaaaagccagcaggacagacgggtctcttacatccggctgaccgaaaagggtgaagcagccgcgcgctgcgaacagcgcggaaaaatgcagctgatttatcatattgaatccagcctgacggacgatgagatcgatctgctgatcgaactgctgcaaaaagtgcattaacataaaacaggaggcgattatatggccacagaaggaaaaatcccaatgaaagcaccggttattccaattacggagaccgttatatttccgggcatcaagaaccggatttatgtcaatgaaaccattggcaacaacattaaacagtacatgggtgatgcgaacacactggccgtcggcttgacgacaaagggtaacattccctacgaagaattaaacgaatcgtccttttaccgcatcggcgtgctgttccaatttaaccgcatcgaagaagcgaataacgggggctacgtcatcgaaatcttcacgcttagacgcgtcgaagttttaagcgttgccgacacgccggatcatcagctgatcgcggaatacgaagaatatcccgaatgggaagacatgaccgaagctgacgacgaagaaatgacggcttacattaaaaatctgtgcagcgaattttctgaaaacttcaagggcgcagactacttcatgaaggtgttaaaccgtcagcagcacgtccagcagatcatgggctacctggtgccgatgatgagcatgtccattccggaaaagcaggcgcttttggaaatcaactctcagaaacgccgagcgctcaaattcatcgactacttgattaaagaaaaggattccgtgcacctgcagctggaaatcagcaagaagtacgccagagaaaaggataagaactaccgcaacgccatgctcagagaacagcttcacaatattgaagcagagcttggagaagacgacggcgacgaatctcagagctaccgtgaacgggttgaagcgtccgacatgccggaagacgtcaaaaaagtcgcgatgcgggaagtgaaaaaactcgaagcggtgccgcagggatcctcagaaatgtcgatcatcatgaactacctcgatctgcttctggatctgccgtggacctgcgaaccgcagcagattgacatcgaagaagctaagcgcgtcctcgacgaagaccactacggtctcgaaaaggttaaagaacgcatcatcgaacatctggccgtcatgaaaatgaaaaacgacaaccaggggaccattttactccttgtcggccctccgggaactgggaagacgagcctcggccgctccattgcgagagccctcggccgcgaatacgtccgcgccagcctcggcggcgtgcgagacgaatctgaaattagagggcaccgccggacttatatcggcgcgctgcctggccgcattattaaaggcatccgagatgccaaaacgatgaacccggtttttgtccttgacgaaattgacaagctgggtatttccgctcagggcgacccgtcagcggctctgctcgaagtgctcgatccggaacagaacaacaccttctccgatcactatctggaagtgccttacgacttgtccaatgtcttctttatctgcacggctaacgacgcctcccgtattccggggccattgcttgaccgggccgaaatcattgagctttcgtcctacaccaatacggaaaagctgcacatcgcgcaggaacatttggttgcaaaggtcatcgaagaaaacggcctgaaaccggaacagttgagcatttcaaaggaagcgatcagccgcattattgaagattacacggcagaagccggcgtcagagggctgactaaacagctcgcgaagatcgctcggatgaccgctgaaaaaatcgtcaccggcagtgccgaaagcgtttcgatcgatgccgacgacgtcgaaaaatggctcggacgcaaaaaacgttatcacgaaaaggtcagagcgcacaacgcgccaggcgtcgtgacgggcatggcctggactgcggttggcggggaaatcctgttcaccgaagcgacgttcatgccgggctctggacgcttgatcatgacgggccagctcggcgacgtcatgaaggaatcggcgaccatcgcgatgagcttgatccgctcgcgtttcagcgaagaagcgacgggattcgattattcgaaattcgacacccacattcacgtgccggaaggcgcgacgccgaaggacggaccgagcgccggtgtaacaattaccaccgcgctggcgtccttgattctcggcaaatctgtggacagccatctgtcgatgactggcgaaatcacgttgtccggcaatgtgcttccggttggcggcatcaaggaaaaggtcatcgcggcgcagcgcgcgggcgtgaagaaaattatcctgcctcttgaaaacaaggaagatctcgaagatgtgccgaaggaagtcaccgacgagctgacctttgtctacgcggaaacgatcgacgatgtgctgaaggaagccctcggtgtcgaaatgccgaagtaccagattcacaccaacattcagttggatcctcagaaaaaggaacagacagacttatcagtcattctctaacttggtttgatctaaatacaaaagggattcggttaatcgccgaatcccaatttttttgaaatgcccttgcattttgcaaaaggttttgataccataagaaaagtaatttttgcgctcgtagctcaggtggatagagcaatggtctccgaagccatgtgtcggccgttcgaatcggctcgagcgcaccatttaaaaagataagccgtttgatagataaaattatcaaacggcttttttgtttaaatttttaggtatattggacgttttgcgcttcaggtgcaaattggcggtccagctgtgattcgatcgcggagagatcagccttgatcccgggaaggggcaggtgggcgtaaggatcgcctttggcgagcagggcgtagcatttttccttggccgtgtttaaatcgtgcatcgcggcgagtaaatcgggagggcagccgatgccgaggaaaagacagtgcccgatgcgggagacgatattggggtagtcggggctgtcggaggtgacgtgtgacagcgcctgcctgtaataatcaatcgcctttttgccgttttgtttgacgtaacggccgtcccggtacatgtcaccgagcttgtacagcgcgcagtggtcgccgttttctgcggctaggctgaatgcgtgaaaggccttttcgtaatcgaccgggatgttgcgcccgtaataatagcagtagccgaggtagaggcagccgccgtcctcgccttggtcggcggcgcgttcgaaccatttacgggccgtcgtgtaatcctggtcgacggtaaagccctcgtagtagagccgccccgcgagatacatggcctgggcgctgccggcctctgctgcggccaaaatatcgcttttcagcgcgtccttttcattttgacgcattgttctccggtcacagctttcaaagcgcgatttaagggattctggcatatttattccccgataatcttgatcagggcgtgcttgtcccgtttgccgtcaaattcgaagtagaaaatctgttcccaggtgccgaagtcgagacggccgtctgtcacggcgacgacgacctcccgccccatgatggtgcgcttcaggtgggcgtcaccattgtcttcaaagccgttgtggtggtagcggctgtagggcttttccggcgctaatttttcaagccagttttcaaaatcttgatgaagccccggttcgtcgtcgttgatgaagacgctggaggtgatgttcatcgcgttgacaaggatcaagccttccttgatgccgctttcttcgagggcttcctcgacgtccggcgtgatgttgaccagccctctacgggtattaaaatgaaaatgcaattctttgcggtaggatttcattattacgctccttatttttttattagattaatcaactctctgcattataacacaggacgtaaagcggttcacggcactgcattgctctaaaaaaagccctgtgttatgataatttaaaataagatacggtaacgatcaaaatttaaataagtaaaaggaaaacagatgcgcaaagaagaagaaattcaacggatgctggcgggaaaattgttttcgccggcaggtcttggcagagacgagtggaagcgggttcacgcggctcaaaaggcctttaacgatgctgacgattcaacgcttagggatgactgccaggcgatgacggcactaaaaaaatgctttggggcggcgccggacgacttaaagcttacgccgccggtgtatttcgatcagggcgttcacgtgtttttcggcgagcatttttacgcgaacacggatttgacaattttggatgaaaatgaagtccgcttcggggatcacgtcatgctcgggccccacgtcagcatctacgcggtgagccacccgatcgatccggaaattcgcggcaccgatttggaaatttcagcgccggtcaccatcggcgacaacgtttggatcggcggcaatgtggtcatcaactgcggcgtcaccattggcgagggcagtgtgatcggctctggctcagtcgtcacccacgatataccggcccgcgtcgtcgcggctggcaatccctgtcgggtgatccgggaaatcggcgaagccgatcgaaaactctgggaggctgaatatgaagactaccggcggcaatttgaagcgtcatctgaaaaacacgatgaatgaggtggatatggacgcgatgatccagcagatgatggatcaggcgcagaaaaaatacgacgagctgaaaatattaaatgtcatggtgctcgggaagaccggcgtgggcaaaagcacgttaattaacaacatgttcagcgcgcatttggccgagaccggcgtcggtaaactggtcacgaaagccattcaaaaattcgaaaagccgaattttccgttggccatttacgacacgccagggatggagctcgacggcagcaacgcccttgagcagctgctcgcagacgtgacggcgattatcaaatcgggcagaaagagcggcgacgtcaatcaaatggtccactgtttgtggtactgcatcgctacgccgtcccatcgttttgaaagcgcagagatcgaatttctgcggcgcgtttcagctcaatccgggaccgggattccggtgatcgtcgtgttgactcagtcctattccaagcgcgacgcagaggcgatgcggaaagccgtcgaggcagagaagctgggcgtcgtcgacgtggtgccggtgctggcagagccctttgtgatcgatgaggcgtttccagccattctgccttatgggctcgatcagctggcggaggtgacctatcggatcatcccggaggaggttcgggaggctttcgtcgtggtgggaaaggatttggcactcaagagaaagcgggcgcgccgtctcgtggccacggcagcagcggcagcggctggcatcggcgcggtgcccattcccgggccggatgcggcgattttgatcccggagcagatctcgatgctggcaggtatcacggtgatctacggcatggattttcacaaatcagacgtgatcgctgtgatagggccccttctggcgacgatcaccggccggacgattgtggcggagctgccgaagctcattccgggagcggggacagccgcaggcagcgtcatttccgcggcaaccgccgcctcgctgacctcagcccttggcgaaaccaccatcatcattttagaaaaaatggcaaagggtgaaatccatcccgaagatttgaaaaataagaagggcgttaaagcgatcaaaaaaatttttttcgatcagctcaagcagttcaagcgctaaattaaaaacccaatgaaaagcaaattttcattgggtttttgcgatttacggattggggaagagtttaccgaaaatccagtgggtcagcggcgcggcgaagaacatattccagaaaaacgccatcggcaggtttttgatcacggtaccgatccagatcgccggcaggttgatggggttggtgtgagcgaggatcaggttaaataaaatcgaggcgatcaaactcattgtcggacacatgatcgcgaccgtgccggcttggcgcatgatgcggcagaaatacgggttgtccttggcaggatccgtatgccgtttggcgaaggcggcgccgatgcggttgccccaaaggctcgaggtaatgaagacgaaggcgcccatgtaagaggcttcaatggcggcgccaacaaagacgtggttggtcatcgtgctgaagccgccgacattaagattaaaaccttgtttaatggcgacgttatacacctccatgccgtaggccatgatatacgacatcaataatccgaaaacgattccttgtttttttgttcttggcattaaaaatacagtcctttcaatttaataaaaatcaacagcaaacagttaattgagtgcggctttcggctcactttggccgatgggcgcgacgcggtgcgatacggtccgcttgagtaaaagcagcgccacgacggcagcggtggcttcggcaatcgggaacgcccaaaagacagcggtcgtcggcagagccaggcggctgaaaatccacgccagcggcagcgggatgacgagcagccttaataatgagacaatcagggaggaattgccagcttccaacccttggaagacgccctgcagcgcgatgctgacgccggcgaaaacaaagccgatgctgatgatgtgcatggcgctgacacagagagattcagttacctgggtcaagccgaagatctgtgcgaggggatgggcgaaaatctgcagaatggccgtcccgatgagcatgacgacgacggtgtcaattaatccccagcggatgcactgcacaatgcgctttttcaaacgcgccccgtaattgtaggcggtcagcggcgtgattgcgtcccgcaggccaaatccagcgaagaaaacaaattgctggattttgtagaagatgccgtaggccgtgacgatctgctgagaaatcgtgccaaagatgatgttgatcccgtaggtcataaagctcatcagcgcctgcatgacgatggcggaaaagccgatctgataaatgccgcggatggttttgacacggggcttcaagaatttaatccccattttaatttcccggttcttcgtcagctggaagacgaaggccagcgcaagagagataatttggccgatgatcgtcgcgtacgctgcgccggcgatgcccatggccgggcagccgagcagaccgtaaatcataatcgggtcaagcacaatgttggtcaacgcgccggtgatctgcgccgttgtggacaggacggttttgcccgtcgattgcagcagcttttcaaaaatgccgtagaggacgttgccgaagcagaacagggtgcagatttttaggtagcgggtgcccatgttcaacacgacagggtcggaggtctgggttctcaggtaggcgtgggaaccgaagaagccgaaaaccataaaaacggccgtaatgacgatgccgaggaagatgccgttgcccgccgtccgcgagactcccttttcgttcttctgccccagctggcgcgaaagcatggcgccgacgccgacaccggtaccgatgccaaaggcaacgatcagcatttgaacagggaaggcgagggtcagggcgttgacggcgagctctccagcgtggaccacaccgccgctgtcgggcattctcgcgacaaacatgctgtcgacgatgttgtacatcgcctgcagtaccatcgacaaaataatcggaagtcccatcgacagcatcagcctgtcgatgcgttcagtgcccattttattctctttcatagcggctaccttctttctttgatttcattttgtaataaaaaagagcaaaataaaaaagcagacaacacggagttgtctgccaacggagttacgtctaccagcgattgattatgatgttcttacgttattttatctaattgaatgcgtttgtgcaaatgaattttttgcaaagtctgaaacaaaatttgaggtggttgtttgaaaatttaaaatcagatataatgaaatagaatcaatatttgatggaatggatacacaatggaagataaaaataaaattaaaaaaatgccgaagggcgtcttggtcggcgagagtattttcgatatcgcctatttgttgtttgcttttattacgtcggggatcttcttttcccacggcgcggacccagtctttttctggtacggctggctgactttcattttaggagccggcgacgccttccacttggtgccccgggtggtgcatcatttaagaggagacagcgaacgggggcagtggtggttgaatttgggcctgatcgtctcgtctctgacgatgaccgtgttttacatcattttggtgagaatttggaccttactgttcgatccgacgtcgatttcttcggtctttatgctgctcgtcgcgctgttttcctttattcgtctggcgctttgcgcgtttcctcagaataaatggtttgccggcggcgatataaaatggagctttgcgcggaatctggcctttttagtcctaggtggtcttgtcgcgtttctgtacgcgtcgatcggcaataccggtggctacggcttgtggaaaatggccgtggcgatcgtgatcagctttgcctgctatctgccggtcacgatctgggcgaaaaccaaaccagctgtagggatgctgatgattcccaagaccctcgcgtatatttggatgatcgcgatggggctggcgctgctgaacgtctgaaattttagactgtttctgcggcaacgcttgtctgctgtataaaactttgatataataaaatgtaatcaaataacaaagggagctgtaaaaggctgagaggaaacgcgagtttcgaccttgaacctgatttggataatgccaacggagggaaatacgtgtgtcaattggcagtcccaaagggctgctttttttatgaaaaggagatgaggttttggtacagattaatggagaagctgtaaatgcggcgggcaaaacgatcggcgcgtatttaaaggacgttgggatcgatcctcagcgcgttgcggttgagtacaatggcaaaattttaagcaaggatgcgtacgacacgacgcagatgtcggacgacgacgtcgtcgaaatcgtaaactttgtgggcggcggctgctagagcggcagctgcataatggattaacaggaattgctgaaagggagaaaaacaatggaaaaagatcaactggtgattggcggtcacgcctttgattcgcgttttattctgggttccgggaaatattcttttgagctcattgacgcggcggtgaaacacgccggcgcgcagattgtgacctgtgcgatccgtcgaaccaagcccggcgaacaaaacatcatggactacattccaaaggatgttacgcttctgccgaacacttccggctcaagaaccgcggaagacgccatccgcatcgcgcacatggcccgtgaactgggctgcggcgatttcgttaaattggaagtcattccggacacaaaatacctgctgccggacaacgcgatgaccattgaagcgacaaaggtgctggccaaggaaggcttcattgtcatgccgtatatgtttccggatctgaatgcggccaaggcattggccgacgccggcgctgcggcgatcatgccgctgggcgcgccgatcggctccaatcgggggctggccagcaaggcgttcatccaaattctcatcgacgaaatcgacctgccgatcatcgtcgacgcgggcatcggcagaccgtctcaggcctgtgaagcgatggaaatgggcgcggacgcaattatggccaacaccgcccttgccacagctggagatattccgatgatggcttcggcctttaaatccgcgattgaagcggggcgcaaggcttaccacgcgggactgggccgtgtgttagtgcgcggcggcgcaccgtcggacccgacgacgggaaccctgcatgactgattttaaaatcatctgcatcaccaaccggcatttttttgacgagacggctgattttttgacccacatcgaccggctggcagcagcccggccggacctgatcatcctcagagaaaaggatctgcctgttcaggcctacaccgagctggccaaacgcgttattgacatctgcgaaaggcacggcgtcgtctgtgcccttcacacctatgtcgcagcagcgattgcactgaaggtagaggcttttcacgcgccgatgcccatgctcgacgcgatgacggacacggagaaacacagctttagacagctcggcgcgtcgacccacagcgtcgagcaggcacgggccgctgaagctgcgggctgtacctacatcacggcgagccacatttacgacaccgactgtaaaaaagggctgccggggcggggactcaaatttttagaggacgtcacgagacggaccgccatcccggtttacgctttgggcggcatcgatgccagtaagctcgctgaagttcggcgcgccggcgcagacggcgcctgtgtgatgagcggggcgatgacctgcgcagatccggcgcgttatatcgccagtctgcgccagttttccaaataatgtttggacaccttgtatttgacaggcaggtctgataagatgtgtcacggatgatatgaaaagtttcaatagaaaaatttcaatgatagaagagcctgaaaatcaggctcttttttaatgcgaaggaggcattcttttggctaatcagcagtctttgaagaaaaagcagcggcagatgatttccgaaagctttcggcttggggcgctgctcgcgtcagtcggtgggtttttagacgcttacagctacgtgacccggggacaggtcttcgctactgcggaaacgggcaacattgtcctgatgagtctcaatttatccaagggtgattttcgcatggcgctgcattacctgctgccaatctgcgtttacgctctcggcattctcgtggtaaagaacgtcgcggagaacgcgaatcagcaccatttaatcgtcattcattggcgtcagatcatcattttctgcgaagcctgcgtgctgatgtgcgtgacctttattccacagacaccgcggatgaatctgctggccaacgtgctgatcgccttcgtttcgtcgatgcaggtgcagagcttcagaaagctcaaaggcttgggctttgcgacgacgatgtgtaccggcaatctccgctcggcgatggaccggctgcactgcgcctttcgagacaaaagccgggaagagttaatcaacgggctgcgctaccttgggattatcttttcgtttattgttggtgtcttcatttcttatcgtctgacgcggcgctggggcatccacgcgatgccggctgcggtctgcgtgctggtggtggtcttcgttctgcttgtccgcgaaccgcgggaatttgaataacaggtaaagtctagattaaatcgaaatttacaataaaaaagcattatttaacccgtgtttttgttataataggggcggttaatacgcatagaacaaccgcggaggcgaaacatggaagacaaacagtacgaagaattacttaaaaaaataaaagcccgacagccgctcaatacggaaatcctcgatgaggtcatgcattcggctgacatcgtctctgtgctggatgaggatgagattacagacgaagacctgaaatggtttttcagcgcgaacaataaggaatttttggccgatgtccttgaggatgcagatgacgagctgcagtcccgcgtggtgcatcagctggattacgccgacatcatcaaaattttctcttacatgccgaaggacgaaatcgccgatattttaggcgatctacccatcggccagcgcaaacagctgctcaacatgatgaaggccagcgacagccgcgaattgcgcgtgctgctggggtaccgcgacgatacggccggcggcctgatgaccaccgagtacatcgctttgtatcaggatttgacgatgtatcaggcgctagctaagatccgggaaattgccccgaagacagaggtcatcagtacaatttttgtattaaaccgatcccgccagcttgttggctgggccgatctccgggatattttgtcggcagatccgggcctgacgatcggagatattatggattcccacgtcattaccgtcgatccgctcatggaccaggaagacgtcgcgcaggttgtgagaaaatacgacttaacggcgctggcggttgtcaaccggcgccattcccttttgggcgtgatcaccgctgacgatatcatggacgtcatggtcgacgaacagaccgaagatatcctgcacatggggggcgtttccggacaggaagaaatcggcggaccgattgccgtttcgatcaagcgccgcctgccttggctgattgtcaatcttgtgacggcgtttatcgccgcctcggccatttccctgtttgaaggggttatcgaacaggtcgtggcgctttcctccatcatgacgattatctctgggatggggggcaacgccggttctcagacgctttccgtcgcgattcgcgggattaccctcggcgaaatcaacttaaaggatgactggaagctggtgttcaaggaaattttgctggggctgttagacggtgcgttgatcggtttgattaccgggatcatcgtgtcgctgcgctacggcaacgcctatttgggtgtggtgaccattttagcgatggtcggcaatctgatcatcgcgggcatcggcggctatctgattccactgattctcgaaaaagccgggcaggatccggcgctgtcctcgtcgattttcttgacgaccctcaccgatacctttggatttttcatctttctgggcttagcacaattgtttttaccgctgttgacataaaaacaatgtcaaaaagacagcagacactgtaaaaagaagtaaaaataacgtgaaaagattgaatccattttgaaaagttgataagatagggctataaaataatagtgaggacagatgtgaaatgaaatctttgacggatcagaaaaagcagcagggagcaaaagaaaaaaaacgttttgtttcgccctccctgtctttaagtatgtccttcaaaaggcagaacaatctgctgcacatctttctgcacggcaagtggcacggcaaaaagacacagatggcccagaaatatatttacaggcgcgacggcagcctgcttcgggttttagtggtctggtccaatgaaggctcggagaaaaatgcgacgggcctgctgtggcttcacggcggcgcgtacgcctgcgggctgcccgaacaggattacggcctgatggacagtttctgtgccgacggcaaatgcgtcgccgttttgccggaataccggctgtcgggggaagcgccttatccggctgcgctggaggacgcttatctggcgttgtattggatgaaagagcacgcgaataccctcagaatcaacccagatcagctttttgtcggcggcgaatcagcgggcggcggactggccactgcggtttccctttacgcgagagaccgccgcgaggtatccattgcctttcagatgccgctttttccgatgattgacgaccagtatctgaaggaaaaggccaaatcctacaggctcaaggatcacgaaaaggcgaggctgaagggatgggaaggctatctaaaaagctttaaaaatgccaatatcattcccatttacgcgatcccggctcgggcgaaaattttggatcatctgccgccggtgtgcaccattgcgggcaccgagggcccgttttattacgaaacggttaaattcgccaagcggctcaaggcggcggacgttacggtttatttcagaacctttgactgctattttaaggtatacaattggcttgaatttccggaccgtgcccatcgcgaagcgagacagttcgttgtcgactgtttccgcagtgcgcagaaaaattattttgcgccgcagccggccggcatcacccgaaaggcgcgcaacattgcgagacgccacgccttttttaaccgccggcgccgcaggatgaagcaggaaaacgcaagcgttaagccttcgtccaatgtagacaatacagcaacgggtgcggccaaggatacggctgcgaaagcccaagtgaaaaaagaagaggaaacaagttcatgaacgaagaaagaggagaagccatgctccgcatgcacgatcatcgcgaggtgacgggattccgtccggcgatcgcctatcagctgctgccaggggatccattgattcccgcagacaacgcgatgcgcaagaccattatgatgaacgacgaactcatcgaaagaaatattgaacaaattaagattcatttttaatcgtgatgaaaaaagaacagccaaaacttaaattaatcgtagggcgcaaccagggcaccatcatttctcaggaggcccagagacgcctcgacagcagaatcaacacattaattaggcggatgcaggacccgacggagtccgaagatacgcgggaaaaggcgaaagacgcccttaaccgcctcatccgaaaggaagagatgaaaatccagcgcgttttcgaaaagggcgatgaggatgcatctcagcttcagtggaacatcgcgatggcatcaagggatcacatcgctgttgatgaaggttttctgtaccggcagatggagcggatcaggagcgacaacgaatcggcgcagatgctgctcgagaatctcgggcgggccagatgggccataaggcggtgggaaagggcgcacctattgagtgaagatggcctgaaagttaaaagcgaaacgccgtaatgcgtacatataaaacaccccggcaatgatcgtagtttttttacaatcattgccggggtgttttggtttgttttgtgatgaaacttaattggattcgagggagaagagcgtctcctcgtcgttgacaaaaagattgaggttttccatttcggcgtaggccttaaagaaagccgtcacccgcgaatcagcattgtcgaccgtgaaaaacagcccgcttccgcaggtatcgtggacgtgcaccgacacgtttaaatgggatgcgatcacttttttgatgcggctcgcatcgataatggatattgctgccatattgatataacctccaatttaattcgattataaaaagaattaaaaggactgtcaaggcagaatcttgcgctggtgttgcgaaatcatggcgggacctttataatataattataatataaaaacaataaaagcctgaaatgatgaattcaacgaaaggagtgtgaatcatgatcaaaatttttggcatggaacaatgtccgcactgcagaagatgcaagggcgaatttgatgggcgggccattgcttatgaatttgtggatatttcccgactggaaaatttaaaaaccttcgtcaagctcagggacacccagccgacctttgaaggcattcgcggaacggaatcgatcggcatcccagcgctggtttttgaagacggcagtgtccgcagagattggcaggcttacttaaatgaagtctctggtgacgccgacgatacggatgttcccgaggaatcggaaggcgccgcgtgtgctttagatggaagcggctgttaggcgtaatctcacttgacaataaataacaaattgagcaaggcggtatcgtcttgcttttttatgtggaaaaataatatttttctttttttataacgaaaagtcgtataaaataaaaagagttattaaagaaagacttaataaagaaaggggttatggtatgttttatggaacctggtggtcgttggtgccgccactggtcgcgattattttggcactggtcaccaaagaggtctacgtgtctttgttttgcggcgtgtttttaggcgctttgtttgttggagattttcatttgtggaaggcctttaccgttttcctgaatacgatggtcaaaagcatcgatttgaaaatcattattttcgatgtgctgctcggcatgatcgtcgttttaatggggcgaagcggcggtacggcggcctacggacgctgggcgacaaagaaaattaagaataaacgtcaggcggaaattacaacgagtctgctcggtgttttgatttttgtcgacgactatttcaactgcctgactgtcggttcggtcatgcgtccagtcaccgataaattcaaggtgtcccgcgcgaagctggcctacatcatcgacgcgaccgccgcaccggtgtgtatcctcgcgccgatttcatcttgggcggctgcggtgaactcctacgtgcccaagggcagtgtcatcaacggctttcagctttttgttagtacgattccttttaatttgtacgcgattttgacgctgtttatggtgttttacacctcggcacggggcattgatttcggcttaatggcgaagcatgaacgcaacgcggaaaacggcgacttgttcacctcctttgccgatgaatttaaggatgaaatcgaacaggaacagaaaaacgtcaaccccaacggcaccgtgaaggatttgatcctgccgatgatcgtgatgatcggtacagctgtcggcgcgatgatttacactggttttttgagcggcgctaaaaacgcggcggaagcctttgccaattgcgacgtcgaaacggcgctggttttctcgatgatcgtgacgatcgtgtttatcgcactgctttacttgccgagaaagctcgtttctttcagtgaaatgatggaagcgctgccggaaggggccaaaatgatgattccggcgattttgattctgacctttgcctggactttaaagggcattacagaccgcctcggcatcggccaatttttcagcacgacgctgaacctgtcgacgactggagttgccttcattccagtgattatcttcttcatcgcaatcttcatctcgttttcgaccgggacctcttggggaacgttttcgattttggtgccgattgccatttcgattttcaataatcacaataccgaaatgatgatcattacggtcgcggcgattttggctggcgcggtgtgcggcgatcacgtctctccgatttcagatacgacaatcatgtcgtccgctggcgcacagtgccaccatttgaaccacgtctcaacgcagctgcagtacgcagttcccgtcgtgctgtcctgcggcgtcggctttgtcattgccggtttctgccggaattggtggctgccactgatcgtcggggtatgtgtgctcttgggaatactgacactgattatgaaatattcaggcaataacggcgaaacaatttcaaaatttgaacgccgactcgaaaagggcaatgtctaaaaggtaaaacttaaattgaaaaagaaattgaccgtgccgttgatcgaccaaaccgaccgctggcccaccgggtgcgaatcggtatccgccgtgatggtactgaaatatttgggaatcgacatctcagtcgaccgatttattcaagattttttgcccaaacgtccgatgtacttgacaaaaagcgcagcattagtcggtgacgtgtgtatcggcaccggtccggatcctgacgaatattttgcgggcgatccctacagcgaagcggcctttggctgctacccaggcgtgatcgtgaaggcctgcaacgccgtttttaaaagcttcggcgcgcctttgcgcgcggtggacgtgacaggcgcaggcgccgaggtgtaccgccgatcgatcgacaatggaatgccggtgatttattgggcgaccctctgctttgagccggccgtgtacgggccgaaatggcagatcgcgggcactggacgtacgctgacctggcatagccgcgagcactgcctggtcttgaccgggtacgatgacgaaaacaatttgttttttttcaacgatccgtgggaccaccacggagagattgcagtttcgcaggccctctgcgaaaagcggcacctggagcagggcggacgcgccgttttaatcgaacagataaaaaaattcgtctaatgatgataagattttgcctcgcagactattcgcggcggaacgtgttaaaataagtctaagatgaaaggggactaacaacatgtgtaccgcgattagttatcagacgaaggatcattatttcggcagaaatcttgatctggaaatatctttcggagaatctgtggtggtgacacctcggcattatcattggcattttagagaagcagcagaccgcgacgacagctacgccatcattggcatggccacagtcgaggagggtatgccgctttactacgacggcacgaacgaaaagggcctcagcatggccggtctgaatttcgccggcaacgcccattatttcagtcaggcggaagccggcaaaaacggcatcgcctcctttgaaatgattccgtgggtgctgggacagtgcgcggacttggacgaagcgaaggcgtgcattgaaaatttgaccgtgctggacacgcggtttaatgaccgcctgccggtgtccacgctacattggctcgtggctgacccgtcgggggcgtttgtcgttgaatccgtcgcagacggtctgcatatttacgacgatccagtcggcgcgctgaccaacaatccgccgtttccgacacagctctttgggctcaacaattatcgtcagctcacggcgggggtgccggaaaaccatttcgcgaaagggctcgacctggatttgtacagccgcggcatgggcgccatcggtctgccgggggatttgtcctcggcgtcgcgttttgcgaaggtcgtgtttacgaagctcaattccaaatgcggctcgagagaagaggaaagtgtcagccagtttttccatattttgggttccgtcgaacagcagcggggctgctgcgatctcggcaacgatcaatacgaatacacgatttactcgtcgtgctgcaataccgataccggcgtttactattacaagacctacgacaacagccggattactaaggtcgacatgcaccgcgaagatctggacggtgataaatggcagagctatccacttttaatgggtgaggacattcaagcacaaaattaaagtaaaattaaaaagtctttcagatgaaattcattctgaaagacttttttgttgttaatggaagcgtttggatttggcgggaatgcccagctccgttctgtatttggcaacggtccgccgcgagatctcgacgcctttggtgctgagcttttctgtgatggcttgatcgctcagaggcgccatcggatcctcttcttgaataatctggcgaatagcctcgtgcaccgcgtcgacagagacgcggctgtcacccggaaggccggcggcgaagaaacgcttcagcgggaaggtgccccgcggcgtgcgaatcgctttgtctttgacggagcggctgattgtcgaagggtgcaccccggtcatgtcggcgatttggtccagcgtcatcggcttgagcagtttagaacggcttaaaaagtaatccttttgaaattcagcaatggcggtgatcgtttgagtcagggtgcgccggcgcatgtcgatgcagtccatcaggaagcacgctttgttgaggccattttcaaggtaggcctgcgcctgctcggagtcagtctgttttaaaagattgtaataaaacggactgatgtgcaggtggggcgcgccgaggtcgttgatgtgcacggtgagctggccgtcgatccattcgatgctgccgtcgggtacgatgtaggcgttgggctcctccttgtcgaagacactgcccgggcgcgggttgagttccttgagcatcattttgaaatcggcgatgcttttttccgtgtgaccggtggccttagcgacctttttgaaagcgttgttcgcgatgtccagcagccagtcgtcgatgagcatttgtctttcaggcgtccacaaatcgttggctttgagctgaaggcttaggcattcgccgatgccgcgcgcgccgacgcccggcgggtcgaaggtctgaatcatcttcagaacggcctcgagctcggagacggacaggccgagatcggctgcagcctggtcggcgtccatccacaaatatccgtcctcgtcgatgtgatcgatgatatatgcccctggcttctgggggatgtcggtgcgcaggcgcagctgcagccgtaaataaacgtccagagaaatgtcgctgtggcgggccttctgaagcgggtccggcagctcggaaaaatccgggcgggccagatcgcccttgatcgacccgttctgcaggctttcgtagtattcctgccaatccattgtatcgctcgccgcgacgtcggtgtctggcgctttgtccatactttggctttcggcgctcagcgggtcttcatccatagacagcatcgggttttccagcatcgcctcttctacagtatttttgatttgtaggctgttcatctgcagaatctcaatggcttcgcgcattttcggcgttaaggccagcttctgcgatgttttgatatcgagatccaaacggttaaatttcatatatttcctcacttcttctacttttaatttatcacatcacactgtaaaaaaaaccaaatacagaaaatttgaatattatgacgaagtattggataatagaaagcgtatcattaaattgatcgaggtttaataatgaaaatatttttaacgcttgtatatgtttttgttgtgctggccgcggccaggggattgtggtcgttgtatttgtggtttaaaaataagaaaaagaaaaaatagctgacgtacggagagggaatcccagtccgactattttgatttgcatataaatcggataaaaccatagaaccaggattcaaagcgatcgtgcgctgtaaatctcatacttttttacgacaaatttacgacaaaattacgacactttttaaaaagaagtgtagaaaaataatcttcacacttaaatgcataaaaaaagaaaccgccgaattcagcggtttctcgtctgttcaaatggtggagatgaggggattcgaacccctggccttttgaatgccattcaaacgcgctcccaactgcgccacacccccaaaaggaacgataattatattaacgtaattacaaacaattgtcaagaaattttataagattttattaaattatctgggcggggtttaagttcaaattgaactccacaaaaaaatcgtctataatatttacaattatgatcaattgggcgggatgctacgagcccttaaaaataaaggagaactgatccatgaaaaaattaacctgctctgtcgagtcgagccacaaaacagaaatttatattcacaatggcctgcgtgaacatctttacgaattaaaagaccaattcgcaaaatacaacgccattgtgatcattacggataaaaatgtcgcaggccattatctgcgcctagtcgtgcagcagctgaaatcttttggcggcaatgtgtattcgatcgtgatcccagcgggagaagcgtcgaaaaatttaagccaggtcgaaagcatttactacaagctcgcggaattcaacgtcacccgttctgacgcgatcgtcgctttgggcggcggcgtcgtcggcgatttggctggctttgcggcggcgacttatatgcgcggcatcgatttcttccagattccgacctcgctcatcgcgatgacggacagctccgtcggcagcaagaccggcgtcgatttggacgtcgggaagaatttggtcggcgctttttacccggcacaggccgttttcgtcgaccctgaatgtttgacgacgctggaagaccgctacttcatcgacggcatggccgaagttatcaaatacggctgcatcgcctcgagcaagctcttcgtccgcctcgccggctatcagtatcaggaagacctgcaggctgacatggaggacattgtcgctaaatgtctgcagatcaagcgcaatatcgtcgaagaagatgaaaaggaatcgggcgtgcgccgcattttgaatttcggccacaccatcggccacgtcattgaaaattatttcggctacgaaggatattcccacggtgaaggcgtcgccgtcggtatgtacaacatcacgaagatgagcgtgcgcgaaggcatcacctcccaggaagatttggacaacctcggcaaaatgctgatcaaatacggtctgcccatcgacatgcccgatatggatttgaaccgcgttcaggacatcgtcgtgcacgacaagaaattcaccggggacattttgaacgtctgcgtcatgccgcgaatcggcaccgcggaaatcgtacgggtccagaaggataaggccatcgatttgttcacccctgatgcggttgaatcggaaatgccagcgccgcttgccgacgaacaagcttaagccaggcgcatcgatggacatcacgatacaaccccacccaatcggcgggacggtgcaggtgccgccgtccaagagcctcagccatcgggcactgatttgcgcggcactggctgacggcaaaagcgtcctcgatcatctgctcgtctccgaggacatcgtggcgacctgcagtgtgctcgaggcattcggcgcgaaaattgaaaaattaaatgaagacggctcgaagctcaaaatgatcggctgtggcagaccctcagccgatcatgtcacgcttgactgccacgaatcgggctcaacggtccgttttctgatgccgctggcggcccttgacgccgcagaggtgacgttaacagggcggggaaggctgccgaagcggcccctcgagccctatcggccgatttttgacgcttcacaaatcaactggcagacggcgggcgatgacgcgctgccgctgaccttgagcggggcgctgaaacccggcgattacaccatgccgggcgacgtctcgtcgcaattcatcagcggtctgcttttcgcactgccgctgttaaacggaccgtcgacgctgcgcatcacaacagcgctcgagtcccggccatacgtcgacctgaccctcggcgtgttaaagtattacggcatcacaatcgacgtctcggaggacggccggttttacgcgattccaggcggacagcattacaagccggcggacttcagcgtcgagggtgattattcccaggcggcgttttggttcgccttcggcgtcaacggcagggcggtgcgctgtgagcatctgccgaaaacctcccttcagggcgacgcggcgatcattccgttgattcgacagatgggcggccagatcgactggcaggacggcgcctgggtcgccaagccttccgcgcgccacggcatcgacatggacgtatcccaatgtccggatctgatgccgattttggcggtgcttgcggcgacggcggaaggccggagtcgaattttgggcgcggggcgtctgcggctcaaggaatcggaccggctgagcgcgatggccgatctgctgacgcgtttgggcgtgcgggtcgaagaagcgccggacgggatgacgatctggggcgcagggcagctcaaaggcggtgagatcgacgctgtcaacgatcaccgcatcgcgatggcggcggccgctgcgagcgaatgctgcagtgacccgctgaccattcacggcgcggaggccgtgcgcaaatcatatccggatttttggcaggattttagacaaaacggaggacaaacagcatgacatcctgttggggacagcatatccatttatcgattttcggagaatcccacggcccgatgatcggcgccgtcattgacggcctgccgtcgggcttcaccattgacgaagctcaaattgccgcagagatggaccgccggtcagcccgcggcaaggacttggcgacgccgaggaaggaagcggaccgggtgcggatcgtctcgggctattttaacgggaaaacgacagggacaccgctgactgggatcatcgaaaacggcaatacctattcgtcagattacgaaaagacgaaaaacaaaatgcgtccgggccacgcggactacacggcctttctccgctacggcggctttcaggattaccgcggcggcgggcatttttcgggccgcctgacggcaccgatggttttcgctggcgcggtggccaagcagatcctcgcgcagaaggtgccggccctttccgtcggcagccgcatcgtccagatcggccaggtgcgcgattcgtcggttttagggccaaaggattacgcggcccttcaatacgccgacgcggggtttccagtggtagatgggacgctcaaggaggcgatgattcgggaaattaccgaggccagagcgcagaaggattcagtcggcggcattgtcgagggttatatcaccggcgttcccggtgggcttggctcgccaattttcgacaacgtcgaaagccggctggcgtcgtttctcttcgcgattcctgcggtcaagggcgtgtcctttggcagcggcttcgacatcagcgggatgcggggctctgaggctaatgacgcctttcgaatggaaaacgggcacgtcgtgacggcgaccaaccacaacggcggcatcaacggcggcattaccaatgggatgcctattgtattcagggtcgcctttaagccgaccccttcgatcgcacagacgcaggcgactatcgatatggccacgcgcgaaaacaccgaattggccattcaggggcgccacgacccgtgtatcgtgattcgcgcgctgccagtggtcgaaagcgccgcggccctctgcctgctggatttgatgatggaggcaggtggacgccatgagtgagctggatttatccgagattagagaagaaatcgaccgtatcgaccgccagatgatcgaattgttccaaaaaaggctggaatgcgtttgcgacgtggcgcgctacaagcacgccaacggtctgccgatttttgatgagacccgcgaaaaggccgtgattgcgaagcggcaggcgcaggttgagccggaaatcaagacggcggtcgggcagtttatgcaggccgtaatggacacgtgcaagcttgtcgaggcagatgtcattgatcagttggaaaagtcccattgattggcaaagaatgacaagactttttacgctatgatcggtatatatgtttaagatgaaccattacgttttgagaggacaacaagatgattaagaaatttaaaaaagtattgatcgccaaccgcggcgaaattgccattcggattatccgtgcctgccatgagctgggcatttcaaccattgccatttacacgcaggaggatgagatgtcgctgttccgcaccaaggcggacgaagcgtacatgatcaactccgcgggcgggccggttcaggcttacctcgacatggacaagatcatctccctcgcgctggaaaagggcgcggacgccatccatccgggatatggctttttgtcggaaaatgctgaattcgcgaaaaaatgcgaagaagccggcgtgacctttatcgggccaacccacgaaatgatggaacaaatgggcgacaagattcagtccaagaaaatggcgagcaaggtggcggtgccgacgattccaggtgtcgaaaagccgattacgtccaacgaagaagcgattgaatttgccaagaaggccggctatccgattatgctgaaggcagcgtcaggcggcggcggccgaggcatgcgcatcgtccgggaagaaaaggatttattaaaggaatatcactcggcggtcagcgagtccaccaaggcctttggcgacggcacgatcttcatcgaaaaatatctggaggatcccaagcacgtcgaggtgcaggtgctgggcgacaagtacggcaacgtggtacatctgtacgaacgagactgctcaatccagcggcgcaaccaaaaggtcatcgaattttcaccttcggtctttttgacaaacgaacagcgcaaggcgatctgcgatgacgcgatcaagcttgccaaatccgtcaattactgctccgccggcacaatggaatttcttatcgacaagcaggggcatcattatttcattgaaatgaatccgcgtattcaggtcgaacacacggtaacagaattagtgacgggaatcgacatcgttcaggcgcagatattaattgcggaaggctatgctctcgactccgacgccattcaaattcactctcaggatgaaatttcgacgcggggctacgcgattcagtgccggatcacgacggaaaacccgaagatgcatttcatgcccgatactggccgaatcgatgtgtaccggacagcgagcggcccgggaatccgcttggatggcggcaacggcttcaccggttcggtgatttcgccgtattacgacagcctgttggtcaaatgctccgcctacggcagaacctttgaggaaacccgaagaaaagcggtccgcgccttgaaagaaacgatcatcagcggcgtggaaaccaataaggatttcctgatcaatgtgctcgaacatccgattttcaagtcgggcaagtgtacgacgaaattcatcggcgatcatccagagctgtttgaaattgaggacaaaaagagtccggaaatggatacgatccgttatttcggcaacatcgtcgtcaacgaaaccttcgggaaaaagccagtgctttcggaacccaaggtgccggagctgccgcaaggcgcaaaaattcagtctctttcgggcacgaagcagattctcgatcagcgtggcgcggatggtctcgtcaattggatcaaggcgcaggatcggctgttgatcacggatacgacgatgcgtgacgcgcaccagtcgctgatggcgactcgcgtgcgcacccgggatatggaccgcatcgcggcggacaccgcgtggtacgggcgggatctgttttcactggaaatgtggggcggcgcgaccttcgacgtggcctacaatttcttgagggaatcgccgtggcatcgccttgatctcctgcgggaaaaaattccgaacatctgtttccagatgctgcttcgcggcgccaacggtgtcggctacaagaattatccggacaacgtgattcgaaaattcgtgcagcagtcggccaaatccggcatcgacgtcttccgtattttcgattccctgaactggatggaaaatatgaaagtggccatcgaagaagtactgaaggcaggaaaagtcgctgaagtcgcgatgtgctacactggcgacattctcgatacgacgaagactaagtacaatttggattattacgtcaaaatggcgcacgaaatcgaaaagaccggtgcgcacattctcgcgatcaaggatatgtcagcactctgcaagcctcaggcggcgaggaagctgatctccgtcctgaagagcgaggtcaaaatgccaattcatttccacacccacgacacagccggcaacggcgtggcggccgcgctgatggcggcgtacggtggtgccgatatcgtcgacgcggctttggccggaatgagcgggctgacgtcccagccgaacttgaattccatcgtcgcggcgctcaagcacacacctttcgatacagagcttgacgatcaggatcttcagattctgtccgattactggacggatttgagaccgacttacagcaaatttgaaagcgggctgaagagcagcagtacggaaatttacgacatggaaattccaggcggccagtactccaacctcaaaaagcaagttgaaagcttcggattaggccataaattcgacgaagttaagcacatgtacaaggtagccaatcagctgctcggcgatatcgtcaaggtaacgccttcgtcaaaggtcaacggcgatttggcgatcttcatggttcaaaacaatttgaccgcggacaatatttacgaaaaaggcaaggccttggctttcccgaattccgtcgtcgatttcttcaagggcatgatcggacagccggtcggcggctttaacaagcgccttcagaaaattgtattgaaagggcagaagccgatcacggttcggcctggatcgctgattccgccggaagatttcgatcaggtccgcaaggattataagaaaaaatacgacatggatttggacgaccgccagctgatctcagcgacgatgtaccctaaagtctatcaggaatatctggatttcaagcaggattacggtaatctggagcgcatggaaagtcacgcgtttttctacggccttagagaaggtgaaaccaccgaagtggaagtcggggaaggcaagaaaatcatcgtcaccctaatccgcgtcggcgaaccagacgaagatggggaacgcacagtgacctttgaagtcgatggtttccgccgccagatcaaggtgcaggataaatattcgctgtcgtctcagaaaaaggaccgcatgctgaaggcggacccgaacaatccaaaggaaatcggctcggctattccggggacggtgctcaaggtgcaggtcaacgaaggagatcaagtcaagaaaaatcaagttttgacagtggtcgaagcgatgaaaatggaaacagagattgtctcgccggtcgatggcacagtcgatacgatttatgtgtcggaaggacagactgtcgagtcgggcgaattaatgatgaaaatcaagtaaaaatagaagacggggatccgaaaggtgaaccgtctttttgcttttagagcgcgaagataaaattttgcaaaaaaataagaccagtcttgctcattctcagagattttacttccttgatacgatgcaagctggtctttagatctcacttaaactttgcacttccggtggtccatcctcctttcgttagatttaaaagacgatgataaatttcttaaacctatcaaccaccatgaccttccgataaatctgccttactaaaccgctttccaattaaatctcaattaattgcctaaccttctgtttaatacgctggattttggtaacgatcgggttaatatttatctcattactcttttatttaccatctgttcttttatttgtctatagtatagcaggataaagtggaaatgtaaaggtttatttataaaaattttgaatgaatttaataaaaacattacatttgataattattatacttagactttttaaattacacaaacgcggtatgtattcaagttcatttagtgtataataaaatacatcaaacagaatcaatcaaggaggcctcaatggaaaatttttttattacactgagatcgcagttttccttttctaatgtcattgagatcctcgtcattacttttttaatttataaaatactcatgtggattcgcggaactcaggccgaacaggtcgccaaggggttgatcatggtgctggtcctgattccgatcagctcctggcttgggtttacaacgttaaattatattttaaacattgtcgtgacttgggctgtcatattaatcgtcgtcgtgtttcagccggagctgcgttcggctttggaacaattggggaataataaattgtttgaccgtatgttcaggtcgtccggggagcggaaaatttacaacaacattcaagaaattgcaaaggccacgaccgacatgtccgacgtccgaatgggcgcgctgatggtgtttccggtgaatactggactcaaagacatcgaagcgacgggtatcaagctcaatgcggacatttcaactgaattgatcgaaaatatatttacgccgaatcgaccgctgcacgacggtgctgtgatcatcgatttgtggagcggcaagattaaaaccgcgggctgcctgctgccgctgacggaccgcaagacgctgaactcctctctgggtacgcgtcaccgcgcgggcattggcatttccgaaaaatcggacgcggtcgtgctcatcgtatcggaagaaactgggaccatctctgtggcagaaaagggcgtgcttcgccgcggattttcagaggatgagctcatcgatctgctcaccgagcgttttatcaacatcgatgaggaagaggaggttgaagacgacctgccttacgacgaatacgaggatataagcgatgatgccgaactggaaagtgatctgattgatcaggaagaagagccagcggcagacgcgttagacgatggggaatcgactgatgaagaaaaataataaaacgggaagtgacagaacggcgcgcatcgtgcggctgattatcgcggcatgtctcgccgtctttttatggatgtacatcaatggcaacgacatcaacatgatcacacaggagatcaacaatattccggtgacgctgatcaacacagaaaagctttcgtcaaaggggctcgtgctcaccgagcagaagaattactttgtcaatattcgggtccgcgggagcgaacggaatgtgaacactttagacgcttcacagatcaccgcgacagtggatcttgcgggagtgaagggaccgggaacctacacggcggacgtcgtgattcagggattgccgaattctgtcatcctgcaggagacacagccttccgagctcaatatcaaaatcgacagtattcgccataaagcccacagcgtgacgatcaacaccagcggaaagccggggaacaatttgtcggtcgtctcggcgacgactactgatcaggtccgcgtggaaggaccgagtgattctgtcaataaaattaaggcgtgtgtcgcgacggccaatgtccaggatatgacagacgatacggatgtttacatcccggtgaaggcggtcgacaaaaagggcaatgtgctttccgatgtggaatgcaagccctcgatgatcaaggcgagcgtcaaagtcggcacgaccaagcgcgtgaaaatcaaggcgcccaaaacgacgggcagcgtggccgacggctacaaggtcgccaaaattacagtcagtcccaagacggtgcttctcggcggcaaggcgtcggatttgaacagtatcaatgcggtgcgcccgagtacagtcgatttaagcgggttgaagatcagcacgacggtacagaaaaaattgaatctgccttcaaacgttacgaatatggacggcagcgccaacgtgacggtgactatcaaagtggaggcgctgacatctaagcagctgatggtcgacgacatcgaacagcgcaacgtgccagacgatctgacggtcacgaaaatggaaaacgcgtcggtaaccgtcaaaattgagggtacgagcagcgaattgtcgaccctcgacatcaaagatttaagcgcctggatcgatttttcagatgcggcagagggcaccggatcctacgacattcaggtcacaaccgataaagggacgatcaaatctgtttcgccgtcttccacttcggcgaccctcaaatcgaaaaattaataaggtaaaaattatatatggataaattcaacaaatcaaagatttggaaaaacaaaaatgttcggagagcgattccgctgtgtattgccattctcttttatctgatcatgactcatctcgatctgatcggaaggggcatcgcgtttcttgtcaatttcattttgccggtcatcgtcgggatcgttctggcttacatcatggacccgccaattcggaatatcgaaaagaagttcagtgaacgcggggtgaatcacgcgaggggaaaggccattgcgatcgtcattgtgatcatactcgtctcgctggcgctgctgatcattgcggtggtgccgcaggtcctcagcagtgtagtgaaatttgcgacgagcaaaacttcctatcacggggcgctgcagcagtttgttgacaatatcgcaaaacgccacgtcgatatgaagtcggcgtttaccgcgatcgacaacatgctcgacaaaatgcaaagccaggttcaagatcgattagtttccggctccggctccggcggaaaacacgtgctcaattttattatcgattttattttggccatctattttctggcggacaagaagcgcgtgcagcgcaacgcgcgcaattttttcaggctttcgatgcgggacaccacctacgtcaaggtttcatcggtctggaaacgctgtgaccgcatttttatcaaatttttattctgcgaagtgatcgacgcgctgattgtcggttgtgccaacgccgcattcatgctgatctgtcaaatgtcctacgtgccgatgatttccgtggtggtcggtttgacgaaccttgtgccgacctttggaccgattatcggcgctgtcgtcggtgcctttgtcttaatgatgaacaatccgatccacgcgctgctgtttttggcctttacgggtatccttcaggccctcgacggttacatgatcaagccgaagctttacggtgacacgctgggtgtgccgggcatttggattttgatcgcggttgtcattgggggccgcgtacttggcatgtggggcatgctgctggccattccgattgtcgccattctcgacatcgtgatccgcgaaaccctgctgccctttatggaagaaagaaaaattaaacgggaagtgcgggcggcagaacgcgccgtgcacgataccgaggaaatggacgcgctcgagctgctgatggcgcttcagaacgatacacaggaaaaagaagaataatcacgcataataaaaataacgatcaggagaaaatctcctggtcgttattttttgcttaaatgcgattattttttcatgttttcaggcttttctggaccgatgtggttgatggctgaaaccaatgcgcgaattgacgcgacgatgatatcgttgtcgatgccggcgccccaaacttcgcggttgtcgttcagagttaagccgatgtacgcgacagcacgggagctggagcccctttcgagggcgtgttcgctgtaggccaaatctttaattggcgtgtggatgtgctgaatgacggtgttggtaaccgcatcgatacgaccgttgccgatttcgctgtaatcgccgatatcgccttcgttgttgattgtcaaatgcgcgcggattctgccatctggaagctgttcaaaatgcgcagccggaatgctgaagtaatcttccttgttgacgtagtgatcgttgaaaatctgatagacttcctttggctgaagttcgcggtgtccgtggtcggatacgttcttgaccagattgcgcatgtggtcgcgcattttcttcgggaggttgaagccataattgtgttcgaggatgaagccaatcccgcccttgccggactgagagttgatgcggatgacatctttgtcgtactgacggccgagatcttcggggttgatggtcagatacggcacatcccaatggtgatcttcgctttcccgcgccattttcatccccttggcgatggcatcctgatggctgcctgagaaggcggcaaagaccaaagcacctgagtaaggctgacgttcgtagacgtgcatccgggtatcccgttcgtaggcttcgcagagctctggcagattgctgaagtccagctttggatcgacgccgtgggtgtacatgttaagtgccaatgtgatgatgtcgacgttgccggtacgttcgccgttgccgaacaaggtgccttcgacgcggtcagcgccggcgagaaggccgagctccgtgtcggcgacgccgcagccgcggtcgttgtggggatgaagcgaaagcacgacgttgtcgcggtatttcaaatgcttgctcatgtattcaatctggctggcgtaaacgtggggaagggataattcaacggtaaccggcaggttgataatggctttgttttcggctgttggctgccaaacgtcgaggacggcgttgcagacgtcgcaggcgtaatctacttctgtgccggtgaagctttccggtgagtattcaaattggaaattgccctgggtttccttggccaaatcgtttaacatcttggcgccgtccacagccagctgtaaaatttcttccttagattttttaaagacctgttcgcgctgctgacgagacgtggagttgtagaggtgaacgatggaatgcttgcagccgtccaacgcttcaaaagttttcttgatgatgtgttcccgcgcctgagtcagcacctgaatggtgacgtcgtctgggatcaagtcctgttcgatcaaggttcttaagaattcgtattccgtttcggatgcggccgggaaaccgacttcgatttctttaaagccgactttgactaaatatttgaaatagtcgattttttcttcgaggctcatcgggatgatcaaggcttggttgccgtcgcgcagatcgacggagcaccaaatcggcgggtggtcgatgtattctttattcacccaatccgtgcagggttctgggggcatgaaataatttcgtttgtatttttttggattcatcatttgaatagtcctcctcataaaagattaaatgcattgtttccataaaaaacgcctctatgccaaagcatagaggcgatgtcggattcgctgtaccactctaattcacattttattgctgaataaatcaataatcataaaataaaatgccttgttgcagatacgtctttagatcgctaaagattatatcctcctgcgataacgggcaggacccggtgcgcctaatagggaaaatccgttcagccttccgctctgaggccagttcgaaaatgttcggcagctgcttcacaccagccagcagctctctggacgcctagaattttttaatattcctcttcattgcgttgtgtttatcttagcggtaaaaaaacgagatgtcaagtaaaagttttgcataattcgcttttatctgaggttttgcatcgccgtgcacattttaaatttcatcaggtatgttataataaaaaaacaaaattcaatggatagagaaggaagattcatggccatatcttttattcataccggggatattcacctggaaaaaacttttcattttaagaatcagcagcgtgatttcggcaaggagcaccgaattgatctatggctgacctttgatcaaatcatcaataccgccgaaaaaaatcacgtcgattttctgattatcagcggcgatttattcgatacgccagatatttcgagcaaggcgctcaagcgcgtcgccgaaaaatttgctcatttgaccgaaaccgaagtggtcatctgtccgggcaatcacgatttttacacgccgtccgcgctctacgggctgatcgagtggcccaataacgtcacgattttcacgcagggtcaaatggaatcgaagtatttcgaagaaaaggagacccgcgttttcggcatcggctggacgaaggatacctacgaggcaatgccttttgacggcagccacatcgatttgtctgaaacggacaacaatattttggtgctccacggcgacgcctacaatcaaatttcgcagtacatgcccattgacttggagcttttcgattattttgattacgtggcgctggggcatattcacaggagcgaacggctgacccttcgcgcggcctattgtggctgtcctgagcccttgacctttaaaaatatcaatgatccaggcattttctacggccaaattcatcatcacagactggagcttcaaaagatcgagaccggcaaacggaaatttttccagaagacccttcgcgtgtcgccagagatgacgcagaacgacctgcttacggcctgttcggatttgggtgacgacgacagcaagcggaaggatttttttagaatttttttgaaaggatatgccggcgccgatatcgacgtggaagagctgagaatgcagctggcgcagatgttttactacgtcgaggtggacgacaagaagctgctgcccaacattgatgtggacaaactgctcgaggaaaatcaaaacaatatgatcgggcggttcatccaggaaatgcgccgcaacggggacaatccgacggctagaaaagcgctgtattacggattggaaggtttgttgaacagtgaggataaagggtgaaaatcaagacacttcatttaattgcatttggaaaattcaagcagaccaccattgagctcgacgacggctttaatctgatttatggccccaatgaggcgggtaaatcgacgattcaggcctttatcgaggggatgttttttggattttacaagccctatcggaagcgccgcacctacagtgaggcgtacgcgcaatacaaaccgctgtactcggatcagtaccgcggtgcgatgatttacgtcgatgaaatggggcgggaaatcagaatcgaacgggatttcttgaaggaacgggacggcgtccggctttttgacaacatcacaggagaggacatcaccgagactttcccttacgacaacatcacgaagcagtacatgcctttgggctaccagtcgatcaactcgtcgatctacaacaataccgtcaatttcaggcaaatggcgtcgaaaaccaacgcagatttggcgagggaaattaacgataagctcattgacatggccaacaacgacagtgacatttccgtccatcaggttatcgactaccttgatcagaagaaaaaggccatcggcacatttcgcgcgaccaaatccaattacggtatggccgtccgcaatcgcagtgatctggaggataagctggaaatttcagaggaaaaataccagaagataaggctcaaccagcgtaaaatcatggattaccgcgaggaagtgaaacgcctcaccagagagcaggaggacatcgccgcatctgaggaacggcagaaggtgcaggccatcgaggagcagaaggacaagcttcaaaaaatcaaggaagagggcgaagccctcgaaaaggagctggccgcgtatcaggcggacgcggaaaaatacaacatcgcgacctacaaccgtctgcagatgctggaggacgatcgtagccagctgaagcggcagatcgaccgttacgagcagcagattcgggacattgaccagcacatcgagagcggacaaaaaaaggcggaccgcctccgcgccaaggtgcgtcattataatgcgctccaggttgaaagagaccaggaagatttaaaacgcatccaaagccagtacagcaggacagagaaaaaagtcgaaagacaaaacgaaagtctgccgctttttgaacgtcatcccatttcggccggtgcgtccatcgcagggctggccgtcgggattttggtactgctgctttctctatttaatcccagtcatgtgctgccaaccggggcggcaattgggtttgccgtagccggcgcagtcatcgcggtgttttttggattggccttttacgccgcacactgccggtcagcccgtttagccgagacggcggcgagctttgatccgcaggatcggattgcgacccacttgtccatcttaatggaacggtatcacgagccgcgggatttagacgcgctgaaggcgcagatgaatgctattttggacgccttcgaccgtttgacggccgcagatcaggatttgtccaatttgaccgttcaaaagcagagcctcgaagcacaaatcgaaagctaccgcgataaaatcgacaaggatcagcaggccatcgaagaagtcttgaaaccgctggggatttccagactcgaggattacagacaagggctcgaccacgagcgcaaggctttggacatccaggcgaagatcgcggccaaccaccagctgtacagcgatttagagggcgaaaattacatccgcgtttcaagtgaatcggatctgttccagcaaggtaagcagcgtaaacgtgcggtgaaaagaagcatcgcgtcggctcagcgggaaatggcaaggctcgagggagaaaatcaaaccctcgcggatgaagtggactcgccggttgtcctccgcgaaaaaattgacgggattaacgcgcagattgccgcttatgaagaagaaatccgcgcctgcgatatggcggaatcctttttcatgcgctatcagaaagaaacccaccgcagtcaggcgggcagtctcaacgagcgcattggcaatattttgaaaaagatcacgaacaaatatcgcgaagtccgtattgacgataagctgaacatcaaggttttggatccgcagacgtcaaatctgatcgatctcaatcagctttctggcgggactatcgatcagatctatttcgcgctgcggttcggcattcgcgaaattgtcgacgaacagcgggtgctgcccttcattttggacgatccctttgtgcagtacgacgacaaacgcagaaaagaaggcatgctattcttgagccgagtggcaaagaacgaccaggtcattttgctgacgtgcagccaaaacgaaaaacagattttggaccaagaggacatcccgtacacgggaatcagtttgtaaaggatccgcagcatgatttcgtggctattatttaaacaaattgtcgttcttttcgtgatgatggggatgggctggcttgttgtcaaaattaagttcctaaaaccggaagattcgaggattttgtcagtcgtctgtttgtatcttgtcgtgccgtgcatgcagattgaggcctttcaaatccactattcggatacgattctcaatggttttcttctcgcgcttttgtccgcctgcatcatgcatgcgatgctatttagcatcacttacggggtcagccgtccctttcacttgaccaatgtggagcggggttccctgatctacaccaacgcgggcaatttgattgtgccgctggtgaccagtgtattagggcgcaactgggtcatttacgcgagtgcgttcatgttcgttcaggcgcttttgctctggtcccacggcaagatgatgatgcagcccggcggcaggattgattttaaaaaagtgtttttaaacgtcaatatcattgcgactttattgggtgtttcgctgtttctaggccatgtggaaattcacggcatcccaagtgatgtgttaaacggcgtttctcaaatgctcgggccgatcagtatgatcaccatcggcatggtgattgcaggtgtagattggggaaaggtctttaaaaaccgcagaatctacgccattaccctcatgcggatgatcggattccctcttctcgcgattttagtactcaaactcattcccatctatcaattggcagccaatgggaaaaagattctgctggtgtcgctgctggcggttgcggcgccgtcgggggtcacgattccgcagatggctcagatttacggcggcgatgcggattacgctggctcgatcaacgtgctgaccactctgtgcagcattgtgacgatgccgctaatgatctacatttaccaattatagggacgctgcggtgacgtaaaaaattgagacattatgacatcaacgaaaacgttttgattgacatttttcagtatatacgttaaaataatcacaataaagaataaatgaattgcgtagacaaaggcgtctgaagcaatagcttcagacgccttattctttattgaaatgatcatcggagagaaaagcgtctagctccagatgagaagattatagaaggaggtaagtgatggaaaaagctgtaaaaagtgaaaaaaaaggattccacatgtcgctgacgacgcagattttaattgcgacagttggaggactggttttcggaacgattgtagggggatgggcggccaatattaaattcattgggaccatattcctgcggttgattcagatgtcagtcgttctgctcgtgatgacctcggttgccggtgcggttggatccggaacgaagggtgtcggcaagatggccctgcacactttcaagtggattatcatcttcactatttttgccgctggtctcggcgtggtgctttcgatgctgattcagcctggtgtcggtgttaaattgacgggaacggttaaagcggcgaaggtgcaaaacacctcccttatcgacacgattactaattttgtgccgactaacgttttggaatcgatggccaacggagatatgattccttgtatcgtttttgctttgttcttcggcgcaggcatgatgaaatataagaaggatactggcaagacgaatattgaagaatttctcaaaggcgtcaacgtcatcatcacaaatatcatcgaatttgtcatgaagattgccccgatcgggattttctgcctgctcgccgatgttgcgggaagcacgggcctcaaagtgatcgtgccaatggtgaaattcctcggactgctcttaattggcgacctgatccagttcgcggtactcacaccgttgactgcggcccttaccaaaaccaatcttgcgaagtacccaaagaagtattctaaaatgtcgattatggcgctgaccaccacatcaagcgcggtctgccttccgactaagatgcaggatgaagtggaaaaatttggtgtcagtcgtcgtgtggcggactttaccggcccgattaccatgtcgatgaacagctgcggtgccgcacaatgttatgtggccgcgatcttcttcatggctcaatctacgggtgtcgcgatgacgccttatcagattttcatggcgattctgctgtcatgtttgatgtgcatggggacgatttctgtcccaggcggatcgattatcgtctacaccttcttggcttctacgatgggactttcgatggattccatcgccattctgatcgggattgactggttcgcgggcatgttccgtaccgttatgaacgtcgacgtcgacgtcatggttgccatgctggtctccggcaagctcggcgaactcgattacgatgtgtttaacgaaaagaaaaaagtcaattacgaagaattggcagagtaatctataactgaatcattaaattaaattaataccgccagtcgagcaatcggctggcggtattaattatgttacagcataaaaccatgattaatgcaaagggtgcttgggcattggcgcgaaaagagtactcagctggatcgtcatctcatggaacaagaataaggacgtgatgtccgcgcgtttgtgttataatatcatcgagtgttttaactttaaggaggtttggcaataaatggatatgcagatgaaattctatcggaagctgccgacaccacaggagctgaaggaagaatttccaatagatgatcatattaaacaggtaaaggaagaacgggaccagcagatcgcggatattttcaccggcaaagacgaccgctttttattgattattggaccctgctcggcagacaacgagtcggctgttttggattacatcaaccgtttggcgaaaacagcggaacaggtgaaggataaaatttttatcattcctcgggtttacaccaacaagccgcgcaccacaggcatgggatacaaggggatgctccatcagccggacccagacgcgaaggaagacatgcttgctggattgatcgctatccgcgaaatgcacacccgcgtcgtcaaggaaactgggctgacctgtgcggacgaaatgctgtacccggaaaaccaccgctatttgtctgatttgctctcctatgtggcggtcggcgcccgttcggtggaaaatcagcagcaccgtttggtcgccagtgggattggcattccggcagggatgaagaatccgacgtccggtgatttttcggtcatgatgaacgcgatggtcgcggcgcagaacagccatacattcctgtaccgcgggtgggaagtcaaatcgacgggcaatccgctggcacacgcgattttgagaggctacgtgaaccgttacggccggtcctatcctaattaccattacgaggatcttcaggcgcttctgaaggcctaccgcgaaaaaccggacctcaaaaatccggcggtcatcattgataccaaccactgcaattccggaaagaatttcctggaacagatccgcatcgccaaggacgtgctgcacagctgcaaacattccaaggatatccgcaacctggtcaaggggcttatgatcgaatcctacctcgaagacggccgtcaggaaatcggggaaggggtgtacggcaaatcgatcaccgacccgtgcctcggctgggaaaaaaccgaacgtctgatctacgatttggcggaattggtctgatatcaaactttcaactaaataaaaataacaaatccgctttgctgttgaaacacagtaaagcggatttgctgtatataagcatcgtgttcctttagggattttatagaaattataaatcttccgcgattgtgaagccgcggccttccaaaaaagtgcgggtttccggttcggaggtctttaaaatcgcaattggcgttgcggcctttcgatcgtaagaaatgtacaggtagtcgatattgattcggccttcgtcaagtgcattcagaataatgtgcagtgagccaggatcgtcaggcatgttgacggcaatgacgtcgtcgagacggcacatgtagccgtcgtcggtaagggccttcagcgcgtcttcagggcgatcgacgatcatgcggataatgccgtattccgccgaatcgttggagagcatcgtgttgatgttgatgtcagctgttttcagggttttcgtgattttttttagagcaccgcgtttattttcggtgaacagggataattgttttgtcattttcgccttcctatcttgcttgaatttaataatttgaatcagaattgtaaattattctctttaaaatcttttgtaaatattttatcataaatattaaagcataaaatcattttttcgggggaggatattatgaaggcgattattttatcttgcggcaatctgctgcctcacgtgagggcggcaaagaaaaaatgcggggttgatctgccggtcatctgcctgaatatgaatctgcacgccacacctaaaaaaatgcgccaggccgtgatcaccgcgatggaaaagcgcattcctaaagcatacgacacagttttggtggcacagggctattgcggcggcgtttgggaggatctgacctttgaccgcaaggttgtcatcccgcgagttgacgactgcgtcagtctggctcttcagacgacggaccactacaagccggatttaaagaccaagggccattactatttgtttaatattctgtcgggactgttttctcctaaaaaactgtttaaaaaattctcccagcagtacggcgaagccaagacgcaggagatttttgacgattggtttaaggattacccctatctcgatgtggtggtctccgatggcgaggacttgagcaatccgaaatatcaaagggaaatcgccgattcttcgaagctcatcaaggccgatgtggaatttgtatcgggttctaatcttttgattgaaaagctgattaccggccgatgggacgaacaatttatcgtcaaggaaccgggcgaacgcatttcgatgagcgatttctttgaccagaactggctggattttcaggaatcaaaataatgaagattacgattctcgcggtagggcatcaaaaatccaaagcccttttgaatttgcagaaggaatacatcaagcggctttcggcttttgccaaaacagaggtcgtggaagtcaaagatgaggctgacgtgcattccgaaagagaaggggagaaaaaacgcatcgtcgatacagaagccgagcgcgcgctgaaaaaaatcaacccaagagattttgtgattctcttagatttacacggcaggcaatgggattcaataggcttcgcgaaggcactccaatcgtggcaactgcgcacgtcacatttggttttcgtgatcgcaggttctctaggaccgggcgaggcgctccttcagcgcgcagatgagcggtggcagctttcaaagctgacctttacccatttaatgacccggattttggtgctggaacagatttacagagggttcatgatcggcgcaggacgcaagtatcataaataggttttttacgaaaaacttggaggacttttaaacaaaaaagaaagcaaagtaaactattgatcaaaataatgtatcaataataattgccccacttaatcaacgacatatccaagcacattttcttggcatctctatcttatcgcagtgaaggatatttaacgtggatgttaaatctcgaggaggtgacatgacctatgtcagataatgtacggactgaacgacttttccaaattcattatgtgaacggacgttttgctggagattggctttcgctcgacgagctgttcgacacgtcaatctatgatagttgcatggctgtgacatactctgttacaccggcgttcgttcatcaatatttccatgatttcacgcatgtggatattgttattggcgtgccggagacggcgacatgggaatcaatgcgcaaaatgacggcagatgaagttgattatcgtgcaaacttgaatcaattggcgcgcaatgtgaatcttaacgatttggctgaacgcggccggtatctcgacgcgttcgcggatgaggataaaataaaattcgcggatcgaacgtggaacttgtggttttcggtagatcagccgatacacgccaaaatggtgctgttatccggaaaagatcatacacgccttattatgggctcggccaacttgtcctatcaagcatataatacaaactgcgaccagtatgagtcaattcttattctcgacgaggataaggcatttgacgaagcaaaatcctgggtgtgcgatacgattatccctgtgtgcagtcgatgtttttcagatgctgtagttaagcgcatgaaagttgacgagctggcgtctaagcaacttgtcgatacggatgcgccggagactcggcttgatgtacgtgtatccgactcaaatgaggcactgtcagtgcggagcgacgacgtggaagatgcggtgcctgtgcggtttctgccgttcacagacgaggatataaataaagctgctgacgaggatgcggcgttggcactcaacgtttcaaatgatcacgtcgagcaggggattgtaaacgagcaggtgcaaacagctaagcgggatgttgctgaacttaccgtaatgtctgacccggatatggccaaggttaaaacacagcttgaaaatacagcgttcgagacgatttaagtatcggtgaatcgggcacgtaaacatacaccgaagccagtacgcgatgcggcgaaactcaaagcttctgttagcaagatgcataaagtaagatttaaagtgcgtcgtgacgcggatctcgataaagccgattatgtacgccatgtgcctgtactgcttgatgaacccggtaaacgtcttgtgtttgaggatgatgacatgatccgcacaggtttgtttcttagatcgtcggcagatgccgcggccgttgtaccttatggaactcaacttgatacagacggtattatgcagagccttgaagcgattagcgggatggtggaatcttataagcagcgttcggcaactggcgcaggcgatgaatacgttggccgtatcatggagacggtgctttatgcgtttacatcaccatttttgtgggaaatccgtgagcgtatcgtgagggggtcgtccgaaacggttggcctaaatgtgccggcttttttgatgctcggcgcgtcagcgcaggcaggcaagactaccttgcttgagtgtctgtctcggctcatgtgtctgaatcaggatacgcgaatgctgcattacgacgaagtgaagtataacggaactgacggcgggcgcacgatggggaatattcgcgctttaatggaaggccatgactcaagcgtgtatcctgtcattattgatgaggtcgaagagaaagctgtgaataacgatgcgtttggtgcctttatcaaaagttacgcgaatcggcatcaggtcggtgacaagacgggaacgctgatcatgtcgatgaacaacgataaggtatcattgacgaacgatattatgcggcgtgtttattatttacgtttcgataatcagatgattgacgataacgatagccgtgatgtcaagcatgatatgcaggcgaagcttgacgcacgtctgttttcagatttctgttgccgtatggcgcgtatgctcgtcgatgataatacagagtggcgtgtagatgacggtaccggacagattgactttctgcactcagcgcgcgtgatatttaagtcatattatgaagaagttggcatacctgttccagcgtggtttccgacgacacttattgatgatcagcgtcgtatgggaattcagaaatggtcgaatctatatcggacaaagagggaagcgttcaaggcatcgaaaatcggcaaggtgaaagtgttcgttgttgagaaagacgaaatcctgccccgtgtgaacgggtggaaggatgctgccatgcagactttgtacgtgaatgaaataccgatggacgtctggtggcatgaggtagggcatgatccggcgaagaccggtccttctgtgatcctaaagaaacgcgagtttctggcgtggattggtgtgaaagaacgctggcatttatttcactggaattgatttgaaataatatcattttgaagggttagacaaacgttatattattggcacatttcaatcaaaataatcaaaatggccaaaacgcattggttacggataccgaaaatttagaactcgcttgtatgcaaacatcaggccgttgatcccgttgagagatcagcggcctgttcacgctatgaaaagtgattaagatttaaaattactgagggtcatggtcatgataccgtccgcccagtccgctttgatttgggcgttgtaaaattcagcgatgcccttagccatcgacaggccgatgccggatcccgcgattttgttgttgtgcgaggtgtcgccgcggtaaaagcgttcgaacaatttgctcgtatccacctgatctccgtttttgtaggtgttcgaaacggaaagcattttgttattgaaccctttagaggcgacgcggacagtaatggtgccgttgggatcacaatacttaacggcattatcgagcaaaatgttgagaagctcttccagcgtttccttttcggccttgactttgacgtgctcttgaatggtcgtactcagcgtcagatttttctgaatcgccgcactgcggtattcgctggccacgtcggaggtgatctgcgacaaatcgatcgtcgaaatctgcagattctgttgttcctcgagccgggagattgccatcaggttattcaccaaattgttcatgcggtcgacctgtttcattgtcgatttggtccactcgttttcgccattgagggcctccatgacttccgtattggcagaaatgacagacagcggcgttttgagctcatggcccgcgttggtaataaagcgtttctgtttttccgcgttttcaatgatggggtggagcaccctgcgtgaaaagagggtgacaacaacaaaaaagcaaatcaagcagaacaatccaaacataatggaaaatctcaaaatttcatggtttgaattatcgaaataggtgacgtccatgaagacgatgagctgtgaattgtcctgaggctgcccaaggtaataggcaaaagacattttgttctggcgcaggcgcttgagttgattcaacgaattgtcggaaaacactctggattgattttggtttttaaaagcggccttggccatttttttcgcagtggattcttcaatcgcggtaatgtgcgacaaatcgtaccgaatgggtttgccatttttgttaacgaagacgctgaaatagcggatttgggaagacgattcgtcggtgagctgcaggcggttcatggtctgcttgtcggccttaatgtttgcaggcagctgaccgtggttttttgagatgtaactcatcaccgcctgaatttcgttgttggactgccggatatacatgatgttgatcaggcccagaacagcgagcaggatcaccgccgcgcagcaggttgcgatcacgatgaattttcgttgcagagatttaaccatgggcacgcgattcctttgcgatgaggttgaatgggccggacgcttcgccagcgatcaccgcgtcggcgccaatggcatccaatttttgattgagataagagatgtaaatccaaacgatttgatatgtatcgtcttcctcagcgtttttcttgtcattccaaacgtgatgatagagggttttcgctggaatggatttgccgggattgagcagaaaataacggatcatccggccttctggggcagaaagctggatggcgctgtcacaggttaacgtgtcgttttccgtatcgaactcaacgcggccaaaggaaagcgttgtcggcgtgtaatcctcagcacggcgtgtaaccgagcgcacccgcgccagcaattccttcatcgcgaagggttttgtcaaataatcgtcggcaccagcttcgaggccggtgacgcggtcgtccacttctacttttgccgttaagaaaatggcgggcgtcgtgtcaccggcatttctaagttttttaagggcatcgatgccgtttaggttcggcatcatgatgtcgaagatgtaacagtcgtaaaggccgttctccgccatctcaacggcttcggcaccgtcggaagcgagatcgacctcgtactgatagatgccgaggaaggcctgaatggcccgctgcatagccgtttcatcttcagccaataaaattttcatcttgttctccttttactctttttccctgattaaattacggatggtctgcatcgagatatcgcaggatgccagctcgtccgcacagcgttttaattcttgactgagaagttcggcgcgtttgggatcgatattttttttgtagctcacctggtgttccaaactcgcccaggtatccatcgcgatagtgcgcagctgaatctccacgaaataatgtcccgggacgctgccgcacacatcttcgtaaggggtctccattgaaagaatcaggtggtagctgcggtagccgtttggcttgacgtggtggatgtaatccttgcgttcgacgatttcgcagtcgtcaaagctttcgatgatgtgaattacgcggtcgatatcgtcccgaaaggtagtgacaactcggatgccaatggcatcagtcaattcgtgcagtgcggaatagggggtggcggggagctgccgccgctcacacttgtcgatcatactggcttcgtttttcacgcgtccgttgaggtgttcgaataaagcttcgccggttttttcacggtaggcttcgctcgctgtattcagccggcccatgagttcatttaaaatgtcgtttaaatggacttggtaggggccgtatatggttgagttagattgatttttaatattcatgatatatattatggcaaatgaatcttaattctcagactaaactcagaaggggcggtcaagaagttagatgatcctaaatacttaattataggggcttgcccttgaattttccttaacgcgtgttagaatatatttatcaaagaaatcatgtgagaatcgcaggattcggctgctgttgatacaaggcactaatgtatcagcagtttttttattttacaaaaaaatatcctctgtctggcagatgctgcgcaggcagaggctgtgagtgtcgtttattcattttcactatcgataatttgcgtcagcagggactgaatttcattgcggtccttgaacaatttttttgcagtcgtctgcaaacggtaaattttggctgaaagcggcagaacagtaatgccgtctaatttttcccaagtgtgattgagcatgtctcttccaatgacgccgcggaacaaatcgtgtttcaaagtcacgaaggcgtgatccgagcggttgaagagacacagaatcacggtctgcctgtagactctcaggtaggcgagaaggtcgtccgtcgtcttgatcgggtaccatctgccgcggctgagcgttttgcttttggcccgcagggtcgtgatggcttcgtaccatcttaaaagctctttatcctcgtcgccccaggggtaggtgcctctgttgtaaggatcctcaaagccttcacagccggcttcgtcgccgtaatagatgcaggggacgcctggaaacgtcatttgaatcaggctgagaagcttgagacgcatgacggcaaggctgcgctgctcaggattgagcttgaaggtctctttttctttgtcggtcatttccttgctgtcgacgccggaaagcaccgtcagcgctctggcgcggtcgtgggaatcgatcaggttcatgttagacatgaattgttccttgggataggtttcgtacaaggacatcatctgacggatggcggtttttgaagagatattgtacaacagaaaatcgttaaaggtctgtctgaacggataattcatcaccgcgtcgagctcgtgtcccatgaaatactggcgctgcacgccgtaggagaccttgttggacgcgttttcccagacttctccgatgagcacgttgtcttcgccctcctcgagaagcgcggttttcaggtcttcgatgaagtcgtcgggcaattcgtcggccacgtcgagacgccagccggaggcgccgtcccggatccatttgcggaccacactgtcctggcctttaaagatataatcgcggtacgccgggttattttcttcgacatcgggcatgttgcctattccccaccacgagtcgtactggtcagggtaattgctgaatcggtaccagctgtaatacggggaatccttggactgataggcgccgacgttcgggaaacggccgtatttgttgaaatagatggaatcatcgccggtgtggttgaagacgccgtctagaatcacgcggatgcctctttttttcgcttcggcgcacagtcggataaagatgtcctcgtcgccaaattcccgcgcgatcattttataatcagccgtattgtatttgtgattactgttggcctcgaaaatcgggttgagatacaaaatcgagacgttgagcgatttcagataatcgagcttttcgatgatgccttccagggtgccgccgaaatagtcccagtaatcaatagatccatcttgattgcgaaaatagtgaggcgtatcattccaatccccgtgtacaagtgaagaagggaaaaagctcggatgatgggtggggtgctgaggtctggcgaagcggtcgggaaaaatttgatacataattccatccttgtaccagtctggaacggtgcggcccttgtcaaataaggtgatttgataggagggggcgttgtcgtggctggcgtaaattgcgccttcaccaccgagatgatcggcttgggtgccgtattgatactggcggttgtaggcctcaaattggaaatggtaccagagcaggccgggctgatccggcatttggagggtcacgctgaataaatcgctgccttcctctggcttcaagtcgtaccaatgctccgtatcacggtaaaaggtctgcagccggatgttcatcacatcgtgcgcttcgacccttatggtaacagaagagccagttggaatggctccaaatggctctcttaatttcaaatcaaatgaatcatgtctaaaatacatatattacacgctttaatttaatcttccacaaatttttttgtaatagtagagataggtttctgctgagtgacgccagttaaagtcacacgaaagagcgtttttcgtcaattgcttccaatcgtccttgtagtcgtaatacagtccgaccgccttttgaatggtaaagagcatgtcgtgggcattgtaggtcgcgaaggaataaccgttgccttccttggtctgcgaattgtaatagtggacggtatcctttaatccgccggtttcgcggacaatcggaatagaaccgtagcgcatcgcgatcatctgcgacagaccgcagggttcaaatttggaaggcatcaggaacatgtcggtgccggcgtagatcttgcgggacaagtcttcgtcgaaggtaatgcaggcgcgcattttgttcggatagtatccggcaacatcgcgcagcatgttttcgtagccagtttcgcctgtgcccagcacgacaaactgcaattccatctgaagaatttcgtggatgaccgcggcaacgaggtccagccccttttgttcggtcagacgggtgatcatcccgatgatcggcttgttggggtcgacagggaggttcagatgcttctgaagggccactttgttttccatctttttgctgtagctgctggtgtaattcgtccagatgtgcgggtctgtctgcggattgtattccttatcgttaatgccgttgaggatgccgacttcatgatcggcaatgtcgcggatcacgccgtcgaggcgttccccgtagtaggggtccttgatttcttcggcgtaggttggagagacagtcgtcacgagatctgcgctgtacagtgcacccttcatgaagttgacgtcttcgtaaaattccagtgtagacgggaagtaatcgaaattgatgatgtttgcgatgtccttgaagccgtacacgccctggaatttcagattgtggatggtgaagaccgtcttcatgttctggtaatgccagctgtactgttccttgtacaggtaggggatcagcgccgtctgccagtcgtggcagtgcatcacgtccggataaaaattgacgtagggaataaattccaacacagcgcggcagaagaaaatgaaccgttctgcttcgtcgtaatagccgtacaatcctggacgcttgaaatagtactcgttgtcgataaagtaaaaggtcacattatcgcttttgtattccaaaatgccgcagtactgatcgttggacccgatgtgcacgtaaaacgagttgacgaatttaaactggtgggtataggtttctggaatgcattcgtatttcggaagcaccacgcggacgtccgtttcctccggcgggaaggccttcggcagcgagccgatgacatcaccgagcccgccgcttttggcaaaaggaaaagcttcagaagctgcaaacaggaccttgagtttatccatttacaggctccttcctttggttaagataatgggatcgtcctttgtgcccaccaatgtggctttatcgcgaatcgtgcaatatttatccagaatgacgttcttaagggttacgttgttgccgatgacggcgtgctgcatgatgatgcagttgtcaatgtgcgaatccttgccgattttagaatctctgaataaaacagaattgttgattttgccgtcgattttgcagccggacccgacaattgaatggttgacggacacatccggaccgtaattcgtcgggtggttgtccttggtcttcgtgtaaatttgatgatcgccgtggaacaattcttccataacatcaaagtccaatagatcctgattgatttcacggtagcgtttcatcgagtttactcgtgataaatagccggtgtgcggtgcgccgaagatgcgcagcgtgtcgatgttgtcgcggatgacgtccatcaaatcccattcgccgatggcgttcgctttttcgagcagattgaggagcacttctcgtttgataatcatcatgtccgcataggcgtaatcagagttcgattcatcgtatggatgaatagagctgatgcggtagcggttgaaatccaaaaagatgtcgttggcgttcaagctgaaggacggacggacctttttgaagatcatcgtgacgtcggcattgttcgttttatgaatcttgtatgccggattaaaatcaaaggaagtgatcaggtttggcgccgaaatgatcacatcttctgtttcaggattgtgatccaaaaacatttcgttgtaatagaggtcgcggaccgaaatcttcacagcgtcgccgtaacgaactgaggaataacccgaaagaatcgacagatcctgtgtttttctggagagcgaccattctttaccggttcccagatgatcgatgagggaggagtacttgtaagagcctaccacaccgatgtgcttgattccggaattaaccatgtttgacagggtgaagtcgatcagacggtaacggccgccaaaaggcagcgttgacatggaacgattttccaacaacggtttgagatctgtattgtccccgtcaatatttaagataaaaccaattacgttattcattatgccgcctcctaaccgttaatgacctgaatttgcgaaggatcatcgttttctgatgcgacaatccgagtatctgccgaaactgtaccgcgcggacccacaatacatctttccagatgagcgccgtctttaatgacagcaccggtgtgaatgatgcagtccttgatgtaggtgtgttcaccgatggtgatgtcgtgggacagaatggaatgttcaacgtgtccaaagaccacacagccgtcgcagatcagcgaatgcgatacttccgcgtttggcccgatgtactgcgggtggcggctgttgttgttggaaaagattctgaagttcggatcggtcagatcgaaatcgcaggattcgtcgagcaggtccatgttcgcatcgtagtaggaatcgatagttccaacatctttccagtaatcggagaacatgtaggcaaaaatacgcttgttttcgctgtgaagggcagggatgacgttgttgccgaagtcgttttctgagtttggatcctgcgcgtcttcgattaacgcctttctcaaaaccggccaattgaagacgtaaatccccattgacgccttgtttgatttgggttccggtggtttttcctggaattcctgaattctcaattcgtcattggtcacgacgacgccgaaacggctggcttcttcccaaggcacttctctaactgcgattgtaagatcagcttgtttggatttgtggtaggcgatcattttggagtagtccattttgtaaatgtggtcgcccgaaagaatcagcacgtattccggattgaaacgatcaatgaagtcgatgttctgcgtgatggcatcggccgtaccgttgtaccagcggccgcccttttggcccatgtacggaggcagaatgcggacgccgccattgaccttgtcgagcgcccaggcactgccgttgccgatataattgttcaaaatatacggacggtattgcgtcaggacaccgacgacatcaatattggaattcatacagttacttaaaggaaaatcgataatacggtattttcccccaaataaaacagctggttttgcattattcgccgtcaaagcttttaagcgagagccttgaccgccagctaacaacatagcaacacattcagtgttcatcataacactccttatctctcttatttatttatcatcagtcggaaagctagcagatatctgatgaaagatatcgagagagagaacggtagatatctgcctttccagttgatgctaatagcgtgttgaaattatttaattttccagatgtctcttcgatagtctgcgattgaacggtcggaagagaaaatcccagaatttgcgatattgataatcgactttttctgccagctgtggtgattgagataatcgcggctggattgatcctggatgtcacaataggaggcaaaatcctttaatacaaagtaggtgtcgttgttcagaaccagcgcatcgtagatggtgtggaaggtatctcccccaagagacccgtcaatcaattggttcatgactttctgaaggttaggattctgctgcagcacgtcgaccgaatggtagccgccgttgtgattataattggctacttcttcagcggaaaggccgaaggtgtaaatattgtccatcccaacgtgttcggcgatttcgatattcgcaccgtccattgtgccgagggttatggcgccgttcatcatgaatttcatgttcccggtaccggaagcttctttacccgcagtggagatctgttcggagatttctgcagctggataaatgagttccgcgctcgaaacgttgaagttcggaataaacacgacgctcaatttgtctttcatcagcggatcgtgattgatcttgtccgcgatgacgttgatcagtttgataacttgtttggcaaaatagtaggaaggcgcagccttgccggcgaagatataagtcttcggaacgaaatccgcgttaggattagaacgcagctgattgtaaacgtgcatgatgtgcagggcgttgagcagctgtctcttgtattcgtggatgcgcttgacctggatatcaaagattgaatgcggattgactgtgatgtcctgatgttccttgatgtattttgccagacgttctttgttgtgatatttaactcctaagagctgtttctggaagtcagaattggaggcgtatttttccagttcctttaaggtttccatctgtccaggctgtgtccatttgtcgccgatggtgtcgcagatcaggtccttgagttccttattggccgccatcatgaagcgtctctggctgacaccgttggtgacattgtggaaacgttcggggtagaccgcgtaaaaatccttgaaggtttcttcgcgcagaatttttgagtgcagttcggccacgccattgacagagtgggaaccgataatggctagatgcgccatgtgaacctgtccgtccttgatgatcgagatgttgtagttgcgggcttcttcgtttggatatttgctattcatttcttcgaggaagcggcggttgatttcttcgatgatcatgtaaatacgcggcaggagattctgcatcatatcgaccggccatttttcaagagcttcaggaagaaccgtgtggttggtgaagctcatcgacttgaccgtcatatcccaggcttcgtcccagccgtagttttcttcgtcaacgagaatacgcatgaattccgggacacacatcgccggatgggtatcgttgatgtggatgcagatcttatcagagaagccgtctaaggaaccctgatgctgctttttgtagcggcggacaatgcgtttaagacctgcgcagacgaagaagtattcctgcttcagtcgcagcagctgtccttcaaagccgtggtcagacgggtagagaacctgagaaatcgattctgcctgtgatttgctctgaacagccttgaggaagtggccttcgttgaaagcactcagatcgaaatcttcgacaggctgtgcgtcccaaagtcttaacgagttgaccgttttgttgtgatagccgctgattggcacatcgtaggggacagccaaaacgggttcgtaattttcgtgaataaaggtcagtttgccgttgaccatttcggtccggacgttgccgccgtatttcacgacaaccgatttttctggctggcggatttcaaacggataaccgtgcttgagccaattgtcggcaacttcaacttgttcgtggttgacgattttctgctggaacaggccgtatttgtagcggatgccgttaccatgagctggaaaatccagtgccgcggcagaatccaagaagcaggccatcagacgccccagaccgccgttgccgagcgccgggtcgtgttcacgagccagaattttgtcgtaatccaagcccatttcttcaagagcttcaggaacgatgtcttcccatcctaaattattaatataaagtctcaacaatcggccgattaaaaattcgattgagaagaaataaatctgtttgtccgtattaatgcggttgacacgtctattttcagcccaggttggcgtgatgttttccatcaccatctgcgccaaggcttcgtactggaattttgttgtagaattttcaagcttttcactcgaaagctcttccactttctttttaaattcctttttaaacttctcttttgtcattttgttttcagtttgttgaaagatattcataagactcccttcgaaaatcaatcgcgaataataaaaaattatattatttcggatttttacctattatacacaacatttgctaagaattcgagagaatctgctcatatctgtcaatattttacttctttttaatcgaatcaatttttgttaacggtttcggcttgacgtccttttgggtcagcggtttcggtttgacatcttttgccaccaatggctttttggaggcgtcgatttttttcggtttttccgtcttggtcttggccggaacctgtttttcaggttcgcgcttataaatcagggcagaaaatcctggcagcgcaatggtgattttatgcggctgattgtggaagccttctttttcgtcagcttcagcctttttaacgacggtttcgccggagccgccgtactgagccgcgttagaattaaagatcagccgccaggtgccgtctctcggcacgccgatatcgtaaatcgggtagctttccgggcagaaattgatgatcacgaccaaatcgtctttcgggtctttgcccattcttctgaaaatgatcacgctttgggccgcgttgtccggttcaatccattggaagccgtcccaagagtggtcttcctgccaaagtgcaggttcgtcgacgtagagcttgtttaaatcgtgaatgtactggtggaaatctcggtgcttttcgttttccagcatgaaccattccagctcttcgtagtaacgccattcgatgaacggcgcattttcgttgcccatgaaggtcagcttctttccagaatgggtgtacatataagcgtagagcagccgcatttcgtcaaatttatggttgtaatctccgaacatcttgtcgaggatcgatttttttccgtggaccacttcgtcatgggagagcggcagaataaaattttccgagaaggcgtagctcatcgagaaggtcaggcggtcgtggaagtgggagcggacgtagggatcggtttccatgtaggagagcgtatcgtgcatccagcccatatcccatttgtagttaaagcccaatccgcccttgtccacaggccaagtcacctgcggaaaagcggttgattcctcagcggccatgatggcgtaggggaaatatttaaagatttctgtgttgagctttcttaaaaacgcaatggcttcgagggaggtgttgccgccctctgcgtttctgcgccattcgttgtcgtagccgtaattgaggtagaggatgctcgcgacgccgtcgattctcaggccgtcgatgtggtacattttgaaccaataataggcgtttgagatcaggaagttcaccacttctggccgattgtaatcaaattccatcgtgccccattgcgggtgttcagtggcttcgtacaaattggtgccatccagcttgtaaagtccgtgggcgtccttgcagaaatggccggggacccagtcgaaaatgacagatatgccgttttgatgcagctgatcgatcaaatacatcagatcttgaggcgtgccgtatcggctggtcggtgcgaaatagccagtgatttgatagccccacgacccgtcgaaggggtgttccatcagcggcatcatttcaacgtgggtgtagtgcatatctttaaggtaaggaaccagctcgtcggccaattcgcggtagcttaaaaacagaccgtcctcgtgggtgcgccagcttcccagatgcatttcgtaaatattcatcggggcgggagagccgacagagctttcacgggcgctgcaccattttgtatcgtgccattggtagtcgagaggccagatgatcgaggccgtgttggggcggacttccgaataaaacccgtaagggtccgccttgtaggcgagagtgccgtcgatttgttcaatacaatatttgtacagcgtgccctttgaaacgagatcggtgctgagctccgtttcccagacgccgccggattggggcagcaggtgcatcggacttaacgcggggtcccatttgttaaagtcgccgacgatcgagaccgaaagtgcattcggcgcccataatctgaaaacaacgtgatcatcttcgatgtgtgcaccgaaaaattcgtagctttgaaggtaatcgccgtcgtgaaatagatacaatgcaactgatttatccatcagaatttcctttccatatgttgaagtgggttttcaataattgtgaatattaatttaattaaattttaacatattacagatgaaaagggaaatcaatattaataaagttttgaataaagaacagataaatatttcactggaaaggatgattttagaatccttgtgctataataataaaaattaattattattcatttatgaaggagacaaaatgggacttacattaactgaaaaaatcatcaaggaccatctggttgttggaaaaatggaaaaaggcactgaaattgggattcacatcgatcagactttgacccaggattcgacggggactatggcctatatgcagcttgaggcgatggaagttccacgggttaaaaccaaacggtctctggcgtatatcgaccacaatatgcttcaggaagggccggaaaatatggatgaccatttgttcattcagacgatggctaaaaagcacggcatctatttttcgcgtccgggcaacggcatctgccaccaggttgaaatcgaacgcttcggtgttccaggtcagaccctgctcgggtcggacagccacacaccgacaggcggcgggatcggcatgctcgcgatcggtgccggcgggctggatgtcgctgtggcaatggccggcggcgaatactacatcacgatgccggaaatcgtcaaggttgaactgacaggcaagctgagaaaaggtgtcgcgtcgaaggatattatcctcgaagtgctccgccaatgtaccgttaagggcggtgtcaacaaggtgtttgaatatacaggaccgggtgtcgcgacattgactgtgccggaacgtgcgacgatcaccaatatgggcgcggaactgggcgcgacgacgtctgttttcccgtcagacgatatgacgaaggctttcttaaaggctcaggaaagagaagacgactttacgccgctttcagcagatgacgacgcagaatacgatcaggttgtcaaggtcgatttgtcgacccttgaaccgctggtggcctgcccgcacagcccggacgctgtcaaaaaggtctcagaacttgaaggcatgccgatcaatcaggtctgtatcggctcctgcaccaattcttcgtatttagatttaatgaaggtcgccgcgattatgaagggcaaaacagtggccgaaaatgtcgaaatggttgtcgcgccgggctcccgtcaggttttgacgatgctggctgaaaacggcgcgctggccgatatcctttcgacaggcgcacgcgttttggaatgcggctgtggaccgtgcatcgggatgggccaggcgccgtgtaccaatggggtttccctccggactttcaaccgcaacttcaagggccgttccggaacagtgtcggggcagatttatctgctgagcccagaaacagccgctatttccgcgattaccggtgtgctgaccaacccgcttggaaaagtcgacctgccggatatcgacatgccgcatcatttcaaggtcaacgacaacgcagtcgtgccgccggcgtcggaagaagaagcgaaggatattgaaattatcagagggccgaacatcaaaccgttcccgctgtccgcgccgctgaaggacgaattggaaggcattgcgttgattcatgtcgaagataacatcacgaccgaccacatcatgccttcgaacgcgaaacttctgccgttccgttccaatatcccgcatctggcgaattactgcctaacaccgtgtgatccggaattcccagaacgcgcaaaggctaacccgggcggcttcatcatcgctggatccaattacggacagggctcaagccgtgaacacgcggcgctggcgccggtatatctgggcgtgcagggcgttgttgcgaagtcatttgcgagaatccacaagaacaatctgatcaacaacggcattctgccactggtcttcaaagacgaagcagattacgatgatattgacgtcggtgattccctcagcatttccgacaccattcacgcgatcgggacgggcagtgtcacgatgaccaatgaaaccaagggccacacctacgaactcggcattgaaatttccgaaagacagcgtgaaatgctggttgacggcggcctgattaatagaatcaaagccaataagtaaaaaatattgaaaggagggcgccgtgaatcctttatacgagatggaaatgattttaacggaagatgagtttcgcaaatcgtgtcaggcgctctcttctgcggcggtaaaacgcctgcagatcatttacatcgtgatcggttcgatctgctgcctgtgcggcatcgcctttattttgtcgccgattttttcgctggtcgagggcttaatcatcgcgattgccggggtcgtgctatgcggtattctcaatctgaacctcatggttcagaccaaaaaagatgtggagaaagcgtggaaagctcacccggaattacacgatattgtgattcacattaccttttttgaggatcatttcacgcagacgacaccgaccgtcagcagcaatgccgattacacggatttgaaaaagattatcgaaacggagaccaattattatttgatgacaggggagaccagtggtgcgattgtcgtcaaagaccgctgcgcctccgggctcatcgattttattcaaaatcttcagagacggatcaattcttaaaatctcatgaacgatttaacgtaaaataatcttcgcgcttgataaattatagagatcatttataatattatgtataagcatttttcaccttggtgtcctgttcgagagagcagggcattttttgctgtaaagggctaaaaataatcatgcacggaactggaaaagcgtgtgggatcatgttataatataaaagccaaaacgatacagttttgtatatttcctaatttctttgccccgctaatcccggggcatttttattagacagcgcagaaactgatcaataatggagaatgaaaatgagcaatacagaaaaacaaaacgaagaagcaatcaagaaaaaaatcatcgaacagatcgatcaggaaaagcaggaggcacagcagaggcgggacaacaagagtgacagcctgcacgtcgaaaaggataagatgttgggttacaaagcgtttttaggcatttggaatacctttgtgtttgccgtcggctggtatttattttacaattacaaaatttttgaatactactcgagaccgggatatctcgttgtggtctgcctgtttgttatcgcctatatcaatcttgtggcgttttatcatgcgtttgatttcaagcataaatcgaaggcgcgattgatttttgccaatacgatttccatcgtgacagtcgatattttgatttatttaggcggctgcctgttcaacgccgggtatatcgacgtgaaaccgggtgtcgtcatggcagcgatccagattgtgattacctgggtagtcgtcaatgtggcaaaaaatcatgccgaactgctgtaaatcaatcgtctgcgccgaatttgctgagtctttaagtaaaatgagcaatttcttagatttaaataaaaatttaatgaaaaagtttacggaacgtgctataattggcttaacaacaagtaaaggaggcgcaactcatgggtaaaatcattacagttggtagagaatttgggagcaatggacgagcagttgcaaaggcgctttcggaagctttgaatatcaactattatgaccgcgagttgatcgcgttagcagcaaagaagagcaaattatcagatgaagagttagaacacgtcgatgaaacgcgggctaatccttggctgtattcctctgtaggctatcaggttggcagcgggtacacgaccattgaacccatcaacgacattttgttcaaagcggaatccgaagtcattgaagaaattgcagccagcgaagatgctgtcattgtcggacgctgttcggattatgtactgcgtcacaaggttgacagccgtcacgtctttatttacgcaccactgaattatcggatcagtgtcgttcaggccagggaccagatcgacgaaaaagaagcgaagcgtttgatcaagaaaatggataagcagagaaaattgtattacaatttctacacagatcggacgtggaacgaacttcgaaactacgacctggctatcgattcttcgattttctctcaaaaagatattattaagattttgaaacaggtttatgaaacccttgaagattaacagtttttgagcattttacaccggcagattttattctgccggtttttttacttgaaaatagaaaacagaatcgttataatatatccgatgtctgggtgtggcgcagtttggtagcgcgcgtgaatggggttcacgaggccggaggttcgattcctctcactcagaccatttttaattgggagattaattaaatatgagtcaacagatgcggcaaaaaaaaagacaagctcaacgaaaaagaattttgatgctatgtcttatttttttggcaataatagcatttggatttattatacatttaaggagaaatgccactggacttctggaacagagcagctacgtcgatgccgtgtcctctgaggtctatttctttaaacattctgactacattgaaatcaacgacttcagcgcggcggatttaaccagcagtgaaggcagcaaggtcaacggctactcaccgctgaccaagaacaaaatgaccgtcagcggcgattatctgagcgcgcagatttcaaccattaatcaaattttaaagaataaggattatctgcattacgacaagattgtgacgcagattgaaaataattttaaaggactggataagctgaccagccaggtgtcgtcggcgcaggaaaaaaagaaaacttatctcgtcaatgcctcagcgtattttggcatgaatcgaaaggaactcatcgcgaagcgtcgcgaactgaaaaagatacagaaaaagaaacaccgcagcatcattttaagcgatttgggcatgctgtcctctggctacgtgtacggaacggtcaacccgatggaaaaggtcgtgacagaaaatgtactgccttatatcgacagcggtttcttaagcagtattcagaaaatcgatcagcaggatgaaagcgcgcttaaagtggtggacaacgaccacctttacgccgcgtttaccgtggattccaacacgaccatccaacacgaagacgaggttaaaaagctgaaaaaaaaggtggccggcacaacgactcgtaaaaaggacgtggcctattacaataagcttgtgaagcgcgtggatctgctttggcagtacccacagatttctattgtcaaaaacaacaaaaagtacaattgttatgtggttaacgtttttaaatccggcaataaaaaaattgtggtcgtgatgctgaaggattatatctcggtttttgccaacgacaatattttgaaaaccgatgtcaacgttcagagcttcacttcctacaaggtgccgaaatctgcgattacaacacagggaaagaatcaatacctgaccctgcttcagaaagggtatttccgaaagagggtaaaggtcaaggtcagccgatacgacggcagaaaggcgattttggctgtggcggataaccccaacctgtcttcaaattcaatgtattgcgtttatccctgatagaaagaaggattaaaatggaaatattatcagaacagaccgacttggattatagagaaaaaatacagcagaatattgagaaaattaaggctgagatgccggatgatgtcaccctcgtcgcggtgaccaagatgcacaccgtcaatgaaacccaggctgtggtcgatgcgggtgtgtacgacctcggagaaaaccgcgaacaggatctgatggccaaaaaggacaagatccaggggccagtgcgctggcactttattggacatttgcagaccaataaggtcaaatatttagtggggcaggttgcgctgattcattcgatttcttcgatgaagttaatcaacaaggtggaaacggagtccgcgaaaaaagacgtagtaaccgatattctgctgcagtttaacctgacggatgaagacaccaaatccgggtttgatgcgtccgagttggacgcggcgacagcccgcgttgcgcaatgcgaacatattcgcctgcgggggctgatgtgcatcggaccgatgacagaaaattctgataaaatacataaaatatttgcccaattaaagcagatgtatgataaaataaaaacaacatacaaaaatggcgataacgaaattgatactttgtcaatggggatgacaaatgattatccgatcgcaattgaagaaggcgcgacgatgattcgggtcgggcgcaaaatatttgaacgctaaggagtaagctgaaatggcaaatgaaaaattcaaagatagaatcgtgaatatgttcaccgcgggcgacgacgattacgatgattacgatgaagaatacgaagaagatgcggacgtagacgaagtcgttgacgatcaggaacaggaagccgcacgttcagaacatcataaaaaacacaacggctcttacgatgcgcctttggcaggcggcgcacaggttttggttttgagtccggaattctttagcgatgcgccgagtatcgtcaacaaaatcaaggaaaataaaactgtggtcgtcaatctgaaaaatacagaatacgaagacggccggaagatttttgactttttaaacggggcggtttttgcactggaaggcaccatcaaccgcattgctgacaatgtctttatccttgcgccgaagcaggtttccgtctcaactgaaatgcagaaggacgatgacgagctctccgcaaagccaatgttggattttgacggcgaaccgagtgacgaagccaactaaaaataagaaaatttagaataataagggccgcaagtacaagcttgcggcttttttgattcaaagaaatacagctaattcatgaacgaaaagaaagaaaatgtagttatttcgaggattgaggatgctgtcgtcaagcaggaccgcctttatttttttgatttctacgacgaggcgatgcaggttaaaatcgagacctttttaaagaaaagtaaagcccattacattttagacggcggttttccagatgcggcgagaaaaatgctctgtgtgatcccagcggactggatgacgtttttggatccagaagcggatatagaatggccgatgatggcggttcgtttcccgaggacctttgcctttgcgcaccgtcacgtgctgggcacgctgatgggactcggcattgaacataagtgcatcggcgacatcaatttagatgaaaaggagtgtcaggtcgtctttgacgagaagatctatccttttttgaagaacgagtttgtcgcgattcgaggccggcgcatccagccagaatttttcgattatccgcatatccgttcctttactctgaagacgaaaaagatggtcatcaccgtcaattcgccgagaatcgatgcggtcatcgaccggatatggggaatttcgaggcagaccgctgaagcggcggtcaggcaatctcgggttcgagtcaattacgcggaaattttgaaaaaggattttgcggttaagcccggggacatcatttcgttccgcggaaagggaaaggccaaaatcgcggacttcattggaaaatcgaaaaaaggaaaaattcaaattcaggttgaaaaatatttatgatcgacgatacaacacaacaaatagatgaaagggttcagcttattgtgcagaccgacgaggatcgggcgcgcctagaccgattctgctcagcgcatctcaccaatctgtccagatcttacgtgaagacgttaatcaaaaaagaatgtgttcaggtcaacggccagatcaagaaggcgtcccacgcgttaaacgcgggggatgtggtcacagttgccattccggcgccagaggaagccggaattcaagccgaggatattccgctcaacatcgtctacgaggatgacgatgtgattgtggtcgacaaaccttctgggatggtcgtgcatccagcaccgggcacaccgtcgggtaccttggtcaatgcgctgatggcgcacacggatcagctttcgaccattaacggcgtcaagcggccgggcattgtgcaccgcatcgataaggacacgtctggccttttggtagtggcgaaaaacgatcacgctcaccagtttttagctgagcagctcgctgcacacgaaatggtgcgccaataccacgggctggttcggggcaatattgcggaagaaacgggcactgtggacatgcctttggggcgccatcccaaggagcggattaaaatggcagtggtcgaagatggccggcatgcggtaacccattttacagtggtgaaacgctttggacaatacacggaaatgatttttaggctggaaaccggccgaacccatcaaatccgcgtccacatgcaggccatcggacatccgctggtcggtgacccgctttacggcgcgcgccgcaaggagccctttaaaaccgacggccagctgctgcacgcggaaaaattggggttcgttcacccgacgacgaagaaactcatggtcttcacctcaccgctgcccccaatctttgaagaagcgctggcttattgccgccggcatgccatgtgatcaatcgtcgtcggagagacgttcgatttgatcgatgatttcgcgctttggcgtaacgtacatcgtgttttgattggtaaagatgaccatgccgggcttggccttgttgggcttgtgcacgtatttgtagtcgacgtaatcaacaggcacgttggacgaggttttcgccttggaataataggctgccagctgacccgcttcgagcagcgttttttcagtgataaagcggccagccgcgacgaccaagacgtgggatccgggggaatccttaacgtggagccagcagtcctccggatcgccgagcttcgtcgcgatttcatcgttttggaagttgtttttgcccactagaatctcaaagccctctgaggagcggaagcgcatcggatgggagggcttgggctttttgtccttgccatttttcttcggatgcttgacgagatccgagtggttcacctcatagcggatttcgtccagctcctcaatttcggtacattggtcaagggcgtttaatagcgaaccgagataatagaccgtatctttcgttttttcaatctgctcggcgacttggacctgagctctcttcgctttgttgtagcgcttgtagtagcgctgggcattctgagccggttcctggttgaccttaagcggaatgtgaacggtcggcagatccgggtcgtagaaattttccacatcgatgccatccatacccttttgaatgcggtagatgttggcggtgatcaaatcgccgtacagtttatccttttccgcttttttcgattttttcaaatctcgatggagattatccagctttttcgtgtcttttttgtataacgtcgacagctgatgcttcaggttggcggcctttgcgttaaatcttaattttttgtcccgaaggtagaaaaaggcttccaacattcgggagaccgagtcgcagggctgatggtcgaggtccttcaaaaaatgcagatcaatggtcgaaaaattctgaatgtgccgatggaagtaataaagggtcggctggcagctggtttcaacctcgtgctggatttcaaaaaagctgtcggacaaatagcccctttctttgactgtgaggtcagacagcggggtttcaccgctgacgccggcgcggaaacagatttcttgggctaaatcaggagaaatccccagaaaaccgccgatgaaaacggccgtgagcttttgattgggctgttttgaaagccagcggtcgaaatcctctggcgtgcggcagtcaaaaaagtcggtccgctctgccgccggcggcagcttgtagtgcagccccggcaaaatgtggcggtaacggctggacgaagggccgacgcgcttgacggcgtcgatgatgaccggtccgtcgtcgggggtctcctcatcggccatagtcaggatcaggttggcgtttcggccggtgatttcagcgacaaggcttttggtgaccggatcgccaaaatcatttttcccgttgacgtcaatggctaaaatgcggtcagagctgatctgatgaatatcggaaatggtggtgttgacgaggtgtttgcgcagcaccatacaaaaggtcgagggctgaggcggattcttctttttcttttcggtgatgtgcacgcgcggctgattggcattggcggacaaaagcaatgtcgcgttaattggcccggaaatctgcagatgcacttcgtcgttttccggctgatagacctttctgatttttcctccgaccaattgagccttaagttcttttacgagatgataagttgtgataccgtcaaatgccactggaattcctcctttaattaagttttagatcgattcaattgattgttgtttaatataatcgaaacggaaaataaaatcaataatggccggccagtcttgtattttttgcgtgaaatcggtatgataaaagaaatattgggcggaggcaatcagaatgaaaagcatgacaggattcggacgggcggattaccgggatgaaaattggaacatttcggttgaaatcaagacggtgaatcaccgctatcgggattatgcgatccgcatgccttcgattttaaattctgtggaatcgaaaatcaaaaatgaaatcggcaagacggtcgcgagaggccggatcgacgtgttcatccagtttgaaaatttatcggaaagccagcggcagatcgtcttggacgaaaatttggcgaagacctatattgatgcgctcaatgccattaaggccctcgatccgatgatgcgcgatgaaatcggcgtggatctggttgcgaaattccccgacgtcatcaaaactaccgaaaaggtccaaaatgacgacgaaaactggcagatgcttcagcctgtactggcgaaggcgctggaacaggttgcggaaagcagggcgcaggatgcggtggcgatggccgatgatatggcgctgcgcgtggaaaacatcgagacaatgatgcagaaaattgcggcgcgcgccccggaggtgcttggtgcgtatcgagacaacattcaccaaaaggtgaccgattttctcgaagggtcagagattgatgaagggcggattttgaccgaggtggcggtgatggccgaccggctggacattacagaggaactcaaccggatgaacggtcatctgaagcgcatgaaggcattacttcaggaagaaacgccggtagggcgcaaattcgatttcctcgtacaggaaatgaatcgggagatcaataccattggttcaaaggcgtccgacctcgaaatccaggacagcgtcgtggatgtcaaggcggaaattgaaaaaattagagaacagattcaaaatatagagtagaggtgtaaaatcaattgaaaaaacagcgtggacagctcattattttatcgggaccatcgggcgcgggaaagggcacggtttgtcaggccgcgacggcgcacaatccgaatcttaaaatatcgatttcggcgacaacccgcgcacctcgcggcgcggaacgggacggcgtcgaatatttcttcctcgacaaagcagatttcgagaaaaaaattgaagaaaatgcctttctggaatacgcgaaggtgcacgaccattattacggcacgccgaaggcccacgtgctccagatgctggatgagggcacggatgtcattttagaaatcgacgtgcagggcgcagcgcagattaaagaaaaattaggctttggcgttctgatttttatcgcgccgccgtcaatcgaggtgcttaagaaaagactggtgaaccggaagactgacagcgatgcccagattcagcttcgtatgaagaatgcgctcaccgagctgaaacaggccgagcactacgactacgtgattgtgaacgacacggtggatcaggccgcggcggacttagaggccatcatccgggctgaacggtgccggacccaaaataatttagaaatcattgaagaaatgttgatgtaaaacttcaataagggttataatattatgtattcattttgaatccacagataaaggagttaacagacatgagctggaaaacatattatggagaaaacggcagcggccttcgttacccgccgattaatttgatgatttccaaggcagacaataaatacgaattgtgcgtcgcgacgtcaagacgcgcccgtcaattgatcgatggcgctgagccactggtccgcgtgaacatcgacaacccgatttcaacggcgaccgaagaaattgccgaagaagaagtgaaaattatcggcctggatgcgaaacaggaacgtcaggaaaaggcccagaatgccgacgatgaatttgcggcggctcaggaaaacgaaggcgtttccctcgaagatctggctaacggagacgacatcattctcgaatagtgaagattgcgagaatctttttaaagcagaccaacaagcgcattgaccacgcctacgattaccgcgtgcccgagacgatggccgatcaggttgtgcctggcgtccgcgtcgccgtgccctttgctcggggcgggcgcgtggtcgagggctttgtgattgccgttggcgatcactcgaaatacgcagataagcttcgcgacgtgctgcaggtgatagaccacgagcctgttgtcgatgaggttcaccgaaaattgtgcctctggctggtgaagatacacgactgtctcttttacgatgcgctggcgttgtttattcaaccggtccgcgtaatccgagaaacggatgaacacggcgaagcgattttccgcccgtatcaaaagacagaaacggtctttcgccttacgcaggcaggccaaagcgccaagacgcgcggcaaaaaaatggcgcggattttagaactgcttaaattggggccgatgagtgctccagaattaaacgccgctgttccgaacgcatcggccagccggcgaaagcttttggctaacgaatggattgaagcggtcgacgcagaagctctgagcgcgccaaagtcggcggtgcatttaccgccaatacaatgtgataatcgtgtttttcaatcgattgtggaaaacttatcaagcgccggggatcaaccggtctttttttatcaaaaagacgatgatatgcggtttgaaacctttcttcaggccgcggtagaaaagatcaaccttggccagacggtgctcatcattgagccggaaatcaatctgctgaaaaaaaacgccggccgctttaaaagcgtttttggcgaactcggtgcagtgtatcacagcggccttaaaataacagaacgctaccgcatttttcaccaaattcaaaaggggcacatcaggattgtattggggacacggaccgcgatctttctgccctttcaaaatatcggcctgattggagtcgacgagatgggcagcggtcagtacatttcagattctgaaccccactatcagctgcccgacgtcgccgcacagctggcgaagatcagcggcgcccagatgctcatatcagatcccattccgtctgtcacgctcagatggcgaatggcggagcggcaaattgtgaaggccgtcgagccgtccagttttgatccagtgggaatcattgacatgaaaagagagatgcagcggggcaatttgagcattttcagccatttgctcgaggaggaaatagaccgtgcccttggccgcggtcagcgggctgtgctgctgcacaaccggcttggctatcagcgcgctgtcttttgcagagactgcggcgagacggtcaaatgcccggtctgtgggcgcccgatgaaaaccgaccataaccgaacattgatctgtatgacctgcggggaaagacggccttttcccaaaacctgtccgtcgtgcggcagcacccatattaaagggatgggggtcggtttggatcaggttgccgagtttgttcaggaaaaatggccggactgccgcgttttaaaaatcgatggcgccgcagtccgccagcgggagtttgatgaatgctgcggcgaaatccgcaaggccgatattgtcgttgggacccggagcctcgtcagaggctttccctttagcgatgtgggttgtgcggccgtcgtacttatcgatcaggatatcgatggcaacgcctacaatgcagcggagcaggcgtaccgtttgtatcggctgttttttgaaagaacgcaggcctcaagccggtacattcagacctacaacaccacacatcctgttgtcgaggcgctgcatcaaagtcaggacgatcaattttacgaggctgagctgaaataccgaaaaagcatggactatccgccctttggccaccttttttatttcgaaatatttggagaagatcaggcgcaggttaaggcggacagcatcagcctgtatcgcgctttacaggctagatttcagcaatgggtcgtgtacaggccggtttttggtggggtcaggcgcgaaaagcatcaaaccgagtaccaaattgttctgaaggcgcctaaaattccgccggtatccaacggcattagacgcatgatctgggacggtgaatttgaacggctcgcttcaaaaatcacggtggtcatcgacccgatattagattaaatcaataatggaggatgataaaaatggcgattcgcaaattgagatacaatgacgatccgattctgagaaaaaaagcgagagaaatcacagaaattaacgatcggatcaaaacgctggcggcagacatgctggaaaccatgtacgacgatgaaggcgtcggcctggcagcgccgcaggtcggcattctgagacgtttggtggtgattgacgtcggcaaggggccgatcaccatgatcaatccagtgattgtcgaccagaagggcagcattgtcgacgttgaaggctgcttgagctttcccgacgacgcgggctacgtcgaacggcctgaatacgtcaccgcacagttcactaatctggaaggacagcgctgtgaagtgaaggggcatatgcttttggctcgggccatctgccacgagctggatcatttggacggtaaggtcttcatcgataaaaaaattccggtcgaaaaagcagaaaaaatgatcgaagctcagaatgcacgcttggcgaaggcacaaaacaaaacgaagccggcgagcaagccggaggaaggcatcaccagtgaagcctttgaaaaaccagcggatatgcaggcggttgaagcactgaatggagaggacagccatgaataatattcgggttgtggtgatgggaacgaccgatttcgcggtgccggcattaaaaaagctgtacgacagcgattttgatgtggtctgtgtcgtctgtcagcctgaccgccccaacggacgcggcaaaaaaatgcgcccgctgccaatgaagaaaatggcacaggatcttgacattccagtctttcagccggaaaagatccgtgaaccagaagcggttgcccatttgaaaagcctgcatccagatttctttgtcgtcgcggcctacgggcagatcctttctcaggaggtgctggatattccgacctacgggtgcatcaacattcacggctcgctgcttccgaaataccggggcgcggcgccgattcatcacgcgatcattgacggcgaagcggaaacgggcgtgtcgattatgaaaatggacatcggcatggataccggtgcggtttacaaaaaggtggtcatgccgattactgagacgaccacggtaggagagatgcacgatcagatggcggaacagggggcagaggcccttattccggtgcttaaagacgtctgtgcggggacggcggaagcggtgccccaggatccagacaaagcgacctacgcggacaaaatcagcagggaaacaggattgatcgattggcatcagcccgcagacaaggtcttgcggcgcatcaacgggacggacccctggcccggcgcctggtgtcagtatcagactaagaaaatgaaatgctttgcgccgaaaatcctcgatcaggcggcatcgagtcggccaggcactgtcgtttcagctgacagcgaaacgggattgatcgtggcctcagcggatcagctcgtcgaaatccaggaaattcagatgcccgggaaacggcggatgaaggccaaggactatctgcggggcaatgccattgaggtcggcacggttctccactgattattttagaaaaatttcagtcttgcccactataatgccattaattttaatagaaaaaggagaatgacaatgtttttttgggactggacgatgatcatcctgatccctgggctgatcatttcggcgatcgctcaggcaaaggtcacctcatcttttaatcgatacagccggattcaatctagatcggggctgacgggctttgaaacggcgaaccgcctgctggccgtccaaaatgtgccggtcacgcttcacagtattgccggcaatttgaccgaccattttgatccacggaataaaactatcggcctgtcgcagccggtaggcaatagcgccagcctggccgcggtcgctgtcgcggctcacgaaacaggacatgcctatcaggattacgaaggctactttggactgaaattcagaaatgccattgtgccggtctgcaattttgcgaccaacgcggcgtggccgctgttttttatcggtctgattttcggcggcgcgagtcaatacggcgtcatgctgatgaatatcggtattctgtttttctcgttttcactgatctttaatctggtgaccttgccggttgaattcaacgcgagccaccgggcattggtaatgcttcaggaaaatcagatgttgggaccggacgaaattaagggcgccagacgggtgctctccgcggcagccatgacctacgtcgcggccaccctcgtgtccttcctgaacctgctgagaatgattttgttgagagatagtcgttcgtaataatatgaagcgaaaaaatacaaaaaacccacacaatttatcgccgcgcgaacaggcttacgacagcctgctcgccattgaccgggagggtgccttctccaatttggaaattcagagggcgctttcccgttcgttgttttcaaagccggacgcccatttgtacacggcgttggtttacggcgtccttcagaatgaaatgctgctggacgaccgaatctcaaagatgaccaagcccggcacgcggcttgattttgaagtccgcgagattctgcgcatcgcggcctttcagctgctgatgatgaaccgcatcccgccctatgccgcgatttccgaggctgtcgcgctgtgcggcaaagtcaaacccaaggccaagggatttgtcaatggggtgctcagaaacatggcgcgccaatcggaccagctcaaacgctggcaggcgtcagactacaaggacgccattcaggcgctctcagtccgtacgtctgtgccgaagccgatcgttgatatttacgccagagcctttggcgcaaaagagggcgtgcgcgagctgatggcggtgaatcggccgtcaccgctgaccattcgggccaatgggctgaaaatatcgcgagacgatttattaaaagagctggccaatgaaggcatagaaggggtgaagacggccctttcgccctcgggtatcaaaatcacgaacgcctctgtgtcggaattaacacagacccaggcctacacggccggtctctttacgattcaggatcagggcgcaatgctgatcgctgaggccctgtcacccgaggcgggggaacgtgttctcgacatgtgcgcggcaccgggagggaaaacgacgtatcttgccgaaatgatgggagatcagggtgtgatcaccgctcgggacatttatccctccagactaaagctgatcgacaaccaggccaagctgctgggcatcgggtgtattcaaacagaggccttcgacggcaccgcacgcaaggcggcggatcacgagcagtacgaccgcgtgctcctcgacgcgccgtgctccggtttaggaatcattcggagaaaaccggaaatccgctaccgatttgagtttaaaaagcagcgcgcgctcattgacatgcagcgcaaaatgctgataaacgcggtcgacgcgttaaagccgggcggtacactcgtttattccacctgcacggtggacccaaaggaaaacgccgagcaggtccgctggctctgccggaacgcaacgggactcactgtgttaaacacgcggcaaatcggtacagccgacgatcaatgcgacgggttttattacgccaaactcgttaaaaacagtgcgcagtcaaaatgacatccctgttggagcagtcgttatcattaacaaagaaagaagtgagggtgtgaaaaagagagatcaagctacaacagccatccgcgctaaacggcggaaattgacattaaaacagcgctgcagcctgctttccggccagtccaaatggtcgtctcagggcattccggaacaggaaatttatccctttgtgatgtctgacggcccccacggtctgaggcgggaaaaggaagacggcagcagctatcctgcgacctgctttccgccggaggtcactttgtcctgctcatgggatccgaagatggtgtaccgggtcgcagcggcgatcgcagaagaagcggtggcgcagggggtagacgtcattttggggccgggcctcaatatcaaacgcagcccactttgcggccgaaacttcgaatatttttcggaggagcccctattgtcaggtacgcttggcaaggcatacatcgagggcgccaaaagccgctgtgttgaaacctgcgtcaagcatttcttcgccaacaatcaagagagcaatcgcatgacgattgatgtgcggctgtcagaaaaggccgcgcgggaaatttacatccgcccctttgaaatcgcgatacgcggcgccgatcccggtatggtgatggccgcctacaatcaaatcaacgggacctacgcgacggaacaccgccatgcgctgacgacgctgctgagagaccaatggcattaccgaggcgtgacggtctcggactggtctgccgtccaaaatcgggagtccagcgtcagagccggcctggatttggaaatgccggattccgatggtgtcaacgacgagaaggtttaccgcgcggtcaggcgcttggcgttgccggagggctgtgtcaaccgcagtgtcgaacggctgatcgccttcggcgaacgctgtgaagcgaaccgccaggcccgtagggagctgaccctttcaagcacagcggcgcatcatcagctggcgcggcgcgcggcagcggaaagcatcgtacttttggaaaacaagcaccagcttctgcccctcgtgcccgaaaagctgcctcgcgaccatcgtcttttagtcgtcggtgccctcgcagagacgccgcggcttcagggcggcggttcgtctcaggttaacgccaattggatcgaaacgccttgggacagcctcaaagcggtgtacgcggacgttcagctggattacgcagagggatatgcgctgtccgcagtttcagataatgagcagcaggcgctttcggcgcgcgcccttaaaaaagcggcgcaggcggatacagttctgctttttgtcggcctgcccgaatcggcagaaagcgaatcttgggatcggtccgacatgaatctgccggtcgaccagttaaaattaatggatcagttgacggcggcgcatcaccgcgtcgtggtaatcgttcaaaacggcggggcagtcctgctggggcacgcggcctgcgcggacgctgtgttggaagcctggctcggcggcgaagcctgcggcccagcgctgtgcgacgtcctttccgggaaggtcatcccctcgggcaaattgacggaaactatccccaaacggctggaggatacgccggcgtatctgaattttccgggcgacggccgtgaagtggattatggggaaggcatttacgcgggctaccgcttctacgatgccaagcacctggcagtgcagtaccccttcggatacggtctgagctacgcggagtttgaatacacgggcttttcgcttaaggaagacgccggcgatgcgctgatttttgaggttaaactgaaaaatcattcggatttcgcggcaaaagaaacgattcaaatctacgtgggcatgccggacagcgcggtgagccgcccgcctaaggtgctggcagcctatcaaaaggtcgatgtgccggcaggcgcggtcaaacacgtcacgatcgctgtgcccaaggatcggctggcttattttgacaccggctctcatcaatggcggattgaaagcggtacttattgcttttactgcggcgcgtcgagccggaatttgaaatttaagcgaagtgcggtcatcgatatgggacatgctgagcctgtgattacggcaaattcaacggttcaggaggtgctgcgcaccgagcgggggcaggcgctgtttcagcaggcggtcgacttttactacaagctgaccggcttcgagctggacatgcatgacgatttcatcgtccattcggtgatggcgacgccgctggccaaggtgccgatgctttccggcggtatgctgacggatcggatgctcaggcgtgtgatccgctacatcaatcacgatgtccgccatctgggcattggctttttggcggccagagaggtgaacggtccgaaggtggtcgagactttgatccgcgcgcggaccacctattcgaaaaatcaggcggcgccttattcagtcgacacgccgatcgatctgctgctggcttcacctgagcaccgcgcggttctggcctcgcttctggggccgaagggcgagaccattttatcccacgctgccgtccgggccttggctaaaacccatttgacccttcgtcagcttcaggccattacgcccctgcatctgtttaaaaaatctgcattagaacaaatcaacacgaaattgaaggcgatacatttatgaaactacttatgatcgatacgtcgaccattgtggccacagcagccgtcctcgacgaggacagactgattgcggaaacaattgtcaactacaagaaaaaacattcggagaaaatgctgccgtccatcgaccacatgcttcaggattcgggacttaagcttggagatatcgatgtattcggcgtcgtcaacgggcctggatcttttacggggctgcgcatcggcatggcgacggcgaagggctttgcccaggcgctcggcaaaccgatggtgacggtgtcgacgctggaggccctcgctgccaacgtctgcgtcacagacgcagcgatctgcccgattgtcgacgcccagcgcggacaggtttacgccgcactctatcaatccgattgggatgcggaagcgcttaatcttaaaaacaccatggccgaaggcgtgtacgacgtcgacgcgctgtgcgatcgattgaacgcgttaaacgcaccggtgatcattttaggtgatgggcttaaaaaacacggcggcaagcttttggcagctgtgccgaaggcccggaccgcgccggcttttctttcgatgaaccgcgcgtcggcggcggcagccgtcgggcttaagaaaatacagcagggccaaacggtggactgttttcaagcagggctgaactacttgagaaaatcctcggccgaagaacagcgggaaaagaaactggcccaggaagcgcagcaccatgagtaacgtctggcggccctacgatttcaggctgatggaaagaagcgatctcactcaggtcatggccgtggattggcgttcagggctgattccctggccggagcattcgtttttagaggagctcgagaatattctggccgaatatctggttctcgttcagaacgattcggagaaccacgagaccgcggtagtcgggtttgccgggcagtggtttgtggccggcgaggcacagctgatgaaaatcgccattgacccggatttccaaggaaacggccttggacgcaggcttcttaaagaaatcattgcgcgtgcgcggcttcacgactgccagagcatgaccctggaggtccggacggacaacgagcccgctttgaagctttaccagagctttggatttgagatcctgggcaaacgcgatcattattatcccaacgggtcagacgcgtatgtgatggatttggttttcccagacgatcaaggagacagaacaaaacatgaagatattatcgattgaatcctcttgtgacgaaacggcggcggcgatcatcgaggacggccgccggatcctggccaatcaggtttatacccagattgccatccacagaaaatacggcggcgtcgtgccggaaattgcctcgcgcaatcacgtgatgaagatgccctttgtgattcaggacgcactggacgaagcgcagctcacctttgacgatctcgacgcggtcgcggtgacgaaggggccggggcttgtcggcgcgctgctcgtcggcgtgtcgacagcgaaggcgctggcctacgctctcgacaagccgttaatcggcgtcaaccacatcgaggggcacattgcggccaattatttggcttttccagaacttgaaccgccgtttttggcattggtggtctctggcggccacaccaatctggtcatcgtcaaggactacggcaccaatatcattttgggccggacccgcgatgacgccgcgggagaagcctttgacaaggtagcgcgggtgctgggctatccctatcccggggggccggcggtcgatcaggctgcgcaggccggcgacccgcaggcgatcgatttcccgcgggtgatgttggaaaaggacagctacgatttcagcttctccggccttaaatcggcggtgctcaacgaattgaaccaccgcaaaatgaagcacattccctacaaaagagaagacgtcgcggcgtccttccaggcggcagtcttagacgtgctgaccgaaaaaacggtccgctgtgctgaggcttatggcttgaaaaaaatcgtggtcgccggcggggtgtcggccaacaaggggctgcgcgcccgcatggacgccgccgcgaagcagcacggctggcagctgtattatccgccgttgtcgctctgtaccgacaacgccgcgatgatcggcgccagagcctattacgatttcaagctcggccgaaccagcggctgggatttaaacgcggttcctggattggagctgccggggatcgatcgcaatagggtataaaacttaaataaataataaattttaaaaatcttcccaaaaagtattgcaaaaagcaggagcatcgtttaatataatgtcagcactcagagataacgagtgctaataaaaacagaaaaaaacttttgggaggctttagcaatgaaattaaaaccattaggtgacaaaattgttataaaagtaaaagaagaagaaaagaaaacaacgggcggcatcgtccttcctgattccgcaaaagaaaaaccgcagcagggtgaagttgttgctgtaggttccggcgaaatgattgacggcaagaaagtaccgctggatgtcaaagtcggcgacgaagttatttattctaaatattccggctcagaaatcaaaatggatgacgaaaagtatctgattgtcaaacagaacgatattttggcaattgtagaagaataattgagacagacagagacaaaaggaggtctatcaaatggctaaagatgtaaaatacggagaagccgcaagagaatcattgctcagcggtgtcgatcagttagcaaacgcagttaaagtgacattagggccgaagggcagaaacgtccttctggcaaaatcatacggtgcaccgaacatcaccaatgacggtgtgaccatcgcaaaggaaatcgaattaaaagacccatttgaaaatatgggcgcacagctggttaaggaagtcgcaaccaagaccaacgatgtcgcaggggacggcaccacaaccgctacactgctggcacaggccattacccacgaaggcaaccgcaacgtcgttgccggtgcaaatccgatggtcttgagaaaagggatggaaaaggctgtcgacgctgttgtcgaaggcttgaaggaaatttctcagccagttaaatctgacaaatccaaggaacaggttgcttctatttctgcagcagatccgcagatcggtaaactgatcgcagaagccatggccaaggtcggcgacgacggcgtcatcaccgttgaagaaggcaagggcatgggcaccgaactcgacttcaccgaagggatgcagtttgacagaggctatgtctcaggctatatggcaaccgatacagaaaaaatggttgctgaactcgacaacccgtacattttgatcaccgatcagaagatttccaacattcaggaaattctccctgtgctcgaacagatcgcacagcagggtgcaaaattattaatcattgctgaagatgtcgaaggcgaagccttaaccacattggttctgaacaaactccgtggcaccctgaacactgttgctgtgaaagcaccgggctttggcgacagaagaaaggccatgcttcaggatatcgctattttgaccggcggccaggtcatttccaaggaaattggcttggaactcaaagacacgactctggaacagttaggccgtgcacgtcaggttaaagttgacaaggaaaacaccatcatcgtcgacggtcagggcgcaaaggaagacgtggacgaacgtgttgcccagatcaaggctcagattccggaaaccgattccgattacgaccgtgaaaaacttcaggaacgtttggctaaattgtccggcggtgtcgctgtgatccaggtcggcgctgcaacagaagtcgaaatgaaggaaatcaaataccgtatcgaagacgcgctgaatgcgacacgtgcagctgttgaagaagggatcgtcccaggcggcggtactgcactgctgaacaccacggataaagtggacgctctgatcgaaacactggacggcgacgaaaaggtcggcgcacagatcatcagaagagccattgaagaaccggcacgccagatcgctgaaaacgcaggtgttgaaggctctgtcatcgtcaacgaattgtccaagaaggacaagggtattggctacgacgcccttcacggcaaatacgtcaacatggttgacgaagggatcatcgacccgacgaaggtcacccgtaccgcgatccagaacgcagcttccatcaccgcgatgctgctgaccacagaagtggctgtcgcagatcatccggaagaaaagagcgacgcaccggctatgccagctggcggcgcaccgatgatgtaagccctgcaaaaatgcagaactgaaaaagagagaagacaaaaatctatcacccccgaatatcatatcccctttgatattcgggggtttttctttataataataagaaaagagatgcttttgggagagacttatgcagcaagacaaaatgattgaagccatgcggcagcgctggggcgaacggacgcctggctatctgccgcggctaaaagggaaaagcaaggcggtgctcattccgctgattcagactgagaaaggactcgaggtcgtctacgaaattcgagcgacgacgctgagaacccaaccgggtgaggtgagctttcccggcggcggcattgaagccggcgagacgccggagcaggcagcggtgcgcgaaacctgcgaggagttgctgatgacgccggaaaatgtcgaaattctggcgccgatggacggggaaaacgccccgaccggcgcgcccctctggccctttgttggcaagctcagccattacaaagggacttattctaaggacgaggtcggcgaaattttcaccgtgccgctgagctggctgcttgaacaagagccagaaatgcacatgacgacactggtgactcagccggatcccgggtttccttacgagctgatcccgagaggggagcactacagctttagaaagaaaaaacacccgatttatttttaccaatatcaaatcgctcaggatcgggacccgatcgtcatctggggcttgacggcgcaggtgacctggtcctggattcaaaaactgaaaaaagagattatcgcgtaaatgcgagcagaggaggaatatatgaaattaacaattttaggcaacaatggtgcgtatccgcgggcgaacggcgcctgctccggctatcttttggaaaacgatcaggccaaggtgatcatggatttgggggccggcactttgagcaacctgatggctatcgacgacgcgtctgatctcgacgcgattctgctttcccacctgcactgggatcacatttccgatttatttgtactgcagtatctcttggaaaaacgggatcaggtggtgccggtttaccttccggaatcgccggccaatatttaccaaatgatcgctgacatcaagagctttgacgtccatccgatccacgacggcgacgaagtgacgatcaaaaatatgacattcacctttaaaaagatgcgccaccctgtcgaagactacgcgattaaagcggtcgacgacaacggcaaggcctgtctttacaccggcgataccggcatttgcgacgccctgaccgatttcgtcgaaggggtgcacacaatgctctgcgactgcacctatgtggacaacccggatgaaaacaagcacttgtcggcggggcaggcggctgaaatcgcggaaaaggccggcgtgcgccatttgatcctgacccacttcaacccagaactcaatccgcgggattacgcgattgtggccgaacgcattctgcgcagaggccgcgtcacgaaatcggaaatcatgctgaccttcaatatttaacccttttatcggccttttgaatcggtctgaggctttggctgtacagggtctttacagatgtgataaatatttgtgaagagatgatgaagattcattgacaagttttgaaatttcaaatataatatcccttgtccacctgtatcaaaagatttccacagggtagtttacattcaggaaggggggatattaaatgtcagaagtacgtgtacgtgaaaacgagtctttggaaagcgctctgagacgttttaaaagaaagaccgctatggcaggtgtcatgtcagaaattcgcaaaagagaacactatgaaaagccaagtgttaagcgcaagaaaaaatctgaagctgccagaaaaagaaaaatgaagaaacatagataaaaggatgtgtcataagtttggctttaaagaaacagttattaactgatttgaaagcggcgatgaaagcgaaggataaggttcgcaagtcgacgatcacattgatccgtgcggcgattcttcaggaagaaaaagataaacagatcgacaatcttgaagacagcgatatcgaagcgatcatctccaagcaatacaaacagagaaaagattctttaaaggaattcgaaaaagccggacgtgatgatttgattgaacagaccaaggctgaaatggcgattatcgaggactatctccctaagcagttgagtcaggaagaaatcggcgcaattgtagaagataccattcaggaaatcggtgcggaaagcatgaaggatatgggtaaagtcatgaaagcgattatgccaaaggtcaaaggaaaggccgatggcaaagtggtcaaccaaatcgttcgggaaaaattgaattaaatcaaagcgccgcagattgtaaatttgcggcgcagatttttaaaaaaatattgacaatataaaagtcagctggtataataatatttgttgtcgaggtgtagcgcagtttggtagcgcacatggtttgggaccatggagccggaggttcgaatcctctcacctcgaccatttttttatttgagggcctttagctcagttggtcagagcatccggctcataaccggcaggtccagggttcgagtccctgagggcccaccattttgggctaaatctagcggttttagctagttctttcgggaaatgaaatgacatttccccgcgaattccccacttttgaagacaatttgccgttgggatcaaaagtagggatttttttatttgtttgctttttttataaacgcattaggtgttccaacgaaatagtgccatttaccgcttttagtgtattttaagaatagaaaagcctataaggtacttgctaaatgattattctgtcgaaagaacagatgattgtgcttcatgcaccttttcaatcttttgacggaaaggatgtctatccatcgattcaataaaaagccgctcgccttgggtatgggttagtcaccaatcatgcttttgttgatggtaacaaacgcatcggggcccatgcaatgttagttttcttagcgctaaatggaattgaactgattatacgcaggacgaattagcggatacgtttctcgacattgccgctggacagaggtcacttgatgagttgttgggatggataattgaccatcagattcaaataacagttgatttatatttgaatcagaggtggggatttttgttctttgtcatcggactcaacttgaagtagagtttctaaaaacgcacatttatgaaactcaacgatctgtttctgtgaaaaattgggggattagatttattatgatcatagaaagggggtctccttgtggatcaaaaaaaaatcggaaacttcatcgcggcttgtagaaaggaatgcggattgacgcaggctgttcttgcagagaaactcggtattacagatcgtgctgtctcaaaatgggaaagagggaagggcctgcctgatgtgtccattatgccggaattatgtgacgctctgaacattaatatcaatgaactttttaccggggagcgattagcgatggatcaatatcaaaaaatggctgaacaacatctgctggaaatgcgcagacaggaagagcaggcaaataaaagactgctttcattagaaaccgtgatcggatacacatgttcactttcatttatattgatgatttttgcagcatcttttgccgtttcgattacggtctggcgaatcgcgctgattgcagcagggtgtatcatttttacggttgggatggtatattgtttaaaattggagcatgatacaggatattatgaatgtccttcgtgcggcgccatttatattccaacaatgaaatccgttgttttttctccccatattggaagaagcagaaaaatgaaatgcccgaattgtggaaaacgcgcatatcacaaaaaggtgcttacgaaataatgattttcgaggagtggaatttgtggcgattgatagatcaaaatgcgccaatatttttctgtatttattaagaatcaatttgagagaattgataataaaataaagatgaaattcaacagatgaatacgttgtcgtcgttcatttctcttaaagtcataattatttgcatattaaatacaaaaagcacattgaaatgtaaaatattaaagcctataataataaaaactgtaatgtttcattacagttttttgttttttacggtttatatttttaaaggaggaaagttttggaaagagtttttaacttcgcacctggtccgtctgctttaccagaagaagtactgaagaaagctcaagaagagctgctttgctacggcaataccgggatgtcagttatggaaatgagccatcgttcagctgactttactgatattttagatcaggcaaaggctgatttaaaggatttgatggggattccggacaattacgacatcctgttcctgcagggcggcgcgtccacgcagttctcaatgattccgctgaacctgatggtgcacaatcacaaggcggattacatcaaaaccgggaactgggcaaagaaagcctacgaacaggccgtgaaggtcggcgacgccaaggtcatcgcttcctcagaagacaagacctacaattacattccggattacgacatctcgatgctccgcccggacgccgattacctgcacatctgcgtcaacaacaccatttacggcacttattttgcaccggatcgtctgccggaaacaccggacaacattccgctgattggcgacatgtcatctaacattttgtccgaaccctacgacgtttcgaaatttggcatgatctacgcaggtgcacagaaaaacatgggcccggctggcgtcaccgtggttatcatccgtgacgatttagtaggacaggcggatccgagcatcccgacgatgttagattacaagacccacgtcgataaggattcctgcttcaacaccccgccgtgctttgctatctatatgtgcggcctggtcttcaaatggctgaaggaaaaaggtggcatttcagcgatggctgaactgaacaaggcaaaggcagccaagctgtacgatttcttggataactccgcgttattcaagccgacggtattaaatccgaaggaccgttcactgatgaacgtcccgtttgtcacaggcgacaaggacctcgacgctaaatttgtcaaagaatccaaggaagcaggtttggttaatttgaagggtcaccggacagtcggcggcatgcgtgcttcgatttacaacgccatgaccatggacggcgtcgatgccctgatcgatttcatgaagaaattcgaaagagcaaacaaataatttcaacctgatattcagctggatcacagggcatcaaagatccgcaaattcgcgcgcagtaaagaccggggtagtatcgtagttggccggatttgctgcggcatgaacagaaggaataaatatgaattatcaaatcaaaacactgaacaacatttcaaaaaaaggactgaaacagctgactgaacaatatgtcgtcgaccaggaaggggccgattcaccggacgcaatactggtcagaagcgccaaaatgcacgacatggcgttcaacgacaatttgtcctttatcggccgtgcgggcgcaggcgtcaacaacattccactggaccgctgtgcagaacaggggatcgtggtctgcaacgcgccgggtgccaacgccaacgccgttaaggaattggtggcaacagccatgttgatttcatctcgaaaggttgttcaggggattgaatggaccaaaacgctggacggaaccaaaacggacatcggtgcagcggtagaaaaaaataaaaaggcttttgccggaccagaattatacaaaaagaaaatgggcgtcatcggtttgggcgccattggtctgctcgtcgcaaacatggccgtcgatttcggcatgaaggtatacggatttgacccttttattacaattaaacacgcctgggggttaagcagaaaagttaaacgggcctccagtctagaagctcttttccaaaattgtgattacatttcaatccacgtaccgtacatggaagcgacgaagaattacatcaacgctgatctgctcgctttggcgaagccgaatctgcgcctgttgaacctggcccgcggcggcctcgtcgatgaagatgcgctggccgaagcgttggaaaacaataaaatcgcggcctacgtcaccgacttcccgagcaacaagacgatccacatgaaaaatgcgatcaatattccgcatttgggcgcgtctacgccggaatcagaagaaaattgtgcgacgatggtcgtcaattcccttcgtgaatacatggaaaacgggaacatcatcaattcagtcaactatccggactgcagcatgggcgaatgtgaaacggcacaccgcatcaccgtggcgcaccaaaacattccgaacatgatcgccagcatcaccaccgtactggcgaaggataacgtcaatattgccaatatgacgaataaaaacaaaggcaaatacgcctacacgatgattgatattgattccgaagactttaaggtggaaaccctcgacgatttaaaggcgattgaaggcgtgacccgcgtcagattggtcaaataagatggcgacaatcaaagcttttaaagccattcgaccgacgccggacaaggctgcagatgttgcagccctgccctacgacgtctacaaccgggcggaagcgcgggaagcggtagcgggcaagcccgactcatttttgagggtagaccgcccagaaaccacgatggatccggacatcgatttgtacgatcccgcggtttatcagcaggctaaaaagaacctcgaccgcttgatcgacgatcacatcctgattcaggatgatcaaaagcagttttatctctacgagctcaaaatgggggatcaggtccagacggggctggtcgcctgcacagcagtggacgaatatttaaacggcacgatcaagaagcacgagctcacccgcagtgaaaaggaacaggaccgcatccaccacgtcgacagctgtgacgcgaacaccggcccgatctttttgacctaccgccatcgcgacgccattgaccgccgcgttaaggccattcaggaaaaggcaccggtttacgcctttaccgcagaggacggcatccgtcatcgggtctggtgcgtggacgacgcgcaggacatcgaaggcttcgtcagcgactttaatgacgtgccggcgctttacatcgcagacggccatcaccgcgcggcgtcagcagtgaaggtcgcgcagatgcgccgcaaggcccatccggggtacagcggcgatgaaccctttaattattttctctcggttatttttccggacaatcagctggccattttggattacaaccgcgtggtgaaggatttaaacggactgactgccgacgcgtttttggacgcggtcggtgaaaagtgcgatatcgaaaaagtggatcaagcgtataagcccggccaaaagggaacctttggcatgttcctagacgatcagtggtacgcccttaagattcacgacgatttggtgaatccagacgatccggtcaagagcttagacgtttctcttcttcaggaagaggtgctttcgccgattctcggcatcggcgatccgcggaccgatgaccgcatcgatttcgtcggcgggatccgagggctcggggagctggaacgccgcgtgcacacggacatgaccgtcgctttttcgatgtatcccacatcgattcacgagctgatggccattgccgacgcggggcttttaatgccgccgaagtccacatggttcgaaccgaagctgcggagcggcttattcattcataaattatcggattaaacaatattcatcatgacattgaattccagagggtatccctctggaattctttttttagctgaaaaatttgcatttttaaaatcttttcaatataatctacgcaaaaggaggtgctttcagatgatgaaacacgatgaaatggtcatttaccatatttttaccatgggttactgcggggcagaagcgacgcaggcagaatgtgacggcatccaccatcgtttaaacaaaatcgaagcacaactgccttatttgaaaaaattaggagtcaacacgattttgctcgggccgttgttttcgtcgatctcccacggatacgacacgacggattacgcaaaggtggacccgcgcctcggcactaacgaggacctgacccacttggctcaggcctgccacgatcagggcattgccgtgattttagattgtgtgttcaatcacgtgggccggacgttttttgcctttgaagatttaaaacaaaatcgtgaagggtctatttataaagactggtttgacagcgtcaatttctgggacaacaacagctacaacgacggcttttcttatcgcaactgggccggctgcgacaatctcgtcaaactgaacctgtatcacccggacgtcaaagactttttaaagcggacgctggcgtcctggattgacgattacgacatcgacggggtccgaatggacgcggccaatgtgatggatatgggatttgtgaaagagctgggcgatatggcgagagccaaaaagccagatttcttcatggtcggcgaatccgtgtccggcgactattcgctgatggtcgaaagaggcgggctggactcagtcaccaattacgaggattataaagggctgtactccagcttaaacgacaagaactattttgaaatcgcttattccctcaatcggctgttcgcgcagggcggcttgtatcagcattttctcacctataattttgtggacaatcacgacgtcgaccgggttgcgtcgaccttgaatgacgaacgggatttggaaccgctctatctgatgctcttcacgataccgggaattccgacgatttattacggcagtgagctgggcatcaaagcgcggaagggcaacggcaccgacgcgccccttcgcccggccgcggacgagctttcctttgatttaaacaatccgctgactgaaaaaatcagacggatgatcgcggtgcacaaaggcgtcgacgcgttaaaaaaaggcagctacgagcagatgttcgtgcagtcctgtcaaatgggctttattcgaagaacagataaccagacagtcgtggcagttttcaactgcgaggggtctccggttcaaattcgggacgatcggttcaacggcctttattacgatttgtatcatcagaaggaatgtcagctctccggtatggtcactattccggaaaagagcggcatggttttgatgtcgatggatcaggagatcccggacattcaaatttctgaagatcagccgaccgcagaagaccgtgacaatgaaaacgtccaaaccgattcgacatcagatgcgatattcggggcgcggcctaagaaaatggaagattatatgggccttgcactggaagaagcgcaccgtgcggaagacgaaggcgaggtgccaatcggggccgtaatcgtaaaagacggcgaagtgattgcgtccaatcacaatcgcaaagaaggcatgcaggacccgacggctcacgcggaaatgctggtcattcaggaagcgtcgaagaagctcgccagatggcgtttagacgactgcgagctttacgtcacagcggagccctgtccgatgtgtatgggcgcggtcattcaaagccgaatcaaaaaagtcgtttttggcgcgtcagaaccgagatacggtgcagtggagtcgacagcccagctgaaacagcacccgatgctgtccaagcacactgagatttacggcggcattcgtgaaagtgaatgcgaagcggtgctgaaacgcagctttgagaaaaacagaaaataagcgcttgacaatttaagcggcaatgttatacttgtatacaatatatacaattacgatgaacgagagaaaaacacggccgatttcttcagcgaactgtcgaagggtgagagggcagcagaaaaaccgtgcgcaataatcactcgcgagtagcggattcgaatggcgtgcagccgagtagaaaacgccgagaggcccatccagcgttagtggattagagtttggattttttcagacttgaagtggatatgtggtgttctcatatcaaaaagagtggtaccgcggacaatgtattttccgtctctttgaattttgcgatagcaattcaaagagacgttttttatttaggaggaagcatgaaggcagaagcccataagaaaatcgtcacattcgattcgacattaagagacggcgcgcaggctgaaggcatttcgttttctgtcaaggacaagctggatattgtcaaaatactggatgcgctgggcatcgacattatcgaggccggcaatccgggatcaaatccaaaggatattgcgttttttgaagcgctcaaggagatcgagctgacccacgccgcgctctgcgccttcggttcaacccgccatccggggaaaaaggcggaagatgacgccaatctgcaggcgattctacagactaaaaccgaatacgcggcgattttcggcaaggcctcggcctttcacgtagaggttattttaaatacaactaaggaagaaaatctaaacatgatcgaggattcctgccggtttttgtcagaaaacggcaagcaggtcattttcgacgctgagcattttttcgacggctacaagctcgacgccgcctacgcccttgacacgctgaaggcggccgaaaagggcggtgccgtctgtgtgtgcctctgcgatacgaacggcggcaccctgccgtcggaggtcaaggacattgtggcagaggtgtgccaggcggtttcaattgacgtggcgattcacgcgcacaatgacagcggcctcggcgttgcggcttcgctggccggcgtcgagggcggcgccaatcaggtgcaggggacgtttctcggctacggcgaacgctgcggcaacgctaatctgtccactgtgatcgccgaccttcagatgaaaatggggtatacctgcctttcagagactgcgatgaaaaaattgacgtcttcggctattaaaattgcagaaatttccaattacgcgctgacgggcagagagccttatatcggaaaaagcgccttcgcccacaaaggcggcatgcacatcgacgccgttctgaaggagccccactcctttgaacacatcaatcccgaacgggtcggcaatcagcggcggattttgatgtctgaggtagccgggcgcggcaccatcattcagctcatacacgatatcgatccgacgattgagaagcattcagaggaagcgacgagggttatggatcgcatcaaggagctggaatacgagggctatcaatttgagggcgcggaaagctcagtcaagcttttgatccgaaaggagctgggccgattcaagccctttttcaaaattgaggactttaaaacgattggcgaaaagccagttgccggacgggccctgtcagcctctgcgattgtgaaggtttcagtagacgggaaggaagcaatcaatgcggccgagggtgacggccccgtcaacgcgttggataaggcccttcgtgcagcgctcgaaggcttctacccgagtattaagacgctgaggctgacagacttcaaggtccgcgtcatcgatcagggggcgacagcctcaaaggtccgcgtcctcattgaaaacagcgatggccgagatatttggactaacgttggggtgtcgacggacgtgattgaagcgagcctcatcgcgctgaccgattccatcgaatacaagctgttgaaggacatggaacaaaaaattaaggattattatttataacgacgctttacaacaaaaaataatttcattaaaatagaatgaagtgcatcaatcatcaaataagtttacaaataaaggagaaacactatgggaatgacaatgactcaaaaaatactggcagcacacgccggtgtggattctgtcaaggctggggatttgattatggccgatctcgacctggtattgggcaacgacatcacctcgccggtagccatcaatgtttttaagaatttaaacacgaacaaggtcttcgatcaagacaaggtggcgctggtgccagaccactttgcaccgaacaaggacatcaaggcggccgaacaatgcaagaccgtccgtgaatttgccggcacacagaaaatttcaaattattttgaagtgggccgcatgggcgtcgaacacgcgctgcttcctgaaaaggggctggtgacggccggtgatttggtcatcggcgcagattcccacacctgcacctacggggcgctgggcgcattttctacaggcgtcggttcaaccgacatggcagtgggcatggcgactggcaaggcgtggttcaaggtaccgtccgctttgaaattcaatttaaccggaaaaatgaagccttacgtttcgggaaaggatttgattctccacatcatcgggatgatcggcgttgacggcgcactttacaaatcgatggaattcgtcggacctggggttgccaacttgacgatggacgaccgattcaccattgcgaacatggcgattgaagccggcggcaaaaatggcatcttcccagtcgacgaacagactctcgcttacataaaagcacattctgaaaaaccgtacacggtttatgaagccgatgacgatgcggaatacgatgccgtttacgatatcgatttatccgaactcaagccgacggtggccttcccgcatctgccggaaaacaccaagactgtcgacgaaatcgaagaaccggtcaagatcgatcaggttgtaattggttcgtgtaccaacggccgcttctctgatttcgaaaaggccgataaaatcttaaagggccgtaagatttcggacgatgtccgcgtcattatcattccggctacacagaaaatttgggaacaatgtatggaagccggcttcttcaaggattttgtcgaagcgggatgtgcgatcagcaccccaacctgtgggccctgcctcggcggctacatggggattttggctgcaggtgaacgctgcgtgtcgacgacaaaccgcaactttgtcggccgcatggggcacgtggattcagaagtgtatttagccagcccggaaacagcagctgcatcggcaattttaggctacattggcacaccagacgaattataagagaaacagaaagaggaaaatcgatatgaatgcaaaaggaaaagtatttcgctacggcgacaatgtcgataccgacgtcatcattccggcccgctatttgaacaccagcgatccgctggaattggcgcagcattgtatggaagatatcgacaaggattttgtcaacaacgtccataagggcgacatcatcgtcgcggacgacaacttcggctgcggttcttcccgcgaacacgcgccgatttcgatcaaggcgtccggcgtgtcctgcgtcattgccaacagcttcgcccgtattttctacagaaattcgatcaacatcgggctgccgatcttggaatgcccggaagcagtcaaggtcatcgaagccggcgatgaagttgaagtggattttgattcaggcaaaatcacagatatcacgaagaatcaaagcttccagggtcaggcgttcccgccgtttatgcaggaattgattcaagctggcggcttggtcaattacgtcaatgaaaatatgctgaaataagggaaatagaggagaataaccatggaatataaaattgctgtaatcaagggtgatggtatcggcccggaaattgtcggcgcgagcatgaaggtgctggacaaaatcggcgaaaaatacggccatcagttcaattatcatgaagtgttagccggcggcatcgccatcgatgaaaccggctcaccgctgccccaggaaacggtcgacgtctgtaaggcttccgatgcggtgctgctcggcgccatgggcggcccgaaatgggataatctgccaggggacaagcgtccggaagcgggccttttaggcatccgcaaggcactggggctgtacgccaacctgcgtccagccattctcttcgatgaactccgcgatgcgtcgccgttaaaaccggaattgatcggcgacggcctcgacgttttggtcgtccgcgagttgacaggagacgtctattttggcgaaaagcacagagaaggcgacgaatacgcttcagatttgatgaactattcccgcatggaagtggaacgcattgcgaaggttggcttcgacgccgcgatgcgccgaggcaaaaaactgacctgcgtcgataaggctaacgtgctcgaaacgtcccgcctgtggcgcaagatcgtcaaggaagtggccgaacagtatccggaagtagatgtggattatttctacgtcgacaacgccgcgatgcagctggtcatcaacccgcagcaatttgacgtcattttaacgggtaacctctttggtgacatcctctccgatgaatcgtcgaccatcacaggctccatcgggatgctgccgtccgctagtctcggcgaaaacaactttgggatgtacgaaccgattcacggctccgcaccagatatcgcaggacaggataaggccaatccaatcgcgacggtgctgtctgtggcgatgatgctcagatacactttaggtctcgaaaaagaagcgaaaaacatcgaagatgccgtagaagcgaccttgaaacagggctggcgcaccggcgatattgcaacaccggacgacgatgtgatcggctgccaggaaatggcacagcacatcattgaaaatttatgatgaagtggtgagaagcaaatgaaaaaaatcaaacgaactgccgcagcgtattcgttgttcaatgcgctgggctataccaaagaagaattggaacgtccgctcgtcggcgtggtcaattcctacaatgaaatcgtcccaggccacatgaacctggataaaattacagaagccgtcaaggcgggcgtccgtctcgcgggcggcaccccgattgaattcccggcgatcgccgtctgcgacgggatcgcgatgggccatcagggcatgaagtattccctcgtcacccgggaactcattgcggactcgacggaagcgatggccattgcccatcatttcgacgcgttggtgatgattccgaactgtgacaagaacgtgccgggcctcttaatggcggcggcccgtctgaatctgccgaccgtattcgtctctggcggcccgatgctggctggtcacgtcggtggccggaaggtcagcctctccgcgatgttcgaagcccagggtgcacaccaggccgggaagatcaacgatgcacagtttgacgattttgtacagcacacctgcgaaacctgcggttcctgctcgggaatgtacacggcaaacagcatgaactgcctgaccgaagcgatcgggatgggcctcagaggaaacggcaccattccagccgtctattctcagagactgcgtctggcgaagcacgcgggcatgcaggtcatggaaatgatcgaaaaggatatccgccccctcgatatcatgacagaagcggccttttacaacgcgctgaccgtcgatatggcgctgggctgcagcaccaacaccatgctccatctgccagccattgcccacgaagcgggcgtgacgatcaatccggacatcgtcaacgaagtgtccgaccgtacgccaaatctctgccatttagcaccggcaggcgatacgcatatcgaagatctgaacgcggccggtggggtttacgcagtgatgacggaactcaataaaaaaggtctgctcgatttggactgcatgactgtcaccggaaagaccatggctgaaaacctgaagggtgttcagaatttggatcctgaaatcattcgtccgatcgatcacccgtatatggaaaagggcggcttgaccatgttgaagggtacgctggccccggggaccggtgtcatcaaacagtctgccgtgctgccggaaatgatggttcacgagggtccagccaaagtcttcgattctgaagaagaagcacaggctgcgatcgatggcggaaaaattgtcaagggcgatgtggtcgtcatccgttacgaaggcccgaagggcggcccgggcatgcgcgaaatgctcaacccgacatccgccatcatgggaatgggcttaggcgattcggtcgccctgatcacagacggccgtttctcgggcgcgacgcgcggtgcctgcatcggacacgtctcaccggaagcagcagctggcggaccgatcgccttcgtcgaagacggcgaccgcatccggattgacattccgaatagaaccgttgatttgcttgtgtcggaagaagaaatggcaaaacggaaggccaattggacaccgaagacgccggatatcacgaccggctatttggcaagatacgccaaattggtttcttcggctaatgaaggcgcggtcttaaaataaagagggagtcacggaaatcaatatgaatctaaacagtcagaaattaaagggttcggaaattgtcgtaaagtgtctgcaggaacagggtgtggaatacgtgttctcatatccaggcggtgcggttattccgctgtttgacgctttttatcggatggatcacaatatccatcaggttgaaccctgccacgaacaaaacgggattcacgcggcggaaggctacgcccgtgccagcggcaaagtcggggtcggtatcacgacctcaggtcctggggcgacgaatgcagtcacagccattgccgacgcacacatggactcgacgccgctggtcgtcttcaccggccaggttacgcagcagcttttggggaaggattccttccaggaagttgacatcacgagcatcacgctgccaattacgaaacacaattttatcatcaaggacatcacgatgctggcgccgacgatccgcgaagcttttagaattgctcaaagcggtcggccggggccagtggtcatcgacgtgccgaaggatatctttttagcggaaacggtctacacgccggaaaaaccctatctgctcgatgtcaaccgcccgacaccgcagcgcgacgcgttaaaccgcgcggctaaatacatcaatagagcggaacgcccggtaatttacgccggcggcggcgtcatcaaagcgggcgcctcggaaatgctggtcaaatttgcagaaaagaccggaattcctgttgccaattcgctgatgggcttaggcagcattccgagagacaacccgttgtcattggggcttgtcgggatgcacggctctcaggaatgcaacctcgcagtcattaactgcgacacgctcattgccatcggggccagattctcagaccgcgttaccgggaatattaacgaattcatgcgcgacaaaaagatcattcaggtcgatgtcgatgccactgaatttgaaaagaatgtcgaagcgaacgtgcatatttgtgcggatgtcgccgatgtgctgccgaagctttacaatctggtggaagaaaaatcttatccggaatggtacaagcagattgcagaatggccgctcgaagaaaaaccggaaacggaataccatccgaagacgatcattcatcacattaacaaggcctttgaagacgcctacgtggtgacggaagtcggtcagcatcagatgtgggtcggtcagcattggaaatttaaattccccaatcagtacatcacatccggcggcttaggtacaatgggattcggcatgggtgctgccattggctgtcagtttgcccatccggacaagcaggtgcttctgatcgcaggagatggctcgtttagaatgaactttacggaattgacgacgatccgccgctacaatctgccgatcaagatttttctgtttaacaatgaaaccctcggaatggtgcgccagtggcagaaattgttcaacgaccgccgctacgcccagacggatttgacggatcacgcggtggattatttgaaattggctgacgcgttcaacattaaaaattacgacgtcaccgatttaaaatctctggatcagaccctggaagaaatcaaggatctcgatgaaccagttctggtcaattgccacattgatcacgacgaaggcgtgtatccaatggttccggcagggaagccgattgacgaaatttattacgaataattcaacccttttcaataaagcgaggcgaaagtctcgctttttttattttttatttatgagtgcaggacttttcttttttgtaaaatattgtataatatatgcagaaatgaatagcgcgggttgaaatcatgatgcagattattttttcgtggatcatcggctcggttttaggcagctttgtaacctgctggtgtgacagacagatatccggccaatccattttgtcaggccgcagtcattgcgatgcatgcggtcaggtggtgcgctggcgggatttgatcccgattgtctcctacatccgccttaagggaaggtgccgagactgcggcgccccgattggaatcacctgcctgatcaacgaaattgtaccggctgtgctcttcgcttattttgcgtataagtggggatggcagctctggtcgattcgattggcggggcttacgttggtgctgatggcggtctcgacgattgacgcccgtgagcagattatcccagatgttttaatcgtgacagggatcttgtggtggattttaacgacgtggctgcttcatttgtcctttttaaaaggggttgccggcggattggctttaggcgccttggtctggctcacggcagtcatcatggaccgcgttttaaaccgcgaatcccttggcggcggtgacattaaattgttctttatgacagggctgtatgtgaccatcaattttgccttttggcacttaatcctttcggcgtgtacaggcttgttgatttacagcatcaaggggcacaagggccagaatgaagaagagctggcatttggaccggcgattgcaatatccacgatggtttgtctcttaacagagccaatttttgtacgattcttttcgtcattcaactaatcattaaagagggatacaagagaaatgaagaaaaaagggaaaacattattaacgggtttgggattgattttgacactcgcactgtgtctgacggcctgcggcaccagcaaaacgcaggagatcacgtcgaaaagccacagtgttatcaagtccattgggacggcgtccaataatttgaacgcgtacaaggccaaggttcagaataaaacgggcaagaagatcaccagcgtcgaaattaaaaattcgattgataatgagtacggggacgatttattggattcaggcgataccttcaaaaataacgaggtgcgctacatgtattacgacgcgacagatgccgtgaataccgctcaggaagatggcaaggaagaatcgtcgattaaatattacgtcaaagtgacactggacaacgactcgacttacgtaatcagcaaattccccttcaataaaatcaagggaaccgcgaaaatttactttgattcggataaagaagtctgttacttaatttacaccaataaatccggaaagaagatcaatactaagaaaaaagaaaagaagagcggcgtatcgtcgtcgagcagttcttcttcatcctccagcagctcatcgtcctacaatgattcttcgtcgagcagctcgtcatcgtacagcagtggacgttacggtgttggcagcagttcgagcaacggttattcaagtgggacaggcagccaaagcagtggacgctacggcgctggcacaagttcgggcaataattattatagaaattacaataataataatggaaataccggtagtaatactggcggaaatactggtggcaataccggtgggaatactggaggtaccacaggtggaacaactggcggtactacaggtggaacaactggagggaacactggtggcaccacaggtggaacgaccggtggcgtaacacagtaagatttatgaattttataaaacaattaatagctaaagctttagccatcactgccatcatcattttggcagtggtggcttattgcgcgtggagcgcgccgtattttaagcagcttggcgtgctcggcggccttgagatccaacagcctaaaatgccggcaatcaattgctggggcgacagcctgacgcagggggtttttggtgaaggtgaaacttatcccaaagccctaaggcgcatcatcgcgcgccagctgacggcaaacggttatccgcaaagtgtgccagttgtccgcaatcttgggatcagcggcgaaacgagtctcgaaatcgcctgtcgtggcggcctcgcgatgcggactcagtcgccgattcgcattaatcagggtgaacggcagatctttagaatcacagcggacggcggcaaggccgtttcaatcctgagactgggcgatacgggcgtcaatccagttaaaattggctctgtcgtcgggcggctcgaccgaattgacgatgaaaatcattacaccttcacgccgacgcacgtccgttatcaggatacccttccgaaaaattcaagagtagttacctacgcagctgcgcattaccgctcggcgatcccggtgattttcatcgggcagaacggcggctacaccaatactgcggatctgatccgtcagcagaaggcgatcattcacaatcaaatcggcgcagagcatcagtacattgtcgtggggttgcacaccggaaccgcgaaacagcggacggctttggaaaaaaagatgcagcagacttacggtgatcattacatcaatttaagaaagattttgtcgaaaaacggcaccaaaatcgcgggcatcaaggcgacaaaggaagaccggcgcatgatgcgcgcgggtatggtaccggccagtttactggcagacgaccatctgcatttcaacgccaaaggatatcggacggtcgctaaagtaatttacgcgaggatgaccgcacttaaacttatccgttatccccttggtgcgcagtcaattgtaaagaattattacgaataaaggagaggcctatggcaaaaataaagacccagtacaaatgcagcaactgcggccacgttgtgccgaaatggatgggccgatgctcccagtgtggcgcctggaatacctttgaggaagtggtcgagacgccgaagatttccgagaaggctcggcagaccggccgggaaagaggcgtttacaaccagccccgaagactttctgaaatttcatcgaagcaggaaaatcgtctttcaacgaaaaacgaagagctcgaccgcgtgctcggcggcggcattgtccgcggcggagttgcgctgctgggcggcgaccccggcatcgggaaatcgacgctgcttcttcagatgaccgaaaacgttgcgagtcaaaattacaaggtgctgtacatttccggagaagaatccgagcagcagatcaagatgcgggcggatcggatgcacattcagtcggactccgccttttttctgtctgaaattaacatgacctacatccgccagaccgtggtgaaggaaaagccgaatctggtcatcatcgattcgattcaaaccatgtacaatcccgaaattacctcagcaccggggtccgtgacacagatcagagaaaatgccaacgccctgatccaaatcgccaagaaagacggcatctcgatgtttttcgtcggacacgtgacgaaggagggcaatctcgccggcccaagggtgttagagcacatggtcgatacggttttgtattttgaaggcgagaaataccacgcgtaccgaatgcttcgggctgtgaaaaaccgttttggttcgaccaatgagctcggtatttttgaaatgacggatcggggcctgcttccggtccagaatccttctgggacgatgcttgtgtccaggcctcaaaacacctgcggttcggtggtcgtcccgatcgtggaaggcacgcggccgctcttggtcgaacttcaagggctggtttccgcgtcggattacgcgaaccccaggcgcatggcaacgggctttgactacaaccgcatgattctgctggttgcgattatggaaaaacggatggggctcaatatgaagcagatggacgcgtacatcaacattgtcggcggcatccgaatcgatgaaccggccgcagatctggccgtatgctgtgcgctgtattccagctacaatgattttgaaatcccaagggatatgctggtgatcggcgaggttggcctgacgggagaagtgagaaatattcaggatgtcgacaaacggctgaccgaagggaagaagctgggctttacgcggtgtatcctgccgaagagcaacgaaaaggcaatcgagaaagttggcaagacgttaacgctttatccagtcgacaatatcgctcaggcctttcacgctttaaaacgcaaataattgaaaacgcaacgaatcggcaatattttatccttcacaaaaaaataaaagtagattataatataggtatcctgaagtgtacgttaccacactatttttgaacctacatctttttacagggagtctggatgttctttgctcgatgccgagccacctcgagtggatggcagagaatgtgaagacaagacacccacctagcatccgctaggcgtcaaaaatatgggacggcacattcgggattttttaatttcagaatcaataatagaataaatttgtgataatcctatgaaagaacagttagaaagagatcaaatcatccatttgtccggtacggacaatacccgcgatttgggcggcctgcagacggcagatcaccacgtggtccggcggggaagacttattagaagtgatcatttaaaccgcctcacagaaaaagattgtacaatattatcagagcagtacaaggtaaaggtcgtcgtcgatttgcggagagagagtgaatctaagcgccagcctgaccaggcgattgccggggcggttttggtgcacgacccactggttccggagattgcacgggccaaaaccttcgctcagattagcggtgtaggcgaattgatgcttgaatccgtgcatcatatgaatgacgatgtattggcttaccaaaccgagcgttatgccgaggcggctttgtctgattttacagccgaggccattcagaaatgggtggcgcttttgctcgatacggaggacggcgcggtgctctggcactgcacggcaggcaaggaccggacaggtgttttggcggccttgattcttttgattttaggggtgcccatcgagacggtaagagcgaattatctactcaccaatcaaatcattcgtcagaaaattcaatggatcgtcgataagacgcgggacgtcaccacagatctcaacttactcaaacaggtcgagctgctctgctccgttcacggcaattatttcgatgcggtgatttcagcgatcgaggcccattacggcagcttgtctaaatacgtccaccagcatctgcacatttcggatgaaatgattgcagcgcttcaaaattcgtacttaatttcaaggaggtaaatgtagatgtcacccgtttatttggctgccattgcacttgtcattgcagtggtcatcgtcattgcggtcgttggatccaagaagcacacaaaaacgccgcccaaagcgcagcagctttttgatgacgacaaaacaaagcaagatgacgatttgtttgaggatgtggagatcatggccgatcaggataatggtccgtcccttgaagaacgtttcctcgctgaaacggtcaaggaggtctcaggagagccggatcgtctttacaataacacctacgtgcccacgccggacggcggcacacacgtggtgcatttgatgctcagagaaacaagtggcttttatatttttagatatttgagtctgccctcgggttggattgtcggtcaggaaggggcgagatggtggatccattttgattcgcctgaagtaaagaattattttgacaacccgattacgactattgacgatgacgtgaagaccatgctgtctttctttccgggcacatctccggaatattatcacgggtacgtcgttgtcgacgaccgatgcgaaattcgcgaggtggataccgacacccatgtgagggttattttactcagcgatctgccaaaaattctcaaagcggatctggaaaacaacgctgaggtgttttcgcctaatatggaccgcatgatgagccgggttttagcgacgatgaaaaataacgtcggtctcgaacagcggctgacccatttaaaaaaggaaatgcaggaagaaaacgaacaagtgcggaaaatgcgcacggcctccgatcaagcggttcagcaaaccagagtgtacgaccccaacgagctgagtgacgaacagaaggcagctattcgcaaaatacaggaaaaggccatcgaggaccgaaagcagcggccagaggatcattttacgcgctcggagctcgccttgcgtgaatcgctgattttgtggcgaaaacagcaggctaatgctgaggctaaagcagagaatgaaattttgtccgatgaaggtatgattcatatcatcaccgttaaacccaaaaccattgatcaattgcagcaggtttccggaatgaatcaggaagctgcagcgcgatacggagaagatctgcttgagatggtgaaacacatgcccgtttaaatcacaggccgccgatgaagaaccggcggctttttttattggaagccttgattttaaaagcgaatgtgatataatgagatgcaattccaagcaaacaacttggaattgatgctttttggaggcaaaaatgaaattatcaacaaaaggacaatacggcgtattagccatgtgcgagctggctgcgcattacggggatggtccaatgtcagtcaaggagattgcagagcggcagcatatttctgacgcttatttggaacagctcttttcattattaaaaaaagcagggctgatcaccagtatgagaggcgcgcacggcggttataaattgagccgtcaacctgatgaaatagcggttggcgaagtgattgatgcggttgaaggaccgattgagctctgcgggtgcagcggcgtggaaaacagcgtgcactgcgggcgggagatggcgtgtccgacagcagcgctgtggggagatgtgctccacagcatccgcaacgtcgtcgaccatcgttcccttcaggacttaattgtgccacattctcaaacggcagatgaacatgagtaaacaaaaaatatatttggaccacgcggcgacgacgccgatgagcgctgaagtgtttgagaagatgaagccgtttttttctgatactttcggcaatccctctgcggtctacgctgaaggcagaagggcaaaagcggcggttgagacagcgagggaacaggcagccagaagcctcaatgccaagcctgaggagatctatttcacctcaggaggatctgagtcagacaattgggccatcaaaggcatcgcgttttctttgcaggacaaaggacggcacattatcacgacagcgattgagcacccagcggtattgaacacctgccattttttagaaaagttgggatacgagatcacatatctgccggttgacccgtgcggccttgtctcagtccagacgctccaaaatgccattcgggaagatacgattttggtctcgattatgatggctaacaacgagatcggcacaattgaaccgattaaagcattggcagagacggcacatgaaaacggggttctgtttcatacagatgcagttcaagcttttggcaatgtgccgattgatgtgactgatttaggcgttgatatgctctccttgtcagggcacaaattttacggtccaaagggaacggggattttattctgccgccagggcgtcaagctggaatccctgattcacggcggaaagcaagagagtggtgtccgtgcgggaaccgaaaatacagcgggcatcgtcggtattggcgaagcctgtgaatgcgccgtgaagcagttatctgaaaattgcatacacgagcgggaattgacacaatttttgatcgatcaattgacgaaaattcctggcatttatttgaccggtcacccggatttgcgccttcccggcaatgcgagcttttactttgaagatattcactctgaggcgctgatgacggccttggatttggatggcatcgaggtttctggcggctcggcctgcaccgcagggtcgatcaatccatctcacgttttaaaggccatcgggctgaacgacgagcaggcccgcaacgcccttcgcttaaccgttggcagagaaaatacgctggacgaaatgaaacagacggtattgtccattcaaaacatcatcgaacggatgcagtgaacattttcgagtaaaaaaatataaattaatgatggcgtcaaggcctgtatcgatgatactgccttgactttttttttcgttaagttaaaattaaaaatgttctaaaagataaaataataataaatcaaagtcaatttgaaaggataaatatattcagcatggaagcattgggattaaatgaaattagagaacggtatctgtctttttttgaaagcaaagggcatttgagactgaaaagcttctcgcttgttccgcacaacgacaaaagtctgctgctgatcaattcaggtatggcaccgatgaagtcttatttcaccggagatgaaattccgcctagaaagcgcgtcacgacgtgccagaaatgtatccggacaccggatatcgacaacgtcggcaaaacggctcgtcacggcactttctttgaaatgatgggcaatttctcttttggcgattattttaaaccagaagtcattccatgggcttgggaattcatcaccaagaatttaaagattgatccggaaaaaatctatgtcacgatttatctggatgatgaacaggcgcacgatttatggcgctcggtcggcgtgaaggaagatcacatcaaacgcctcggaaaggaagacaatttctgggaacacggcacaggcccatgcggtccgtgctcggaaattttctacgaccgcggtgaaaaatacggctgcggcaaaccgacctgcggtccgggatgcgactgcgaccgttacgtcgaattctggaatctggtctttacccagtttgaccgtgatgaaaacggcgactaccagccattggatcatccgaatatcgatacggggatgggccttgaaagaatggcgaccatcatgcagggtgtcgacaatatttttgaagtcgatacgatccgccatattttagactacatctgcaatctttgcggcgaacactacggagatgacgaacagaaggatgtctcaatccgcgttatcactgaccatatccgttcggtcaccttcatgattggcgatgggatcatgccgagcaacgaaggacgcgggtacgtgctgagaagaattttaagacgtgctgcgcgtcacggccgcctgttaggcatcgacggcgccttcttatacgatgtggcgaaagaagtcatcgcggtttctggcgatgcttatccagaattaagagaaaagcaggaaaccattcaaaaggtcattaaaatcgaagaagaacgcttcgacgcgaccatcgatcagggcctcaatcagctcaacgccatgatgcgggaaatgaaggaaaaggatccggacaatcatattttctccggggaagaagcctttaaattgtacgatacatttggattcccgtttgacctcacaaaagaaatcgtggaagaacagggctacacgatcccgaaagaagaatttgacgacgcgatgaatgcgcagagagaaagagcgagaacagccagagcgcagaatgataccgcggtctgggcagacgacccgttcaatcctttgggaccggatgcggtcgacacgtttgtcggttatcagaaattaaagagcgacgctgaaatcatcggtttaatcgtcaatgacgaattggttcaggaagcgcatcaaggcgatgacgtactggtgctgttggatcagaccccattctacgcacagagcggtgggcaggtcggcgatactggccggctcgaaagcgaagacggcagcagcctgattgaagtcaacgactgtcgatacgggagtctgaaacgccatatccattacggaaaagtggtcgaaggcgacttccacgttggtcagacgatttatgcacacgtcgacgaaatgaagcgttacgcaacagctagaaaccacacatcgacacatatgctgcaaaaagcattaaaaatggtattgggagatcatgttgaacaggccgggtctttcgtatcgccgacgcgtctccgcttcgactttaaccatttccagccgatgaccgcggaagaaatcaagcaggttgaagaaattgtcaaccaagccattctcaaagcgatgccggtggaaacatttgaaacggaaattgacaaagcgaaggaaatgggcgcgatggccttatttggagaaaagtacggccacattgtccgagttgtcaaggttggcgattattcaattgaactttgcggcgggacccatttacagaattccgcacaggccggtatgttcaagatcatcagtgaaaatggggtcgctgctggcatccgcagaattgaagcgacaaccgggatgaatacctatcgctgggcagaaaaggtcgaaagtgtcaatgcaaaggcctctgctatggtcaaggctgccccagatcagttgattgatcggattcaggaaatggaagatcagcttaaggaaaaggatcgcgaaattgcatccctcaagcatcagcaggcagattcagaagctggcgaattattaaataagatccagaccattcaaggtgtaaaggtgctgattgccgaagttaaagcagaagacgtcaacgaaatgcgcgatttatcagatatgatgaaggaccgcatggaaagcgggatcgtggtatttggcaaagccgacaccgacaaagccaatttgatcgcgacggcaaccaaggacatcgtgaaaaaaggcttccacgctggtcagctgatcaaacaaattgccaaaactgtcggcggcggcggtggcggacgcccagacatggcacaggctggagggaagaaacccgctgctttagatcaggctttggctcaggcagaaaacatcatcgcggaacaattatccgaataataaaataatttagacttgttttaatttcaaacttgcgttaaaatagaccaagattaaacgggaggagaaaggcataatgggcgttaataatcaaaatgatgtcgaacaaggtaccatcatgttcgatgctgacaagcagagaggacaagcgatcgatatgattatgcggtctgttcgggatgctttgatcgaaaaaggatataacccagttaatcagattgttggctacgttatgtccggagatccgacttatattacgagctataacgatgcaagaacgttgatccagcggatcgaacgggatgagttattagacgaattggtaaagcgttatttggataagttaccagaataacatttaaatattgatttaaagtcccagcagaaatactgggatttttttttagaaacaaaatggaaagaatactaggattagatatcggagacaaatacatcggcattgccgtttctgacggattgggcattacggcgcagggataccgcacctacaaacggggaacgcgccaggacgatctgactttttttaatgatgtgattgtacaatttaacgtgcatacgatcgttgccggtctgccgaaagacatgaacggcacggaacagacgcaggcgagaaagacacaaaattattgtaattttttagcaaagcggttaaactgttctgtagtttacatcgacgagagattgaccacaaaggcgtctgaaaatgtgctgattgaaggcggtgtccatcgcaaggacagaaaaaagtatattgacaccttgtcggctcagctgatccttcagatgtatttagatcaagttcatgacaaggcataagtggctttgaaatggcaaaaccgcaaaatttagaatttgtccgtcttgtagaaaaagacgacggcacttacatgatttttatcgatgaaaatcatcaggaacacgtggtgaaaatgactgattacgacgattacggcgaaaggcatttcattttggaaccggatgattgaaataaaatattttaaactaaaggaagtgaaaagatggaaaaccaagataatcacaccattatcttaaaaaatgaagatggtgaagaacacgaatttgaattggtctgtacgctgagcgttgaagaaaatgaatacgccattttggcggatttggattcagaagatgctgtagcgatgcgaattgaaggcgaaggtgaaaccgcagccttaattcctgtagaagacgatgaagaatttgaagaagttgcggcggcttacgatgcgatttcaccggaagaattgggatattctgaataacgccaagatcgtaagttggaaatatcaaaatatccagtcgtaagcgggaaatttatcagtagacgcaatcgctttgtcgcagaaattctcttgacttcgaccaatgaaagggttgaggcccatgttcccaatactgggagaatgaaggaattattgacaaaagatgcggaggttggattggcttattgtccgtccccgacgcgtaaaacagactataccttgattaccgttcgttatcatcagatctgggtatgtatcgatgccgttgcggcaaatcgattggtctaccactatttgtcacagcaaaagggaataagaaagcttcagcgcgaggtgacctatcgagacagccggtttgatttagccagagaagacgaaaacggctacggctacgtcgaagtgaaaagcgtcaacctcgtgatagaaacttccgatcatcgcaatcgatgtgcttgttttcccgatgcgccgacaaaaagaggaacgaaacacataatagaattaacttcaggattgaaagagcatcaaaacaatgccctttattttgttgtacaaagaaatgatgcggattgtttcgttcccaatcaattgacggatccagaatttacacaggcgtttcaaaatgcgagacaaaatggactggatgtacacgtcctgctgtgcgatgtgacgatcaaccagatgaacgtcatcaaagaaattcccgtatatgcgttagatgacaatggcaatataacgaaaggaaaccacgattgaacgaacagaaacagaacaataatgggaaaaagagcagctcgaaacgtcatagctggttcagaaaaaagaaaaagaaaaacaacaacaataatggaaaaaggcacgataaattaaaggttataccgatcggcggcttaggcgaaatcgggaaaaatatgaccgcctttgagtacaacaatcaaattgtgattgtagactgcgggatgatgttcccagaagacggcatgtatgggattgactcagtactgcctgatttttcttatttagtcgaaaacgcttcaaaagttaagggcttggtcatcacacacggtcatgaagaccatattggcgccattccttatctgctgaagaaaatcaatgtcccgatttacgcgacaaaatttacgatgggactgatcgaccataagctcgaggaacatcgattgatcagtcaggctaaacgtcatgtgattgcggcgggcaatgaagtgacgattggcgatttccgaattgaatttattcacgtcaatcacagtattgcagacgctgtggccctctgtatcaaaacgcctgcggccactgttttccataccggcgattttaaaatcgactttaacccggtagatggcgatatcatcgacttgcagcgcattgctgctttgggcaaccgcggggtcgacctgctgctgtgtgattcgacgaatgtcgaagaaaatggctacgctggcagtgaaaccgaaattggcaagaccttttacgatttattcagaggcaataagaagcggatcatcgtgacgacttttgcgtcaaacgtgcaccgtgtccagcagattatcaatacggcagcggtctacaatcgaaaagtaattattaacgggcgcagtatggagacgatggtctcggtggccagcgatttgggatatttagacattccgaaaaatttggtcatcgatatccacgatatgaaaaaatacaagccgtctcaactggtcgtgattacgacagggtctcagggtgaaccgatggcggcgctcggccgaatggcgaacggcaatcacaaatatctccaaatcggcaaggacgataccatcatcatttccgcatctcctgtcccgggcaatgaaaagatggtcgctgaaatcatcaacaaattagttgatttaggcgctgaagtcatttacaataaatttgctaacattcacgtgtcaggccacgcgaagcgagaagagcttaaaattattcacacactggtgaagccaaccttctttatgccggtgcacggtgaagcgcgtatgctcaaactgcacgcggatttggcagagtctctgggaatggacgcgaaaaacatccggatccagcagaacggggatgtcatgcagctcagccacaaggaatttaagaaaatcgatgaaatctcggctgaacctgttttagtagacggcctgggtgttggcgatattggcaacattgtcttaaacgaccgcaaacgcttgtcagaagatggcttgtttattgtggccatcacgatgaaaaatggtaaggccgtttccgggccggacattatttcaagaggctttgtctatatgcgcgaatcagaggatctgattaacggtgcgaaggcgactgtccagaaggcactgaaaaactgcgaaaataaaaaagtgacggattggaaaactatcaagagcgatattcaggatgcactcttcagatatctgtacaaagaaacacaaagaaaaccaatgatcctcccgattttaatggaagcctaagcgaaactggccatattattggtcatatgatggagaataatacgaaatatgaatatttacgatgagatcgatgaattcacaaaaaagcttgagaattcacccgaatgcatgcgattcaagacggctcaacagaaaattgacgctgtgccggaaatgaaagaaaaggtggaagcctatttgcgtgaacaggcgatgacgcaggcgcgtcaggcgatggggatgccattgtcccaggaagaaattgaaaaatttaatcaaaaaacgcgggaattgctgaccattccagaagttgctgaatttttccaagcgcaaatggcgattatgccggtattaaaaacactggcggaacgcattgcaggtgcggtcggttttgattcgagtgtttttaatggcgtgttaggcaatattacaggagcgtaaccatggcgcagaaagatcaatcatctctatttgatgagcatacaaccaacgagaatgagacgaaaaatcttttcgccgattctgaaaaaatcaaagagcaagtgaagcgttcccgccgaaaagttttcattacaattattgtgatcgcgctttgcgcagtggggctttgcgccgggtggcggatttattataacagccagcttgaaccggtcagcagcagcaagaaaaaaattattgtcgaaattccagaaggctccaatatcgatgatattgcaaaaatcttgtacgacagtggtctgattaaaaaccgtatggtctttcagagctacgcgggcagacacagccggggtattaagcagattaaggccgcgaactatcgtttcacgccatcgatgtcgtcagttgacatttttaacgcgatgttaaacggcaaggactacgatggtgctgtggcgattaccattccagaaggcaagaacatcaaggaaatcggtgcgattctggaatcgcgtcatatctgttcctcagcggatttcatcaacgagacgaaaaaggtatcggagtataaaaaaaattattcgattttaagctcctatccggataacgcagaagggcgcaccccgatggaaggctatctgtttgcggacacctatcaatttacttcaaatagcagtgcggctacagtggtgtcgaagatgctcgctaatacccagagcaaattttcagacgcgatgctgaagaaaatatcggacaatcatcaaacggtcgatcaaattttgacaatggcctcattaattgagatggagtcaaaattagacagtgacaaaccgaaaattgcatctgcgttttataatcgtttggcgaaaaacatgaaactgcagtccgatgcgactgtgaattacgcattgggcgaaaagaaaaccaatatcaccaatagcgatttgaaggtcgattctccgtataatacttacgccaatacgggcatgccaattggaccgatttgttcaccgagcttaaaatccattaaagctgcgattagtccggctaaaacagattatttgtattttgtttccgactcatctggaaagacctattacgcaaataacctgcaggatcatcaggcgaacgtcgataaatatttaaataattaaataataaaaagcacgcagctgcgtgctttttttgaggaaggaaaatgaatcaaaccaaaacgccggaattattagcgccggcaggaaattttgaaaagctaaaatacgcgctcgcatacggcgcagatgccgtttactgcgccgggaagaaatttggactgcgtgccagggcagacaactttgacgaagagactcttagagaagctgtcgcgtatacccacaaaagagataaaaagatttttgtaacgctcaatatgatcccacacgatgaagattttgagggattgagtgactacattcggtttttagatcagattcacgtcgatgaggtgctcgttgcggatcctggggtatttacgctcgtccgcgagaatgcgccgaatatgaaaatatcggtcagcacgcaggcgaataacgtcaatagccggactgtgaaattctggcacgatttaggcgcgtcgcgaatcgtgcttgcgcgggagttgtcgggaaaggaaattcaaaagatttctcagaacagaccagatcagatggaaatcgaaacctttgtccacggtgcgatgtgcatttcttacagcgggcgctgtttactgtctcattatttgacagggagagacggtaatagaggagactgcgcgcagccctgtagatggcaatatcgattagaggaatcgaagcgtccaggtgaatttttcccaattgaagaagataagactgggacgtttattatgaactcaaaagatctctgccttgcagaaaggattccagaattgatcaaattcggcgtcaacagttttaaaattgaaggccgtatgaaaagcgctttttacgtcgcgacggtggtgtcgatttatcgccgaatcatcgatgctgcgctggccgatcctgatttcacagtgccgcacgcctggattgaggagctgaccaaggtcagccaccgccattacaccactgcctttttcgaccacaagccgacagccgatgctgaaaatttcggcagcagcagttacacgcgcaattacgatttttcaggtgttgtcttggaggatttttcgggaaatggcagaatgctggttgaacagcgcggcaagatctcagtgggcgatcacatcgaagtgattcaaccgggacaaagcgggcagaatgaattatttctttcctgtcaagtgaagcatttatttgatgagcagggcaatgcaattacgtcgacccctcacgcgaagatgcattatcaactggaatttgacaagtcggttaaaaaaatgtcaattttgaggaaacggctgatttagcacagaatgaatcaaagttttttccttgattgagaaaaacgcgtatgttatactttaaaaattgaataagagtaataaatagtggtttggaggataaaatgactgcaaagattcttgaaaatgaaaaaaatgtcgttaaactggaaatgagtatcccacaggataaattccagaaggcgatggatcaatcgtacaaaaaaaataaaaagtatttcaccattcagggcttccgcaagggaaaagcaccgagaaaagtgatcgaagcgcactacggcaaagaagttttcttagaagatgccattgaattcgcattcccagaatcttatcaggatgcgatcaaggaagtcgaaattgacccggtaactcgtccgtctctcgaaaaggttgaagatgtaggggacaatggcgcgacctttattgttaaagttgccgtaaaaccggaagttaagctcggcgattataaaggcgctgaaattccagtcttagaacagcctgttgacgatgcagatgttgaagcacgtttgaaacagatgcagaatcagaattccagactggttacagatgatcaggcagaagcgaaaaacggcgacactgtcgtgattgattacgaaggttctgttgacggcgtcccgtttgatggcggaaaagacgaaggctacagcctggaactgggcagcaatacctttatcccaggattcgaagatcaattagttggcgttaaagcgggcgaagataaagacgtcaacgtgacattcccagaagattatcacgcagaagatctcaaaggcaaagacgctgtcttcaaggtacatgtcgttgaagttcagagaaaggaacttccggaacttgacgatgaattcgcaaaggatgtcagtgagtttgacactttagatgaattgaagaacgatctgaaggataagattgcgaacgaaaagaaagaagcaagactcaacacggcaagacaggctgcgctggattacgcggttcagaatgcagaaatggatatcccacaaatgatgatcgacgaagaagtcgaccgtgattatgaaaatctccagcgccagatgtctggccagggcctcacgatggaaaattatttcaaatttacaggccagagcaaagaagtcttcagacaatccatggcaccggatgcagaaagaaatatcaaagcagatttagtacttgaagcaattggcaaggctgaagcaatcgaaccttctgaagaagaaatcgatgacgaaatcaaagaatacgcacacgcgtttaatcaggaattcgaaaagtataaggaatcattagatgatcagatgatggaatacatcacggatacccttaaacgccgcaaagctttagatttattagtcgactcagccaatcaggttgaagattttgaagcgaaacaagaagcaaaagcaaaagcaaaagaatcagaagaaaaagcagacacagaagcagaaaaggaagactaaaatgaatctagttccgatggttgtcgagcagacgggattgggcgaacgctccttcgacatttattctcgtctgctgaaagaacgtatcgtttttttagatggtgaaatcacagacgaatcagcgggattattggtagcacagttaatttttctcgaaggcgaagacccggaccaagatatctatatgtatatcaacagtccgggaggatccgtttccgcaggctttgcaattatggacacaatgaatttcattaaatgcgatgtctgtacgctctgctacggaatggccgcgtcaatgggggcattcttactggcagcaggcgcaaaaggaaaacgtcaggcgcttccgaattccgaaattatgattcatcagccattgggaggagctcagggacagagctctgacgttgaaattcacgcgaagcacttgatgcagacaaaagaaaaattaaatcgcatattgagtgaaaatacgggtcagccgttgaaaacaattaaaaaagacacagaccgggatcatttcatgacagctgaagaagcgaaagcgtacggtttaatcgatcaagtgattacttcccgtgaataattttatgacttattacccacagagggagagaacgaatgtcagaatttgattatacagatggaatcaatcaagtgagatgctcattttgtggtaaaacacagtcacaggtaaaaagaatggttgccggtccaggcgtctacatttgtgacgaatgtgtatcactttgccaggaaattattgacagcgaagaagaagaggaaacggtaacctactcggaaataccgaaacctcaggaaatcaaacagtatcttgatgattatgtcattggtcaggatgaagcgaagaaacagctggccgttgctgtctataatcattataaacggatcaattcactcaatgatgatgacgatggtgttgaaatccagaaaagcaacattcttttagtgggtccgaccggttctggcaaaacgttgcttgcacaaaccttggcgaagatgctgaacgtgcctttcgccattgcggacgcgaccacattgactgaagcgggatatgtgggcgaagacgttgaaaatattttattgaagctgcttcaggcggcggacatgaatgttgaaaaggccgaaaagggcattatctacatcgacgaaattgataaaatatctcgtaagaatgaaaacccttcgatcacgcgggatgtcagcggtgaaggtgttcagcaggcgttgctgaaaattctggaaggcacagttgcaaacgtgccgccgcagggcggccgcaaacacccgcagcaggaattcatccaaattgataccaagaatattctattcatttgtggtggcgcattcgatggcatcgaaaaaatcattgcaaagagaatggaaaaggggtccatcggctttggcgcgatcattcaaagcagctctgaaatcgaatcagacaaattgatgaaacaaatcatgccacatgatttactgcggtttggcttgatccctgaatttatcggccgagtgccggtcatcgcgacacttgatcatttggataaaaaggctttgatcaatattttaacagagccgaaggatgcactggtcaaacagtatcaaaaattatttaggcttgaagatgtcgatctccagtttgaaaagggtgcaattgaagaaattgcggttcaatcgctggaaaacaagacaggcgcgcggggactgcgcggcattatcgaaacgctgatgcgcgacttgatgtatgcgcttccttcagacccagacgtgacgaaggtggtcatcaccaaacagatggttttgggaaagggcaagcctaaaatctatcggaatgctcaaaagaaaaaagctgacgatgaaaaagaaagcgcttcataaataatccatagaaattcaaggcaatctttgtgaagattgccttttttaacatagaattaaaggagattgtgtatggaaaatgagaataaggaaatgcatattgatcaagagaaccaaaatgatccattgaacaatagccaggcagagacttcaaaagatctgccgcttattcctgttaagtctatgaatttgtttccgggaatgattctgcatttcgatttaaacggaagcaaatccctcaaagcactcgaatactgcatgcaggcagaccagctggcttttttatctgagcaaaaggacatcggtgtgaacgcgccctaccgatatgatatttattcagtagggtgcatcgcgaaggtgaagcaggtattaaagctgcctaacgactacgcccgtgtgctggttgaggtattgcagcggggtgtgatcgactattggatacaggacgatcccttttttatggtttcagttcagcctaaagaatcgactttctccaacgattctgaaagccaaacgcttttaaaacttgttgaagaaacctttgtgagttatatgcatcagacaaaaaatgcctctgaaaatgtgcagaataccttagaattactggatgaaccggatcatctaatcgatttaatttgcgcgaatattccgttatctcatgaaaaggctcaggaaattcttcaggaatttgatggggatcatcgtttaatgctggtctatcaggaaatggtgagggaactctccacttataagatcaagcagagtattagcgaaaaggtccgttctgagatagaaaaaaatcagcgtgaatacgttttgcgggaacaaatcaaggtcctgcaaaacgaattaaatcacgcgacaggtgaagaaagcgtcattgaggcgtatcaaaaaaagattgatgcgaaaaatttaagtcctacagtcaaaaataaggcggaaaacgagctgaaacggttatctaagacacagccgggcatgccggaggccggtgtcattcaggattatctggattggatcctgtcactgccgtggggtgaatccacggaagaagtcatcgacgtcaatcatgcgcggaaaattcttaaccgggatcattacgcgctagacaacgtgaaagagcggattttagagtatatttctgtgcttcagctgacgcagtcgttaaaagcaccgattctctgtcttgttgggcctccgggcgttggcaaaacgtcgatcgctaaatccattgccgaagcgctcaatcgaaaatacgttcggatgtctctgggcggcctaagcgatgaagcggaaatcagggggcatcgccggacctacatcggggcaatacctggccgcatcatttaccatatccgccaagctggcagcagtaatccgctgtttttgctggatgaggtcgataagatcagtcaaaacttccgtggcgatccggcctccgcattgcttgaagtgttagatccagagcagaacagcacgtttaccgacaattatctggagctgccctttgatttgtcccacgtcttgttcatagcgacggccaacagcctgtcgacgatcccgaggccgctgctggatcgcatggaaatcatcgaggtgaatggctacatcgaggatgaaaaagaggtgatcgcgaaaaaatacctcattccgaagcaaatcaaagaaaatggccttaccaagaaacaaatcactttcagcgaaggcgccattcggaatacgatcgagtattacacgagagaatccggtgtgcgcgagctggaacgggaaattgcgaaggcctgtcggatcgcggcgaaaaatgtcgtcagtggcgccaaagcaaaaaatcagatcaatgtcagaaaccttgaaaaatacttgggtaaacagaaatttacttttgaaaaggttcaaagcggcagcgttgtcggtttggtcaacgggttggcctggactgctgtcggcggcgtgacgctcgaaatcgaagcccttgcggtcaacggcaccggtaaaacctttatcacaggtaaattgggcgatgtcatgcaggaatccattaaggcagctattggctatatccgctccgtatccaatcaattgcacatcgacccggatttcatctcgaacaaagacattcacattcacgtgccggagggagccgttcccaaggatgggccatcagctgggatcacgatggcaacagcgctcatttcggcgttaactggccgtccggtgcctcaggatattgcgatgactggtgaaatcacgttattgggacgcgtactgccgattggcgggctgcgggaaaaattaacggcggccagccgcgcatccattacccgcgtgttgatccctaaggaaaatcaaaaggatttagacgatattccagaaagcgtgatcggaaagttggaaatttatccggttgaaaaaatgagtgaagtcattcaatttgtatttggtgaatttgatgaaagtaaataaagcagaaattgtgatcagcgcggtttcggaaaaacaatacccaaatgatgcgctgccggaaattgttttgcttggccgttcgaatgtgggcaagtcttcgctgatcaatacgttaattaaccgccagcatctggcaagaaccagttcaaagccaggtaaaacacagaccatgaatttttatcaaattaatgaccttttccggttcgtcgatatgcccggatacggttacgccaaggtgtcgcgaaaggaaaagcagaagtggggtgagatgattgaaaattatctgctcaaccgcgaaaatctcaagaatgtctttttgttgatcgacagccgccatgaacccacagaagacgatgcgctcatgtacaattggctgaaatattatcatctgccgacgcacatcattttgacaaaatttgataaattatctgcgtctaaaaagaaaaaatctgtacggcagctgctggcttcattgaacgttgaagcggacacagttattcctttttcggctgtttcaaaagaaggggttgaaacctgctggcagattattcaaagcaaaatagctgatgattcaaaacaatgagcccctgacggaagacgcaattcgaaggcttgcagaaaaaatcgatattccaatccttgggattactgatgctgagcctattacggagatgctgccttatgaaaagcagaggcgccaggagaacaacgggttgattccctttgtgcgcacaaagcctgaacgccgaatcgattttaaatcggttatgccggaagtcaaatcggtcattgtgattggcattccttatcctttgtttccccaaaaaatcgaggattttaccacttatggatacttttcgtcggttacctgtgggaaagattaccataaggtcgtcatggaaaagatggacgcattgtgtgcgcggatccaatctgagttgtcggcagagattcaagttaaaaaatttgtcgacaacagccgtttgatggacaaggcgtccgcctggaaggcgggattgggattttttgggaaaaacaatttattgatccaccctcaatttggttcggcgtggaatatcggccaaattctgattgacaaggccatcgttcacaaagcaatcacgcctatggcaaaccaatgtgggaaatgccaaagatgtatcgaagcctgtccaggtcacgctttgggtgatcagggataccagttgttttacgaacgatgcatctcctatctgacacagaaaaggaagttaacagaagcagaagaaaaaagaatacgttatttcctttacggatgtgacatctgccaatgggtgtgcccttttaataatcgggaagggaaaaaaccagagttagacagcgcagtcaagcttgatgagattcttaacttatcggagagcgaaatcaaaagcaaattcgccgatcgcgcgctttcatggctgccgccttctgtccttgttcgtaatgcgggaatattaaaaaaccgttctaagacatcatttaaatgatataataacaaacaacattaacgctaaggagaagatattaatggttagagttcgttttgcaccgagcccgacaggcaatgtccatgtcggaagtttgcggactgcattatataattatttatttgcaaaacaaaatgacggtacatttttactgcgactggaagatacagaccgaacacgttatcaggaaggttcggttgaaaatcttttaaatgcgctttacacaaccggtgttgtgcctgatgaaggcctgcagttggttgacggcaaaccggttgaaaacggcgaatacggtccgtacattcaatcggaaagactggatatttataataaatacattcagcagctgattgacgaaggaaaggcttattactgcttctgcagtaaagagcgcttgacccaattaagggaagaacagaagaaagctggtgaaaccccgcgttacgacggccactgccgtaatttatctcctgaagaagtccagaagagaatcgccaacggggatccttatgtgattcgattaaagcttccggaaaataccgatattacctttaacgatgtcgtgcggggcaaaatcacgattaacacgaaggaaatggacgaccaggtcttaatcaaagaagatggattcccgacatatcattttgcggtagtcatcgatgatcacctgatgaaaatcacccacgtgatcagaggagaagaatggctcccgtccacaccgaagcacgtgtacctttatcagtgtttcggctggcagccgccgacctttgttcatttgtctaacattctcaatgaagaccataagaaattaagtaagcgtcagggagatgtcgcggttggtgacttcttagcaaaaggttacctgcctgaggcgctggttaatttcctcgcgctgcttggctggagtccggaagacgatcaggaaattttctcgttggaagaattggaaaaggcctttgacattcaccggatcagcaattccggagccgtctttgatagagaaaagctcaattggatgaatggccagtatatcaaaaaagcatcggtcgacaccatcgttgatggcattcagccgtttttggaaaaggccgggatgattcagacggattcagaatcagacaaaacggtttggttggaaaaagtagctgagctgttaagagaccgcattgattactttgcgcaggcgcctgaacagcttgcacaaatattggacgacgattaccagattgatacctctgatgaagctcaggacattctgaacgctgaaacagtgccgattctatgcagcgcattagatgaaaaaatgactgcggcggatcaatggaatgcggcatatatccagaaagatattattaaggcgatccaaaaagaacataaacaagaaaaaataaaggggaaggcgctttacatgccgattcgtctgattttaactggaagcatgcatggccctgatcttgccttaattatggatgttttaggaaaagacgtctgccttagcagactccaccattacacggcacaattgaaagaggaaaaataagtgaaaaagaaaatcaacacgaaaagcacggttggatttttcgcttttgttgccattcttatattttgtatggttgtgcttttccacggtatttcagttggcgtgtacgatatcgggaatatcaaggaaaatatgcattacggtttggatttgacaggcggcgtcaacgtggtgcttcaggcaaagccgactaaagggaaaaagctgaccgactcgaaaatggaaggaacggtttcagcactgaaaaatcgtgtcgattctctcggcgtatcggaagcaacagtgacacgtcaggggaaaaaccggatccgcgttcagattccttcgatacaaaatcaacaggaagcacttgacttgattggccgaaccgctcagcttaaatttgtcgggccggatggcaagactatcttaactggcacccacgtgacagattcaaaggctgttacacagaaaacgagcagcggggtcgaacagcctgttgtcacattaaaatttgacagcaaggggaagaaagcatttgccgaagcgacacaaaagtatatcggacagcagattaccattaaattggacgacgaagttatttcttcgccaacagtcaatcaggcgattaccgatggcgaagccgtcatcgaaggcagctctgatatggacgaagcagggaatttggcttctttgattcgcggcggggcgctgccggttaagctaactacagttcaggcgtcgacagtcggtccgactttgggggccaattcactcgaccagagtatttttgccggtgtgattggggtcgtagccgttctcgtttttatgctcgtcttttacagaggactgggcatcattgcagatttagcattgctggtttttgttatgctcgatttagtggtgatgtctttaatgaacgtcacattgacactgccagggatcgccggcatgattttgaccattgggatggctgttgacgccaatgtcatcattttcgaacgaatcaaagaagaatcgagaaacatgggacagtcactttccagttcagtgaacgctgggtttaaaaacgcgatgcgttcgattgtcgactcaaatgtgaccaccttgattgctggtttcgtgctctttttcatggggacgggctcagctcaggggtttgctttgacgctggtcgtcgggattattctgtcgatgtttacggctgttgtcgtgactcgtcagctgattaaattgttcttaaataccaatttaattcagaatccaaaattctacggtatataatggagggcagaaatgaacgttgagaaaaaaattccgattattgaaaagactaaaatctggctctctatttcactgattatgattgcggttgcagtcggtgcgatcctgattcgaggattgaattacggcattgattttgtcggcggcaccatcgtgacgattgatctgcatcagacctttaataccaaggacatcagaacgattacgaatgcctatgataaatcggctgatatcacttattcgggcaaaaaaaagcatgaggtcgtaatcagcacaaaagaaagtttatcgaacagccagcagaaaaaattatttgcgtcttttaagaaaaaatacaatttgagtaacaaggatttggtctcagttgataacattaccgccagtgtgggggcggaaacgacacggaatacgataattgcatcgattgtggcggtcgtcttgatgctggtatatgtgacgattcgatttgaattttattttggattgtctgcggtgttggcgttgattcatgacatagttatcgtcattggcgtctacgcattgttccaaatccaagtcaattctccgtttattgcagcgattttgacgatactgggttactcgattaacgacaccatcgttgtatttgaccgcatcagagaaaacgagggctttattggcatgagcaacgagcaggaattaagcaatttagttgatatcagcgtgacgcagaccatgaggcgaagcatcaatacggttgcgacaacgttggtggcaatcatcgcgttgtacattttcgctgtcgacgcgatacgtgattttgcgctgccgttgatcgttgggatcgcttgcgggtgttactcttcgatctttgtagcaagtccattgtgggtcatttttcagaaaaaatcatccagatctaaatttaatacaaaaatgcagaaaagatcacggcgcggacaaaagaatcgtcggaaagttgaaaagattgaagtctaatgatgaaataaaggtcgaacgtaattgttcggccttttgttatctgtaaaaaggagaaagtcattgcaagagatatggtgtgagcgaattgattccagccaacctgaattagcggctgtgatcgatgaaattgcagaggaatgcaatattccaagagctgttgcaaaaattgctgcagcacgggggtgccgaaatggcatggaggccatggcttatttagagcccaacgtagaggattttcacaatccatgggatctgccagatatgcaaaaggctgttgagcggatcttatcggccaaggaaaacggtgaaaaggtctgcgtttacggtgattacgatgtcgatggcacaactgccgtatcgattttggtcgattattttaaatcactcggtatggatgtcatgcacaaaattcccaatcgtttaatcgaagggtacggcatgaacattgaggccgttcgcaaattaatcgattgcggcgtgaagctgatcgtgacggttgataacggcatagcagcgaaggacgaaattgcctacgctgcagaacatggagttgatgtgattgtcacagaccatcacgagtgtcagggagaactgccgaaggcagtcgctgtgatcgatgcgaaacgtcccgattctcagtatccattttctgaactttgcggcgcaggccttgcctttaaatgcgtgcaggcgttggaggaagcgcaaggccagacgcgcgatttgagcaattatctggaatgtgcggcgatggcgacggtcgcggatattgtgccgcttcaagatgaaaaccgtctaattgttaaaatgggtattgagtcgattaataccgattgtaaaaatgctgggattcaggcgctggctcaggtttcaaatgtgcaggaagtgacgtcgggtaatattggttttgtattagcacctaagattaacgcggcaggccggctgggcgaagcggactgcgttgtggatttgtatacgaaaaaagaggctgtgcaggtcaatcaagttgcagaattcttaaaagacgaaaacgaaaaacgtcaggaaattgaagctcagatttacaatgaagcggtgcaggccattaaattgcaaaagaaatatcaagaagtttttatctgcgctgctgggaaaaattggcattcgggcgtgattggcattgtcgccagtaaaattcaggaaatttggtatcaccctgttattgtgatgggaatcgatgaagacgggattgcaagagggagctgccgcagtgttgaaggcattaatattttcgaagcgctgtcgggctgttccgagctgttcgaaacctatggcggtcacgagatggcggccgggttttcaattaaagaggagaatattcctaaattagaatcatttttgaaagaatgggccaagaaaaatcattcgagaataaatctgattaaaaaaatttattacgacggcgatctttcagaaaacgatattgactgggaattgatggattgcatttccatgtgtgaaccctacggcgtgaaaaatccgagcccgctttttcggttaagccatattcatcccgaggaagttaaaacgatgggacaggatcaggcgcatttaagctttaaagatggggattttaggtgcattgccttttcgcaggggaaactggcatccgctttactgagagactatgacgaaggcatcgatgttttggctgttccaaaagtcaatcattttatgggaaacgatcaaattgaactgatggtaaaaaatattttaattccagaattatttgatcatgaaaaatgctggcaatatttgaaaatcctcaaaaatgcgtcggatgctgtgatcaaggaactgccgatttggcagtacgatcaaaaagatattttaccgaatcgggaagaaacggtttgggtttataaaatgttgaaaaaatatgcagaaaatggcgtgaaatttgatgccttgatggatcggaataaaaccttgaactgttttaagctgcttgcgatattggaaatatttaatgaaatcgatgtggttcactcaaaattgaagaaggggatcatatattcaaagattccgaaagaacaacaaaaaaaggatataaaaaaagcagagttagtgataaaattaaaaagaaatattaactagaatgtggggattacaatggatttaaaaagtaaaattgcaatttatcctgattttccaaaaccaggcattagttttaaggacattaacagcttaattaaagacggggaagcctttcacgaagtaaccgatcagttttatgaaatcgcaaaggctttggatgtgaatgtcgtctgcattccggaagcgcgaggctatattttcggctcagctttggcgtacaaattaggcgttggtttggtgccgatccgcaaaccggggaaactgccaggcgaagttatggcaaagtcttacaaactggaatacggtgaaaacactgttgaaattcagaaagatgccattaagacaggcgaccgtgtcttaattatcgacgacctgcttgccacgggcggtaccatgaaagcagcaatcgatttggttgaattgcttggtggggaagtctgcggcgcgctgttcatgattgaattgacagatcttaagggcagagaagcgttaaaagactactacgtccagtcattgattcaattccctatttaatagaactttatagaacgtcagagctacggtaagaggaggtgcgcatggcaacagaagcagtcaaaaaaaagatagacaatatcattaaaatcgttgaaaagaatgaccccgatgccgatccggatatgattatgcgcgcttttaacctagcggatcaggcacatgcggggcaaaagcggaaatcaggtgaagactatatcattcatcctgttgcagtggcttatattttggccaaatacaggatggatacggaaaccatttgtgccgccctgcttcatgacgtgatcgaagacacagatacaacgcatgaagaaattgccacgatgtttaatcctaaaatagcggacctggttgagggcgtgacgaaaattgggaaaatcgattaccagtcgaaagaagaaagccaagcggaatatatccgaaaaatggtcatggccatgtcaaaggatatccgcgtcattttgatcaagctggtcgaccgtctgcacaatatgcggacattagagtacatgaccaaagaaaagcagaaggaaaaagcgcgggagacccttgatatttacgcgccgattgccaatcgactggggattcaagccattaaagctgagcttgaagatttatccttaaaatatcttgaccctgaaggctattacaatttggttaaaagtgtaaaagccaaaaaacaggctcgagaagaatacgtcaatcaagtcatcgatattttgaagaaaaaattagcagaggtcgatattccatgtaaagtgtacggccgctccaaacatttttattcaatttatcgtaaaatgaaggcgcagcaccgaaaattcgacgaaatttacgatttggtcgcggttcgtgtcattgtgaatactgtaaaggaatgctatggggttttgggactggtccacacagaatggaagccaattccaggcagatttaaagactatatcgccatgccaaagcccaatatgtatcaatccatccacacgactgtgattgggccgaacggcgatcctgtagaaattcagattcgaaccaaggaaatgcaccgcgtcgccgaatacgggattgcagcccactggaaatacaaggaaggcaagggcagcagcaaaaattccaaggacgcgcattacgagaaaaaaattgcctggctcagacagattatggaatggcagcaggagctcgacaacgccggcgacttattggaaacaattaaggtcgatctgctgaacgaagaagtttacgttttttcaccaagaggcgatgtgtttgagctaccagtcgggtcatgtccccttgattttgcctatcgcgttcacagcgatatcgggaataattgtgtcggcgcaaaggtcaacggcaaaatcgtgccgctgaactacgaactcagcaatggcgacattgttgaagttatgacttcaaagcacagcaatggcccaagccgtgactggttaaacttcgttaaaagcgctcacgcgagaaataagatcaaacagtatttcaagcgtgagacaaaagaagaaaacattgaaaagggcaaattagcgcttgaaaatgaattaaagcggcaagggcttcaggactctaagcttggcaatacgaccgaactggaaactttgtgcaagcagctgaattataaaacagtagacgatctttacgctgcgattggctacaatggcattaagatgggaactgtttttacaaaaatgaaattgctcttcccagaggttttcaaagaacaagaacccgaaattgccattaaaaaaccgacaaaaaaggaaaaaaataattccaatattttggttgcggggctgaacgatattgatgtgcatttggcgaaatgctgcagcccagttccaggggatcagattattggacatattacccaatcccacggtattacggttcaccgtacagattgtcccaatgtgctgcacattgacgccgaaaagacggttgatgtcgaatggaatcgatttggtgtatcaggtaactttagtgcagaaatcagcattcaggccgatgaagatccccatacactcattgaaatcaataaagtatttattgaaatggatattcctttaacggcgctgaccgcacgaaatgacagaggaaaattcgattattttgaagctgtttttgaagtcaaatcgagaagagaattgaatttagtgattaaaaacattaaaaaaattccttctgtattagtggttaaacgtatatagggtcaagtgatgagagcagttattcaaagggtatctgatgcctccgttcaggttgacggtcaagtgattggcaaaatcgggcggggcatctgccttttaatcggttttgaacaatcggaccaggaagccgacatggattatatcatcaataagacgctgaatttgcgtatttttgaagatgaaaatgataagatgaatttgtctttattagatgttcatggcgagcttttggtcgtgtcacagtttacgctctacggagattgcagaaagggacggagaccgagcttttcaaaaagcggtgacgttcagacagcgcggcagaattatttgagattcaaagaaaagattaaaaacgctgctgctgaccgcgttgcctttggtcaatttcaggcagatatgcaggttcaaattcataatgatgggccggttacgcttttgcttgatagtaggaaattattctaagtaaacaattatgataaagataaacagatatatggttggtccgctgatggccaattgctacctggtttggtctgattcggatcatcagggtgtgatcatcgatccaggcggatggacaaaacaaatcgaaaaagacattgaggacaatcaggtccaggtcaagaaaattctgctgacacatggacattacgatcatatggcaggacttccgcaggccagcgcctatacgcatgccgacgtctgtattcacagagacgatgcggattgtttatcctcaccgggtaaaaacatttccctgctgatggggcggtccgccgttttcccggctgcggatgagctgcttaaggatggcgacaaaattgaaatttctccggaactttcgttttcggtgattcatacgccggggcataccccaggaggggcctgctttttgacgaatcaggaaatgttcacaggggatacgttgttttttggctctgtcggacgaactgattttcaaggcggctcttatccggatatcatcaagtccgttaaacgtctgctgacatatccagatgatatcgttgtttatccggggcatggcgaaaaaacgtcaatcaaatttgaaaagatgaataacccttacgcacaatagcttatgaaaatagaagaaattgatcaagttgtattgataatgccggacgttccgtcttggaaaaacggtgcacgcgaactgacaaaatccttttttcccaatgcgaaggttgtttttgaaggggcaggagatcttgtcatccagacgacggttcagtctgatcaaatcgtgtttgcagcacaattcgatcagcaagaattgaagcgagaaacttatcgtatttcagaaaaacccgttgattctaatgaattcaaggggtttttttatcgttttatgtcggatatcgcttcgcacaccctgccttggggaagcttgaccggtattaaacccgtaaaaattacacacgagctgctgcttcaaaatcgccacgacgaggcactggcgctgaaggattttaaagatcagtattttgtttcaacggaaaaggctgaacttgccctcgacatcgcaaaaaatgaaatgccgattgtttatccaaatgattcaaaaaagatttcgctttatattggcgttcccatttgtccggcaaaatgcgcatattgttcttttgtctccacggttgcagacaaaaagggtaaattatgcgcggattatttgcgagcgcttttgatcgaaataagggcatttgcagaactcatccgcgatcagcggctttcaatcgacacactgtatattggcggaggcacgccgtcgatcttttcagctgagcagcttgacgcgttattaaaggcagtctccagcgaatttgatttgtcgaatattcgggaatttacgttcgaagctgggcgcccggaaacgacaacgctcgagaaactcaagctcctgaagcaatatcatgtcaatcgactctgcctcaatcctcagagcatgaacgacgctacactgcgcgcagtgggaagactgcacacggctgaagatatccgaaatgtctatcaaatgataagagaaatcggatttgactgtgtcaatatggatttaatcgttggactcaacgaagaacggcctgagatagtcctgtcttctttgcagaaggtcattcaactgcatcccgaaaatttaaccgtccacagccttgcgattaaaaaaggatcgagactgagagaagaagaagggtgtcagtacgagcagatttactcgaaggatttttacgacgaaatctcaaaccgcctgaaaagctcggaatatcgcccgtattatctttaccgccaaaaatacgcacagggtaacggagagaatatcggatactgcttaaatggcagcgaagggatttacaatatattaatgatggcagagcggcagacgatcatcggcattggcgctggcgccacaggaaaagtgtatcatcctgaacaaaaccggcttaataaagtctacactgttaaagatatccgaacgtacaacgcgcgggcagaagaaattattgcgaaaaagataaaagcctatcgacaatatttagaaatggatgattgacgtgtcacgttaatcctttgtgtgcttgacggaataattaataatgcatataataaaaaaacatgaaattatgcctctttgagggctttgaatagaattaggaggaagattgtcaaatgatggaaacgcattttagatctgccgtttgcggcgaggtcaatgaaagtaaggtgggccagaccgttaaattagcgggatgggccgacagccgccgagacttgggtggcgttatttttgttgatcttcgcgaccgctcggggaaggttcaagttgttttcaatgaaaaaatagttggatctgaattcccaattgccgaaaagatcagagatgaatacgtattgaatgttgaaggggttgttcaggaaagaacacctgaaacggtcaatcctaagatggaaaccgggaaggtagaagtaatggtgcatcacattaccatcttggatacttcagcgacacctccaatttatgtaaaagataacgataaatcgggcgaaaacgtcagactgaaatatcgctatctggatctgcgtaagccgaaaaatcagaaaattttgatgactcgggcgaaggtcgcttctattgtcagaaattatttgaacgaacatggtttctgcgaaattgaaacgcctattttaggaaaaacaacgccagaaggggctcgcgattttctggttccttcaagagttcaaaagggcaaattctttggtctgccgcagagcccacagctttttaaacaaattttgatgatctctggcatggatcgttattatcaattggcaaaatgcttcagagatgaagatttacgccaggatcgccagccggaatttacccagatcgatatggaaatgtcatttgtcacaaaggatgacatcctgccgattatggaagaaatgatcgcaaagatctttaaagaaatccgcggtattgaattggaacgtccgttcctgcggatgacatggcgggaagcgatggatcgctttggttcagacaagccggatatgcgtttcggtctggaactacacgatctttctgatattcttaaagattcatcctttaatgttttttccgacgcgatcaaacgaggcggttctgtccgagcgatcatcgcgaaggacgcacaagggaaactgtctaaaaaagcccttaaaaatttggaaaaacacgccaagatctacaaagctaagggtttagcttggattgacgtcaaagacgatgaatcccagatgaaaacaccaattctgaaattcatctctgaagaagaaaaacaagcgatttacgaccgcttaggcgcagaagaaggcgattatatcttcatggtcgcagatacagaccaaattgcgtgcaccgcgatggggcagctgcgcttagaattggcacgccgtcttaagatcgatgtatccaatcagtttaaattcttgtgggttatcgatttcccgctgcttgaatacgatgaagaacagggccgttatgtagcggttcaccatccatttacagcaccgcttgacgaagacattccattgttggaaactgcaccagaaaaagtacgttcagatgcgtacgacatggttgtcaatggcgtagaactcggcggcggttctatccgtatccacaacggcgatattcaggaaaagatgtttaaggcgcttaatctctcagaagaaacggttcaaacacagtttggcttcttaatggaagcactcaaatacgggactccgccacatggtggtttagccttcggttttgaccgtttgattatgatgttgatggatatcgacaacatccgcgatgtcattgcgttcccgaaaacacagaatcacagcgatttaatgacagaagcgccagctgatgcaggtttggaccaattgatcgatttgggcatcagcgtggatgaagatattgtttaattgaatgcacaactcccaattttttgggagttatatttctaatagcataaaatagaggcatttaagatgatcgaatacggaacagttaagagaataaagaaaaacaatacggcaagggtcatcattacgcgtcatgaaatgtgcggcgactgcaaagcgtgtgaattgggcacgtcaaaaaaaacaatgactgtcgacgcaaaaaacgatgtgaacgccaaggtaggcgataaagttgcactcgaaatggaatttgccaattttatgaaagcgagcggcgtggcctacggttttccgctaattggctttttactcgggatatttatcgggtactccattgcaccgatgctgcatttaaatgaagtttacactggctttttcggaggcctcattctcatgtttgcggcatacgggattattcatctgatggatcgccggggaaggtttggaaaagacaaatacgaacctgtgattacaaatgtcattgatcctgataataatctgctgctgaacaaatatgcaaaatccgaagaaaaataaagatgagtaataaagttaaaaaattctttttcgacattgacgacacgttgtacaatcagtacgagccctttagaagagcctttgaatattcctttggtgatcgcttcaaagcgttgaatgtagagcgcatttttatcgacagccgtgctcggagtgacgaggttttcgacatggtctccagaggcgaaatcgataaagaagaaatgtatgcgtaccgtattggaaaagcctttgaagataatggcgcttacctttcaaaaccggattgtttggcctttcaggataattacgagacctttcaaggaaaaatctgcctttcagaacagatacaaaatttgttgacctatctgtcaaagcagggtgtgttcttgggcatcatatccaacgggccagaacggcatcagtggtttaaaatcaaaactttaggccttgaaaaatggttccctaaagaaaatatttttatatctggaaagataggactcacaaaaccgcatcgggaaatattccaatatgtagagaagcgtacccacagtcaatctgacgaatgcttgtacgttggcgatgcttatccgatcgacgtggtgggggcaaaaagagcgaactggaaatcggtatggttcaatagacgccaccacgttcagccagacgatagtgagtacacgcctgattttgtcgtcgaatcggaattagaattaagcgaattgttactcgccatttatcacatcactttatcgtttaatgaaaaatgattcttattcattgtgattaaaccatctttttgcatttttgagagttcatgggaaagcgcggagcgatcgacgttcaaataatcggccaactgctgtcggttaaagggaatgtcaaagcttgcgctttctttttcttttgaaagaaaagacaagtacgaaatgacacgtccgcgaatggtcttgctggatgtatgaaagattctatgggacaaatgcaaattcttttgactgcaggcgagaagtaaattttgtactaacgtattttttgccgatgaaatggctgattgttctgcggggacagattgaaataatttctgtgtagagataaataagatctcgctggttttctgagcgatcacgtcgacggacaacggcttattagccagaacgtaactttcggcgaaaatggcgccatttgataaatgggcaatgatcgaggtgtttccccaaaagtcgacgttttcgatacgcacttcgccgtttaagacgatgccaaattcgttaagttgatctccgacatgataaatgtattttttgcgttgaatcgtcttcacatggcagcccaaaaaactgagaagtgcttccagttcggcggggttgatatggttgaatagtttgatttgctctaaatcatatgcttttatttccatggacagcctccagatttttctttttttatttcgctgaatgtattatactaaaactatatccaagatgaaagaaggggattataatgaaatacaaagttaatgatggttgtattggatgcggcgcctgcgaagcgacctgtccggaaatatttttcatcaacgatgaaggcgtcgccgaagccagagatatcgaagtgacacctgagttagcggaaagcgctgaagaagcgatggatggctgcccagtaggcgtcattgaacaaatttaagtcaaacacattaaagaacgtctaatcattatacgattgggcgtttttttatagggagcaaaggggggaagatagtgaaaaaacgcgtttcaattttagaattatacatcaccttttttaaaatcggtgcgatgatgtttggaggcggctacgcgatgctgccgattcttcaaagagaagtcgtcgaggataaaaaatgggttacagatcgggaaattgcggattattacgcgatcggacagtgcacgccagggattattgcagtgaatactgccacatttattggctataagaaacgtggcatcattggcggaattattgcgacattgggcgtcatttcaccgtcacttttgattattatgacgctggcaaaaattatcagccgttttgaaaacgctgaagtggttgtcaatgcttttaaagggatcagaattgcggttgttgtgctcattctcaatgcggtcatcaaaatagggaaaagctcaattgtcgacaaagcgacagctggcattttcctagtcgttttggtattggctcttgccacaaatgtgtcgccagttgtgtttgttctcattgcggccgctgccggcatattgattcaatctttgcgcttccgaaaaggaggtaaaagataatggtgtatgtgcgactcttttgggaattttttaaaactggtctttttgcaattggaggagggatggccacctttccttttctcagcaatattggtcaaactacacattggtatacccagtctcagctggcggatatggtcgcagtctctgagtcgacgccaggcccgcttggcatcaatatggcaacgtatgtgggctttaccgtaagcggcgtgttgggagctattgtatcgaccttgagtgaggtactgccctcagtgatcattatcacgctgattgcgaaggcacttcagacctttaaggataatcaatacgttcaggacggtttttatgggctgcgtcccgcctcaacggcgttaatcgcagcggcctgttgttcggttggagaaattgcattatttaatacccatacgcatttgtcgattcaaaatttcttgtctttcattaattggaaagcggttgcttttgccgtcgttatttttgttttgtcgaattgggttccgaaggtgaagaactggcatccgattatatttatcgcaattgccgcggcagtcggcatcgtcgttaaattttagacttgaactcttgataaggattagatataatactaaacaattcatttgaataagcgatgataaaaagagtagtttatttgtttctttccagagagtgtttggacgctgagaaaacacaagaacaaataaatgaagtacattttggagctttcagtttgaaaaatcgccttgcggtgattgattaggattggacgggtctgcccgatacagcttgtattatatattaatacaccgaggagtcttagcggcttaaattgaggtggtaccacggttattcgtcctctatctgaattttcagatagaggattttttatgatatggaggtaaatgaatggaaatttatgatgaattagttgcgcggggtctgatcgctcaggtgactgacgaaccgcagatccgggagttgattaataagggcggcgcaaaattctatattgggttcgatccaactgcagattctcttcatgtcggtcattttatggcattgtgtttgatgaaaagactgcagcaggcaggcaaccgtccagtggcgttggtcggcggcggtacagggtatattggtgacccgtctggccgaacggatttaagacgaatgatgacgccggaagaaatccagcacaactgcgactgctttaaaaaacagatgtcgcggttcatcgaattcggagaagataaagcccaattagtcaataatgcggactggcttttagatttaaattatgtcgatgtgcttcgggaagttggcgttcatttttcggtgaacaacatgttgagagcagaagcgtataaacagcgtatggcgagagggctctccttcctggaattcaattacatgatcatgcaggcctacgatttttatcacctgcatcaggcgtacggcgttaatatgcagttcggcggaaatgaccagtggagtaatatgctcgccggaacagaattgattcgcaagaagactggtgacgatgcgtacgcgatgaccattacgctgttattgaactctgaaggtaagaaaatgggcaagacagggaaaggcgcggtctggctcgatcccaacaagaccagtcctttcgaattttaccagtactggcggaatatcgacgacgcagacgtgatgaagtgcctgcggatgttgacatttattccccttgacgaaatcgacgaaatgggaaaatgggacgattctcgtatcaatgaaaagaaagaaatcttggctcacgaattgacaactttggtccacggtgaagaagaagcgaacaaggcccagaaggtttccagaaacctgttcacaggggcaggaagtgattcggacatgccgaaggttgaaatttctaacgatcaattagaagacgatcagatcggtgttgtggatctgctgacggtttctgaaattgccaagagcaaatcagaagcgagaagacttattaaccaaaatggcatctcgattgatggcagcaaggtaaccgatcaaaatatgcagattaccaaagcgatgcttgaaaagggatttgtccttaaaaaaggaaaaaaagtatttaaaaaatttgttttggcgtaaaatcaaaacgggctgtccggaaagggacagcccgtttttgggttatgattaaaatttaactggcccagttgccattgatgaaaatagggattttggagccgtcagctttaacgccggtaatatttaaatctgaagcgccgaccataaaatccacgtgggtgtcggaaacatttaatccggcattttttaacgcggcttcgtccatattttggccgcctttaacacaggtaggataagcggcgccgagtgcgaagtgacagctggcattttcgtcgaacagggtattgtagaaaagaatgccgagattttgaattggggaatcgtagggcacaaaagaaatttcgccgagctgattactgcctgggcaggattcaagcagtgattgcagcgcgtcgtatccctgctctgctgaaaaatctgtcacaacgccgtttttaaatgtaaactgaaaatgatcgatcagctgtccattgtaaaccaaagggtgtgtgctgacgagcgttccgtttacgcgatctttatcaggtgcgcagaagatttcttcagttggaatattagggaaaaaggacacgccgtcctgagcgatttctgaaccgccggcccaaacgtgatttttgggcatgccgacgtgaagatcagtgccggatgacggggaagtgtagatgaattctgtgaactggtgctgatttaataggttgacacgtttttcaaagctttgattatgggcctgccaagcgccgacaggatcagctaaatctgttcttgtggtgtagaaaatggcatcccataacttggaaacagcaagatcttcaggaagttctgggaaaattttgtgcgcccatccggccgttggaacagaaatgacgcaccagcggatgcggtcgttcatcacggcctcctgatacctttttccagcagtctgagcagcccgtgtagcagccaataccttgctggtatccacacccttcatcacatcagggtcttccgcataaatggagatcaccgccgtattttgatcgacgtagtcgtttaatcggtcctgctgccactttgggatggttgttaaggcttccagatcggcgtgatcgtatcgcagtcttgaaaaatgttcgtcattgtagcgaatcgagacatccttcgcgccgagttcaaaggcatttttggcaacaaggcgtgcaaaatcagcactttccactggcgcattgacaacgagcgtctgaccgggctgaatattgacgcctaaagagcaggcaagatgagctaaattattttttttctgtttaaaagtgagtgttgaattcataataagcctcatttctttgaatatctaaaagacaaggactggcggatgacgatagtcatgaaacaacagcgcgtcgccatggagataattccacatattttgggcgcgcatatcaagtcctaatatttccttcgctggttgatttaattgtgtttgattgctttttacatttattaatataggacagtcaatttttttcttattttcagctaagaatgcacgccctcgatcgttcattccaagaattcgaatatatggcggtgcgcatgcccagaattgatcgattgactgttttgaaatattgagagccaaattgaaaagaatgcgccggactcggcttttaggaatgcgtttagacgaaacgcaatcgatgatctgctgataagaaaatccttgtggatcgcgggcggtgttttgaagggcgaattccaagccttctgtcacctccggtaagccgcgaagctggggcagggaagctgttaacaatttagccgccgcaaagttctcaaaatgtgtttccagagaacaaaagtgggtgtcttttaatatttgtgatgggtagggcaggtagtctgaagcgagggcaatatcgtctgttctcattaattgccgaatggcagacgatgaaaatgaatcggaagcgatttggtcgtgaagcgcacctcgtctttttactgtgatcggatggagatgggcgtgactgcgagtgatcgcctttaaatattcgatgccgagaatgttattaggcttagccatggcgtcggcagcgcttcgccccagaagtgaacaaacggctttttctctagattttgcaaaactggccccgcgtttaaggcgctttttcagttctgattgaaaaacaggcggttcttcagataagagatgcgcaatcttttttaacgattcgatgtcgcccgattccgaaccaaaagaaaggtatgtacaatgcaatgcgtctaaaatggcaacggcaccttctgcaaatttttcggcacctgctgttgcccaggggacgggcagctcgcagacgagatcggcgccgccagcaagcgcaatcctgcagcgctgccatttatctaaaacagctggagtgccgcgctgcacaaaaggcccgctcatgacgacaatggttgcgtccggatggactttctcttgagaggcgcgaatatggaagcggtgcccattgtgaaagggattgtattcggcgataattcctaaagctttcaaaatgaatgcctccatttgtttttttcttggatttttttgatattttcatattatattacaaaataatttaggacgaaagaataaaaaaatgatatagtattagaagtttgaatagtatatttttattctaaggagaaagtgaaaagatgaaagtacttgttatcaacgctggcagttcttctttaaaataccagttattagacatggaaactgaaaccgttttggcaaaagggcttgcagaaagaatcggcattgaaggttctgttgtcaagcatgaacccattggcaaagctaaggttcagtttaaacgtccattagatacacataaagatgcgctcgacattatttttaaggctttggttgatgaaaatcacggtgtgatcaaatcattggacgaaattgacgctgttgggcatcgaaccgttcacggcggggaagcgttcgcatcttccgtgattattacagatgaagtgattgaaaaaatggaagaaaattctgttttagcaccgcttcataatccggccaacttgatcggcattcgcgcttgccaggaaatgcttcctaatgtgccgatggtcgctgtatttgacaccgccttccaccagacaatgccgccgaaggccttcatttatccactgccgtatgaactctacgaaaaatatggcatcagaaaatacggcttccacggaacttcccatcgttttgtcactttgcaggcagctaaattaatgggcaagccgctttcagaacttaaattaatttcatgccatttaggcaacggtgcaagtatcgccgcagtctgccatggcaaatcgatcgacacctcaatggggttgacgccattggctggtctggctatgggaacaagatgcggggatatcgaccctgaaattcttattttcctccgtcagagaggctacacgacagaagaagttgacaacatgatgaataaggaatcaggtgtccttgggatttctggtgtgagctcagactttagagatatcgaacaggctgcaggagaaggcaataaacgtgcacaattggcattagatgtcttccagtacagagttaaaacaaccattggctcgtacgcagcagctatgaatggcgtagacggtattatcttcacagcaggtctcggtgaaaactcggatacagcgcgtgccgcaatttgtgacggcctgcagttcttaggtgttgaactcgaccctgaaaagaataaaatccgcggagaagaaaccattatttcaactgacgattcgaaaacaaaggtcatgatcattccgaccaatgaagaattaatgattgctagagatacagttgaattagttgaagcggctaaataaggacaaacgaaatattaattcaagaatttttcttgacagaatgggcaattctcatttataatgagtcttgcccatttggagtttataatgaaaatagaaatttcagaattacacggtggtgtgcagtatccactggattttcaagtctattcgaaagatttggtcgatgaaaatcaagaattgaatggccaaatttctgatgaaggtctgcatgttacggggcatctcagcctattaaatcgtcatgaagtgatggctgatttgcagataacggggacgatgatttttgaatgcgccagatgtttacagccgacaccataccagtgtaattatacataccgtgaatcgagcgaaatcaatccttcagcaaaggattttgacgtcattccctgcgtggaagaatgtctttatatcaacgagccttttagagttttatgcaaaccagactgcaaaggactttgcccgggatgcggcgtgaatttaaactttgaagaatgtcgatgcaatgacagcgatcattctgatgacgacaatgggattgaccctagaatggaagcattaaaaaaacttttataaatggggctaatgtagtataattacttaatcatagttatagacgttgggaggtgtaacaatggcagtaccaaagcacagatcatctaaagcaagacgcgacaaaagaagaacgcattacaagctgacagttccaggcatgagtgtttgcccgaaatgtggtgaaattaaattaccgcatcgtgtttgcagaaattgtggaacatataaagacacagaagtgttagctgaagactaaaacagagctttgcctctgtttttctaatttttaagggaaacaatatgcatatctttgtggatgcaatgggtggcgactatgccccgagagaaattgttaagggctgcgtcgatgcggtcaatgaatatcatgttcatttgaccctcgtcggcgacgagtcggcgatccgtgacgagttgtctttggcaaaagatccaaaagaagctatcgatattctgccggcgaagtcggtgattggttttaatgaagaacctatgaaggcgattagagaaaaaaaggattcttcgatcgttgtcgggttagatgcagtcaatcaagaagaagaaaatagtgtgcttgtgtcagccggttcaacaggtgccttgttggcaggcggtctcttcaagctggggcgcatcaaaggaattaaaagacctgctttagctacgccacttccgacaaaagatcatgtcacattacttttggattcaggagcgaacgcagattgtaaagcggaatacctgcagcagtttggtattttaggatcaatctactatcaaaatgtttttaacgttgcctatccgaaagttgccttacttaacataggtacagaagaagaaaaaggcagcgttctggttaaaaaagcgtatcagcttttatcagagacaaagtcaattaattttattggcaatattgaatctcgtgacgtcatgaccggtgaagcagatattatcgtcacagacggttttaccgggaatatattattaaaacagctcgaaggactttccagctttttattaaatggattaaagcaagccatcttaggttcgaccagaggtaaaattggcggagcactcataaaaaaagatctccaatcttttaagaaagaatttagttctgacgaagtgggtggtgcaccgtttcttggcatacgcaatggactgattaaggcacatggcagctccaatgcttatgcgattaaaaatgcaattaagcaggcaattgcttacatggatggcgacatcatagcgaaaattgaaaacacaataaatagtgaaatgcagtctaaataattaaatggaggatcaaacaatgagtaataaacttgatcaggtaaaaaccatcattgcagaacagttaggtgtttctgaagatgaaatcagcgaagatagcaatttggtagaagatctcgatgcagattctttggatattgttgaactggttatggcttttgaagatgaatttggtgtcaaggtcccagatgatcaattagaaaacatcaaaacagtcggtgacattattaaaattcttgacgcttaaatgaaacttgaaaaagctcccatatatatgggagctttttcgttaatataaggattcttttagaaatggaaactaataaattagaaaaagaaatcaattattattttgatgaaaaaaaatatctaatcgaagcgttaacccatagttcgtatggaaaaagcgacacgaacaatgaacgattggaatatcttggagatgctgttttggaattatctatttcagaatacttgtacaagcatttcaatttttctgaaggaaaaatgacacggcttcgagcaagtattgtgtgctccgaatctttatccagagcggcagcgaaaatccatttgggtgattttctattattgggaaaaggtgaaatcgcatctggaggaagacatcgcagatcaatattagagaatgcttttgaagctttaattggcgcagtgttcctagattcagactacgatcaaacaaaaaaaatcgcttattctttattggacgaaaatatacatttagcgcttagcggacatttgaataatgattataaaacagccttacaagagctgattcaacaacaaaaggagcatgttattgaatacgttcttgaccacacaacagggccggaacacgaaaagaatttttacgtctccttatttattaatggggaaaaatgcggcgatggcgtaggaaaaacgaaaaaagaagctgaacagcaggctgctaaaaatgtattatataaaaaattaaattagatctgtaactaaaggtgtaataatatttatgtatttaaaatcgttgcgaatggtcggatttaaatctttcgcgaattccgttgaactcacttttgatcctaacattacagccatcatcggtcctaatggaagtggcaaaagcaatatcattgatgcgatccggtgggttttgggagagcaaagcagtaaatctctgcgcggaaaacaaatggatgatgttatcttttccggcacatcttttcataatccgatgggatacgcagaagtgacgattctattggataattcggaccgatattttaacgaatttccggacgaagtctccatcacgcgcaggctctttaaaacaggagaatccgcttatctgattaataatcaatccgttcgtttaagggacattcacgcgatatttgcagacacaggtcttgggaaaaatggctactcaatagtaggtcaagggaatatagaaaatattattaacagcgatccggatactttaagggggattattgaagaagcggttggcatcgttaattataaatcccgtgagcatgaggcgcaaaaagaactagattctgctcaagcgaatatggagcggattcaggatttgatgcttgaattggaacgtcagcgcaccccattatcgaaacaggcggaaaaagcaaagcgttaccttaacttgaaagaaaagctgaaaaggttagatttaatctcgtttcaaagggaataccaagcacttgaaagaaaaaaatcagaaaatcaaaaagcgctcgatcaatgtaacgacgaaatcaataaaataaaaatagccatacacgatgcggatgcgcaatatcaacgattacgtgttcagaagaaaaaaatattagaatctaaaaaagaaagtgatctattatttgaagagatatccacgaacaacgtgaatgttgaaaaagacaaggcgcatatagaagaacaaatcaatcgcacaacatttgaaatcagcagatgcaatgaactcataacagatttatcgactcaaaaggatgagaatcagaaaaaaatagatggattagctgatgagatccgagcgctccaaaaggataatgagcgtttaaggcgcgaacaagcgctgcagcaaaaaaagggcaatgagcatgcgcaagccattggaaaaattcaagaccaattaacaaaagcgcagggaatcgataaaaattttcgatctgaacgagaaaaaaataaagataaaatcgcacaatacgattcagagttatcagttattgaagaaaaaatcaatattagaatgcagcacatacggaatgaaaaaaatatcatttcagagaataaaaagcattatgaacgcgaacacgcaaagttagaacaagatcaaaagcaggctgcagaaacccaaaagcaattatcagaagcacaagcgacacttaatcaattaaaagataaagagaaaaagctatcgaaacagattaatcaactcagaaatgatcaatcacttctcaggactcggactgattatcttaaaagggtacaaagccagttcttagattatgtgcctggaacaagatggattatgagcagaaaaagctcaatgccaaaacaaatacagtataatatttttgggcccgttggcgatctcattgaagttccgaataatttaatttatgcaatagattcggctttaggaagaaagactcaaaatattattgttgccgatgttgacacggctcgttattgtatagaattattaaaaaagaatcggtctgggcgtgtcacttttttgcctttatccaatttaaaaagtaatcagatttctgaaggagaaaaaaacagttttactcattttaaaggttatgccggcattgcgtctgacttaattcgattttctcctgaaattcagccggctgttgaaagtttattgggtagagtgattgtggtcgacaaattcgatgcggcaagacaaatgcggcgtgttgtaaaatactacatgattgtgaccctggatggtgaaatcttttatgcaggcggcgcaattgtcggtgggaggcagaaaaagaatcaaagtacctaccgatacaataaaaaagacgagcttaaaacctatgcacttcaagaaaagaaaatggctgcgcaaatagcagattgtgatcgtgaactagctgctgtacagaaatcacgatcaactcaacagcaaaactatttgaaattaaaggctcatgacgaagaagttaaacggcttattttcgaagaaaatcataaaagtaagacattaatcaaaacgaatttagatatacatacaaatattgatcaagaagaaaaagaatgtcaacaactgaaaaataggttcagcgacatacaaaaatcaatcaaagaaattaataagctgataacaaaagacgatactaacgaccatgctgttaatcaaagtgatattcaaaatcaattaaatgcgctgcatcaaaagcaaagggaaaatgaccggatcattgccaaatacaacattgcaattgcaaaaaataatgaaggcattaaattaaaaaagaaacaatcagaaaatgtaaaacagcaaattgatcaactcatacaaaaaatagaggctcagagcactctctctaaagagcttgaaatggctgcaaaacaaagcaaagcgcgtttgaaagaaatcgatcagtcgattcttttattacaaaagcgggaaattgaccgaaaagaaaaggccaattcatttgcagagagtgaagcaaaaatagacgaacaaatagaggataccgacagaaaaattagaacgttaaatcatcagcagattttgcaaaatgaagaattgaacaagctgcaaatcgcatcacaccgcatattaacggtaagacaaaatatgtccgacaaaatgatgagacgttacgatatgaatctcacgatgattagtgattggctgagaaataaaaattgggatgaaacggctgctgacaagtcgtctattcagtctttagaacagcaaattaaagatctgggcaatgtcaatgtgaatgcaattgaagattacgaagagatcaatcaaagatatctttttattcaaaatcaatatcacgatctattaaaatcaaaagagaaaatagaaaaaatgattcaggaccttcaaaaagaaatgacagaaagattcgattttgaatttaaaaagcttcagttgtatttctcacaaatatttaaagaattgtttggcggcggaaaggcaaacctattttatatggaccctcaaaatatcctacaaagcggtattggacttgaggctcagccgcctgggaaaaatttaaaacagctgtcgctaatgtcaggtggggaaaaagcgatgacagcaatttgcctgctgtttgcctttttaaagcttaatccatcaccgttttgcatcattgatgaggtggatgcggctctagatgatcaaaacatttaccgctttacgacttatttaaagaaaatttatgatcaaactcaattcatactaattacgcatcggaaaaacacattaaaaatctgcgattcgatttatgggatttcaatgacgaacacaggcatttcaaaaattgtctcagtaaaaatatcagattatatttaatattacaaaaggagaatagaatggcttctgtatttaaaaaaatgcgcgatcgcgtttccggtacgacaaaaaaatttactgaaaaaattgaccacttgctctattacaaagaattagacgaagatttttttgatgaattagaagaaaatttaatattatcagatatcagtgtcaatacagcggaaacgattgtcgaagaactgcaggataatatcaagacaaaaaaattgaaaacaaccgaaagtgtcattgaagaacttcagaatatcatgatccagatggttgatattccggaagatccaattcaatttcctgcaatcacattagttgtaggggtaaatggcgttggaaaaacgaccacaatagctaaattagctcaaaagtataagagtgaagggaaaaaagtagtgctcgctgcggcagacacatttcgtgcagctgctgtggaacaactagaaacctgggcggagcgaatcggagtcgatatcattacaagccgttcaggagcagatcctgcttcagttgtttttgacgcgattcattcggctcaagcgaaaaatgcggatatattgatttgcgatacggctggacgtctgcataacaaagtcaatctaatgaacgaattaaataagctgaatcgaatctgcgaaagagagaagggcgattatcacatccataatgtgttggttgtggatgcgacaacggggcaaaacgctttgacgcaggcaaaaacgtttaacgatgcggttccgctgagtggcatcatcatgacaaagctcgacggcacagctaaaggcggcgtcattattcctattttaaatgaattaaagattccgattgaatatgtagggcttggtgaaaaagcggaagatctaattccatttaatgcgaaggattttgttgaaatgctgtaccatcccgatgaagatgcgaattcataacaaattgtaaagaaaaagacttgacacatcgtggaaagatttgtaaaatatataagtcttaggaaagaggtctatgtcaaaagaagagtcgatccggaaaaaatatcaagaacagttgctttttgatttctatggagaattgctttcgtcaaaattaaaattgccattatcgtattactacaacgatgattattcagcgactgaaattgctgaaatcgtgcaaatgaccagacaaggcgcatatgatgccattcgtagagggcgtaaccagctgcaaaaatttgaaaacaaactccatctcgtagagcggtttgaaaagacaaaaatattaatcgccaatattgaaacagagttggacgagttgcaaacggatgagatgatcaaacaatcaccggcagcgatgaagacgctcaaaaaattatcaaaagaaattgatgattttaaagatgaatattagaggaaataatcatgtttgaagggttaagcgaaaaatttcagaatgtattcgccggaatgcgaaaaaaaggcaagcttgatgaatctgacatcaaggctgcaaatagagaaatcaagttagctctcctagaagcagatgtcaactttaaagtggttaagtcctttaccaagtcagtcagtgaacgagcaaaaggcgaagaagttcttaaatctttaacaccagggcagcaatatgttaaagttgttaatgaagaaatggtgaagatgctcggcggcgaagatcaaaagcttgagatttcaaaagataaaatgaatatctttatgatgattggtctccaaggcgctgggaaaacaaccactgcggcaaaaattgccaatctcttgagaaaagaagcttcattaaagcccttacttgtcgcggcagacgtgtacagacccgcagcgattgaacagttaaaagttctgggaaaagaactagatatacctgtttattcagatgagacgaatcaggatccagttaaaatagcggaagaagcgaagcaaattgcagaagataagggctataatttagtcattatcgataccgccggcagattacagattgacgaaacattgatgcaggaactatctgatattgatcaggctattcagccgacagaaaaattgctggttgtcgatgggatgacaggtcaggaatccgtaaatgtttcaaaaacctttgatgaaaaactgggtataactggtgtggtcttgacaaaacttgatggcgataccagaggcggcgcggcactgtctgtcgcgtataccacgcaaaaaccgattgtctttatcggaactggcgaaaaactatcggatattgagtcttttcatccagaccgaatggcctcccgtattttgggaatgggcgatgtgctttcattaatcgataaagcacagggaatggttgatgaagaagaagcaagactcatggaacaaaagatacgcaatgcatcttttgatctcaacgactttcttgatcagctccatcagctccaaaaaatgggctccatttcaagcctgcttgagatgatgccaggtatgaataagaaagctctggctggcttagatatggcagctacagaaaaacaaatgagtagaaccgaagccattattttttcgatgacgccggaagaaagagaaaaaccggatatcatcaatggcagccgacgtaaacggattgcaaatggcagcggaaccagtgttgctgatgttaaccgcttgttaaagggatttgaacaaagcaggaaaatgatgaaacagatgggcaacatggggaagaaaaaaagaggaagaatgaaattgccgtttatgtaataataatattattactgaacatagagatagcaaaaatgaaaggagtcaaaaatggcagtaaaaatcagaatgaaacggatgggaaagaaaaagagcccattttatcgtttagttgttgctgatatcagagcaccaagagatggaaagttcatcgaagaagtcggctattacaatccaactgtcgaaccgcctgtaattaaaattgacggtgatgcggttaaaaaatggatttcaaatggcgctaaaccatctgctacagtaaaggcgcttttacaaaaagaaaacatcatcgactaatcaggagcactttttatgaaagaactggttgaggtgatcgttaaagcactcgtggatgatcccgatgctgtagaagtgactgaaagtgaaaagcataatgaaattattcttgaacttcatgttgccgatcgcgatatgggccgagtcattggtcgtcaaggtcggattgcgaaagcgatccgttctgtcttgaaggcgatgggaagtaaagaaaataaacgcgttatgctgaatattgtagattaataattaatatcgaaggatgattcgtgcaagcgaatcatttttttatatcttgggaaatcgaatgaaacaattattaacaattggaaaaataacaggggctcacggtattcgaggagagatgcgcgtcatgccaatgttggacgttacagagcagtttttctcatttaaaacggtttatattcaaaaaaaagggaataaaccgcagaaaatgaatgtacaaaacgtgagattacataaaaacatggtgctgctcacattggaaggtattaaaagtagaaatgacgcggaagcattaatcaacacaacggtctgcatcgatcgcagccaggatcaattagaagaagatgaagtgtatattgctgatcttattggtattcgggttttcgacaaaaaaaatagtgaaataggaaaaattacggatgtgttaactaatacaggatcagttgatacgcttgagattcagctcaggaataaagcgaaaaaaatttatgttccttttagaaaatgctatttttatcagtgggatttagatcaaggaacgatgttggccgatattcctgaagaattttttgatttataaatagctatgatggacttatattttttgacgttattcccagatattattaatcaatacttttctgaaagtattatgaagcgcgcactggaagatcatattatacaggttcatgcaattgatattcgggattttgcaaataacaagcacaatcgcgtagatgattacccttatggcggcggcgctggaatggtcatgcaggcggcgccaatcataagagctattaaaagcattgaggattatcaggagattccaattatttttttgacgccctcaggtacaccatttaatacggaagagtgtcaaaaattaaccttaaggttaaaagagcgcaagcgctttatatttttatgcggccattacgaaggtgttgatcaacgcgtcatcgatcgttatgtaactgacgaatattctattggcgactacgttttaactggaggtgagcttcccgctctagttatggctgacagcattatcagacaccttcaaggtgtcttgggaaacgatgaaagtttaacggaggaatcttttgaaagtaatctactcgaatatccgcaatacacgaggccgcagcaagtcgaggatatgtcggtgccaaaggttttactttctgggaatcacgcccagataaaaaaatggcgaaaagcgaaatcacttgagattacgcagaaaaaacgaccggatttattaaaaaaagagaaatagcttgcaattctgaatcgcttcgattaaaattggtaagtactgtcttgatgatccgctggtatggttatacgaatgatcttcaaattttctacataaaggagacaagttatggatttacttaaaaaagtacaagaagacaatatgaaaaaagaagtcacaccatttgaagtgggtgatactgttcgtgttcatgtacgcgttatcgaaggaaaacgcgaaagaattcagatgttcgaaggcgttgtgctgaagaaacagcacggcggcattaacgaatcattcactgttcgtaaattatcatctggaattggcgtagaaagaactttcccggtacattctccaaaggttgctcaaatcgatgttgtgcgccgtggtaaggtcagaagagcaaaattaaattatcttcgcgatcgcgttggtaaagccgcaagagttaaaagcagagactaatacatttaatcataagggtcctttatgggcccttgttttgtatgcgatattttaggagtacaatatgtcgaaaaaacgaaaagaaaacgaggaagaatcggcaagtattaaggattggattatttctattttaattgcagttggtatcgcaatcgtgattaagatgttcttctttgatttcgtagtcgtacaaggaccttcaatgcagccgacattacatcaagggcagcgccttgttattaataaaatcgagtatcgggtaggcgagcctgattatggcgacattgtcgtgttgagattttctcctggagtggattacgtcaagcgcgtcatcgcaaaaggcggtgacaccatcgaaatcaaaaatatgaaagtttaccgcaacggaaaacttttgaaagagtcttatatcagtcaagaaccctacggtgattatccaaagacgaccgttccaaagggaaaatattttgtcatgggtgataaccgcgcaaatagttcggacagcagattcacatccttagggttcgtagatagtaaagacatgatcggtcacgtagtatttaggttttggccctttaataaatggggaacaataggtaattaacaatggcaacaacatcgaagcagctgcagtggtatccggggcatatggccaaggcaacgcgccagatcaaagaaaaattaaaactagtcgacacgattatcgaaatattagacgcacgtgtccctgtcgcaagtcgcaatccggatattgcacagctgcttaagaaacgaaaaaaaacacatatcattttattaaacaaatctgatttggccgatccgaaaagaactaaacaatggatcagcgcaattaaaaaagaaacgacagctcagcatgtgatggcatttacggcttataaccgaggtgatcgatcaaagctaatgagcgtgctgcagcaaggcgaatcaaaaaaatgcttaatctgcggcatccctaatgttgggaaaagtgccattatcaatacattggcaaataaaaaaaaggcagttacggggaataaacctggcgtcaccaaaggacagcagtggattcaaactgaagaaaaaatcatgctgttagatacaccgggtattttgtggcccaaatttgattcagaacgtattggaaacgagctggcatggattggtgcgataaaagatacgattttcgaaaaagaaaatctcgctggtgagctcataaaatttatgatgcagtattatccggaccgcattcaagatcggtatcaacttgaagatatttcggggaaaaaaccttgggaaatttttgatatgatctgtgaagaaaaaaaactgcttgtgcggggcggtgagtacgattatggccgtgcttcaaatatgcttttgacagacataaaaaatggaaaattcggaagaattacaattgacatgccagagagcgagaccgagtaaaatcatgatgcaacattttgatcaaatgcagctttctaaaatgaccattaaagaaatcgaccattggattagtcaaatttcagaaaatgagctgtctcaaattttaacatgtctggaaaaagacccaagaaaaggcgtgcaggcacttgtgaagaaaaagagaagacaagtgcagagaacaattgccaatctcgaaaaaattcatcagaaaaagcaacttgaagatgagttaatgtctcaaggctttcagtttattgcgggcattgatgaagttggacgaggccctctggcgggaccggtcgttgcagcagcagtcattatgccaaaagagtcgtgtatattggggatggaggattcaaaaaaactttcggaaaaaacgagagaaaagctcaacctgaaaataagaaaagaagcaattgccattggaatcgggcaggttgaaccacaaataatcgatcaaatcaatatactagaagcgacaaaattagcaatgaacaatgccgttgaacaacttcatcccagccctgatttgttattaatcgatgcggttcaattgccttcagatattccggttaaagccatgatacatggagatgaaagatgttattcaatcggtgcggcaagtatcgtggcaaaagtttatcgtgacaatttgatgaaagaatacgcaaaacaatttcctcaatatggatttgaaagcaataaaggatatggctcggcggaacatatagccgctattcgccgatttggcgcaacgccgattcacagaaaaacttttattaaaaattttgtgtagatggacaaaaaattaaatcgcaaaaaaggaaattgggctgaagatgtagctgcattttacttggaaaaatacaaaaatcatcaaatcgttgcgagaaattattctgataaaaccggcgagattgatattatttcaaaaattgaccagatgtacgtttttacagaggttaaatacagagcgaatatgcatcatggcactcccggacaagctgtaaattttagaaaacaagaacatattattagaacggccattttatatttacaaaaaagaagagtaataaatccgagaatccgttttgatgtcgtagaagtcgttggaacgaataaagaaaatgtgagagtgcggcatattgaaaatgcattcacttcatatggatattatctatagtgaaataattataaagaaatcttgacaaaagaattgcagagcgttattatgaacaccgcaattgaaaaataacctatctagagcggcggagggaaaggcccaatgaagcccggcaaccagcaaaagtatggtgctaataccttcaggaaactgaatgatgggatgaaagaatcccactcgttacaaagtgggattttttaatataatatacaaaaggagatactatgaaaagattatttacttctgaatcagtgacagaaggacatcctgacaaaatctgcgatcaaatttcagacgctgttttagacgcgatcatggaaaaggatcctatgggacgtgtagcttgtgaaacatctgttgcgactggtttagttttggtgactggcgaaattacaacgaactgctacattgatatcccgaaaattgctagagaaaccattcgagaaattggttacgatcgcgcaaaatatggttttgactgcgatacctgcgcggtcttaacatcaatcgatgaacagtcaagcgacatcgcaatgggcgttgatgaatctcttgaatcaaaagaaggcggagatatgaacaccggtgcaggcgaccaaggtatgatgtttggtttcgcgtgcgatgaaacgccagaactgatgccgatgccaatttcgttggcacataagttgacaaaacagttagcaaaggtcagaaagagcgggcagctcgactatttgcgcccagatgggaaatcgcaggtgactgtcgaatacgacggcaacacaccggttagagtagatacggttgtgatctctacgcagcacagcgcagaagtcgattcgaagacaattcgccacgatgtgatcgaatatgtcatcaaacctgtcatcgatgctgatatgatggatgacgatacgaaaatttttgtcaatccgactggaagatttgtaatcggtggtcctcaaggagacgctggattaaccggaagaaaaatcatcgtcgatacctatggtggtgtaggccgtcatggcggcggcgcattctccggaaaagatccgacaaaggttgaccgttccgcagcctatgcagcgagatggattgcgaaaaatatcgttgcagcaaaattagctaaacgctgcgaagtacagcttgcatatgcgattggggttgctaaaccagtttccattttcgtagatacttttggtacaggtgctgtaacagatgataaaatcgtcgaattaatcgaagaaaatgttgacctgagaccggatgcaatcattaaaaatttagatcttagaagaccaatttacaaacaaacagctgcctatggtcacttcggcagagatgacttgaatctaccgtgggaacagttaacattagttgatacctttaagcaagcgctttaatgcggacacttgagacacgttagttagacgtgtctctttttttaaagaacgctgaaataatttgtatattatgaattcttgagttatactaaactagaaaaattaagcattcgcattgtaaaagcgagttttaaatcgattgatatagaaagagtacactatgatagaatttgataatgttacaaaaacatatgaaaaaaacgaaaaagatgcgctgaaggatatcaatctgcgtattgaatctggagaatttgtctttttagtgggacgtagtggcgctggaaagtcgacatttattaaattattgctgagagaaattgatgcaacgagcggcgttgtccgtattaagggacatgatatttcaaaactgtcaaaggcacaaattccttatttgagaagaaaattaggcgttgttttccaggatttccgtttattggaaaacaaaaatgtttatgaaaatgttgcctacgccatggaaattatcggacgtccagaaaagaagattcgaaaaaaggtgccgcttgcattaagcatggtgggcttatcagatcggatgtaccactatcccaatgaactttctggaggggaacaacagcgggttgttattgcgagagcgattatcaacaatccaagtatattgatttgtgacgaaccgacaggaaacttggacccggaaacatcaaaggatattatgcgtattttgcttgaaattaacagacatggcacgacgacagtggttgttacgcatgatatgaatattgttaaacttttaaataagcgagttttaacacttgaagatggcaggttaaccggagacagcagcaaaggtgggattgtgaatgtttaatcttcgaagatctacaattcgcgatgccgggcagagtttgcggcgaaattcgttaatgagcttggcttccattatttcaatgactgctgcgttaatcattttgggcatctttttagtcattacaatgaatattcggcaaattactaaacacgttgagggtaatctgcaaatccaggtgtatatgacagaaaactgcacacaacagcagaaagatggattgaaaaattatttaaattcaaataatttgattcaatctgtcaaatatgaatctaaggcgacagcattaaagaatttctctaaccagttgaatagttcatcagatttaactgatacgtttaacgctaaaaataaccctatgccggagtcgtacatcgttagagcaaaaaatgcagacaatctcggtaagataaaaaagcaaatttcacagtacaacaaaaaaaataatgcgggaattgaatacattaaatacggaaaagattatattaaggcgttgactaattttagtcattttattaatctgttttgtatttttgtagtaattgtcttgtctgttatttcttatttcttgatttacaatacgatcaaattgacagtatttgcaagaagaaaagaaataggcattatgaagtatgtcggtgctacggacggttatattcgagctccgtttattttagaaggggcattcttaggcattattgcagcgttagcggccactttagctgtgcgtactggatatttctatattctaggctatctaagcggtaatgcgctgctcccaattacggctaatttgtcctcgcctgctgccctgattggacaaattgttattttctttttagtgtacggtattttgatcggtacgattggaagccgtgttgcgattagaaagttcttagatgtttaatttatttgaatagcgcggaaatatttacgtccccccaattgtattgagtttataaactcatgaaagattagcaattggggggcttattatatttatattagtggaatcaatctcaatggagtaatatcaatgaatcgtacaaaaaagaatgtccttattatcattttagtgattattttaacgaatctgctgactttttttctcacctcattcggtatttttcacttaaaagattactatgtattcaaggccaatacctctaaaattgcaaaatcgactcaaaaatttgcacagctggagaattcaatagaagaaaattactataaaaaagtggataccgacaaactatcagagtctgcttacaaaggaatgttcaaggcaatcaaggataaatattctatctattacacgaaaaaagaatacaaggcattgacccaagaaatttccggttcctactatggtataggggtgatattaagtgaagatgacaataaaaatgcctatatcgtatcagttatgaaaaatacaccggcagaagaagcaggtttaaaggccggagatgtgatcaaaaaagtggatggcaccaattatttggggaaaggctcgtctgctgtcgcgaataaagtcagaggaaaagcgggatccagcgttcagcttgtgattcaaagagatgggaaagacataaatgttaaagttgaacgtgctgcagtaaagaattcgtcagtgacgtcgagaacttttaatcagaatggaaagaaaataggttatatttatatttctgaatttgcagaaaatacagatgaagattttgaaacgcagctgacttcacttcaaaaaaagaatattcagggcttaatcattgatttgcgcgaagatggcggtggtatcgtagatacagcagtcaatattggcgatcaattgatatataaagggaaaatcgtaacgacaaagggaagaaacggcaatgatgaaacctatcgagcaactagcaaggctcaggttaaacttccaatggttattttagttgatcaaaatacggcaagtgcttctgaaatattgactggggcattgcaggattacaacaaagcgaccgttattggcacacaaacatttggaaaaggaattgtccaaagcgttattccgatgcatgacggcacgggatatcagattacaacagctcaatattacacacccaaaggaagaaatatcaataaaaaaggcattacgcctgacattgttgtcaatgaaaatgatttgacggaaaattatcttactgataatgatcaacagtttcagaaggccttagaaataataagtagtaaaattttaaaatgaaaaaaatcacaaaagtcaataaaccatttaaagttgtatcaaactttacgccaaagggcgatcagcagcaggctatcgataagctctcaaagggaataaaagaggggatgaaataccaaacgttgttgggagtaacgggttcagggaaaacctacacaatggcaaaagtcatagaagccgttcaaaaaccaacacttgttttggcacataataaaacactggctgcgcaattggcaaatgaatttaggacatttttcccaaataacgcagtggaatatttcgtctcctattatgattattatcagccagaagcttatgtcccaggcagagatttgtatatcgaaaaagatgcttcgattaatgatgaaatagataaattgagacactctgccacagctgctttgtttgaacgaacggatgtcattattattgcgtctgtctcctgtatctatggtctcgggagcccaatcgattatgaaaatctcgttatttcgttgagacctggcatgaagaaagatcgggatgagatcattagacagctggttgatattcaatatgttcgcaataatatcggttttgagagaaataattttcgtgtacgtggcgatgtcttagaaatttttccggcatcatcaacggataaagcggtaagaatagaattttttgacgatgaaattgaccgcattacagaaatcaatgtggtcacaggtgaaatcattggagaattaagtcacgttgctattttcccggcttcacattatacgaccacaccagatcggcttgagaacgcgataaaagggatacgcaaagaactcggcgaaagatacacttggtttaaagagcacgattatctcgttgaagcgcagagaatattgcagcgcaccaattacgatttagagatgcttcaggaaatggggtattgcacaggaattgaaaattacacgcgctatattaacggttcaaaaccgggtgcgccgccttatacattaattgactattttccagatgattttttgattttcgccgatgaatctcacgtctcaattccgcaaatcggcggcatgagtgcaggcgatcgagcgcgaaagaaaaacctcgtcgactacggatttagactcccttccgcctatgacaatcggcctttgacttttgaagagtttgaaggaaaaattcatcagattatttttacatctgcgacgccagggaaatacgaagcagaacatagtgagcaggttgtagaacaattgattcgtccgacgggattgttggatcctgaaatatcacttcgtccgaccaaagggcagatcgatgatttaattagcgaaatacgaaaaacagtttcgaaaaaagagcgcgttttgattacgacgctgacgaaaaaaatggcagaagatttaacggaatatttaaaagacaatggaatcagagttcgatatttacattctgatattgataccattgaaagaatgaaaatattaagagaattacgccttggaagttttgatgtccttgtggggatcaatctcttgcgcgaggggttagatctgcctgaagttggacttgttgcgattttagacgcggacaaggagggctatttaagaagcgaaacatcgttaatccagacgattggtcgagcagctcgaaacgtagatggccatgtcattatgtatgcagataccgttacaaaatcgatggattatgcgattacagagaccaagcggagaagaaaaattcagcagcaatacaatttagatcaccatatcgtgccacaaactgtaaagaaagatattcacaatattattgaagtgaccaaagctgccgaaacacctgttaaatacgaaaagcagccttcaaatcgaaatgtggacgattttgatttagaaaaacttgaaaaagaaatgaaagaagctgcagctcagcttgactttgaaaaagctgcaaaaattagagatttgattaaggaaatcaaaggtcaaaaagttatatgaaatatatatcagtcattggagcaaaagaacataatttaaaaaatgtcagtctaaaaattccgagagatcagttggttgttttcactggcgtatcgggttcgggtaaatctacactagcatttgacacgatttatgccgaagggcagcgcagatatattgaatccttatcttcgtatgcgcgaatgtttttaggcaacagcagaaaacctagagtcgaaaaaattgatgggctctcgccagctgtttccatcgatcaaaagacgacaaatagaaatccacgttccacagtcggaacagttacggaaatatacgattatttaagattattgtatgcaagaattggcattccgcactgtccacactgcggcaaagaaatttcgtctcaaagcattgaccaaattgttgatcacattttggaactgccagaaggaacgaagtttatgattttagcgcctttagtaagaggcgaaaaagggcagcagaaaaaattgctgtctcgcttaaaaagagaaggatacgttcgtgttgttgttgacggtgaaatgcgtcttctttccgaaaaaattgaattaaagaaaaatattaagcatcaaattgatgtcgtcatcgatcggctgaaaaagagagaaaatatgcgcgagcgcttgacggattcagtcgaaattgcacttaaaatgtctgacggccttgtaaaatgtcaagtcatcgacggagaaagtagactgttcagtgaaaagctgtcatgtccagactgtggcttttctatggaggaacttgagccgcgttctttttcttttaacaacccatacgggatgtgcccaacctgcaacggtttaggttttcacaaagaggttgatccacatattttaataccggaccgcagcttgtcaattaatgaaggggctatcaaattttttggacttaaacacgataacaggcatcttcagtcaatgctaaaaagtttgcttgaaaaatacaattatgactttgatacgccaataaaagatatgtcaaaggcctgtcttaatgaaattttatatggctctaatgatgaaatgactgtcacttacgatggtaaattcaaagggacctacacgtcgcgttttgaaggtctgatcaataacatggagagacggtttagagagacaaaatcaaatacaatgcgtgggtttattgaaagatacatgtcagacattccgtgtccaagttgtcacggcaagagactgaaccctaaagtattgtccgtaaccattgcgaatatgaacatcattgagtttactgaactttcaattcgcgaagcgctaaagtttctagatcagctctcgcttacagaacacgaaatgctgattgcgagtcaaatcataaccgaaatcaaaaatcgacttcaatttttgtcagacgtcggtcttgattatttgacacttgaacgttcagcggggacgctctcaggaggagaaagccagagaattcgattggcaacgcagatcggaacgggattaacaggcgtattgtatgtgcttgatgaaccgagtatcgggctgcatcagagagataatcgcaagcttttaaactcgttaaggcagttgacagatttgggcaattcgctcattgttgttgaacacgacgaagaaaccatacgtgaagctgattggattgtcgacatcggtccaaaggccggcgtaaatggaggcgaaattatcgcagaagggcatgtggatgatattattcggtcagagcgatcgattacagggcaatatttatccggtcagaaaggaattccagttccttctaaaagaagagagggcaacggaaaatttattaaaataacaggagcggctgaacacaatttgaaaaatatcgatgttgccttcccccttggaaaacttattttagtaacaggtgtttcgggatcgggaaagtcgacgttggtaaacgatattttatacaatggtgtctccagatcgctttaccacagctacaagcgtccaggaaaacataaacgcatctcaggtatacaaaatattgacaaaatcattgcaattgatcaaacaccgattggcagaacgccgaggtctaacccggctacatatacaggattatttgatttaattcgagatttatttgcaagtacaaatgaagccaaggcccgcggttacaataaagggcgatttagctttaatgtaaaaggtggcagatgcgaaacatgtcatggtgatgggatcataaaaatagagatgcatttcctgccagacgtgtatgtgccgtgtgaggtctgcaaggggacacgatataaccgggaaactttggacgttaaatataaaggaaaaaatattgctgaagtgttggacatgactgtcgatgaagcacttgaattctttaaaaatctcccgcgcttaaagcgaaagctggaaacacttcacgatgtggggttaggttatatcaaactggggcagccttctacgcaattgtctggaggagaagcacagagagtaaaattatcaaccgaattatccagacaaaatacaggtaaaaccctttatattttggatgaaccgacaacgggactgcacattgatgatgtcgcaaaactggtgaaaattatgcatcgcttggtagacatgggaaatacagtcgtgatcattgaacaccatctcgatgtgattaaagttgcagattatatcatagatttaggcccagaaggcggcgaaaacggcggcacgatcgtcgcccaggggacgccagaagaagtagcacaaaatccaaaatcatatacaggtgcgtacttaaaagaaattcttacacagaatgaatgagatccttgattacttctccagccataattaatcccgcgaccgatgggacaaaagagacagaaccgacaattttttcaaatttgtcggtttttattttttgtggtttttctgtagagtaaacaacttttaattgattgatatgacgtttgcgcagttcatgtcgaatgacttttgccaatggatcaaccgaagtttggaaaatatcggcaactttaaattgagtgggatccaatttatttcctgcccccattgaacttatgattggaacatggtgctgataagattcttctataagtgttagttttgctgtgacagtatccactgcatcaataacataatcgtattgtgtgaaatcaaattgatttttggtatccggcagaaaaaaaataggaaaggcctttactgaaatatgtgggttaatatcatgaatacgctctttcataatttgcgtttttaattgtccgatagttgatctcgtcgcgataatctggcggtttaaatttgtaatatcaaccgtatctttatcgataatatctatatgacccacaccacagcgggcaattgcttcgacagcaaatccacccacgccgcctagtccaaaaacagcgacatgcgaatttcttaacgtttccatggcttctgaaccaagtaataattctgttctttgcagctgattcatttttccctcacattgataagtaaattaattaatactatactataccttaatttgcatttctatttatttctttaaaaagactttattactttaattaaataattaaaaagtgtataatattttaaattacttgtcgaatggaatacaaaagagagaggtataccatgaaaagaacaaggaaaatcttttttctgattttttgtttagcattgatttttactttaacaactgcgtacagtcaaaagacgaaaacaagctcagattcgttagctgacggcaccattacattcggcgtctgcgcaaatcatgcaccaatggcttttactgatgataagcaaaatgtcattggatttgaaattgatttaggcaatgccattgcaaaagaattaaatgtaaatccttattggatcaatacatcttggaatagtatttttgacaggatgaatagaaataagtacgattgtgtgttatcttctgtaactgacacgccttcaagagaagataatttcagcttgtcaaaccgttactttgtgaataatatcgtgatattaaaaaaatccaaaacagacgatgaagcggtgaatgattcaaatgagacattaaaggatttgaaagacaaacaggttggcgttgttgtaaatagtggtggggccggaactgcaaaggcacacttggacaacgggaaagttaagaaatttaattctctcaattatgccgttaaagcattgaaaaatgatatggttgttcgtttgattatcgatgagtctgaagcaattttttatataaaaaaatacccaaaccaatatgagatcacatctcaccctatagccagtgaaaattactcaatcgtttgccgaaaagataatgagaagttgacgagaaaaattaatcgagcgttaaaacatttgatcgataatggtacgtatgcaaagttgacagaaaaatggtttgataaggatatgacttcgtcaatacaataattattatgttaaatataaatatattgacattaatgccagaggattttaaaggctttttatcatctcatatcgtcaaacgtgcgattaaaaatcaaacagcaaatgtacaggtgattgatatcaggcaatttgtcaaagggagttttcgtaaaattgacgattcgccatacggtggtggcgccggcatgattctgcgttatgaaccaattgtaaaagcaatcaatgcactcaaacagagtgagacttttacaattttaatgtcaccttctggacagacgtataatcaggcaatggctcgaaaaattgcccacacttatgataatattattatgatttgcggccattacgaaggtgttgatgaacgtgttatgaattatgttgatttaaaactttcaataggtgattacgttttgactggtggggaattaccttccatggttgtaacggattcaatattgaggcaattaaaagataatttgaaagcatctagtcttgaagaagaatcttttgatcatttccttttagaatatccgcaatatacacatcccagggaaattgatgggtatcgcgttcccgatgtactgttatcaggagatcataaaaaaatcgaaaaatggcgtcatattcaatcattaaaaatgacgaaaaggtttagacctgatttattcaaaaaataccaaagcataagcatagacgagaaaaatatcatagataggagtattgaaatgacagaggataaacaaaaagataagcacaattttgatctatcagatgaattaatatatcgtaggtttatgttgattaacaacagtgagctccagcatttctttcacgaaatgacaatctctgagttcattgtgctgaatttaattttaaaaaatgaaaaaaatgatccgatttatggtggcaaaacttatttatcagatttagccgaaagtctgcaccgtccaattcgctatgtatccaatttatcgcgacagcttcaagacaaagggttgattatctggaagcatgacggagatggagaacaaggtacatacgttatgatcacagatgatggaaaaaaattagttgaagaccaccaaaaatcaactcagcaattttattctcatgtgatcgaaaagtacggtcaacagaatatgataaaattacttgacttaatgaagcaattggataccgttatcacgacagagttggaaaaggagaaacaatgagtcaaggacaatcaaaatacctcgaaagacaaatcgcaatatgtaaagaaaatgacgaaatttcacctcggctttacagtgaatatggcgtaaatttagggctgagagatcctgatggaaagggcgtcctaactgggttaacgaatatctccgcagtcaatggtacaaaggttgtcggcggaaaacgcgtgccttgtgaaggagaattgtggtaccgaggctatcgtattgaaacattaatcaatagcttaggtgaaaatgaaatgggatttggcagaacagcctatttattattaatgggagaattgccatctgatgaagagttaaaaaccttcacttcagcagttcgccattatcgaaaactgccaacgaattttgtcagagatgtcattatgaaagcacccagttcggatataatgaatagtatgtctagatctattttgacactggcatcttatgattcagaagccaaaaatccttctcttcaaaataatttaagacaatgcttacaattaatcggtcaattcccgatgctggccgtttatgcatatcatgctcatgtttttacaaatttggatggcagcatgtacgtacataatccaaagccggaattgtcgaccgctgaaaactttttaatgatgctcagacccgatcaatctttcacttcagttgaagcaaagacattggacactgccatgattctgcatatggaacatggtggaggcaataattcaacatttacaacgcgagtcgtaacgtcaagtggttctgacacgtattctacgattagtgcagctatgtcatctctaaaggggccaaaacacggcggggctaatattaaagttatgaacatgatgaacgatatccgtcaaaatgtaaaggattattctgatgaagatgaaatagcctattacttgagaaaaatactagcaggggaagtactggatcacaaaggactgatctacggtatggggcacgctgtctatactttatccgatccaagagaaaaaatatttaagaaatatgttaaacagttggccaaggaaaagggaagagaaaacgatcttttactttacgaaaatattgaaaaattagcgccagagcttattaatgaaaaacgtaaagttaaaaaacctgtctgtgcaaatgttgacttctacagcggattcgtttttaacatgttaaacattccaattgaattgtacacaccgcttttcgctgtggcaagaatcgttggatggagtgcacatcgaatggaagagttgatctgtacagataaaatcattagaccagcgtacatgagcgtgatggaaaaacatgaaaattgagagaacagttcagagatgacaggtgggtaagcttgtcatctttttttcttgaaataaatctttatctcaacaaatatatatgatatattaatgaatacttaaatatttaagaagttttagagggggtagtttatgcaaaataagcattctcacagtagctttagtggacaacttggctttgtgatggctgctgcaggctcagctgttggcttgggaaacatctggcgatttccatatttagcggctaaggacggcggcggcgtttttttagttatttacttagttttagttctaacgtttggctttactttacttacaagtgatattgcggtcggcagatatacccaaaaaagcccaattgaagcttatgaagcgcttaaaccaggatggggctttttaggaaaaatcactttcttagttccagcaattattatgacctattacgctgttattggcggatgggtactcaaatatgtaatgacttattttattggagagggacaagctgcggcttccacaaattatttttcttcattcattacatcaccggtcgctccaattgtatatggtcttattttcatgatctttacttcgcttattgtgtatcgtggtgtacagaatggcgtcgaaaaattttcgaaagtgtgcatgccgattttgtttatcatgattttggccatttctattttttcacttacactgaagcatacagaaaatggcgtcactcggaccggtctgcagggattagctgtttatatgattccaaattttaagggaatgacatttggaaaatttctctcagttgccttagatgcgatgagtcagttatttttctcattatcagtttcgatgggaatcatggttacttacgggtcttatgtaaaaaaagatgtagacttaaaccattcgattaacatgatcgaggtttttgataccgttgtggcttttttagccgggttaatgatcattccttcgatttatgttttctctggaacagaaggaatggcttctgggccatcattgatttttgtctctttgccaaaggtattcaacgcaatggggccagtaggtaatgttttcggggctgcattttttattatggtgacttttgcagcgcttacttcttgtatttctgttcttgaaacattggttgcagactgcacgaagctttttaatgcacctagaaaaaagaccactctagtcttaacggttatttatagtgtggctacagtcataattacattgggatacacgatcttttactttgaattaaaattgcccaacggtacagtaggacaattattagatttagcagattatatcagtaatagtgtattaatgccaattacatctttattatcgtgcattttgattggttgggtcgtaaagcctaagctgatcattgatgaaatggaattgaacggagaaaattttaaaagaaaatctatttattctgtgatggtaaaatacattgcacctgtcattatggttatattgttcttgcaatcgacgggtttctggcagtggttagctaaattagtgcattaaaataaataagacgtcatacttttgaaaggtgccgatcaccttgcgtatgacgtcttttttgttatagtcctaatttaatttcaacattatatttatcttttaaatcttcggcttcattgacataagctctgttctgtttttgtcctaaaaggaaacgatgcagactatcatgagccgcttcaaaaggaatcttttctttgatttttttatcggttactttaatgatatgatagccaaattgtgatttgacaggttcggaagtcatttcacctggttccaaagcaaaagcagccacttcaaattcagcgaccatttgacctttgtggaaatagcctaaatctccgcctttttctctgtttgcctgatctaatgaataatctttagcggcttgttcgaatgttttgccgccatcattgatttctttaatgatatcaacagcttgctgtttagaaggaagcaggatgtgagaagctctgattgaatccggtgcaataaactgattgctgtgttcgttataatacgcttttaattcttcttcagttaccttcacattatccatgaaatgcgcaatcatataagatttcatgaacttttctttcatttcagcaaattctttttggtattgttccgtttcttcgacgtgttcatcttttccctttaagtagaacagttcttgcgcaatcatttcatttaacagctgacgctgcccttcacgtgttttgaattgagcctgttgatctgcaggagcctgcgcaataagaagatctaactgattctgagtaatttccttaccttctacaatcgcaaggactttatcttctaaagacataatatccctcctattaattaagatataaaagttatattaacggttatcattttaactgtcaataaaatttcatgacctctaagtttctatttttagaatcatttcaagtctttacatttatgtagaatagtgtataatatatataaatataaaaataagttgttgtcgaaaagagcacgtttttgtgttctttttttaggatatagaataaggaggttcctgtgaaagcaaaatatgagcgtgtgatgataaaacttagcggtgaagctctggcaggcgatcaggggtttggaattaatccatcaactgttaaagatatctgcacttcaattaaatctgtatatgatttaggtgttgaaatatcgattgttgttggcggtggaaatttttggcgaggccgccaaagtgatgaaatggacaaatcaacagcagattacatgggaatgctggcaactgttctgaatgcgctcgctctgcaggattcacttgaaggcatgggaattccggttcgagttcaaacagctattgaaatgcgagaaattgccgaaccttacattaagcgcaaagcagttcgccatcttgaaaaaaatcgcattgtcatttttgccgctggaacaggaaaccccttttttactacagatacaacagcagcactgcgagcagcagaaattgatgcaaatattattttgttggcaaagaatgtcgatgctgtgtacgattctgatcctaacattaatcccgatgcgaaaaaatattctcatttatcttatctagatgtcatcaatcgtggattaaaggtgatggattctactgcaatcaccttatgtatggataatcacattccaatcttagtttttggactaaacgatccaaagaatattttacgggctatttcaggcgaaaaaattggaacattaattaatggagataaaaatgagtagtgaagtcatgacggctgccgaacaaaagatgaacggcgccattgaaaatttaaatagtagtttgctgacattacgagccggacgagcgaatgcgcatattttagacaaggtaacagttgattattacggagcaaagacgcctgttaatcagattgctacaatagctgttccggaacctcgttcaattacaattcagccatacgatatcaatagcatcaaagatattgaaaaggctattttaaaggccgacttaggatttaatccatcaaacgatgggaaaataattcgattagttgtaccgcagctgaccgaagaacgaagaaaagaattggtcaaattaaccaaaaaatatggcgaagagtgcaaagtttcagttcgaaacgtaagaagaaaagctgatcaaaaaattaaagctcagcaaaaagataatgaaatcagcgaagacgaattgcacgatattcaagatgatattcaagatttgacaaataaaaaaataaaagaaattgatcaaatcttggacgaaaaagaaaaggaaattttggcagtttaaaaagaatatataatttatggcatgagagtggggcttcccactcttatgttttttgtgaaacaaaatgactaaacaagaaaaaatatatgaattgtttgaacccattgttactcaaatgggttatgaatgttacgatgttgaattaaacaaaaatggaaaaaataaagtcttaattgtttatattgatcatccagatggtataaaactagatgactgtgaaactgtcagccgtaaaatcagtcaatttttagatgaagtagatccaatacaggatgcgtatacattggaagtatcttctccaggaattgaaagaaaattaacaagagtcaaacactatcaggcggctgttgggaaaaaaatagatattaatttatttaagccaataaataaaaagaaaaaattgtgcgttttgctaaaagaagcgggcgatgatggaatcgttgttttagacgatcaacaagaaatccagtttcgctattcagatattgccaaggcgacaatccattttgattttaattaatatatattgtaggagtggaaaatgaacgcagaatttatggctgcattagatattattgaaaaagaaaagggtattaataaagaggaactgatacaggatattgaaagttcaattgagcaagcctataagaagaattatggaaatgaccaggactttgaagtgaattttgaccgcgatacgggcgaaatcaaaatttttgcgcgatggcttgttgtggacgatgatgcaccaatcggacaatctcattctgaaaaaagatttcacgatgcattgaaaattgacgattcctgtcaaattggagatgtgatcgagcaagaaatcgaaccaaaagattttggacgaattgctgctcaaaatgccaagcagatgatttatcaaaaaataaaggaacaggaacgtaaaaaaatctataatgaattcatcgaacatgaggatgaagtggttgtaggcaccgtcgatcatgttgaacgaaaaatgatttttgtgaatcttggtgatacgattggttttttacctcaaaatgaacagatccctggagaaaattatcatgcaggcgatagaattaaagtttatattttgtctgtgcgcaatcaaagcaagggaccggaaattattttatcgagaaaacatccgggattattaaaaagattgctggaagatgaagttcctgaaatttatgatggcattgttgaggttgaaagcattgcccgcgaggcgggagcaagatctaaaattgctgtaaaatcaaatgatccttcgattgatccagtaggtgcttgcgtaggccataaaggcagccgcatacaaaatatcattgatgaactgggaaatgaaaaaattgatgtgattaaatacagtgataatccgtatgaatatatcacaaatgcattgagcccggccaatgttaaggaagtattgattaatcaagaaacgaaacaggcctacgcaatagttgatgattttcaattctcactggccattggaaaagaaggacaaaacgttcgattggcggttcatctaaccggttggaaaatagatataaaaagtgattctgaatttgaaaaaatattatccgataatcctaatttcagagaagaatttagcaaaaaagacgaacatgttgaaaagcttgttgatgaaatcaaaaaagaaatggatgcactgttggataatacagccggatctggtcagcttgacttagaagatgataattattcgatggaattaaatagcgatgatgatcgtaccgaataaaaatgaaaaaaataccattaagaacttgtatagtatgtaaagaaaaaatgcctaaaaagcaattggggcggatcgttatcaattcagacggaaatttagaatatgatcgtacgggtaagaaaaacggcaggggggcatacatatgtatgaattctcaatgcctttccaaactgaatgcctcaattttatcgagaacatttaaacagcaaataacttctgaaaaaacagaagatttgaaaaatatattatataaggaaatgaaaaccatgtaaaaatagaaaaaaggaggagtttatatggcaaaattgcgagtctaccagttagcaagtcaatatgaaattcccagtagagaatttgttcaaattttaaatagatataatattccggttaaaaatcacatgagtgctttaaccgatcagcaggttgaagaatttaaagcgagctttgatccaactaaagaccgcagggcagaagaacaagtacctaaaaagaaaaagtcaaattcatcaaagtcaacttctaagaaagcttcacaaaagtctcagcaagaatcaaagccgacttctaaaaagaaagaaaaaaagccagataaagccgaaacagtaaataaaacacaggctgcaagtgagttgaaaacgcaggataaaaccgaacctaaaaagaaaaaaaataaaaaagcttcaaatcctcatgccgataataaatctggagatcaatccaatagaaatacgaataaccgtaacaagaagaaccgcaagaaaaaatctaaaaaatcaaatcgtgaggaaacgataaaagttaaagaccatagcaaaaagggaaaagtttctcattctgtctataaaaagaaaaaggacgaaaagaaatccgaacaggctaagaataaggtctatgaaattcctgaaagcttaactgttggcgaattagctgatattgttggtgctaatgcgacagatatcataaaaacattgatgatggcagggacaatggcaaccatcaatcaaacgattgacgcggatacggctcaacttgtctgtgatgaactcggttatgaagtgaaagtcatcaaagatgaagatgtttttgaaaaaatcatcgaagaatatgatgaaaaagaaactggaaatgaagtttcgagaccacctgtcgttacggtaatgggacatgttgaccacgggaaaacttctttattggaccggattagaaaatcacacgttactgcaagtgaagcgggtggcattacgcagcatattggggcttataccgtaaaaatcaaagggaaatctattacctttattgatacgccggggcacgcagcttttaccgcgatgcgctcccgcggtgctcagatgacagatatagctgttcttgttgttgcggccgatgatggcgttatgcctcagacgattgaagccattgatcatgcaaaggctgcaaacgtcccaattattgtcgcgattaataaaatagataaagaaggcgctaatccggaaagagtcaaacaagaacttgtcgatcaaggtgttgttgtagaagaatggggtggcgatgttatagccgttcctgtttctgcaaaaaaaggacaaaatatcgatgagctgctcgaagatatcttgcttgtagccgaaatggaagagcttaaagctgatccagatcgtccggcaagaggatgcgttattgaagctcagctgaaaaaaggaaaaggttcaactgcatcgatgctcgtccagcaggggacgctccatatcggcgatgcaattgtttctggaacaacctacgggcgtgtcagaacaatggtcgatgataaggggcatcgcattaaaaaggctggcccgtcgaagcccgtcgaaatttcaggtttgtctggtacgccggaagctggagacgattttattgttatgccttctgataaggaagcaagacagctggctgaaagacgccaagaacaagaaaagaatgaaaagcaggcgaagagtagtgtttcgcttgaagatcttttctccagaatcaaagaaggcgaaatgaaggacatcaacttgatcgtaaaagcggatgttcaaggttctgttgaagcgctgtcacagtccttagtcaaattaagtaatgacgaagtccgcgtcaatgtcattcacggtgctgtcggtgcagttaacgaatcagatgttttgctggcttcgacatccgacgcaatcattatcggatttaatgttcgaccagataaaaacgcattagaagcagccgatcatgaaaaagtggatattcgtttgtaccgtgtgatttacgacgcgattgacgatgttaaacaggctatggaagggatgctgactccggattatgttgaaaaggtaaccggtgaagcggaagtcagaagcacctttagaattcctggtggtattattgttgccggtgcttacgtgacagatggtaagatttcaagaacagacgaagtacgcgttgtaagagacggtattgtcgtgtacgaaggcaaaattggatctttacgcagatttaaagatgacgtcaaagaagttcagcagggctatgaatgcggtatcgggattgaaaaatacaacgatatcaaggaaggcgacatcatcgaaacatttgtcaatgaagctgtaaagcgtgaactgtaatttatggacatatgaaagaggtgtggcttaatggcttctcatcgtttagaaagaatcaacgcacaaatacaaagagaattaagtttgattatcagtcaaaaggcaaaagacagaagactgcataatacaacctttggtattacggatgtaaaagcaactcaggatttaaaagttgcaaaggtttatatttcggtcataggctctcaagaagaaaaagagggcatcatagatgcgctgaataacgcaaaaggttttctgcgcagttcattaggtcgtgtcttgaaaacacatacgacgccggaacttatttttaaaatcgatgaatctgttgaatatggtatccatattgaccaaatattatcagaattagaaaatgataagaaatgaaattaattaacgaaaaaatcacagactatattcaaaacaatcaaacctttttattgatgacgcatcaaaaaccagacggtgacgctattgggtcagttattgcactcggcagaggactgaagcagatcggtaaacaaattgactatttcatgcaggatccgattgaacagaatttaagtttttttgatgaaataaaatatttcaacaaaacagagaaccaatcctacgatgctgtgatagtggtcgactgttcgacatggacacacatttgtaaaccggctaaacttcccgaatacaaagcggtcatcaatatagaccatcacattacgaacgaaggctacggagatctcaatcatgtcgagaatgttgcagcggcttcagaactgatttatcgtttgcttaaacaaatgaatatacctctcgatgaagaaatggctgacgctttgtacacggggatatcgaccgatacgggctcgtttcaattttcaaatgtcacatcagcaacacatcaaattcttgctgagttatatcaatatccttatcgatatgctgacattgctagacgggttcaccatgaaaaatcattgatgcagatgaaaatgtgcggcgcggcaattgaaaacacaactctaattaacgatgcgacaatcgcttggacagttttggattacaagacgattcatcaatatggcggcgacatcaatatttccgatgacattgcaaacatcggaattaacattaaaggtgtcagtattggggtgactttaaaagaggttgaaaaggatatatacagagtttctctccgagcaagctcagaatgtgattttgatgtgtccagcatcgcaaaatgccacgatggcggtgggcataataaagcctcaggcttcaccttccaatctaacttggaagcattaaaacaggaaataaccagtaaatttaatgaaataaaagatggaagaaatcaataataaggaaaaaaatggcgtcttaatattaaataaacccatcgggatgacatctcatgatttggtcaatgttgttcgaaaattatttgatataaaaaaagtgggacatactggtactttagatcccgatgctcaaggggttatgattgtcgctttaggcagagccacaaagtttatccgttttttctcagatacaaataaaacgtatcatgcacaagttctttttggtaacgaaacggatacctacgatataagcggaaaaatcataacgagtaaggaaccagatttttctgtcacgtcgttaaaggatagtcttgtatcttttgtcgggaaaattatgcagcagccgccgatttattcggcattaaaaaaggacggcaaacattattacgagtacgcccgccaggggatacaaattgatattccaaggcgggaggttgaaatttttaatatccagcttttagatgcggaggtgccatttttagctgatatacgcgtcgaatgttcctctggaacctatatcagaagtttatgtcatgatatcggtttgtcacttaacacatacgcgtgcatgggaaaattggaacgaactgcggttggaaggtttgatattgagcaagcgcttgacatcaacgatttagtgaaaatgagtcttccccaaagaatggagctgttattgtcagttgacgatttcttgccgtcctatcgatcagtgcagagtaatgctcgaggagatcgttttattaagaacggaaataagctttttcaatggaatgcaattgattcttttgaaaattatcgagatagagagcctctcaaaatttatgacagtcaacgccattttattggaatgggcaggtacaatcaaatagaaaattttgtgtatccattgaaaatgttttaatagtattaatatgaaaaaaagaagagaaacaaataagtctgatcaaggaatggtcatggccttaggtttttttgatggtgttcataaagggcatcaagcgttgctaaaaaaagtaatagagatttcagaaaatgatcatttggaatcaggcgtcatgacttttgttaaacatcctctaactctgatttttccagcatatacgccggatttaattacaacaaatgatgaaaaagtaaaaattatccattctttaggcattcagcatgtttatttggatgattttaatgaaaaactaatgaatctctctagtgaaaattttattagagattatctattagtaaaatacaatattaagcatctcgtggttggatttaattatacttttggctataaaggtgctggtaatgtcgagacgttaaaaaaatatggcaagaaatatcattttggtgtttcggtggtttcaccgtgtattattgacggcgaaccagtcagcagtacgagaattcgcggcttaatagaagctggcaaggttgatgagattgaaccgcttttggggcggccttatcaaatcaaaggaaaaattgtaaagggaaagggactaggtcaccaattcgacgttcctactgcgaatttaaaattaaaatcaaaggtcatattacctagttctggcgtttattacacaaaagtaattttacatgatcatgtatacgatggattgactaatttaggagcaaacccaacatttaaacagcatccttacacgattgaaacgtttatatacgatttcgatgaaaatatatataatcaaaccatgtcacttacttttgtaaagaaaataagagatgaaattaaatttgacaatgtagatgaattaatggatcgtattaaatacgatattgattatattgataaaatatacaggaatcatccctcgagcttgcaaggtactaaataaaagaaggtcatgtcatgccacgttattctgaagaaattattcaagaggtcattgaagctaacgatatcgttagtgttatttcttcgtatgtacaattgaaaaaatcgggccgatcgtttatgggcagatgtcctttccacaacgaacgcacaccttctttttctgtttcaccagacaaacagctatatcattgttttggatgcggcgctggtggaaacgtcatttcatttattatggatattgaaaatatgagttttccggaagccttggaatggttagcggaacgggctaatatcacgctgcctcaaaaaacagaatatacggattatcagtatcaacaaaagaaaaaattttacgaaatcaaccgtcagcttgcaaattattattacgtgttattaaagcactcttccaaaggacaaaaatatatccaggaaagaggcttagatcagtcgacaattaaaacattcgggattggttattcaaaagattcctgggataatgcgattcggtttttatcgagcaatcacgtttcttctaaagaaatgctacaaattggtttagcgattcaaggaaaaaatggcaaattatatgatcgttttcgtgatcgtttgatgattcctattcaaaacagtcgggataaaatcattggcttcggcggacgtgtcatcgataaaaaagaaaatacaccaaagtatttaaattctccagaatcgacaattttttcaaagggaactgaactttttaacttgaaccgagctaaaaaaaatattcaaaataatcagtttattgttgtcgaagggtatatggatgtgatcgcattatatcaatatggaataaaaaatgtcgtggctgcgttaggcacagcctttacaccaaaccatgcgaaaatattagaccgatacgtgtcatctgttgttttatgctttgatggagaccaagctggagaaaaggcgacgaaacgcgccattgatatattgaaaaaatcagatttgacaattaaagttttgcgattaaatatcgaagacgatccagattcatttatccggaaaaatgggaccgatgcttttttagataaagtcaatcatgcaaaaacagctacagattatttattagatgatttaaaaataaataaccctctaaatacaaacgaggaaagaattaattatgttaacggagcgattcctattctccaggatacaaaaagtgacgtagaaaaagaggtttatgcaaaagttgtttcaaaaagaactggaatctctgctaaaatgatatttaacgaggcaaaaaaaagtaaaagtgaaaataataagattaatttaactgccttgtctcaaaaacaatcctcttctgataaagtgcctaaggtgcttcagcaagcggagaaaaatgtcatcctcggactgttgaataaagagattaatattgagaattgcagactcgatacattgtgctttacagatccattcaataaaaaaatttacaatctcattgaaaataatcacgacataaatgcatcaacaatcatgtcttttcttgagacagacgaaaaaaaacagctttcggaaatgcttataaaaaacgagcagggaaatagtgatttattgaatatgtacgaagagagcataaaaatactgcaaagagaaggacaaaataaaaaaattgctcaactggaaaaaaaattaaaagacgatcctttcaattctgatgtcgtaaatattatggagcaaataaaaacgttaaaggcagaatcaaatataggaggacaaaatggcgaaaactaaatctgacgaattgacgaaaaacagtgttttaagtcaattaagtcaaaatgaaaaggaaattgaagatattactcctgaactaaagaaattgccggaagttaaagaacttgtcaaaaaagggaaaaagaagggatatctagataatgaagacattgataatgccttagataaaaaagatctagatccagaagaaatagattctatctatttatatctccaaaaagaaggaatcaatttggttttcggggatgatgtcgatgatttatccgaaatggacgattcaagcattgctgaattaaatgagattgaaaaaaacgagaagaaaaaagacgccgaactgtcagacaatatcaatgttaatgatcctgtcagactttacttaaaagaaattgggcgtgttccattgttgactccggaacaagaaatggaaattgcaaaacgcatggatgagggcgacgaagaagcgaaaaaagaattggcagaagccaatttacgactggttgtcagcattgccaaacgctatgtgggtagagggatgtctttccttgatttgattcaagaagggaatctcggcttaattaaagctgttgaaaaatttgattataaaaaaggattcaaattttctacctatgcgacatggtggattcgccaagccattactcgtgccatagcagatcaagctcgaaccattagaattccagttcatatggtcgaaacaatcaataaactcattcgcgtttcaagacaattactgcaagaatatggcagagaacctacgcctgcagaaatcggcaaagaaatgggcttttctgaagaaaaagtgcgtgaaattcaaaaaatcgcacaagatcctgtttcgttagaaacaccaattggtgaggaagaagacagccatcttggtgatttcattccggatgatgaagcaccggctccttcagaggcggcttcttatgcattgttgaaagagcagctgatggacgtgcttagcacattgacggaccgagaagaaaaagtgctgcgtctccgttttggtctagatgatggcagagcgagaactttggaagaagttggaaaagaatttgacgtgacccgtgaacgaatccgtcaaatagaagctaaagcattgcgtaaacttcgtcatcccagccgcagtaaaaaattaaaagattatttgacctgatgattgcaaaaaggctagaagtcatttctgaattagttgcgcatagccggtgcactgcggatattggaactgatcatggcattgttcccttgaaattaattgattctcatcgggcggacaaggtgattgccactgatgtctccgccccatctttaaataaaacccaaaaaaaggtagcaatcaatcatttgggttccaaaataataactcggttgggtaatggtttggatccaataaataaaaatgaatgtgatacaattattattgctggaatgggtgggctattaatcaaggatatccttaaccgcggtgtgaataaaataaaaaacgcaacattaattttgcagccaatgaataatgcacattttgtgcgaatgtttctcgagttcagtgattacaagattacaaaagaaatgattgtatttgaaaacaatcattattatcagatcatcgttgctgaaccagggaacatgaaaattgatgacccaattgattattgggtaggctgcaaaagtgcaagaaaatctgatgctgtatttgaaaatttcataaaatctttaatatcaaaacagaaagagatcatccattatacaaaaaatcagcctacagctaatgcacgtcgtaaaatcattcagacaaagaatataatctgtatgttagaggagacactcaaataatttgaatattttcaaattgggggctaaaattatgaaggcacaagaaatatataaggttattgaacagattgctccattatatttggctgaagattgggataattccggacttcaaattggctcttataatcgagatatcaataaagttcttttgactttggatgtcacaaaagaagtgattcaggaagcagtagaaaaagatgtgcagttaattgtatcgcaccatccatttatctttaacggcattaaatcgctatgtatagataatggcaaaggagagcttgtcgcacaattaattaaaaataatatctctgtatattcagcacatactaatcttgattctgcaaaactaggattgaatcattatattgccaatcaattagggattaaagagactgagccacttgtacaatctgatcaagatcagttatttaaacttgttatcttcacacctcaaaatttttctcaaaaaattttagacgtacttggagaaaatggcgcaggtttattgggaaaatacagtcattcatcttttagagccgcaggcaaatcgacgtttaaaccacttgaaggttcaaagccatatattggaagaacaaataaagttgagactgttattgaagatcgtatagaaaccattattgatcgacacttagctaaaaagattttacctattttaaaagagatccatccttacgaagaaatggcttatgatttgtatcctttagattcttccatttcaaaaaatgaaaatggcttagggagaattggttttttgaataagtcgatgtcttctcatgaatttattgatttaataaaaaagagcttaggcgtaaattttattcgtacggctggaccaatccctgaaaaaataaagaaagttgctttatgtacaggggcaggcgctgaatttctaagtattgctaaattcaaagcagcagatgcttatatcacaggtgatttaaaatatcacgaagcgcaaaatgccaaagaaaatagtttatgggtcattgatgccggacattttggaacagaaaaaaatgttgtgtatctgttgaaagatcacttaaaatcgaattgtccatcaattgaaaccatcatatcagaaaatattaaaagttattttgaaatttactaagctaatatatagatggattcatttcataaaagcaaggaggactttatgaaaaaattgtttacaggaaatgaagcagctgcgcgaggcgcttgggaagcaggcgtaaaatttgcagcagcttatccggggactccaagtacggagattctggaaaatttagcattgtacgatgaagttcaaacggaatgggcaccaaatgaaaaggttgcagttgaatcagtggctggtgcttcgatcgcaggtgttcggagtttagcgtgtatgaagcacgttggtctcaatgtggccgcagacccgatgtttacctttgcttatttgggcgttaacggcggttccgttatactgacggccgatgaaccaggaatgttttcttcccaaaacgaacaagataatcgtcattacgcaagagctgctaaaatgccgatgtttgaaccatcagattcacaagaaacaaaagacatgatgatcaatgcctttgatctttcagaagaatatgatgttccagttttatttagaatgacaacgcgagtcgatcattcaaaaagtattgtgaattgtgaagatcgcaaagatatcccagataaaccatatgaaaaaaatatccctaagtattgcccaatgcctgcttttactggggatatgcagaaaaaattgtatgcaaatttagaaaaagtcaaggatttttcaaatcattgcaagtggaactatattgaagataaccataagtcgttggggatcattgcgtctggcgttgcgttccgctatgcaaaggaagtttttggcgacgaagcttcttatttgaaaattggcttttcacatccattgccgatggaattaataaaagaattcgcatccaaagttgaaaccatttatgttttagaagaaaatgatccgattatggaaacggaaataaaagctgctggtattccgtgtattggcaaagatatgtttccacaaagaggggagttattgcctgaacgtattagactagctgcctttggaaaaactcaggaaacaattaaaccaaatccggaagcagttgttggacggccaccagcactttgcgcgggttgtccacatcgtggattcttctatgagttgagtaaacttaaaaacactatgatttttagcgatattggctgttataccttaggggcattggcgccatataacgctacagatgcctgcatttgtatgggcgcttcaatttcaggcggacatggtgtggcgcaggctttaaaattaaaaaacgaagacatgaatgtcgtatctgtaattggcgattcgactttcttccattccggcatcacatcattacttgacgcttcttacaacaaaagttcgtatttaacagttattctcgataatagaattacagggatgaccggtcatcagcaaaacccaggaagcggttatgatttaaagggaaataaagcaccgatttctgatattgaaaagatctgtcgtgcaatgaacattaccaatatccggacagttaatccaaacaatttacaggaaatgaaagatgcattagattggggaattcattgtgacggaccagctgtcattattacaagatggccctgtgcattaaagaaactctctgaagaagacaagcaagaatttcctaaggtctttactcagaaatatcatgttgatatggataaatgtatcggttgtaaaaaatgtatcgggacaggctgcccttcattagaattcggtcgtgttcaggacaaaaaaatgaacatcactgaaagctgtgtgggttgtggcgtttgtagtcaggtttgcccggttgatgcgattattaaaggataatgtaatatggaaacaaaaaatatattgttagttggcgtaggcgggcaaggcactattacagccgcaaaattgttgacaactgggcttatggcatcgggatacgatgtcaagatgagtgaaatacatgggatgagtcaaagaggtggttctgttagctctcaagtacgttatggctctgaagtacagtcgccggttattgaagctggaacagctgatatcattgtggcttttgaaaaaatggaagccatgcgctatatcaattatttaaaaccaaatggaaaagttatcgttaacgataaagaaatctggccaatgcccgttattattggaaaagcaaaatatcattcggatattataggcgaattaaaaaaattagcggacgttactgtaattaatgcttctcagctggccgaagaacttggcaatgaaaaagtaacgaatgtcattttattaggcgcaattgtcaaagcaatgggattggatcacattgattgggatcagatcattgcagacaatgtcaagaaaaaatttgttgaattaaatcaaatcgctattaaaaaaggaatggatttggtttagtgaataaagaaaacggccaaaactatcgattttttcaacataaggattgtgaatttttcccttgtcatcaagtggagcatgatcaaatttccaattttaattgtttattttgttattgtccactttacgccttaggaaagagatgtggcggcaatttttacatatctgaaaaggggattaaggtatgtacaaattgtacattcccacataaaagggaaaattacgatcaagtgatgaataaattaaaagtatttatccaggaattaagtgaaaaaaatctaaagtaattcaatcataatgggagagaagctatgaatgtgatgtggggaatattactacttatcggatgctatttcattggaaatttagattttgcttacattgttgtaaaaatagtaaaacatgatgatatacgtaactacggcagtggaaatgcagggacaacaaacgtcctgcgaacgatgggattaaaatacgcagcattggttcttttacttgatgcacttaaagggactctatgtattgctattgccaagtatctcaatctaaaaataggacttgatccaatgtggattgctggagctggaattgccgtattatgtggacataactggccagcgcttctgaaatttagaggaggcaaaggcacagcaacctctatcgggttattcttgttatatgattggagaatcgcagtaatttgtattggcattgctttaatcattttagcaatttttaaaatggtttctttagcttcaattacaggcatgacaattttaccatttgttacattggcgttttggggacttactaatccgccagcattaattttgactatttttatggctgtgtctacggacgttcagcaccgcagcaatattaaaagaattattgcgggcacagaaagcaaagttggtcaacatgttgaaatgaagaattcagaaaaataatgtgtagaatccaaaatatgatatttgtcatattttggatttttaaatattatatatataaaaaataatggaacaaattgaacacaatatagatcctttttttgatttgaattcccaaatattaatattaggttcttttccttctccaaaatcaagaaaaactggtttttattatggtcatccacgaaatagattttggaaaactttatgcggggcatttaacgataaaattgtacctaatagtatttttgaaaagaaacaatatttaaaaacgcgaaaaattgcactgtgggatgtggtggccagctgccaaattcatggtgcatcagattcttcgataaaaaatgtttattataatgatttgcattatataataaatacagcgcccattcaattaattgttacgacggggaaaaaagcagattctctttttcgaaaacgatggtcaaaagacccagtgattaataaaatctcatatttgaatctcccttccactagtccggcaaatgcttcaatgaatttagcgcaattaataaaaaattatcatcaaataatagatgtattaagacgaaaggataaggaataacatgaaaatttcttgtgaacgatgcgggagagaaattggtttcttttcaagagcgcatgaattaaaaaatgtaaatctaaatattgaatatagtaatttatgctcaaaatgtaattccttattaacaaatgcgatatcaaagattgatgcaatggcacaatccattcgtaaagctctgcttaacgattataaattttcaaatctcgtttctgttgatttggataccatcatttttttatcaattgatgccgtattaagaattaatccgagtttctctgatcctagtgatgcgctttaccaagttttcattggtgagaattcagaaaatatatattctgaaaaagaattgctatctaaaatgattaaaaaaattttagattatggattttccgctaatttagaaaacgccgaattattgagttatagcaaatattttagtaataccgtattgtcaattaagcaaatacaagctaattgtagtcaaaatgttccccagacctggatagatctgtttttaaccaaaagaggcgtcgtgcttcggcaaacagaaggcggacaaattaccagagttaatttcccgtttaatgaagaaattaaatattctttaaaaaagcaagatggtttgcaatctatccaattttcaaatgttaaatatccagaatcgttattcaaggatcgaaatgtagttttatacagtaatgacgataatcaattgcagcaaatcaaaaaattagttgactattttaatgaacaattaaaagaaaaagaagatcaaaaacgcagattaattttgaaccagataggtgaacaggtcagaaatgatctgagaaaaatattttcagacacacctatctcaacattgcacgtggatagcgttttgttgatcataatgaaaaatatcaaacgaaggaaagaaatacctgttctagatatctataatccttacggtgttatcgtcgatttattgattcgagattatttaactaattttttgactttagggattagaactagggacgaaattgttgaatatattcaagaccattgtttgtacactgaagaatgtaatataaaattacctgcattaaaatctgatcatatgtggggattctttacctctaggggatatattctctttcttaaaaagacaaaaaaatatttgtttgtttttgaaaaaaattatccaaatgatatttattaccctttaaacaatttgctttaccagggaattagatatattcaaattccggataagtatcaccatttatctaacaaaaacgaacaaaatggcgtaattttatacagcaaaaaaattgaaatcgtagacgaaatgaatcgtttctttacaaaaaataattgtgattttcaaatggacttttacatggaaaaaagaaacgaaatttttacagaccgcgatcaaatattagaattaaaacgtgcgtgtgataagttgtttgctgttttcggatacattccgttttgcatgtacgatgaatggttcacaatttatcaagaaataataaaagatagtccattccttgaaagattattttctgatcaatcctcgaccgtcaatcaatataatcatcatacaatttatacaaagcgaattacacatgcttttgataaaggtgcaaccgatctgatgaagactttaaagattgatgatattgatattgcgaaaggattaatgttggaatatttgaatcagtcattaattgatcttttatcacaagagtgggttcgaattaatggcgatgaaattaatgccaacacatcgttagaacaagcttttgattattatcttaatctgaaaaaaattgaacctcaaaaagcatattattttggattatttgtttattatttaatgaacaaaggtgttttatcaaaaaaatacaatttttttgaaaattatcaacgttctatggctgtatttttacgctgtcagcaaaatttagagtatgataccggcattgaaattccatcagaaatgctggaaagtgattctgaaactgaagtgaatgagacgacaaaggaataaattataaaaaatgaatcaagatatcaccaaaggattaaacgcacaacaaaaggaagcggttctgtcaacagaaggaccattacttattttggctggagctggatctggaaaaacgcgaacaatcattcatagaattgcttacataatccaaaataatttagcatatccttcacagattttagcgattacttttaccaataaagctgcagaggaaatgagaaacagaattgcggcgatggacattgaaggttctcggtatatatggatgtatacttttcatgctatgtgttcaaggatcctccgaacatacgcagaattacttggatatcagaaaaattttgttatttatgatacagacgatcaaaaacaattatataaacaaatcattaaaacattaaatttttctgataaattgttttcttttggcagtgtgattaacgaaatttcattggctaaagagaaaacgatcttacctaagcaatatgaaaaggaagctgcaggtgatttccgaagagaaaaaatcgctcaattctacaaggtttatcaagaagaactcaaaaaaaataatgcgatggactttgacgatttaattctcaatacgattattttatttaaaaccaatccccaggttttaaaaaattaccagcacaagtttaaatatattttggttgacgagtatcaggataccaatcacaatcagtatgaattagtcaatttactatcagcggaaagtaaaaatatttgtgtgtgtggtgatgacgaccagagtatttatggatggagaggggcagatattcataatattctagattttgaaaaggattatccaaacgcaaaggttattaaattagaagaaaattatcgctcaacaccttctatattaaatatagccaatcatattatttcgaacaataaagagagaaaagaaaagaagttgtggacaaataatcccgacgatccacataaaatagtgttacgttctttcgattcgggaaatgaagaagcagaatacattgcaaatgaaattcataatttaagagaagaagaccattataaatttaacgatattgcgattttatatcgaacgaatgcacagtcgcgtttattcgaagaaacttttatgcggcgaaatattccataccagctaataggcggaacaaatttctacgcgagaaaagaaattaaagacattatttcatatctacatgtgttgtacaatccacaagacgatttagatacgcttagaataattaatgagccaaaacgaggaatcggcaatacgacggttcaaaaaataagagattatgctgattttaaaggttatagtattttagaatcagcttttcattgtgatgaaaatcctgagttatcgatgtcagcaagaacaaaaattaagcaatttacagatattatttctaacttacttgaattatcaaatactgttggcgtggcagacttattagaagaaacggttaatcaaacgggctatttagagatgttaaaaacaggaaatgttcaaaatgcagaatctcgaattgaaaatctgcaggaattaatttctagtgcagtggaatttgaaaagaactctgacgatcaatccctgcaagcttaccttgaaaccatttcattgacgaatgaaacagataaatatgacgatcaagacggaaagatacttcttatgacgctgcataacgcgaaaggcctcgaatttccagtcgtttttatgcctggaatggaagacggcatcttcccacatattcgttcctttgatgatgaaacacaaatggaggaagaaagaagaatttgttatgttggtgtaactcgggcacaaaaaaggttatttttgacttatgcaaattctaggacaatttacggaagaacgcagccggaattaccatcccgttttcttgaagaactaccaaaagaaaatattgattttcaagaaacaggttatgcgagtcgaaataagcttatacgagatagcggtgcatcttcaagatataaacaccgcgcatttaataaaagcctccattatgcaaaaacaaaacagcatgatgcatttgtaactaagtctgaaaataattttcatttagcagatcgtgtgaaacatgaaaaatttggtattggaacaattattgatattcaaaaaaatcaaatatcagttgcttttccaggcgtgggaataaaaaaacttgcaccatcatatgtgcaattagtaaatgagtaaaatatggattcaatttcatcgaataaaaagattttaatcgattctcttgtcaaaaaattaaatgatgcttctgacgcctattataacggcaaagaagagttaatgtctaattatgaatgggacaaactatttgatcaattaagtgatctagagaagcaaacaggctacgtattaagcaacagtccgactcaaactgtaggaactgttcaaaataatgatggtgataaagtagcccatgaatatccggcattatcactggcaaaaacaaaagacattaatgatatgatcgattgggctggtgaaagagatgtttggttatcctggaaactagacggtctcactttggtagcaacttatgataatggaaatctctcatctttagtcacacggggaaatgggataatcggaacaaatattacatcacttgcctcagcgattcagggcattccactatcgattcatttgaaaactcacttggtcattaggggtgaggccattatcacatactctgattttgaaaatttttgcctttcatctgacaatgattatgctaacccaagaaatcttgcatcgggatcattgagtttaaaagacattaacgaagtgaaaaaacgtaatattcaatggattccctttactttggtgcatacggatgaattaattgtctcttggggtgaaagaatggaattattaaaaaatttaggttttcatccggttgaagcagaaaaattgcatcccaaagagatcgaagacgccatcacacgttggagtaaaagggttgcgagcaatcaattagattatcccgtggacggtttggttatggtttttgatgacactgaatatgcaaggcgaggtggcgcgacgggccatcatgaaaaacgcgccggactcgcgtataaatggcaggacacgtcaaaaacaacgaggctcgagaaagtcgagtggtcttgtgcggcgtcgaccattacacctgttgctatatttgatcctgttgaacttgaagggactactgttaaaagagcgacgcttcacaatatcagcgaatgcaggcgattgggaattggcggacgtggaacagagattacagtcataaaggcgaataaaatcatccctaaaattattgctgctaagtcagttggggagttttctattccaaatgagtgcccagtctgccaccatgaaacaaaaatagaaatatcatcttctggcgcggaaacacttcattgtactaatcgcgattgcgctgccaagcatcttaaaaaatatgaacgttttgttagtaaatatggcatggatattaatggattgtcgcttcagactttaaataaatttatgaatcaaggatatattaaaaatttttctgatatttatttattaaaacagtatgaagatcaaataaaaaggttagacggttttggagaaaaatcagtggataacctatttcaggccatcgaaaacagtagacaggttaaagcagaaaatctgctttttgcattaggcattcctatgattggtgttgacgcagcaagaaaaatcatccaagctattggctttgaacaatttctctatttttctaaaaacaaaatagatttttcaagtatagatggcattggagaaaaaatgtctgcttctattattgagtggtacgagaacaattcagatgatttaaatttattgcttcaacaattaaccgtacaagataatcaagtgaatacaagttcacagaagatgtgtaatcaattgacattcgttattacaggctctctcaatcattacaaaaatagagatgcgttaaaaagttatattttaagtcaaaatggtcatgtgactggaagtgtttctaggaaaacagattatttaattaataacgatatcaacagtaagagtgggaaaaacaaaaaagcaaaagagctgaatattccaattattacagaagatgattttattcggcaatttacaaacgagggttaatagctcaacatatcaatattaaccctttgttgaaaatatagtttcttttatttataatgtattatatttaaatattgattaggagttatgatgagtatttcaaacgaagaagtaacctatgtttcaaaactagcgagacttcgtttcaacgaagaagaaacaaaaaaaatggccaaagaattaggatcggtattagattatgttgcgactttgaatgaagtagatacgtctgatattgaaccaacagaacatattctccaagtaagtaatgtatttcgagatgatgtggttggcacaccgctaagcaaccaagttgcactggcaaatgcaccagatcaggaaaatgggtgctttaaagtgccacgtgtattagattaaggagatatgatgaatattaatagacttacaatacatgaaacaaaggaagcattatctaaaggagaattttcttctgaagaattagttacttcatatgcggaccgtattgaaaatgtcgatccgaaagtcgatgcttttttactaaaatgcttagacgatgcaaaaaatcaagcaaaaaaaattgatagtgatggaaaaactaattcgagcattttatctggcattccgtatgcattaaaagataatatttgcacaaaagatataaaaacaacggcagcgtcaaaaatgctgtacaatttcatcccgccgtacagtgccgatgtgtatgaacgcttgcagagtttagacagtatcatgctgggaaaagtcaatatggatgaattcgcgatgggatcatccacagaaaactcagctttcaagacgacaaaaaatccttgggatctttctacggttccgggtggttcttcaggtggttccgcagttgcagttgcatcagatatggcagcttatgcactgggcagtgatacaggcggatctatacgtcagcctgcatctttgtgcggtgtcgttgggcttaaaccaacttatgggttagtttcgcgatatggcttaattgcatttgcttcctctctggatcagattgggacttttactaaggatgtagaagatgcagctatcgtgctcaatgcaatttctggtcatgatgcaaaagactcgacttctttaaatttgccgaaaaaagattatacggttaatttaaagaaaggagcaaagggactaaagattggcattctgaaaaactataaaacagaaggcgttcaagaagatgtccaaactgctatggacgagtcaattgcagcttttaaagatgctggagccgaaatagttgaagtggattttaggtatttcaaacaggcattggctgcttactacattattgcatgtgctgaagccagttcaaatcttgcgagatatgatggtgttcgttatgggtacagagcaaaagaatatacagattatatcgatatgtactataaaacgagatcagaaggctttggttcagaagttaaacggagaatcatgcttggaacttatgcgttaagttcagggtattatgatgcgtattataaaaaaggcatgcaggttcgaacggttattattaatgaatacaataaaattttcgaacagtgtgatgttctcatgacgccaacttctgcaacgactgcatttaaaatcggagaaaaggttgacgatccattacaaatgtatatgtcagatacttttactgttccaattaacatcgcaggtattccggcggtttcaattccaacgaaacttgatcgaagtggtctgccaattggcatacaaatagtaggtccagcattgggagaagaacaaattcttcaagctgcttgggcattagaacaatccttcgattttagaaaaaatcagccgaacctataagaggagaaacatagatggaatacgaaattgtcgtcggtatggaaatccacgccgaacttttaactaaaacaaaaattttctgttcttgccccaccaaatttggcgatccagaaaatacacatacctgtcctgtttgtttaggaatgccaggtgtcttgccggtattaaataaagacgttgtccgttatgctgtaagagctggattggcgctcaattgtaaaattgctaattttagcaaaatggatagaaaaaattatttttatccagatcttcctaaggcttatcaaacttctcaatttgatcgtcctttatgtttaggcggaacagttgacattaacgtaaatggccaaacaaaaccaattggtattacgcgcattcatattgaagaagatgcgggtaaactgcttcacgaatcgacagatgggacgttagtggatgtaaatcgttgtggtgtgccattgatagaaatcgtttcggaacctgatatcagaggaccagaagaagcgagaatatttgctgaaaaggtcagaaatactttggaatatacaggagtttctgactgcaaaatggaagaaggttcaattcgatttgacgtcaatgtttcagtacgagaaaaaggtgctgaaaaattaggaactcgtactgaaatgaagaatctaaattcttttagagcattggaaagagctattaagtacgaaagtaagcgccaaattatcgaattaaaaaaaggtcatccgattattcaagaaacaagaaaatgggacgatgtcaagggcgtcagttcagcaatgcgttccaaggaagacgcacaagattatcgctatttccccgaaccagatttggttccgattaccattactgatgaagaaatagaaaaggcaaaatctgaattgcctgaactgccggaagcaaaaaaagcaagatatatggcagaatacgatttgccagaatacgatgcggatttgatcacttcttctaaagaaatggcccaattctttgaagacactgttaaaatttccaatcatccaaaacagattgcaaattggttaatggttgacattcctgctcacttaaaggaaagggaattatcgatgtcgactattccgtttacgccaagcgaccttgctgaattgattgatttaatccaaaatggaacgatatcaggaaagatcgccaaatctgtaatggaaaaaatgtttacagaagatggttcaccgaaagaaattgtcgaaagaaataattgggcacaaatgcaggatgaaggagagcttcaggcaattattgaaaaaattgtagaagataatccgaaatctgtttctgatattgcttcaggaaataaaaaggcatacggctttttgaccgggcaggttatgaaagcaacaaagggaaaagcaaatccacagttagctaacaaaattattagagaagttgtagcgaaaaagttaaataaataataaaatgaatcagacatttattagaacagacggtcgttcctgtgatcagggacgacctgttcaaattattagacattttacgaagtatgctcagggttctgtcttaattaaaactggagaaacaacggttttatgctcggcaatgatcgatgaaaccgtaccttcatttatgcgtggagaagaacgaggctgggttaccgcagaatacaatatgctgcccagttcaacaaaaaccagaaaaaaaagagacagaaacggaaaaacagacagccgttctgtcgaaattcagcgattaatcggaagaagtttacgttctattatagatttaaacaagcttggtgaacggacaattaagattgattgtgatgtgttacaagctgatgggggaacgcggactgcctcgattactggagcctttgtcgcgctgtacgatgcagtacagtggctgctggatagaaagatcattgaggaaaatccgattaattcttttgttgcatccatttctgttggaatatttaaagacatgccaattctcgatctctgttatgaagaagattcacaggcgattgttgacatgaatgtcgtcatgaatgataaaggtgaatttatcgaaattcagggaactggagagcagcggccattttcacataaagaattagaagcattattatctcttgcaaaagaaggaatagaatttcttatatctgagcaaaaaaatgcgttaggaattaaataatgagtaataataagataattgttgcgacaggcaataaagataaagtaaaagaaataaaagatgaaattggctcttcttttgaaatgttgacgatgaaagaagccgggattgacgtagatatcgttgaagacggaaaaacctttgaagaaaatgcactcataaaagttcgaacaattaagccctacattaaggataaagatcacacaatattaatggcagatgactcaggactatgtgtcgatgtgttaaatggcgcaccaggtattttttcagctagatacgctgggccgaatgctacctatctagataacaatcaaaaattattagatgctatgaaaaatgttccgccatctaaacgagatgcagaattcgtctgcagcattgcacttatttttcctgatggtgaagaatggacgtgcagaggcgttgtgcatggaaaaattgcaatggacataactggacatgacggtttcggatatgatccgttatttattgaaaaccaatcgggacttacatacgctcaaatgagcctagaagaaaaaaataaaatttcacaccgctcaattgctgttgcaaaagcttgtgaaaaaattaaatcaaaaataaacgcataagttcgggagagatagcttggttaaaataggggtaatttctgatagccacggcaatttaacaaatttacaggatgccgttggtgagctcaatcagttaggtgtcgatgcaatctttcatttaggagattatgtacgagattcaaagaaaatccacgtgtggtttaatcggacgatttattcaattaagggaaactgtgatcagggcagtcttgacggtttaaattacgccaaaatttcttttgaaaataaaattgtttatgcgacacatggacacttatttaatgtaaaaagtgatttggatgcattatactatgaaggatctcaaaaaaaagccgacgttatattatttgggcacacacatcgtcgattattaaagaaaaaaaatggtattttgttaatgaatcctggctctcttatgggcggccggtatagtgaggatccttcatatggcgtcattacgattgataataatgatgtgtctggagaactttttaaattaaattgataaattgatatttttagatattataaagcaaattaacgctaaggataattttttgttatcatatatcattcgatatatacgctttgtaggggagatatatcaaaaaaatatctttaaattaaactgtatattttttgctattatgatataattatttgtagtaaagatgctttaaaaagtgtttttaatgtttattaattaattttcaaagaggaggaaaatatgtccaaaaaaatgatgacgatggatggtaacgaagctgcggcacacgttgcttacgcttttaccgaagtcgctgggattttcccaatcacaccgtcttcaccaatggcagaacatgttgatgcatgggctgcagctggcagaaagaacatttttggtgaaaccgttaaggtctcagaaatggaatctgaaggcggcgcagctggtactgttcacggttctcttcaagctggagctttgacgactaccttcactgcttcacaaggtctgctcttgatgattccaaacatgtataagattgctggtgaattactgccaggggttttccatgtttctgctcgtacattagcagcacattcattatgtatctttggtgatcaaggagacgtaatggcttgccgtcagactggttttgcacttttagcttcaggatcagttcaggaagttatggatatcggtggcgttgcacacttagctgcaattaaatcgagaattcctttcttacatttctttgatgggttcagaacttcacacgaaattcaaaaagttgaagttatggattacgatgtcttcaaagatttagtagattgggatgctgttcaggaattccgtaacagagcattaaatccagaacatccagttactcgcggtactgctcaaaatggagatgttttcttccaagcaaaagaagctgctaacaaattctacgatgcagttcctgaaattgttgaagattacttacaaaaaatctccaaggtaaccggtcgtgaatatcacttgtttaattattatggtgatcctaatgcagaacatgttattgttgcaatgggttcaatcacagatacaattgaagaaaccatcgattacttggcagcaaagggcgaaaaagttggtgttgtaaaagttcacctttacagacctttcgcaaaagattacttaatgaaagctattccgaaaacagctaagattattactgttttggatagaacaaaagaacctggcgcactgggcaatccgctttatcaagatgtctgcacagcattctatggcgaagaaaatgcgcctaagattcttggcggcatttatggtttaggttcaaaagatacaacttcaagcgatatcaaggctgtatttgataatatgaacgaagctgaaccgaaagatcagttcacacttgcaattaatgatgatttgacccatcgtaatctggaagttaaagaagaaatcaatacaattccggaaggcacaacaagttgtaaattctggggtcttggttctgacggtacagtcggcgctaataaatctgcaatcaagattatcggtgacaatactgatctttatgctcaaggctacttcgattatgactcgaagaagtctggtgggattacatgttcacacttaagattcggcaaaaagccaatcaaatcaccttatttaattaatcaggcagatttcatttcttgctcaacagaatcttatgtccatcagtatgacttgctgaaaggactgaaaaaaggcggcgttttcctgctgaacactgtttggacacctgaagaaatcaacgaagaattcccggcttctatgaaacgttatatcgcacagaacgatattcagttctatacaattaacgcaacaaaagctgcagaagacattggtttaggccgtcgtacaaacatgattatgcaggctgctttcttcaaattagctgatattattcctattgaagatgcggttaaatattctaaggcttcaatcaagaagacatatggccataaaggcgacaagattgttcagatgaactatcaggctgttgatgcaggggttgacccggatatcttgaagaaattcgatgtcccagcagattgggcaaacgctcaggatgaacctgctaaacctgatactgatcctaaatttgttcacgacattgtcagaccaattggccgcttcgaaggcgatacgattccagtatccgcgtttgaaggatatgaagatggtacatggatggctggcacttccgcatatgaaaaacgtggtattgccgttaatgtgccgaaatgggatatctcaaaatgtatccagtgtaaccagtgtgcatttgtttgcccacacgctgcaattcgcccggttctcgtaacggaagacgaaaaagcaaaggcaccagctggctttgaaacaaagaaagctatcggcaaacaattatctgatcttgaattcagaattcaggttgatgtcatggattgtaccggttgcggaaactgtgttgatgcatgtatcgcaaaagaaaaagcattaactatggttccaatccatgaagaaatggatcaggttgaaaactgggattatgctgtaactgttcctgtcaaagatgacagaatggacaaatactccgttaaaggcagccagttctgccagccattgctcgaattctctggcgcatgtgcaggatgtggtgaaacaccatatatcaagaccattactcaactctatggcgatagaatgatgattgcaaacgcaacaggttgttcatcaatttggggcgcttctgcaccagcttctccatattgcaccaatgctaagggacaaggcccaacattcgcaaactctctgtttgaagacaatgctgaatttggttttggtatgctgcagggtacaaaagcaattagaaatacaattgctgattacttaacagatattaaagaagctgcaccggctgatttagcagaagctattgacgcttggattgctggcaaagatgatggggatgcttcaaaggcagccgcaccggctttgaaggcagctttggataagttcgaagcacctgtagaattagctgataaagttaaattcgtaaaggacaacagcgatcactttgtcaagaagtccatctggatcattggtggtgacggctgggcatacgatatcggttatggcggattagaccatgtactggcatccaaagaagatatcaacgtctttgttctggatacagaagtttactctaataccggtggtcaggcatctaaatctacacctacagctgcaattgccgaatttgctgctgctggcgaaagagtcaagaaaaaggatttaggtatgatggctgcaacttacggatacgtctatgttgctcaagttgccatcggcgctgataagaaccagttcattaaagttctgaaagaagcagaagcttataaaggaccttctttgatcattggttatgcaccatgtatcaaccacggtattaaaggtggcatgggcaaaacgccaactcacgaaaaacttgctgttgaatgtggctattgggatctctatcacttcaatcctgaagcagaacatccgttctcacttgatagcaaagcacctgacttcagtaagttccaagacttcattatgtctgaagttcgttacaattctctccgtcgtggattcccagatattgctgacaaactttatgaacagactcaaaaagaagccgaagaacgttataatggctatgtaaaaagaaacgaaaaataacaattagttatttacgtcttttcaaattccactcactgatattcagtgagtggaatttttttatttgttttcagtcttattttctacataaatatttaaacctatggtacaattaactttatcagattgatgtgtagacattaaattaaataaggagacaaatactatgattagtcaagaagagcttaaagctgcacaagataaatttaataaaataattgaagaacaattgacaagaattgatgcgatgaaatcagaaggtgattttatcgattattccaagaaagaccatatcgaaattggtgtagttggcggtgatggcattggcccatttattacaaaagaagctcagcgtgttttagaatttttattgaaaaaagatattgaatccaatcgtgtaacaattagaaacattgacggattaacaatagaaaatcgtgctgcttgccacaaggctataccagatgacgtattggcagagttaaaagaatgcgatgtcatcctgaagggaccaaccacaacaccgagaaaaggtgacaaatggccaaatatcgaatcagccaatgtcgcaatgagaaaagaattggatttgtttgcaaatttacgcccggttaaaattcctgaagaaggtgtagattggacatttttccgtgaaaacacagaaggcggttatgcggttgggtctgaaggtgtcaacgtcaatgatgatttagcaattgactttaccgtaactactcagccgggaagtgaacgcattatccgcgctgcatttgattatgctcagaaatcagggaagaaaaaagtcacagtcgttacgaaagcaaatgttatcaaaaccactgacggcaaattcttagacacagctaaagaaattgcaaaagaataccctgatgttgaaatggatgactggtacatcgacatcatgacggccaaattggtcgatcctaaacgtagacaacaatttaaagtagtcgtactgcctaatttatatggagatattattacagacgaagccgccgaattacagggtggagtaggaacagcaggatctgcaaatattggaaagaaacacgctatgtttgaagctattcatggttctgcaccgagaatggttgatgaaggacgtgcgcagtatgctgacccaagctcaatcgttaaagcggctggtatgttgttagattatattggatatacggaagaagcagaaaaactttcaaaggcattgcagatttgttcagaatacgaaaagaaggttgttttaactggacgttctgacggcggtactggagaagaatttgctaattacttgatggaaactttgtcaagagatgatctcgaagaatattattcttcttttaacaaataatattacggatgacgaataacaaagagtttatcgaaaattacattttaccgcgggtaaaaaaaccaatcacatatcagggaaacgaaattaattcgattcataaggatttaaatcgagtttcagttcgttttgcgtttgctttcccagatacgtatgaaattggcatgtctcatcttggcatgaaaattctctatagcttaattaatgccgttcctgaattttattgtgaacgtgtctttgcaccttggcttgatatggaagcccaattacgagaaaatcatgtccctttatatgcacttgaatcgatggatccgataaaatcatttgattttatcggatttacacttcaatacgagatgtcctataccaatgttttaaatatgttggatcttgcagggctccctattcttgcgtcaaatcgaagcgatgacgatcccatcgtaattggcggtggaccgtgtgtatgcaacccagaacctctggcttctttttttgattgttttttaatcggagaaggggaagagcaattattagaaatattaaaagactacgaacaatacaagaagcagtctaaaaatttttcaaagcaggattggcttattcatattgctcaaacttacgaaggtatatacgtgccttctttatatgaggcctcgtattttgatgatggaacattatctgatttttatccaatcgttcctaacattcctaaagtcatcaagaaacaattcattaaggatcttaatcgtgtttattatcctaaagaattagtcatgccatatcatgagagtgtccaggatcgtattccatatgaaatctttcgcggctgtggcagaggatgccgcttttgtcaggccggtatgatctatcgaccgatcagagataaaagcgttgattgtattgaagaaggcattcaaacactgttggatactactggctacgatgagattacacttttgtctttaagtacgagtgattatccgcatattgaagaattagctgctgatttattaaacaaatacaaagataaacacatcactgtttctttgccttcacttcgtctcgattcagtttcagcagatgtattagaacagttgcaaaccgcgcgaaaaactggattgacttttgctccagaagcaggaactcagcggttacgcgatgtcatcaataaaaacgtcacagaagaaaatttgatgcaaacagctacaaacttttttgatcgaggctggaatcgcataaaattgtatttcatgctggggcttccgactgaaacacttgaagacattgagggaattgcggatctagctgaaaaagttgtcgaacgttacgacaatacaattgattcaaaccgtagaaaaagatgccaagtaactgttagtacgtcaggatttgtccctaagccatttacacctttccagtggtttggtcaaaattccattgaacaatttaaagaaaaacaaacgtacttaaaacaaagaatcacaaataagcgcattaaatataactggtcggaacctattctcagcttttacgaggcagtattggcaagaggagatcgtcggttaggaaaagttttacaacgcgcatgggagttgggttgtaaatttgatagctggcatgaatgttttcaacaggatgcgtgggaacaagcatttaatgatactggtatggattcagccttttacgccaatcgccatcgagatttagatgaaaaatttccttgggattttatagatatgggtgtaagtaaatcatttttaattaaggatttggatagagcacaggctgcttcatcaacaccttattgcagaaaaggctgcgcaaactgtggaatcatgcaattcgatccaaaatggagatgccactcatgagtaatgatcagacaccaataatgacgatgcgttttaaatttaagagaaccgcatcactaagatttctttctcatcttgatcagcaatctacatttcagcgtgcattcagaagagcgaaaattccatttgcctattccaatggattccatgcgcatccgaagctttcattcgcattggctctttctgttggcatgacctcttcttccgagtacgcagatcttcgtttaactgaagaagtcaatccaagcgaatttgtttcagcagtcaatgcgtctttaccggatgggcttaagatattagatgcaaaactgataaaagggaaagttaattcattatctgcatcaataaaaagttcatcgtatcgtataaaaattttagatcacaaatacgataaattgttatcggatgagatccaaaattatttaaatcaaaacgaaattttggtgaagaaaagaaataaaaagggaaggcttcagatgattgacgcgcgccctttcattaaacaattttccgtctttcaagatgatcatgatgacttgcaatttaatcttagtctcaattatcaagatcaaaaaaccattaaaccaacgattattttgcgttcttttgaaacctttgctcaccgtgaattcggagacgatttgctttggcaagttcacagagaaaatttagaacttagttcaaaataaaaaatagcccttaatagaaaattatctctattaagggctaaatatttatcatagtaaatacgatttattgattgatcacatactcactgtgactaataagatcatatgctttttcttgatcagatgtcgctaaaacaagcatatagggtgcacctgttttggcatagggataggcataatcaacattgatgtcattagccgccaataaatgaaatattttgttcatcatgcctggctcgttaactggctcaataaccatcacatctttaatgcggacaaccttaccattttccctaaataattcaactgtttcataaggcttatctacaattaatcttaaaatcgcatattcttgcgagtcgtacacaaataatgcgagaatgttgatatcatttttagctaatatatccgtcgcagccgccaaatgaccaactttattttcaataaaaactgatatttgttttaccattgagatcatgttattcaccctcattcttttcttttatcaataactcgaacagcttttccttttgaagcttccatgctaaggggttcgacaagatgaattgtcggatgaatgccaagaacagtgtgtagtctttcttgaactgtttttaataaattatccaagctagatgcggtatcgagtaaagaagagtctgtgacttctacatcaatatccattttgtcaagataaccttttttacttacagtaatcaaataattgctgccgattccttctgtcgacaaaaggacttcttcgatctgagatgggaagacattaacaccactgatgatcaacatatcatcagtacggccggtgatttttgacattcgcatagtagtgcgtccacattcgcatggcgaagaatctaaacttgtgatatcttttgttcggtatcttaatacaggtgtggcttgacggaataggggagtgacaactaattctcccttttcaccttccggcaaaacttctcctgtttggggatcaatgatttcgcaaataaagtaatcttcattaatatgcatgccatgaagcgcaggacattctccagatacgcctgggccgcctaattctgacatcccataattttcatacgcgtgcataccccaattttcgttgagttttttccgcattgcttctgtcgaaggttcactgcctaaaacaccatacttaacttttaaatcatttactggatcaagaccaagtgattgggctacttctgacaaatgcaatgcatacgatggcgtagcaatgagcgctgtcacaccccagtctttcataattttaatttgttttttcgaattgccgctagacatcggtactacagcagcgcccactttttctaatccctgatggagacctaatgcacctgtaaataagccgtatccaaaagcaatttgtgccgtatcatggtacgtcacaccagccattgaaacaattctagcaatgcattctttccacactttcatatcgtgttttgtataaccgacaaccgtggggttgcccgttgtaccggatgaagcgtggtaacgtacaattttttctttcggaacagcaaacagtccaaatggataatgattgcgaaaatcatccttcgttgtaaaaggaatttttgaaagatcatctaacgtctggatatcttctgggacgattcctgcttctttaaatttttcttgataaaaaggaacgttctgataagcgtactggacagtctgttttaattttttcgtttgaatcaatcgaatttcttcgcgatccagagtctcttttgttgaccagatcattatttctattttctcctatttatttcttcttaggtggacgccatttgctttttaatggaacaacctgattaaacacgggatgccctggtttggaatatttcggatctaccgaaaaatacccacatcgtacaaattgtgctttttcgaaaggtttcatgttgattgcttccggttctgcatatccatgacatacttcaagagaattcggatttatcttttcgatgatattatcgagcgtatagcgggaatcatcttttaacagggaatcaaacaagtgaatttcgacaggttttccttctgtcgcagacacccaatgaattgtaccttttactttcctgcctttgaaacctgttccgcattttgtttcaggatcataagtacatttaagttcaatgacattgccatctttatcttcgacataatcttgacaggtgataaaatacgcaccacggaaacggacttcattacctggatagagtctaaaatactttttaacaggttctttcataaaatcagactgttcaacataaagttcacgggtaaatggaactttatgcgttcccatttcttcgacgtcttggtttgtttcaatcgttaaccattcaactttgtcttcaggccaatttgtaatcgtcactttgagaggatgaagaacacagttataacgtggtgcctttgtcttcaaatcatctcgaataaaatgttccaacatggcggtatcaaccgtcgaattcgctttagcgacaccaatttcttcacagaaattttggatagcttctggggtgtagccgcggcgtctaagacctgaaatggtagccagtctcggatcgtcccatccatcaatgacaccttcatcaaccaattttttgatgtagcgtttgcccatgatcgttttactcaaattaagcttagcaaattctatttgacgtggcggttcatgttgaaattcatctaaattttctaaaaaccaattgtataatgggcgatgatcttcaaattcaagggtgcataatgaatgtgtaatcccttcaatggcatcttctactggatgtgcaaaatcatacattggataaacgtgccattctttgttcaaagtcgggtgtaccatgtgacggactcgataaataatagggtcacgcatattcatattagggttagccatatcgatcttcgcgcgcagaactttttcaccttcagccactttgccgtcaatcatatcttgaaacagctgcatattttcttcaactgtacgatttcgatacgggctttcaacaccaggagaggtcagagtcccccgggttttctttatggtttccatatcctgatcgtcaacgtatgcaacaccttttctaatatattcctttgcaaattcaatcattttagggaaataagatgaagcaaaaaattcattttcaccccattcaataccgagccattttaaatcttttttaatggcatcgacatattccatgtcttccttttctggattcgtatcatcaaaacgaagattaaacgtgccatggtattttaatgcagttctataatttaacaatgatgattttgcatgaccaatatgaagataaccatttggttcaggcgggaaacgagtatgaacacgattgttggcataaatcccgtcttctaaatctttatcaatataactaaaaataaaattactttctttttctttatcgttcaattgaagctcctatatgtgttcattttttatattgtattttaccataaaatcccgctaatatcttacggttatttaagaatgatcggatttttcaaaatatgatgataatggatttttatatactgcatttctgacatcatcatcttcaatatgcgtataaatctctgtcgtagaaacattctcgtgtcctaaaaccttttgaagtgtccgaatatcgatttgaccgtatttatacattaatgttgctgcagtgtgccgcaatttgtgaacagtaaatttatttgaatctaatcctgccttttggatatttttattaaccattacttcaaccattcgattcgaaatgccctttccgcggctgctcaaaaacagatgatcttcttttctagttatatcttcgtcatcattgtcctgattgctttctggttcatcacaatcatttttttttgctgcgtttattttttcttctgctttcttaagctgttgttctctgacaggaaggtaatcctttatggcactgatacaggcgtcgttcatcatgatgtctctttctttattaccctttccaacaacatgtaatgtttcatcttgaatatcctgaattcgtaaatttgttaattctgataagcgaaggccacaatttaaaaatagggtaatgattgctaaatctctttctttatttcggccgtccacagcattcaataaacttaatgcttcgtctaaggtgagataaatcggatctctttttttagcttttggcacttctaaattttgtgttgggtcatttattttttcctgcataatattaatctcgaaatgataaaaagaacgaatagcagcagtttttcgtttccgcgtagtatctccattgctgcgttcggtagcgctatacgataaaaaggcatatatatcgactaattgaacttctgacaacagagtaggggatacgagattaatagatgtttcatctaataaatcatcttctttaattttaccgaaacgtataaggataaaatgaagaaactgcttcaaatcatttttataagaacgaactgtattttcagagtatccttttactgatagaaggtaattacaatagtcatccaatatattatttctctccatgatattaatatcctctctgttatttcgtgataataatattatacgcaaaaagcataaaaacataagataaaaataaaattaacttaatttctgtttacattaaagcttttttctataacataaaataaaattcagaaggagaaataagaaagctagttcttattgtaatttaaaaaatgaagaataacgattttacttatgaccaaaacaactattacgattaccagtatgactttaccgacggctccaatgatccaaatgcccaaaacagctttaaaccagaaaaaaagcccaaacgccccttaaaaacaaaactgcttgtttttatttgtttgatagttggttttttaggtggattaggtggaaactttttgtatcaagctatttcatcaagtcaaggttcctcgtttgtttataaagctgccaatcatgttacaacaacatccacatcttcgtcttcatctagcgagttaacaacagaagaaattgccaaaaaagccagtccatcagttgtgtccatcacaacagaatcaaaaacaacatcttcattttatggagattatgtaacccaaggcgccggatctggtgtcattatttcatcggatggctatattgtgacttgtgaacatgtcgtttctgatgcatctactattaaagtaacgacttcggataataaatcttatgatgcgactgtcattggcacagatgcttcttcagacattgcattgatcaaaataaacgcaagtaatttgaccgcagccgtaatcggtgattctagcaaattaaccaccggtgaaaaggcagtcgctattggaaatcctttgggtacattgtcaggaactgttacagaaggcatcgtttcagctactgcgcgaaacattaccatcgacgggagaaaaatgagtttagttcaaacttccgcacaggttagccctggaaattctggaggcggtttgtttaacaaatacggcgaattaattggtatcgttgagtcaaaatcatcatctgatacaaatgcagaaggtcttggatttgctgttccgtcaaataaagctatttctgttgcagatacattgaagaaaaatcaaaatagcagcaacagcagctcatcatctaattcatcatcatcagaaaattcatcttcgctctacgataatcagcaaaacaatgaagacagtaattccaatagcagttctagaaattcattatacaattttttcaattctattttttaaaaaagaatagtgaataatgcaaaagcccacaaaccgatgtgggctttttaaatttcgttgaataaacacgacttttggacaacttggcctcatttggcagcacaattgcgtataacctacgttatacgcaattgtgtcgatcgcttactaaagcttccctaatcgttatcttcgtctccattttgaccaataattttcatgcaagcttcatatgcttcttcataggtatcccatttaattttgtcaccttcgcgaacttctagatcgccaattcttgcatacgaatgtacgccatcattaaatgatttaattgaaatgtccttttttgtaaaattcggaaaagctgggtatttacgatataagaaattatcttcagtttgaggttctgtcgtccattttccatcactatcaatatagagctgttgattggtcgcaagagccttcatctgttcatctaaactattgtcattcgtatgctgtgaagcttgctgtacatcaatttttttatcacttttcttattgtgcttttgaatatccaaatccgatttctgctgcctagcatccgaaatttcattgtaataagcaataagctgttgaatagaacgaattttaatcagccatctttgtgttggtttgcccttgtcgactaaaacaaataaccaattgatttttttcatgtttttctccttatcttatgattctaaatcatcttgtgttttatttaattcaatttgactttcaaataatttgttttgcaaatctaaaatagatttacgattagcatcattttcttcctttatctgtttaatatgatcacggtattgattcaataaatcatttttttggtcaagctgatcttttaacgaattttgagctcttattaattcatcaattttttgatttaattgttcaatttgtttatttttttcttctgtttgttgatctaaagaatccttatcattggtcaattcttgaattttgttggccagttcctgattgtgattctcactttggcaatacatatcggctaaattcatacatcccataaccattaaatagatgcggttaatattaggattactttttcgaattttttcaagctcatgattagccaagtctgttgctttttgtatttctaattcattattatcattttttacttgaagaattgtccctgcaatattaacttctataggctttttttccatttatcaaatgctcctttgcattcttattttatcacattttatttaatgagcctataaaaactcgtcatcctcctaggacaaaagtcatttaataaataattaatcattcattaattttctaaaataaaaagataaaaaacagccctcaagcaggaaaaaatttccttcttgagagctgtgaatctattgagataagtaatattaataatttggcgttgcgtatccaaaaatagaacttgatttgtagttaatcgttctgcgctttacttgatcactatagttgccttcgattgttgtaatatttccattactgtaggattcgactaagcctacatgatctacaacgcggtcaccattccaatcgtaatagacaatgtctcccatcttcggcacatagcctttccattgccatctgcctttactttgataccaacttacacctgatgggcaatatgcgtgataatagaaaacatcgcttgaaagacccgcttgattgccacaccaggatacgaacatggcacaccacgctgcatgctgataaatactcgaatggacgtaatttccataccacacaccgtattttgtataattattgctgccttcttttgttccaatttgagatcgagcaatattaataaccttctgccttttgcttacaacgggcttagttttaaatccagaagcattagccttttcaattgtaaattgctgtgcggctgagttatttaaagtgtacaattctatattggaattatcggctgtattgttacctgttaaatccatcacacgagttttgctacattctggctgaagataatagacacccgatccagagcttgtttctcgaatatagaacttttggtttaagccgttatttaaagtacaaatttgaatgttggctccatttttatccaaaataccataaacatctaatactttttttgaatcagataatgagtagatagtataggatccatctgaatttttcttaaactgccatccctgttctttataattattaacagattgtaaaacaacattattcgaattccctacagcaacagattttccacttgctttatgcttaatccttgccgtgaatgaatcacccaaatcaacgtttgttacttttgctttctctgttgttgaagctgaatcagacgaaaatgttgcattaccacttgaagttgatgtgtcattttttttacttgaatcagaagatgtatttgtcgttgtttttgtcgtatctactgtttgatctactttagctgtacttgttttatctgttgtagaagtagtagaatttgaatctttcttttctgctatatcagttttcgttgttgtttctgagctggatgatgaagttgttgatgtactagaagcctgttttaatgcagcaatttgttccgttgacaaaatgctaattttaaatttctgttgacttgttttctgacttgctttgatgagtacattgttattatcaatagtcaatacctttgcaagcgaactagaaggtcttagcgaaaacatattattatcttctaaaaatacgttccacatttgtccataggattgtttagatacagccgaagagacctttgctccctctatatcagaaccaactgttagcacgtaagcatttgattttgaaacaattgaatagacgtttttcgtatcatcgtaaataaatgtccacgcctgattggtcgtatttgcattatcctcaaagctcaatgtgccattttgattcgtcaatacctttttctgatcactagaccaaatttgagcaacaaacgtattaccgttattaagttctacgcttgcagcggcaaaagaaggccactgaaaaaataaggaaatcaatgcagcaagtagaccaatcatccaccacttcttataacttttatctctttgattctctatcacggtttctcaccttcctttacctttattcgtaataattcccaccgatttttacagaatttgcttttttcgttgcttggaatgaataataagaatggtttctcacaccgccatatacgcagtctttgacagcagcttgaacggcagccgaagatttaccatttagatattttttatgagcacctgaactgtatgcagaaaattgcccttttgcttttacaacggcaaccgctgtagtgcctccccattttccagaatcagcgcgattcataatacacgaaataaccgctaatgcgccttcataacctgaattatcttcctgtgacacaacagcacataaaaagtcaaaatcagatgcacttacattttccgttgtatgattgtaagtgatattttttgtctgacttacatactgacttaaactgctttgtgtactgttactcgaagatgatgtacttgtggtactcgtcgtagtagcagccgtagactgagtactatcagttgtttgggtcgttgcagtctcttctttagttccaatagcaacaacctgcgtaacaggctgtttagtaattgtcgaagaaatttctttctgtgaaattaatttaccatcttcataagtcatttcagtcgtaactgttttttctccgttaaccccttgcgttgttgtttgagttgttccttttgctagattggagacatacacgttgtaggtctgatatggtatgacaacagtagaagttgaagtttttgttgtagtgctggaattgctgctttctgaagtatttgaactgtcagacgatgtgtttgagctggtacttccagagtctgttgttgtcgaagttgtctgagttgaacttgtgctagttgtactatctgatgtacttgaggaagcggaatctgttacggttgcagtcgattctgacgtctgactcgtgtctttcgatgttgtttcgtctgatgatttattatcttctgttgtatcaggtgtttttgatggatccgtgtcagtgcttgaagaattagatttttcagacacatcaggtgaagtcgacgaatctttcgatgatattgatgatgagggattagaagtatctgaagaagtattattctttgaagacgtatttgtcgcaatgtccgatggattcatggataccttcattgtgactggttttgctgttacagatgaacttttgactttttctgagaccaaaacaccattatgataaactgcttcggacactactgtcttctggccgttctgtccagattgctctacttttgagctgccctgagatacattgctgtctgctacgacctctgtttgataaggaacttcttcagtagaagcaacctgtgctttggtaacacgaacaacattgatattttttactttcgatgtcagtaaagtagaagtcccgggagtaacaatatcatctttattgatttttatatttttttctttcaacaaaccggctatcgttttttgagtcgaactatatttaacttttttatcgccgattgtaatgacaccattggcctttttcacaattttaatattgtgaatttttgatgcctgactagcaaggctgacggaataatcgtaaaggtccttatctattgagtagccattactttttaataaatcctgaactgtttgtccttgttttgaataaactgtttttgtcgttgtttttgaggatccatcatttggatcgtaagaaactttcacgctattgttgcttcttcctgcgaaaaaaatacccgcacagacgcatgcaatcgcaatgaaaataaatgctttcttttttcctagatgcattggatctcctttctactgctgttgatctgctttgaaataacttggttttagattaacaaagccttgttacttaggtcaacgacccgaaagaagcgattttgagttaaaaagttcgccacaaaaatttaaatatttttttattttattaatgtgaaaagcaacaataaaatttaatattaataaataacattgcgtaaagaaatttaatactcgtatgtaaaaatcattctcttttgaaaaaatgaaaatcttaaaaattaaaaggcctatttgaatcatatcaaataagccttttttgaaaataaatgcgaaaaattactgttataaacgatcaatcacatcaagtactttatttaattgatcagtattttcaatattttctattttcccctgatccattaattttgcgatttccggattcataggaagttgtcctaaaagatcaatatttttttcttcagaaatttccttgatgtgactttcgccaaataccgatattctttctccgcaatgaggacatagtaaataactatagttctcaattacacccagaacatcaacattcatcatttttgccatattgactgctttttctacgaccattgacactaaatcctgaggtgaagtcacgataatgattccatcaattggcaaagattgaaaaatagtcaatggaacgtctccagttccaggtggcatatcaatcaataaataatccttatcaccccaaacaacatctgtccagaattgcttgaccgctcccgcaataacaggccctctccaaatgactggatcagtttcattttctaaaagcagattcatcgaaataacatcgataccctgttgagttgccacagggtaaaaatactcttccgagcctcttgccttctccgttataccaaatgctttcgggatcgaaggacctgtaatatcggcatccatgatgccaactttttttccgcttctatttaatgcaacggcaatttcagacgtaactgtagatttccctacaccgcctttaccacttacaataccgataacttttttcacagaactcaatggattaagatccactttaaaatttggctttggaatatctaccatgtcttttctccttaattaatgattatcatgttcattataataatctattttatttttttcaattaattctttcttttgattatgggtcatacgattttttattatagcttcccagctcattgcgtcgtgtttagtttcaaaaatcttataatatgatagccgaacaggtcttcggcttctcgtatatttacttccctttcctttattgtgagtttcaattctcttttttaaattattggtgtaacctgtataaaatgtgccatcagaacaagtcactatgtatgtgtaaaattgcataattgttatttttataataacctttcaataacaaaaataataagcagccttttgctgaccgcttattatttgatcttatccatcttttaacatcatgtcttttactttcattaaccgagttgtcgtccctcgttcattttcttccagacgcatcatgatatatttaatattctttttagtttctggaatcataacgtgctctaaagcattcacgcgtcttcgagttttttcaatttcatcagctaataaattgcaggtcttttcaacttctgccaattcgattagcagaggcatcaactccgcaatgtctagaaccgactgatcgagttctccagatgtaaaggaaaaaccatatggcaattgaggtgcctttccagattcttcatactttaattttggcacatcaacactcataatgtttgccttatcaactgtaatatcagttgattttgccggacacaagagagcttcagttactaggtcttcgcccattctgctttctgcaaccgaaaatcgttgtaacgcttctgttaatctggtttcaatttcttctcttaatgtcctattttttttaatgtagatcataaatctacggaccatttcatctcttttgtcctttaataatttatggccacgttcagctgtttgcagcctactttttaaacgtgttaattccattcgagtaggcttaatttgcgcgcacataatctattctccgtcaatagaagactgtttgttgtcatcaggataatatttgtcaatataatcgagcttaattctctttaattctgtcttcggtagaatagacagaagcttccatccgatatccaacgtttcttgaatatctcgatttgtatcatatccttgagaaacatatatttcttcaaattgatcagcaaatttagcgtaaagcttatccatgtcggacaatgctgcatctcctaaaataacagctaattcctttgcctctttgcctcttgcataagctgaaaaaagctgattcattgtgtcagcatgatcttcacgtgtcttacccttgccgatccctttatcttttaatcgactcagcgagggcaaaacgttgattggcggttcgataccacgcatattcaattctcgagataaaatgatttgcccttcagtgatatatccggttaaatcaggaattggatgtgtaatatcatcttccggcattgataaaatagggatttgcgtaatcgagccttttttccctaaaatacgccctgcacgttcgtatattgaagccaagtctgtatacaaatatcctggatatcctcgccttccagggacttcttttcgagcagctgacacttctcgtaatgcttcagcgtaattcgtcatatccgtcataatgacgagcacatgcatatctaattcaaacgctaaatattccgcacaggttatggccattctaggtgtggcgattcgttcaacagcaggatcattggcatagttcataaacagaactgctcgttcgatcgcgcctgttttcctgaaatcttgaataaaataatctgcttcttcaaaagtcgttccaattgcagcaaatacaaccgcaaaatcttccgaatcatctaatactttcgcctgtctggcgatttgggcagccagctgagcatgaggcagaccagatcctgaaaaaaccggaagcttttggccacgcaccagggtgtttaatccatcaattgcggaaatacccgtttgaataaattcggccgggtaatccctggctactgggttaattggcgcgccattgatatcgagtttttcatcaggaataatttgtggcccatcatctatcggccgacccattccatcaaaaattcggcccagcatgtctctgcttacgcctaattctattccgtgtccttcaaaaataacttttgaatccgatattttaagtccttgtgaactttcaaacagctgaactaatgccgcatccccatcgatctccaatacacgtccaactcgttcttctccgttagcttgttttatttgaactaattcatcgtactttacattttcaacatgatcaacaagcattaaaggaccaacaacttctctaatcgttttgtattctttattcatccgctttttgtccttctgataatgcttcaaaggcatcattcatatctgttcgaatgcgttcgtatttttcatctttttcattttcaggaacgtacttcattctggcaattttttcccgaattggcatttgaatgactgcgtcaaatgaaccgtcagcatttagatacttttcgccttcagtataccaacttaatatcatttttaaaattgcaatctgtttttgcggtgatgaataagtatcgacatcatcaaaagccgattgatgcaaaaaatcctcccgaatcgaacgtgcacattccaatgtaagccgatcttgataacttagcgcatcgacacctactaaatgaacaatttcttgaagttctgattctttctgcaagatattcattgttgcttggacagatttcgaccaatcttgatctatattttgattaaaccactcatttaatctattactatacaaagaatagcttgttaaccaatcgattgcaggaaaatgacgctgataagctaaatcggcacttaatccccaaaatactttgacaattctcaatgttgcttgtgaaactggctcagaaatgtcgccaccaggaggcgaaaccgccccaattgcagaaatagcacccgttctttgatcagagcctaaacaattaactacacccgctcgttcataaaattcagctaatcgcgatgacaaataagcaggataaccttcttcaccaggcatttcttctagtcggcctgacatttcacgaagcgcttcagcccaacgagaagtcgaatctgccataattgcaactttatatcccatatcacgaaaatattccgcaatagtaatgcctgtatatattgaagcttctcgagcagcaaccggcatatcagatgtattggctattaagacagttctcttcattaagctcattcccgtgcgtgggtcatttaattccggaaattcgcgaagcacatcagtcatttcattgccccgttcgccgcatccaatataaataatgatatctgcatcagaccattttgccaattgatgctgaattaccgtttttccggagccaaatggacctgggatcgcagcaacaccgcctttcgcaataggaaacaacgaatcaatgactctctgacctgtaatcatcggttcattaggcgttaatttatttcgatatggccgtccaattcggacaggccaaatctgaagcatgggcacatctttttcatccccatcacccgtttctatttttgcaattggctcagtaattgttgcctcgccatcgtagatccacgatatcgttccggaataattgggcggcatcatgattttatggacaacagcgggtgtttcttcaacttcgccaataatatctccaggctgtaattgatcgccgattttcgctacaggtttaaaagaccattttctttttcggtctaatttaggcacatcaatgcctcgtgtgatattattgccagcttctttatagatggaagtcagcggacgttgaataccatcatagatcccttcgattaatccaggagccagttcaactgacagcggttgtcctgttttatatactggttctcccgggccaatgcctgccgtttcttcgtaagcctgaatagaggctttatcgccacgtagttcaattacttcgccaatgatatgtttattgctgatttttacaacatcatacatttgaacatcagccatatgctcagcaataattaatgggcccgcaacttttacaactgtacctgtttgttctaaagtgctgccactttgtttaggattcaacttatcatcatttcctttctaaaagatgtctgcgccaactgctttttcaatattttcttctattcccctcttaccaattcctaacgcaccatttttattcggaatcgggataatcgcaggaaaagatttatccttatattcatcgattattgtttctattcccgctgcaatattttctgtaatataaataatagaaaatttattgcgttcgagctccttgatttgtttgccgatatcttcacattcttcaacgggaaatacagaaaaacccagcaccttaaaaatcataatggaattttgatcgccgataacagcaattttcgctttttgactcatcaaaaatcacctcaacatatctttttctgtcgtattattggcaggactgtttttctgagcagccatcactctcagtgacgaaccttctcttcttttttcaagcaaataattaatgattggcccaattccaaaggaatcatttttttcttcgtgaataattgaaaaggcaaaatcatctaattgactttccacttcagagataatatggcgtttcgaataatcgtccaatatttttcgatatactgttctgttaggtcccgtcgataaataagcacacaactgatcttctgtttgaccgatagccttgtgcatctctgtctgatctaatgatccagaatcgaaaagcagaagattaattttttcagaattccattgcaaggcatttcccctgagaattgccaaaatgttaactttatcaaaaataatattaaaatattgcttgagcaaagcattttgatgcatctttagagcatccctaattgttgtcaatactgcgaagtctatcttttgactgatttcaaacggatcttctagatctaaggcagcttttatagctttacctatagctgaaggcagctcattatatttttcatctgaaatagcttcaatcaattgatcgatatgaatcacacccgaagtgtgcaaaaatgattttgtgtctttcctgattaaaatgcctttaataagcattttgatattgtaggcatcttcagaataataaaacaaatttgtcaaaactgggtcaggcgaaagagatttaatgtccgaattgacctcattcaattcagaagcaaccatctcattcacagtatggccgctgtcttctgcagagccataattattttcttttaacacctgtatcatcgctgactcatcttttgcatctgataaacgctgccagacattctcatctaacaacttattttctagccccttaattctaccaactgcaaaagggtaactaattccagccatgactacgcctcatctcgatcttcgaataatatagcagcaacttctctttcatacttgtcccgaacttgttgaagcaaaacttcgaaatcaccattgatatcataatgatctccttctaacaagatacccgcttcaaattctgctggatctgagtcaagtgtcaatttcccaggtagaccgtttaccttaagtcctttattcagcgtagataaaaagccagactgatatttttcataatctttttcaggaacttttatcgtttcatttccagttcttgacgatgaagcaacgatctcagcaatcaacacagaccagtccttttcaggtaaatgattcatcgcttctttagcttgagcaaacgctcgatctattaattctcttttctttaaaagtctattttttcgcgcttctaaatgaaaaatcaattcacttctttcttcaaggtcttgcatctttcgatcgaaatcattttccatctgacttatttgctcatcagatttcctttgaattgtctttttcagttcttgagccttttcttttgaatcattttttatattggctgcatcttcatttgccttgtcaagaatcctactgataattgtactctgcgccatgataacccttcttgatttacttaatgctgaataaaatcaaaattgaagccagcaaggccaaaatggcataagtttcaactaatgccgtcattgtgattccttttgctgaagaatctgggtctttcccagtcatatgaatcgccgcggcagctgtttttccttgtgcaatgccagataaaagtccaacaactgcaattggtaaagcagctgcaaaataagcccatccctgcataacagaaatactgtgcggtgcgcctgaaatcataccagtttgtactaaaatcagcaccgctaacaagaatccataaataccttgagttcccggcaaagcctgaagaacaagaactttcccaaataaatcaggttgatctgatgtcacccctgcagctgcttgacctgcaatttgaacgccaacagcggatccgattcctgataaaagtgcacaaatggctgctccaaaagcagcaatgataattccctgcgtcataatattacctctctattttttattttcttctgtattgacattaacgtacttagacttaatagacaatggttcaaaaggaatgccaccgccttcataaaatttattgaaaaattcaatatactgcaatcgactgtcgtggacatatgcagataacaaactcatagccaaattaaaagtatgaccaatgaaataaataaataatgcgacaattattcccacaatatttacagcaaccatacgggctaaaagattcataaccatcccgataacgcctgtagccaaactcaatgctaatattcgagaataagataaaatatcgcttaaataagaactgatattatataaccccaataaacctcccgtgatttttttgacgacatttttgttttctcttcctgctgtacataaaataatcgcagcacctgcaattgccattattgcgcctgctcgacgagtcgcctgcaaaaacaagagccccaatcctgtaattaaaatcatccagctcacttgatcaaatatggcatcccatggatgaccagctttaaattgctcaacgattttaatagacataccggagaaaatatgtaacacaccaacaattaatgtgaaaatcaacattttcattggatttgtcaatggtgcgaacaaaatcggatgccaggtttccccgaaataagagccaaacagtacaccaaaaagtatcgttgtaaaagatgaatacaacagtgtgttgacaagctttaaaccattgccttttggttttttcaatttacgaaaaatgtaaaacacaaaaaacatgcagatgccatagccaacatcccccatcatcatcccaaagatgacccaataccatggcccagcaactaaagccggatctaattctgaggggctcggctttgaatacatatctgttatagtttcaaattgagcccaaaatcgaggatttcgtgtcactgttggcggcttatccttttttgtcggtttatcaaattgaagatcataatcgtgaatcgttttatcaatgacttttttgaccttttcaatccgatcttcacatacccaacctagcagcaaaaccgtttcgtttgtttttaaagttttaacattgtctctattttgtttcgtttcgtattgttcatttaataatttaatatctttttcgtcttctgatattttttttatcgattgttcgatattaattttttcttttctatcctgctgaattttttccctaagctctgcaattttctctgatgccgaacaggaagtctttgttaaaataacttctctcattcctagttcttttaatttggataacagctccggcatttctttccttgtctgaacaactaatgcagaagcttctttcttttctacatcaaaaatttgaatctgagctttttcttcttccacaatcttgaccgcattgtctactacaggctcaggaagaaacacagtagacatttcaacgtatttgcttccttttatttgatcaagaggaatatccatcttctcccacggcagcaattcttcaatcgcttttgaactattttcgatatcaagctctaaagctttataatgttcattaaaactttgcagctgttgacaaatctccttaccctttacattctccattaaaaaagtatcataactaatttccggttgatcttcaaaaagcttatgataatattttttgtgatattgatttgaaagttttaacatttcagcagcttgttgagcttcacttgaaattttattttccgacggctgtgtgtcttcggaatcttccaaattaataggcatatactcccctgttttttgtaatgccttgagtactgcctcttcatcttctcggaaaacaatcaatttcattttccgcattggaataatcatattgattttaccttttctaaaatatattggacagcttccgatacattcatttcatgatcttttatgaatttttcgtcattttccgctgctgcttttagctttgtccgtaaataaacttcttgtttttcttcggcttcttttaattttttgtttaacgtattttgataatcagccatcctctcttttttatcgttttctgcttcagtccgcgccttttttacaattgcctttccctcttcccttgcttcttttctaattcgatcagcctttttttcagcctctcgaatatcatcaatgattgacataatctatcaccccaataaaaaaagttcatgattatattatcatgaacttaaaagaaaaacaattattaatatatgaagtgttaaacatttacagactttcagcaaatatctgcacaaccttgtctatttcttctttaccaataatcaatggtggaacaaatctaatggttgaatgtcctgccccacaaacaagtaatccagattggatacattgattaattacactcgaaacatcctcatcaatttcaacgccaatcattaagccttttccccgaatatctttgatatgcggattcacatcctttaattccgaaagcttttgagcgaaatattgagatttttcagagacatcctttaaaaattctggatctccaacggtatccaacacataatttgccgcggaagtggccaatggattagccccaaaagtagacgcgtgggttcccggtgtgaagacttgagcgactcgatcacaagccaaaatgcctcccattggaattccacctgcgatacccttagcgaatgcgacgacatctggtttaatgccgtaatgttgataagcaaagaatttccctgttcttccaatgccacattgcacttcatcaaaaatcaaaacaatattttggtcatcacacaattttctaacttttttcagatattcttgatctgctggataaatgccgccttcaccttgaatcggttccaacaaaatggccgcacaattgtatttatcaaccgccttttctaatgcttcaaaatcattaaacggtacgtgcgtaatatctggcactagtgggtcaagatttttttgatatttggcctgccctgttgccgtgatcgctgcataagttctgccgtgaaaagaatcctgcatcgcaatgatctctgtggcatcctttgatttatataattttgagtaaatgcgggccaatttcatcgccgcttcattcgcttccgctccgctgttacaaaaaaaggctttatccaatccagataacttgactaatttttcagccgcagtaatcattggcacattccaatacaaattagatacatgaagcattttatgaatttgcttttcgattacctgattcaatccagcgtgattgtaccctaaacaattaacggcaattccgcccacgcagtcaatatattgttttccctcgatatctgtcaagatacatccatctccatggtcgaaaacaatagggaaccgactataggtcggcatgatgacttgattgccccgattaatatattcttgtgtattcattccactctccaagttattttttaagcttcctttatcattgttccacatccagcagcagtaaataattccaataatagagaatgttcaatcgtgccgtctaaaatatgcgctgaacgaacacctgaacgaattgcatctactgcattttcgacttttggaatcattccaccagatattattccctgttcgattaattcttcaacaccgctaatatttaatcttctaataatagagtttggatctttcggatccatatatacaccatcggtatctgttaaataaatcaatttttctgcattaacagcctttgcaaccgcgcaggcaacatgatccgcattgatattataagtttcccgcttatcatcacagcctattggtgcaataactggaatataatcattttttattaaatcttgaagaaatttcacattgactttatcaacttcgccaacgaatcccagatctttatctttatactcttttttatgtactcttaataacgcactgtccttaccagatatgccaacagcgctgatcccgcgattctcgagcagctgcacaatttctttattgattttcccgcatagcaccatttctgctataccaacagtttctttatcggtcacgcgcaaaccatcaataaaagatgattgaatatcaagtctttttaacatgtttgagatatcttttcccccaccatgtacaagaatgggcctgattccaaccaatttcatcagtgcgatatcatccatcatggaatgcttaatgccctgatcatccataaaagatccaccgtacttaataacaacaaccttttttctaaattgtttgatatacggcagcgcttctactaatgtatttgctttttctatatatatatccatatcagtcatttgtattttctcctttttcttttttatggatcaggttcgatattccgcattaatttttacataatcgtacgaaagatcgcatccccatgctgtcgctttataaataccttctcccatatcaatattaatgataatttctttttgttttaatatgtcacttgcttgcttttcatcaaacgaagtaggtttaccgtgatcgagtaggagaatactccctacagaattagaaaaggttaatgacaccgtgtttggagaaaattttacgccagttgcgccaatggaggaaagcactcttccccaattcgcatcctctccgaaaatcgcagtttttacaagattagaattaacaaccgccttggctaggattcgcgcatcacctctggaatctgcattattaacatgtacttcaatatatttagtcgcgccttctccatctttcacaatagactttacgatagatgcgtttacgaaatataaggcgtcaaagaattttgtataagcgtcaatatttgcttctgtgatcttttcattgcctgccattccatttgccagtactaacaccgtatcattcgtactcatgtctccatcgacagacatcatattgtaagtgtccattgcaataacgcttaacattttctgcagacaagcctgatcaatatcggcatctgttgttacaaaagataacatcgttgccatattggggcaaatcatccctgatccctttgccattgcaccgatatgaacggttttaccgccaatttctatttctacagcaacagttttagggacaagatccgtcgttaaaattgctcgagatgcgtcactttggccatcaatagaaagattttgaaccaaagtaggcaccgtgtctgtgatctctttaatcggcaaaggtacaccaataaccccagtagaggaaataaaaacttggttaggatcacaattaaaatgttgactgacgcactcagcttcagtttttacatctaacaaaccttgttcacctgtacaggcattggcatttccgctattgactaatacagcttttattttttgtttatcctttttaacgatttgattgtcccaaagaactggcgctgcttttactgcattttgtgttgtaacaatggctggaaccgcttctacatcagattcgattaatgcaatatctaactgattattgggtttgagccccgttgctgccccgctggctttaaacccctttggtgctgtaacaccgccggaaataatgcgatatttcttttctttcatcatattctccaattattcattacacaggataatctgtaattaaatcaattcctgtcttttctggaaagccaaacataatattcatattttgaatagcttgacctgcagcgcctttaaataaattatcaatggcgccaatcacgatcgcacgatttgttcttggatctactttcacagcgatatcgcagaaattagatccttttacccattttgtatctgggatgcggtcgtcaaggattcgaacaaaatattcgcctttataaaaatcacgatataaagcggtcaattccttttcagaatacttctttccagcgtcattcagcgtcgcataacaaactgctgaaatcccacgattcataggcactaaattgggggtaaacaaaagcttaatttcttcatcacccaaaagacttaattcttgttcaatttccggcgtatggcgatgacatcccactttatacggtttagcagattctgtacattcacagaacatataaggaagctgcccattacgtcccgctcctgttacaccagatttggcgtcaataataatggagttgccttcaattaaatgattttttgccaagggtgccaaactcaaaatactgcaggttgtataacatccaggattgccaattaaacgtgctttttttatttcttctctatgtaattcgcaaagtccatatactgcttctccgataagatcctgtccgtaatgatctactttataccattctttgtagacatcgagatctttcagtctaaaatctgcacccaggtcaataattttacatttatttaaaatatcttggttgatcttctgagaagccactccgtgaggcagcgccaaaaatataacatctgccatttcagataactcttctacagttctatttttacaaatatcttctgttatatgttcatataatggataaacatccttcatgggctgtccatcataagatctagatccaattgaaacaacttctacgtcaggatgccgcaataacaaacgaagtaattcctgaccagcgtatcccgttgcaccaacaatagctgcttttatcaaattattcactccttaatgcaaatgcatttttattaattattatcacaaataacaagaaggattataaccctatttatgtaaataatcaagacctcggaaagtatttttataaataattttcgtatatatttacattttgcacttgatttatttcaacagttagcttataatcaaacacatcagatttttaaaagtaatataaaaacaaggagtttataaatggcaaataaaaaagtaattcttgcatattcaggcggtttagatacaacgacgattgtgccttggctaaaagaaacctacgactatgatgtcatctgtgtttgtgtcgatgtaggacagggtaaagaaacagaaggtctcgaagaaaaagcactcaaaagtggtgcatcgaaatgctacatcgtcgacgtgacagacgaatttgttgaaaattactgctggccagctttaaaggccgatgctgtgtacgaaaaaaaatatttattgggaacttccctcgctcgtccactcattgcaaaggtcttagtcgattacgctcacaaagaaggtgctgaagcaatatgccacggggcaactggaaaaggcaacgatcaggtacgttttgaattaggtattggcgctttagatccccaaatcaaaatcatcgcgccatggcgtgaatgggaccttcagagtcgagaagatttaatggatttctgtattgaacacgacattaaagttaacactcgctacgatcagagctatagccgtgatactaacatcctgcatatgagtcatgaaggacttgaattggaagacccttcgatcgaacctaattacaaacatatcttaaggatcacaaatgcgctctctgaaacacctaatgaaccagaagaaatcaaaattgattttgaaaaaggggtgcctgtaagcattaacgatcagaaaatgacccctaaagaaatcttaacattctgtaataaaattggtggcaagcacggaattggtgttgtcgacctcattgaaaaccgtgtggttggtatgaaatctagaggtatatacgaaacccctggcggaaccattttatatcgtgctcacgaagaattggaacacatgtgtcttgaccgggaaacatttgcctttaaagaagaagcagctgttaagtttgcagaaattgtatatggtggaaaatggtttaccccactccgcgaagcattgtctaaatttttcgatgaaacgcagaagacggttactgggactgtaaaattaaaattattcaaaggtaatatgattttaacttatgtctcttcaccctattcgttatacaatgccgaaatcgccagttttacaaccggggatctgtataatcacaaagatgctgaaggctttattcatttatatggtctgccgcttcgcgtgcgtgctttaatgcgtatgagtgcagaagaaaaggcaaaaaataaggaaaactaatatggcagaaaaattatggggcggccgctttcaaaaagaaacagatgcattaactgatgattttaattcatccatttcttttgatgcgcggctgtatcaacaggatatccgaggctcaattgcccatgctaaaatgcttggaaaacaaaaggtaattcctcaggaagatgccgatttaattgttaaatcattaaagcaaatcttatctgatattcaagaaaataaaattgaattttctgaagagatggaagatatccatatgaacattgaatcgattctaatcgatcgaatcggcgatgttggcaaagagcttcatactgggcgcagtcgcaatgatcaagtagcaacggatatgcatctatacgttaaagacatttgtctattaattatcgatgacatcaaagacttaatcacaaccttactcgatctggcttccaaacacaccgaaacaattgttcctggctatacgcacttgcagcgggctcaaccgattacttttgcacatcaactaatggcttacgtcgaaatgcttaaacgcgatatcaagcgttttcgccaggtctatgaaatggcagattctctgccgttaggcgcaggtgctcttgcgacaacaacttatccactcgaccgctattttgtcgcaaaggaattgaatttttcaagtgtttatctgaatagcttagatgctgtgtcagatcgggatttctgcatagacttcttagagagcgtttctattacaatgatgcatctcagtcggttctctgaagaaatcgttttgtggtgttcttcagaatttcattttattactttggatgatgcattttcaaccggttcttctatcatgcctcagaaaaaaaatccagatattgctgaattagttagaggtaaaactggaagaacctatggcgatttaatttcattgttatctacgatgaaagggcttcctcttgcctacaataaagatatgcaggaagacaaagagcctgtattcgatgcctttgacacgatcgacatctgtcttaaaacatttaacaaaatgattgcgaccattacggtaaataaagattcaatgtacgacgccgctgctcatggctttgccaacgcgaccgatgcagccgattggcttgtcaaacacggcattcctttcagagatgcccatgggatcgttggccagttggtatactactgcatccaaaacgagaaaagtttagatgagctttctctaaaggaatatcaaaaaattgatcctatttttgatgattctatttatgaagcaattgacctgcataattgtgtcagccagagaaagattgttggcggtccagcaaaatcaactgtagaacgagctattgcaatcaataagggattattgaaaaaactttaataatatattaaacgttcattcaagcagtaaaaaagctcttgatgttagacatttatctaatatcaagagcttttgtttacattttgataataccaaaaacatttaatactgaactgatcaaaataatagctaagaaggcaatacagaaatatttgataaataaattgtatattttttgtcttttaaattcagacgatattttaatctcttcttcaattctattaagcgtgacagaacgtaaaatgagcacacaagtggcgatcgcagcgattggcatcattacggagtttgaaatgaagtcaaagaaatcgaggaaatccattcccaatattttgatacttcctaaaacgctgtagccaagagaagatagtgtacctaaaccaacgatgatgacgctgacaagcactgtcgacgctttccggctcatcccagcttcgtcttcaaatgtcgagactgctgattcagccaatgcgatcgcgctggtcaatgctgcaataaaaaccaataaaaagaatgcaatacctgctggcgtccctaatcccatactagcgaaaactttggggatcgtaataaacataagtgatgggccgacctgtaatgctttgggtgtccctccagaaaaagcgaacactgcaggaataatcataagtccagcgagaacggcaacagcagtatcaaaaaattccacctgagaagttgccttttcaatatccatatctttcttcatataagagccaaaagtatacaagatacccattgcaatagataaagaataaaacatctgtcccattgcagcaaccacggtcatccaagaaaaattatcaaaatttggaataaagaaatattttattccagcaattgcacctggccgcgtcatagaataaatggcaacaaaaattcctaaaataattagaactggcattccaatcttagaaattctttcgatcccattttgaacaccaattaatatgatgagcatcgttactgctgtaaagagaatgaaatagacttctgtcggcacactctgactgataaaattagaaaagtatgtgtccgtggccataatttttgatgcgcccgtgatgtatcctaccaaatacttcagaacccatcccccaatgactgaataatacgaaacaattatcattggaataatagcattgatccatccgccaaacttatgtccaaacgtgtttccaaaaaatttaaaggcgccaactggacttttatgagtcatcctccccaatgtcgtttctgacataatcattgtatacccaaacgtataaacgagtatgagatagataactaaaaaagtcccgcctccatatttcgcagctaaatatggaaaacgccagatatttcccaaaccaacagcagaacctgctgctgccattacataaccaattcggctagaaaaatttgctctgcctttattttcctttccttgttccaatctttagatccatccttcctatctctaatgttctgactgccaagcagttcgaatcgcctcttcatattttggatatttgcgcataaaaatccgaatgtccctcatggtattgctaaccaaacgatccatattgtaaaatgtttgaccaaatgcaaaattttgctttgcagaatctagatttttgaaaaccaacttcgagaaatctttttgcgttatttctttgtcttgaacatcgttcacagcgcgttcataagctttagcatcaaaagttgcaagcatgtgcatgcgttcattgaaaactaaatgaaagatcatcacaacattatttgccaagtcagcagaatcgccgtcgttttcaacaatttcttcaatttttttccaatgaagttgaatcattttttcaagcgattccacatccgatttttgatacaaatttttcatagcttgaatttgcttttttgtcgctttaatcataatcacctcaatttgtattatcactgaacttatattatatacaaaaaaatcccgcttttccagtaagaaaagcaggacaatcaattttattgatttaaattagacaaggccctgagccatcattgcgtcgacaactttttcaaatcccgcgatatttgctccaacaacgaaattaccttcgtgatcatatcgttttgcagcatccgataccttagcgtagatattaaccataatatcctttaatttcgcgtcaacttcttcgaaggaccagctcaaacgttcgctattctgtgtcatttccagtgcagaagttgctacgccgccagcatttgctgccttaccaggcatgaacaatacgccattttcctgcaaatactgtgttgcttcaatagttgtcggcatgtttgcaccttcagcaaccaaacaaacaccattcgctaccaattgtttcgcgtcttcaagacccaattcattttgtgttgcgcaaggaagtgcaatgtcacacggaatgctccagattcctgttccatcatgatactgagcagaagcaacctgatctgcatattctttaattctgccacgctgcacttctttgatatctttaacgatatccaactgaatgccttctggatcataaacatatcctgtagagtcacacattgcaacgacttttgcgcctaactgctgtgctttttctgttgcgtaaatggcgacatttccagacccagaaatcacgactgttttgccttctaagctgtcattaacatgttttaacatttcttcgacaatatatacaacaccatatcctgttgcttctgttctcgcaagagaaccaccccaggttaatcctttgcctgttaaaacaccttcatacagcccggtaattcttttatactgaccgtataaaaatccaatttcacgtccgcctacgccaatatcaccagccggtacatcttgatcagcaccaatgtatttgtataattctgtcataaagctttggcagaagcgcatgacttcagcatctgatttgcccttcggatcaaagtcagaaccgcctttgccaccgccaattgggagaccagttaatgaattcttgaatacttgttcaaatcctaaaaatttcaagatcccctggttaacagttgggtggaaacgcagcccgcctttgtacggtccgatagcagagttaaattgaacccgaaaacctttgttaacttgcacttgaccttgatcatcaatccaaggcacgcggaaagaaataacacgttctggttcagttaatctttccaataaagcagcctttctgaattcatcttcgtgtttttctatcacaggagcaagagattctaagacttcctttactgcttgatgaaattcaggttcactcggattctttttaacaacccgttcatacacttcgtcaacatatgacattatttgtacctcctaaaaaacaactatatgataataaaataccataattattatagtctaagggaataaccctatgcaagatttttttaccccatacgttgattcatttcatccattgcctgattcactaattgatctgccctgttattatattggtcgttggcatgtcctttgaccttaataaaggaaacacgatgtgttttcgttaagctgtacaacgtcttccacaaatcggcattttttaattctgcatttttgcctcttgtccatccttttttagcccagccatcgacccaatgctgattaaacgcgttaactacataagctgagtcagaataaagtgcaacttcacaaggttccttcaacattttaagacctgtaatggctgctagtaattccattttattatttgttgtatttgtaaaaccttgtttaaactccttgtgataatctccgtatatcaagattcccccaataccaccgacgttttctttggattggccgttacctcgacagccaccatctgtatatatttggacctttttcattttctctctacgatatattaaaaggggattattttttaataatcccccttaactgatatgatttattttacgacaatattataaattttcccaggtctgtatatttcttttacaatttgtttgttttcgacaaatttattaatattttcgttttggagtgccatattgtgggctgtttcttgatctgcatcaatggcgatctgaattttacctctgaccttgccattaatctgaaccgctatttcgatcacattgtctatggttttttcttcatcaaaagtaggccatgaagcttggtgcagcattcccggttgaccgatgattttccaaagctcttctgttatatgtggtgcgactggatataacagtttgaggaaatcaccgaattcagccttggtaacttttccgacttcagtaaagcggttaagcagtgtcatcaatgcagcaatcgctgtattgaatttcatcgcttcataatcttcgctaacctttttgatcgttttgtgcatatcgctttcgagcacatcactgtattcattcttgtcaacgacagcatcttgaagtcgccaaactctttccaaaaagcgattgcatcctttaaggccattttcggaccaaggcgctggtttttcataatcgccgatgaacataatatacgttcttaaagcatctgctccgtattcattgataatatcattgggattgacaacatttccctttgatttactcattttttccccatctgatcccaagatcaaaccttgcgctgtacgctttttgtagggttcttttgttgggacagcgccgatatcgtaaaggaactgatgccaaaaacgtgagtacagcaaatgtctcgtcacgtgttccattccgccattataccaatctactggcagccaatacttcattttatccatatcagctaaggcttctgtgttatgtggatctgtgtatctcaggaaataccagcttgatcccgcccattgcggcatagtgtctgtttctctttttgctgggccaccgcaaattggacaggttgtattaacccattcaggaatatcagctaatggcgattctcccgtgtctgtcggttcataatgtgtcactttcggaagttcaaccggcaaatcttcttcaggaactggtacagtaccacaatgatcgcaataaacaattggaattggttcaccccaataacgctgacgattaaaagcccaatttttcattttataattaatcgtctctttcccgatatgatgttcttccaaatattgaatcatagtcgggatagcttctttgacttccaacccatttaggaattctgaattgactaatgtgcctgaactcacatccgtaaacgcttcttcctgaacattaccgccactgatgacttcaataataggaaggtcaaattttttcgcaaaatcccagtctcttgtatcatgcgccggaacagccataattgcgccagttccataccccatcatgacataatccgcgacaaaaataggaatttctttaccagatacaggattaacagcggtaatgccgtcaatttttactcctgttttatccttcactaactgaactctttcaaattctgttttgtgctgtgcttcttttttataatcgagaatttcatccatattcttaatttcagatgataattcttcgataatcggatgttcaggtgcaataaccataaacgtcacaccaaacaaagtatcagcccgcgtcgtaaaaacctttaatttttcgtcatgatttttaattgcaaaatctatttcagcgccaatcgatttaccaatccagtttttctgttcaattttaatgcgcggcagataatcgacatcatccagcccctttaataatttttctgcgtagtctctgatctttaaaaaccacacatctttttccatttggattacatcgctgccgcaacggtcgcattttccatctctaaaatcttcattagataagacgaccttgcagtgcgtacagaaattaacataagtatgatctttgtacgccagaccgtgcttatacatttgcaaaaatatccattgcgtccacttaaaatagtccggatctgttgtatcgattacgcgatcccaatcgaatgaataaccaattgatttcaattgctgagtgaagactttaatatttcgatccgtaacctttctcggatgctgtcctgttttgatagcataattttccgtcggcagtccgtaggcgtcaaatccaattggaaacaaaacattatagccctgcattctgcgttttctggcaataacttccaatgatgtatacgcgcggacatgacctacatgcaaaccgacgccacttgggtatggaaattccactaatccataaaatttgggcttgtcaaaattatcttccgctttaaaagcttctgtattctcccaaattttttgccattttttttcaaccttttcgtgattatatttttccattggaacctccataatatgatctctttcgttcctttattatagacatcgcaattatttgtgtcaaaccgagtaaaaccaacttatagaatttttttcttctttctgctatcatatttacctatattagaaaagaggatatcaatgttattaaatgcagatcatatatgtttcggatacggcgaacatcaaatatttaatgatttaaccttttccgtttctgaacatcaaaaactaggcctaattggacaaaatggctccggtaaaacgactctttttaagttaataactcacgaactttcccccgattctgggaatatttattatcattcctccattcaaattggttatttgaaacaggaacaaatcttcaattctgatttaacacttcatgaagtctttttatcttatttccaatcgctaattgaattagagcaagaaatgaatcagcttcaaaaaacgattgattgtactgatggtgaagaacaggaaagcgcagttcttaaattaggagaattacaggaaacatacaaaaataatggcgggtatgcctaccccagccgcattagaggtgtagttgcaggactcggtttcaatgatgatgatttgaaacgaaaaattaataccttcagcagcggacagagaacgagaattgcgctaggttccttactcttacaagaacctgatcttttactattagatgaacccactaactatttggatattcgctcattaaactggttagaaagttatctaaaaaactacccaaatacatttattgttatctctcacgatcgataccttttagattgtgtatgtacatccatttcggaaattcgaaatgaaaagcttcttcattttgaaggaaattatacatcttatctttcaaaaaagaaaaaacacgatcaggcggaacaaaaaaaatatgaacaaattcaaaaggaaattgatcgcgaagaggccattatttcaaaactaaggggcaattttacaactaaaaatacaaaacgcgcaaagagtcgtgaaaaaaagctcgcgaaaataagaagcgactattcaaactcacattctccttcagaaaatcatgagtttcatttttcattatcgcccagcgtccgctcgtctgatgatgtgttgaaaattaagcacttatccaagtctttcgatcaattatcactatattcagacttaaatatagatgtttttcgaggcgaccgcattgggataatcggacctaatggcactgggaaatcaacgcttctaaaaataataaaaagagaattgttgcctgatactggcagacttatattcggagagaatgtacatattggatattattctcaagaagcagacgacacattatccaatcattctgaaacactcattgatgctcttcgtactgttaatattaagctatctgacggagaaattcgaaatatcttagcacaatttatgtttagaaacgacgaggtttttaagaccgtaaatgaactatcaggtggtgaaaaatcgcgccttcgcttagctatgcttatgatctcacaggctaatctgcttcttttagatgaaccgacaaatcacattgatatggatacaaaggaaatacttgaaaatgccctgttgaattatgaaggaacgattattacggtttctcatgaccgatactttctcaacaaaattgcgactcgaattttgtccatttcaccggatcagattttggatattcctgggaattacgacgattatctaatgtattgttcaactcatcagaacacacaagaaaaaaagtcctcaccagttcatactgagaaacagcagaataataaaaatcaacacgcgattcaaaagcaaattagaaatcagaaaaaagaattacaaaaaattgaagatcaaattgatatgctgtctgatcaagtcaagcaaattgaatcggaaatgaatcaacctcaattttacgataatcaaaagactgctgaccaaaaaattgaagcctattcacaattaaaaaagcaaatatcgaaattaactgaccaatgggaagatttagcattaaaattagatagaatctaaataaattattagcttgtctcagttttgaaaaaatattattataaaataaaaatttggagatttcaccgatatgttaaatttaactaaagaagaaaaaaagatattaaatacattatttaaagatgtccgttataccactagaaatcagatgatttatgtgctgtatgcagcaaagccggaacccactactccagatgctaagtacatcaacttagttattaatcctttaattaaaaaaatataccacgcggatcgaaaagatatggaagaggtctttgaagcaattccctttgatgtggattaaaatttcattcaatacgtattaaaagctgctattgtaataatttgcaatagcagcttttttatttaaactaaatcaaaaaagtgattttgccgtaatgcttcgtacaaaacgatattgacagaatttgctagattcagtgatctggcttcaggatgatcccgcatcggtattctaaatcgcctatcataaaagcgcttatgaatgtcatctggcaatccagccgtttctcttccaaacataaggaaatcgttatcgtgaaattttatatccgcataattttttgttgcatgagttgttaaaatatatggctgtggataattatttttttctaaaaatgtctcaaaatcaacatatactgaaatatcaactaagttccaataatccaagcctgctctttttacagctttatcactaattgaaaatccaaggggttcgattagatgcagctttgtttctgtgagcgcacaagtccttgctatattgccggtattttgtggaatttctggttcataaagaacaacatttaacataataataaaatagcctttctatcgatcactacaatgcgtattttggaagaataattgtaaatgtacttcccttccccaattcagaatctattgttatttttccgccatgctgcttgactattaaatcgcaaatatttaatcccaagccaaaaccaccctgttctcggtgcctggcatcgtcaactcgataaaagcgttcaaaaattttctttttgtcttcctcagacaagcccacgccagtatctgtcactgcaatttgaatagagcgcatggctgctgtcaatttaatcgataccgttcctggcgcagtcgtatactttatagcgttatcgactaaaatccgtatggcttgtttaagcttgtcttcatcgcctttatattcaatgtcttgctggatatcgctttttaatgtaattttctgctgatttgcaaaatcaaacattaaatcgtacacttccgcacataatgcactcaaatcaaacacttttttattaaatacaagtcgattattgtccgcctgtgcaatggtcagtaaatttgagatcaattttgacatggtctcactttcggatgcaatattattaagccaatggatattttcagataatacttcatcttccttcatccgcagcacttcaatgtttgtttgaattaccgttaaaggtgtccgcaattcgtgagaagcatcagcaataaattttttctgattttcgtaggattttttaacaggctgaagcgattttccagctaaaaaataactgataggaattaatattaaaatccctgcggagccaaaaaacaacaaaataacaaatacggtctgcgtaaaattttgttcattgctgatttgttggaaaatttgcagcgttttgacttcattatctttcttaaatcgttttgaataaacacgatatgtaatatgattagtttcaaacgtacgaaatgttttattaaacttcgtgtcttgaagaagttcatgccctctgagtatcagagaatcgttaaaaactttcatatgttcagaatgatgatctccatcccatagtataaactcataattgctggcacgaccatcataattcgtgttttttcttgtttcgtatttttcgctgttaataatattctgggctgtttggactaaaaaacgttcactgaaattaacatacgtccatctccacataaacatgagaagtgcaataaaaaaaactaaaaagacaattaaaattaatatattaaaaagcgtgatctgctttttaatttctctaaacattgacgtctcctacagccttattaacgcttgcccatcgtatatccaacgcctcgaatggtgtcaatttttacatttgtatccgccaatttctttctcaagttatggacataaatttcgatgttattttcattcacttctttatcaaatccccagacacggtctaaaatttgttctctcgtgaaaacttgatttggacgtttgatcagcatttccaaaatttttgattcttttacagataatttgtattcatttgatttcgtaatcaaagtatttttctttgtattaaacgaaacatcttcgaaatcaatgcattccccttttatttcattgtcaggtcttctgctcaaagcacgaattcttgcaaaaagttcctttgcagaaaaaggtttgaccaaataatcatctgcgcctaaatcaagacccttgactttatcatcaacagtgccttttgctgtcaacagcaaaataggtgttgtaatgtcatgatctcgcacatcttttaatatttccaaaccattttttccgggcagcatgatgtctaaaacgatcacatcataaatcggatttaatgcaaagaggagcccttcttcgccgtcatttgcaatgtcacaatctatattttggattcgacacaattcttttaatgcatctgttattttcttttcatcttctataaataaaattcgcattataatcacctcatacaattttatgaacgattatatctattctgtcttaattctgtttgaatggataatacacattttttatctaatccgttgccctatcaatctttcttacatacataaaaaagccagcagattattctgctggcgtaaaacgaagtttcaatcaaaattatgcattctgtttaattgctgcttgtgctgcggcaagtcttgcaattggaactctaaacggtgagcaagaaacataatccagacctaatgaattacagaattcaacagatgtcgggtcgccgccgtgttcgccgcaaataccgcaatggagatcagcgcgagtttctttaccttttttgactgccatcttcatcagctgaccaacaccatcttgatcgagtcttgagaatgggtcattttcataaatcttatggtcataatatgaactcaggaatttacccgcgtcatcacgtgagaacccaaatgtcatctgagtcaagtcattggtcccgaagcagaagaattcagcttcttttgcaatttcgtcagcagttaagcaggcacgcggaatttcaatcattgtcccaaccttatactgcatgtcagaaccggctgcctttaattcagcatctgctgtcttaacgacaatatctttgacgaatttcatttctttgacttcgccgaccaaaggaatcatgatttccggaacaattgtccattccggatgtgctttctgaacattcaatgccgcacggatgactgcttttgtttgcatgacaccaatttctggatatgtaactgtcagacggcatccacggtggcccatcattgggttgaattcgtgtaaactgctgatgatcgctttgatctgttcaacggttttgccctttgcgtccgcaaccttttgaatttcttcttctgttgtcggaacaaattcatgcaatggtggatctaagaaacgaatggttactggacggccagccaaagtttcgaataatttttcaaagtcaccctgctgcagcggcagaatcttatcaagagcttcttctctttcttcaacagtatcagagcaaatcatttctctaaatgcatcgatacgatcgccctggaagaacatatgttcagtacggcagagaccaataccttctgcacctaattcaacagcctttgctgcatcttcaggtgtatccgcattagttctaacctgcatggttctaaattcatctgcccattccataatggtagcaaaatcttcatcatcgatagaaccttcttgaacatctaacggtccatcgtagatattccctgtcgagccgtcgaaagaaatcacatcgccttctgagtaggtgtggccacccaacttaaatgtgcgattagcttcatccatttcaattgcagagcatcctgcgacacagcagctgcccataccacgagcaacaacagcagcgtgagatgtcataccgccgcgagcggtcaggatcccttgtgcagccttcatcccttcgatgtcttccggtgaagtttcgaggcggaccaaaacaaccttttcgccatcagcagctgcttctttagcatcttctgcagtaaagacgattttaccacttgcagcaccaggtgcagctgggaggcctttaccaatcagttctgctttatctaattcagacttaacgaatgaaccgtggagcaaggtatccaggtttctcggttcaacgtcgaggacagcctttttcttatcgattttgccttctttaactaagtcattggcaatcttcaaagcggcttttgctgttctcttaccgttacgggtctggagcataaataatttaccttcttcaatggtaaattccatgtcctgcatatcacggtaatgatcttccagcgtatttgcaatgctgagaagctgatcatagatttttggcaatttttctttgattgcatcaatcttcattggtgtacgaacaccagcaacaacgtcttcgccttgtgcgttcatcaaaacttcggcgtagaatttgttttcccctgttgcaggatctcgcgtaaaggcaacacctgaaccggaagattcacccatgttaccaaagaccatttcctgaacgtttacagcggtcccccatgaatatggaatatcgttgtcgcggcgatagacattagctctcggattatcccatgaacggaatacggctttgaccgcttcaattaattgtgtttctggatcttctgggaaatcttgtccaagctgttttttgtattcagccttgaactggtttgcgagttctttcagatcgtcagcattcaagtcgacatcctgtttgacaccgcgatctgccttcattttatcgatcagggtttcgaagtatttcttcccaacttccataaccacgtctgagaacatctgaataaatcttctatagcagtcccatgcccaacgtggatttcccgattttgctgcaatcgcttctacaacatcttcgttcagccctaagtttaagatggtatccatcatcccaggcattgatgctctcgcacctgaacgaacagaaaccaataatggattttccttatcaccgaatttcttgccggtaatttcttccagcttcttcatataatctttgatttgtccgatgatttcatcattgatttgtttaccatcttcataatactgtgtacatgcttctgtcgtgattgtaaatccctgtggaaccggcagacctaaattagtcatttctgcaaggtttgcgcctttaccaccgagaagttcacgcatgttagcattaccttcggtaaataaatacacccatttactcataaattaacctcctaaatcctaatcgtgattaactcatataaggtttaaattttctagacattagtataccattaaattttttgaaaaaaaaccaaaatatggaaaaaataaacatgtatttatattttttgagaaaaccagtcttttccgttataaaccatcactgtatcttgcccattttgggataaatagcgaagtgattcgttgattaaaaaatccatcgcttctgggcaatgtgcgtctgtattgacggttagcggaatgtgcatttgaatcgcttctttcaaaatggcttcgctcggatacatacagcgcataccgtatcgaaaggcgcctccagtatttatttctaatatagatccagccttttttattttttctaatgcatgatgccatgcggtttgataccattctgctgattcatcaaaaaagtaagactctttattgttctttttgatgatatcgatgtgtccgataatatcgggatggagactctctgccatttcaccgattccctcgtaatactgacaaacggcttttttgctgtctccaccatagagttgatcgattcccctttttaaactttccttcgtatcatctatatatgcgacttctccgtcattaattacgcccagacaatgaatgctacctatccaataatccaatttttttaaataatttttgcataacggtgaaagatcatgacttgccaaataataatcaatttctaagcccttataaacctttatttgcgtctgatattttttgataactcgttctaattcattgaaatattgcggcaatgcgttctcaggcatcgtccaatcattttgatactttaacggtgcgtgactagaaataccaatattatcaaaatctctagaaatagcagcttgaaccatctcttcaattgaattttttccgtcacaataatttgtgtgaatgtgataatttgtctttttcattttctatttcactaaaaaagactatctcctttcaattaaatttataaagaagacagtcttaatttgtttgaataaagcttacaaaatttttttcaaaaagctctgcgttctttcttcttgcggatggtcaatcacctgttcaggtgtcccttcttcgcagatgacgccattgtccataaaaataacacgatctgccacttcacgcgcgaatccaatttcatgcgtcacgatgatcatcgtcattccatcgtcggcaagctgacgcatagttcctaagacatctccaactagttccgggtctaaagctgaagtcggttcatcaaacagcatgattttaggattcatggccaatgctcttgcaatggcgacgcgctgctgctgaccaccagacaggcggactggatattcgtaagcccgatcttttaaaccgaccatatccagcagttcaagcccacgttttgtgatctcttctttatttgcctttaaaaccgtaatcggcgcaactgttacattttcgataacatttaaatgcggaaacagattgaaattttgaaataccattcccaaatcgcagcgaagctgctgaagacgatctgcattgatgtgattaatcgttttgttattcttgcgcttatccatcaattcgccttcaatgtatatttcaccatcggtaatgcgttcaagctgatttaaacagcgcagcatagtacttttcccagagccggatggtccgagaatacatacaacttcgccacgattgactttaaagttaacaccttttaagacttttaaatcgccgaaatatttcgtaatattacgaacttcgaccatcgtttcactattggtttgatttgttgtagccatctcttacctcttttcatacgcgccgaaacgtttttccagatggtcgaaaagcacctgcagaattgtcgttaagaacaagtatattgccgccgcatataaataatagacccaattccctgttgacgtggccattgttttaactgttctcaaaacatcaaaaagagcaatcgttgaaaccaatgacgtatctttcaataacatgatcaattcgttacccagcggtgccacaaggcgtttgaacgtctgtgggatgatgattttccgcattgcttgatgatagttcatcccaagagcctttgccgcctccatttgcccttctggaatagattctatcgctgcacgaataatttctgccatatatgcggttgaattcagagaaaatgtaataaaagcgcacagcatcggatctacaaccaatgtacttcccgttacatttaaataaatgattggaactgcaaaataaatcataaatagctgcagcagcaatggtgttccacggaaaaaccaaacgtaaaaccatgtgattgcttttgcaactttgttgtgggaaatacgtcctaacgcaacaatgatacctaataccacaccaaagaaaagtgcgaccaaggcaatttcaatggtcaaaattgtgccatgaaaaatttcccatccttgagctgaagttaacaaataaaactcctcacttcctaattaattaaaaaacaataatgaacggtataattatacgatacacatttttgattatcaacttaaaattttattataagagccgtatttatggttaaatccgcgctctttatatcaaataacgcaattgaattatttaaacattattatcaccttattctctaattttgtatctctaatatctttaaaaaagagactgccctcttgtggaagacagcctctttgctaaaatcattttttatccttcttgtttttataattataacataggattaaatatttaggactatttttgaataaacttttataaaaagaaaaagcaccgaatctctaaaagaattcggtgcgattttacaatggtgatccatcggggatttgaaccccggacaccctgattaaaagtcagatgctctaccaactgagctaatggatcagattcgttatggcaggggtagcaggagtcgaacctgcgaattccagagtcaaagtctggtgccttaaccacttggccatacccctaaataaaaaaatggggtggatgaagggactcgaacccccgacaaccagaaccacaatctggcgctctaccaactgaactacatccaccacaagcaaatggcgcgccaacagggattcgaaccccgggcacacggcttagaaggccgttgctctatccaactgagctattggcgctcgtgcctcaaccataatgactttctggagcgggtgaagggaatcggaccctcgcgactggcttggaaggccagggctctaccactgagctacacccgcaatttcacattgcgaaatacttctgcaacagaacgaaattaattataagtgaaatttcttgctttgtcaatacccttttatacattttttattatattgaaatgatgggcagcggcaacctacttaataagctgccgctatacaaatcaacacttattcactaatacccttaaccgaatcacgaactttaacttcataaggaacgtacaaagttttcatttcggtttcttctttttcacacattttaatcagcatacgtgtcgcaactgcgcctatatcatacatcggctgagaaatggtcgtaattttgggagtgacccattcagacatccaaaaatcgttaaagccagctactgaataatccttaggtacgttgtagcctttttcttcgattgcacggattgcacccaacgccatttgatcattaaaacagaacacatttgaaaaagaaacttctcccttttccaaaatatctttcatttggttatacccgcctgaaatagatgagagacaatgataaattcggtctggattaaattctagtcccttttctttgtatgctttctggatcccttcaaggcgttgttcaacaatataaccactgccactttcatcactgaagataatattgtcgcgatgtccagcatcaatcacctttacagccaaatcataagctgcagaagcattgtcaatcaatacaccagaaagttttccagttacgtcgggcacacagcctaaaaccacttcacaggaggcagatgttaatcgatctctcatttcatctgtcagatttttcccaacataaataatcccatcacattgtttttcaactaaaacgtcgagtgattttttttctttttccggattaaagtctgtgtcacttaaaataatattgtaattatatatgccgcagacatcttctgctcctcggacaatccaggtataaaatggatccaaaatatctgggatcatgatacctaaagtattcgttttttgaatttttaagcttcgcgcaatcgcattaggtttataccccgtttttttaatggcctttaaaactctttctcgagtttcttcattgaccaaagggatattattgacgacacgcgaaacggttgcgacagaaacattcgcttctttcgcaacatcaacaatttttactttcatgagctttctccacttgcttaatgattaatcaaatttatcaattgctgctttaattaatgcaggagctctaccgcatttttcttcattaactgcacatggtgcaaatcgaagacctttcttcaatgcaacaataaagaaattcttctggtcagctaaataatctctaatcgcttctcgattttcacatggaatagaaatgaagaaaccgtcgcgatatgtacatgtttttaatccaacttccttcgcagaatccataaacgctttagcacgagtctgaagcgtatttctccagtctgcttgttcagcttcatatgcttctctcaattgatcgttagaaataatctttgccaatgtcgcttgcgctgatctcgtcccatttgaccaggtgcctcgatttgagaaggaacaagaagctttaaattcatctgcaatttcctgagtcggtgctacgcacaaaagtgcgccgtttcttaaaccgtacattgtcatcgctttagaagcagaatatgcgtaaagcggcagaacattttccggcattccggagaggatttccatgaactggcgggcactttcacccttccctgcaaaatcgatataagcaatatcacaaagaacgataatacgccaatctggatgttcatttgctgttttggtgtaaaattcaaccagctgtttccattcatcgtcagaaatattatatcctgttggattgtgcgccggcgtatttaatatcgttaagatccgtttttgcttttcgagaagttctaaaactttattttcataagatttaaaattaaaattgccattttcgtcaaaaagctcaaacgttgtgatctttctgcggttttcttgagcgattgtgccatacggtgcccaatgccaatcctgaactaaaacttcatcgccaatttcactataattggcgatcgcatttcggactgcgcctgtaccacctggtgttgcgaccgcttcaatgtagccgtctggtttatgatgtttaaagcaggcatagacaacattttccaaaaattcaggaatacctgcaatgcttgcatatgcagcaatttcagtatcctttaaattgcggaaggttgaatagacgctatcgaatgcaactaaattaccatcatcgtccattaacgaaccgattgtcgaattgattacaggttcatgacctacttcggcaattcttttctttgccagttccgcaatatgaaaaatcggatcgttgccagcttctctaaccgatgatgaaatgaccattctattactcataagttcctccatttatttgattgtcaattatgtatttacgaaataatttaggaccgttgtcgtaaatattatttccttttgcatctattgcgacaaaaattggaaaatctttaacttccaattttctgaccgcttctgttcctaattccggatacgcaatgatttctgaatgctgaatatgtcgtgcacaaagggttccggttcctcccacacacgcgaaatatacagctgaattttttcggatactgtcaataacaggagaggtacggtttccttttcctatcataccctttaagcctaaatccaacagcttaggcgtgtatttatccattctatgcgaagttgtcggccccgccggtccgatcacctctccaggtgccgcagggcaaggacccatgtaaaaaataatttgtccatttatatcgaaaggcagtggattgtgatcggcaagatcttcaagcatctgtttgtgagcagcatctctcgcagtgtaaatcgttccagataagaggacctgctcgccgcagaccaaatctttgataacatcatctgtaattggtgttctgattttcttcatctacaagatcaccgttcctctccgatcaacataacagcagatattaacagcaacgggaagcccagcaatatgtgttggataatcgagaatgtgtatgccgagcatcgtcgtcatccctcccattcccatgggaccaattcccgtttcattaatcgtctgcataatagccttttccatggaccgcaaatgtggtttttcactatgttgatccagcggaatcaacaatgcctgttttgacatgattgcggccttctcaaaatcacccccgacgccaacgccaacaataatcggcgcacaagcatttggcgctccgttttgtatcgttttaacaataaaatcctgagcgccatctatgccatcagatggcttgagcatttttagagcactggtgttttcactgccaaaacctttagccataaccgaaattttgagattgtctccttcagtaatctgataatgaataacagccggtgtattgtcgtttgtattttcgtcccgaattaacggatccgatacaatcgactttctcatatagccttgacaatacccttttttaacgccagcttgaatcgcattttcaaggctgccgccctcaatatgtatctcttggccatactgaacaaacacaaccgccatacctgtgtcttgacaaataggccgctggcagtttaacgcgagttcccggttctcattgatcacagacaatatattttcagctaagggataagattccttttgctgtgcctttttaagggaatgatcaatatcgtctgccaacttcgcattaatcttaatacacagttgggcgattgcttctgtaatatcttttgcctgaatatttttcacagtatttcatttgatcctttcaaaagattttacattaatattatagcatagctttaaaggctttcattcggttttttgaaaatttttcatcttttttatcgtgatgaaaatttattattacataaaaaaagactgcgtcatccaacgcagtctgagtacacatcacgattcgtgatccgcaccgctccacttcaacaattcataatagttcggatatgtatctttctgaaaaatttcaccatcaacaacagtaactggaaaagcatctggcccatctgtcagcagcacacgctctaccggcccgtttgtgtattgagattgatcttgtgaaaaattccgcaaatgaatatcaatgccttgacgtttcaaatctttaacaatcacttgaatagctaatgcctgttgagattttaaatcaacatcaatgggattataaatatttattgtacacatctgaccaaccccttcgtataatctactgataatttaacataattttattaaaattgcttggtatttttttgtcacatcttttcactattatttcaatagacacgattgcacacaaaatctgccatctgaatataaaatgaagtatcaatagaaagatttgacaaagcttctattgcagtacgatgatactcttctactttttcctgagcgctttttaacccatagagagaaaccattgtggttttatgttcttcctgatcgctgcccacaggttttccaagcacctccgtatctgatgtgacatcgagtatatcgtcaacaatttgaaaagccgttccaattgcttctccgtattgtcgcatccattctaaagactctgaatctgtatttgccattacagcaccgcaaagcaatgccgctgttaacatcgcacccgttttatgagagtggatatactttaatttttctgcattcatttcatcatcgtcttcagctaacacatcaccaacttgtccaccaatcataccgcctacacccgaagcctgcattaatattttcaaagcctgaatgccattgccctgctgctgagcaggcaatctctgcaatccgtcaactgccgtttctaccgcgtaattaagcaaggcatctcccgctaatatagcgatatcttcgccataaactttatgattagaaggctgccccctgcgcaggtcatcgtcatccatcgccggcaaatcatcatggatcaaagaatatgtgtgaatcatttcaatggcacacgacaaagcgcgggcattttcgacgtcgcctccgaataattcacaagtcttccgcatgagcactggccgtattcttttccccccagcaaataaactgtatttcatggctgagacgataatagcaggcgcatcaaatggtttttcaaagcaaacgagcaaatcgttttcgacgtcctttgccattgtttctaaagtgtttttaaagtcttgattcatgagattcctccaaatctttttctgttatttcttctaattcagaatgaccggactgatcttttgttaataacgcaattttcccttctgctgactttagatcattttcgcatttttttaatagagtcattccctcttcgtaaagtttaacagatttttcaagactaagctgatcgctgttcatttctgctacaatttcttctagtcttgacattttttcatcaaatgttttctttcgtgccatgtttattctctctttcctgatcgagccgcacactcacttcgccatcattaaatttgagcatcaattgatcaaactgagccgctttatctgccgtctcgacaaccgttctattgggtgaaaaaacaatcgcgtagccacgttccagtacctgatttggattgagcaagtgcaattgttttcgaataagctgagtctgtgtttgcgccgataatatttttttctgaatcaacaactgaaactgatgaaataattgattgagttgaatattttgtgccttgattttctttcttggattgttgatcccaatcattctttgataatactgtatctgtttgcgatggttttgaatttgtcggttaaatgcatactcaatatcgtttcctatctgtgtaatttttttaatttgataggttcgatcttccgcaactaattcgccagcagctgttggcgtggctgcacgaatatcagccacaagatcagcaatggttatatctgtttcgtgcccaaccgcagagataataggcttcgctgcgttgtaaatcgcatctgcgacttttctttcattaaatgcccaaagatcttcaattgatccgccgcctctgcccacaataattacatcaatatcatctctttgattcagacagcggattccctctgcaatttcctcagctgcattttctccctgtactttagacgggaaaaaaataatattaatgctggcatttctcctccgaatagtagaaaggatatcatgaacggccgctccttttccagaagttacaacgcccactgtatgaatatttggaggtagtcttttttttcgtttagaatcaaaatagcccagcttttctaactgatttcttagtttttgcagcgatataaataattccccgataccagccggttccatcgagcttatgtataattgatactgcccgtttttttcgtaaacgtcaatggacccatggcaaatcacgtgcatgccgtctgccggcatgaaagaaagatgcgcagcttgataagaaaacataacacaggaaattctgctttcttcatctttcaatgaaaagtacaaatgaccactgtaatatgccttgaaattagaaacttcaccttcaatatcaacatttttcagcagactattcgtggaaatcacactttttacaaagtggtttacctgtgtaacgcttaagtgtctgcgaatcaattgatcttctcctgttgattgaacatttcctttgttaataaagcgcaccctacgccgttatccgtggcatattgtggtttggcaaatatagcacggtattgacgtttcattcgctttcgtatcgtttcttttacaatgcgattggccatcacaccccctgaaaacacagcaacttttatttcgaattgctcgcacaaaacattgatagcacgaccgatggttctgccgatacattcaaataaagcgtatgcaatttccgagaatggcaccccatcgtcaattagttgatgaatctgattttcctgaccagaaaagtgaaaatcacatccctcaagccgcgaagcgattttaatttcgtgttgattagacgtcaatgccagtttttccaattctttacctgcaggaaaagaacagcccattgtgacaccaattcgatcaatcaattgtcctgcatttaaatccaacgtctttccgacaatccgattggtgtggttctgcgggtcaactaccacaatttcagaggtgcctccagataaatgaactgctaaaaagggcttgtttaatttttcgcaagcatcttcattttcaattaacgctgctcggatatgaccttcctgatggctgaaacaatatagtgggacctgtaacaaatcggcatatgatttggcaacagcgtatcccacacggaaaactggcatatatgacccttcttgaggtcttggtgaaaccgaaacgccaaccgccctgacgttatttttcatctctggaattgacgcaaaacgtgccgtcagttctggaatattgcggatatgttcaaaaacagcttcagactgccgcaatcctctctgcccttttttaactggcaaaacttttcgttgatcagctatgatcccatttcgcgtatccacaaccgctacagatgacgtataattacttgtatcaattcctataaacatagattgcctcagtcagctaatttttatttgaaaaatgtttacccaaattattcaatatgccattgatataacgatatgatttttcatcacaatactttttagccaattccacagcctcattcactgcaatttcaattggcagacctaaatacatcatttctgccgcgccaatgcgcatagcagcaagttcagcgcttggaatgcgatcaaagcgccaatcttctcgaagatatttttcgatttcagaatcaattgtctctaaattgtcaataaccgtttctactaataaatgggcatacgtgtattggtcgtgctgaaaatcttcttttggatctgcaaaaccagcgccattatccaatgtggcgataatttttgcctttaaatcagattgtccgcgatcttcaaatccaatttgaaaaactgcccgataagcaagctctctttcaaatttacgtttttctttattcatttttctccgttaaaaaagccgcttactagcggcttcatttgtttatttaatattttccgcagcctttaaccagaatgttcacttgtgagaccggtttgcccgccataatttctacagactccttaacctttttttgtacttcttcacaaacttctggaatttttatgccaaggcttgtaatgacatgaagatcgatttgatagccatcttctttttcaataactttaacacctttagaaacagccgaagggtaaatagcatcgagtatttcatcagaaatacgcataaacattttttcgatcccatcaatacccaaagctgccatacttgcaatcgaacatatcatttcatttgatatgtcgtttgaagctgtattgatattttcttccatttacatacctcttttcaatgatgatgttcgtcatgatcctgaagtttttcaagggtggcatcgtctaaatgaaattgactttcacactgaggacatatgacgcgatcctcagcgaaatcttcaaaatttgcaatgaaggtatgtccgcaattcgcacaggtgacttcgtaataatcatcttcttcatcatgatgacacgcttccaccgtgttttccaactcagcgacccgacgctctaaatcatctatacgctttgccagttcttcaatcgctgtttttgtatgatcgtccattaaacacgttccatgtattcgccagtccgtgtgtcgacacgaatggtatccccttcgttaacaaacaagggaaccgtaatctgggcgcccgtttcaactgtacacggtttgtttgcccctgtcgcagtatctcctttaaaacccggttcggtttgtgtgactttcaatgtcacgaagttcggtgccttgacttcaaaaggttcgcccttaaagaatcgaatggtcgcattgtcgttttcttttaagtactgtaaagcatctttcactttgtcgtattcgatcggaatctgttcataagattcgagatccatgaaataatacagatctccgtccgcataaagatactgcatttcttttgtatcaatatgggcacgttcaaatttttcatttggtgagaaagtggtttcagtgactgctccagaaatcacattgcggatctttgttctgacaaatgctgcacctttaccaggtttaacgtgctgaaattcgacaaccacataaacctgtccgtccattacaaatgtaacgccttttttaaattcacctgctgatatcatatccgttatacctccattatagaaaaacaattttctatttcgttctatattaataatgattatttagtattttatcacacctgatatttttgttcaatgacttaagcgcctgcaaactacccctctgtctaagcctgataagtcccggataactttttgaacgctgaaatcatatttttttgcaatacacgtaatcgcattgacttgattccaaccgcattcgcagataatcatgccgcccggtgtcaaataatcagaggcctttaaaaatatgctttgataaaaatccaatccagtttctccgccatcgagtgccatcttcggctcaaagtctttgacatctgaagataactcatcaatttcccgtgtcggaatataaggtggattggttacaatcaagtcgtataactcagagagatcctgaaacaaatcactctgaatcaacgagatgtctgttcggttcctttgtgcattcgcttttgctatttttaacgcatcaactgacaaatccgcaccggttactactgcttttttttcatagtacgcaatcgaaatgccaattgctcccgacccacagcacaaatctaggacgcgaaccttttgctgtggcattgtttttaaaacctgcagtgcattttctacaatattttcagtatcagggcgaggaatcaacacatccggtgtcacaataaaatctaagcccatgaattctttttttcccacaatttgagcgtaaggctgatgatggcttctttttagcagacattgatcgtaacgctttttttgttcttctgtcatttctaaattttgatcaataagcaaatgaatacgactcgtgtccagcacgtaggacagaaataactctgcttcaaaacgaggctcaggaattttgctttgtttcaagatctgtgttcctcggcgaagtgcctgttcatatgtttcacttttcattttattttaactacaattaaacaaaaaaataagccggtttaccgacttatttttcttcgttatttaatactttagcgtatttcttcttaaatctttcaactcgtccgccagaatcgactaatttctgtttacccgtatagaatggatgacaagctgagcaaatttcaacacgcagttccggttttgtggaaccagtttcaaaagtattgccacaagcgcattttacaatggccttaccatattttgggtggatgccttctttcatcgtattcacctctttctcattcgcatatttaagatcgaactttagctaaaattcaactgttttagtatatcaaaataaaattcgaaatgcaataacttttattgatttatttatacatttgccggttgtgatgagtgatgctgtgtccatgacattttaaaagaatgaacaaattcgcaagttgccacacctttgtcgactaatgaaacgatccagctttcagcatattttggcggtgtaactgttaccgggaacatgtgccttaaaatcatattttcttcttttttattaagatgataatctttttccgcattttttaatgcacgtttgggatgtgcaactgcatgcatatttcgaattcgatcaatgccgtgttcattgtgttccaccttgcgccaatcttcaaaataataatcgtgtaaaagcgcccctcttgctgttgacaaactatcgagatgcatttttctcgcaatgacataggcgtaataagcaacacggacacaatgtgcgtatcttcccaattcgttaccatgatggcgctgctgttttaatgtttggaattttgaatcgttgataatatcggatgtaatagaataaaattgattaaaatatttcttttcccgaatgcttttcatatagataaatattccacctcactaagattcgtttgaaactcattaagatatatttataatccatttttctgaaattagcattaatatttactaaaatttccaaaagaaaaaaagcaagcttaaaagcttgcttgatttgatcaaaaatggtggagatgaggggattcgaacccctgacctcgtaaatgcgaatcacgcgctctcccaactgagctacacccccattaataggtctttgactggcggagaaggtgggattcgaacccacgtgcccaataatggacaaccgcatttcgagtgcggctcgttatgacctcttcgatacttctccaaaaagattacgttatttattttaccattgttcttttttatgtcaagtcatatcttatagatattaatcgatttttttatttttttctgctatggaaatgtttataatgtgtttaacaagtcctaaggaggttaatttcatgatcaatcaacctatcggcattattggtgccggaaatatggcatcagccatcgcaaggggaattattgacaaaaaggctgttaccccttcatctgttcatatgtttgatcctgattcgacaaaactcgcagacctggccaatgaattaaatgttgttcctgagtccaataatattgccttggtgaaaaattcaaatattattatattagcagttaagcctaatatttatccgacggtcatcaaagaaatccgcgacgcagtcgatcaatcaaaaactattgttaccattgccgcaggacaaaaaatttctatcattgaaaatctttttggtaaacccatctcattggtccgagtcatgcccaatacaccggctcttgtcggcgaaggcatgtctgctctaacaccgaaccaattcatttctgaagaaaacaaaaaagaagttttaactttatttgaatgccttggaaaagcagaaattattcctgaaaaattaatggacgcggtgaccggcatttccggttcctcccctgcttttgtttttatgttcattgaagccatggcggacgctggtgttcaggccggcatgccgcggcagcaagcctatacatttgccgcacaagcggttctgggctctgcgaaaatggtgcttgattccggaaaacaccctggcgaattaaaagatatggtcacatcgccttctggtacgaccatagaaggcgttttgactttagaaaacaagggctttaggggcattgtttcacaagcggtaaaagacacgatagaaaaatctattgtaatgtcaaaagacgattaatcataaaaaggttattcccgctataatgtgggaataacctttttgattgattaaacattaaatttaaagaaggtcacatcgccatccttcatgacataatctttaccttctgttcgtgtcaatcccaattctcttgcttttgcctcgctgcccgcttcgattaaatcgtcatagctcgtgatttccgctttaataaatcctcgttccatatcagtgtgaacttttccagccgcctgaggcgcttttgttccttttgtaatagtccaagctcggcattcatcaggaccagctgttaaaaatgatatcagccctaacaaacgatacgcaacggaaataacgcggtctaaacctgatgaatccattcccatcgcttcgaggaattcttgtttttcatcatcttctaaggttgaaatttcttcttctatttttgctgaaattttaacgacttccgcaggtgccacatagtcgcgaagttttttgacataatcattgtcttctgataggtcatcttctgaaacattggcaatataaaagatcggcttcgtgcaaatcatttgtagactagacacccatttccattcatcctcggaatagtctgacggatcaggttttttttgtgcttccaacgacgccttaacacgctgcagaatttccagctgctttttagcttctttagatccctttgccgctcgtgtcgttttatcaattctgcgatcgatcatttccaagtcagcaaaaattaattcgagattaatggtttctacatcgtcaactggatcaattttcccttcaacgtgtacaatattttcattttcaaaacagcggacaacatgagcaaccgcatcaacttcacgaatattcgcaagaaacttattgcctaagccttcgccgcggctggcgcctttaactaaacccgcaatatccacaaattcaatggtagttggcacaatttttttcgtatcatacatttttcccaatacgtccaatctatggtcaggaactgccaccatcccaacatttggatcaatggtgcaaaatggataattagccgattcagctccagcctttgtgatcgcgttaaaaattgtactttttcctacgttaggtaaaccgataatccctatctgcattaatctgtcctttctaattatttctgatttgacggccgcatatcatcctgccataaacgttccaaatcgtaaaattcacgttcttcctgagaaaaaacatggataatcacatcgtaataatccaggagaatccaacgcgattcgcgttcgccctcgacatttttaggttctatccccatcttagatgcattatcttgaatgttttgactaatggcattaacctggcgaacgttattcccactggtaattacaataaaatccgctaaagacgatcggccgcgaacatcgatcactttcgtgtccatccccagtcggtcgtcaatccatttttgcacatattcaacaaattccgccggttctatctcaaaaattttattttcactcattttaattcctattattcttgttctaactgatacttatcttcaataatcatataatttcgcgcttcaatcgtcctaggatggatcaggccgccaatgctcatgacatatgatatggtattatcaaaagcttcccgacaggcagtatccaaatctttttcgtaactcgttttgcgcagatgctctacaccaggataatctcttcccggttcaataaaatcagctaaataaataattttgtctaacgtactcatcccgctttttcctgtcgtgtgacaggcaacagctgacaaaatttcaggatctttgacatgatattttttcttagccactacagcacccactggcccgtgtaataattgcggttccaatatcataattggatctaatgctattttttcatctttcgcgacttgaagcatttcttgattagaaaaattcttagcacagtcgtgcagcaaagcggccagctcagcctgacgggcatcaatagcgttttgttttgccaattttgatgctgatttaacgacgccgagtgtatggttgaaacgatgcggttttaatactttttttagttcagccttaatttgctcaaactgatttttttcttttttcaatataacttcctatttattgatataattttttggactgaatataggcattaacatcatctggaattaaatagcgaacggattttccctcccgaattctctttctgatatcagttgaagtaatatccattccagataacatcatagggtaaatcctcgcctggtaatgcttccttaaccttaatattgtccatcttaatttaaaagtgggataacctggccgttccgccacaataaaagctgtttgcttaaacagctcatcaattctccgccattttgtgagattaaaaacaatatcggcgcccgcgataaagaatagttcataatcaggatattgtttcctaattctttggatcgtgtcaattgtataagtttttccagtacgattaatttcaatcggtgatacttcgaaaaaaggatttgacgcgatggccaaagtaaccatttcatatcggtttttgcgttctgaagtatcatttgtgggcacagttttaaatttaaaaggattagctccagttggaatgaaaataacccgttctaatccaaactgaattcttgcagattcggccagatggaggtgtccaatatgaattggattaaaactgcctccaaaaatcccaatttttccactcattttattttaattcattcttccttgtcggcagttcgattcgtatatgctgaggatttctcttaaataggacaaaagtattgcctaacaccgtgacaacatccgctttcaattgtgaagccagttcttcagctgccgttctcgcatcaatcggtgcattttgctgaacttttcccttaatcaactctctagccacgattgccttatgggactgattcgtaatctccctgtcaataccaccttttccgatgtaaataacaggattctccgaaacggctaattttcttaaataatttctttgtttgcttgttaacataattttttattaaatgaaatattcaaattctattccttcaattgagacaatatcttcttcttgaatgccttctttttcaagagcagcaaaaacgcctgcatcctttaatcgtttttggaaataacgcgttgacgtcaggtcgtcaaaatttactgaatggatcagctgatcgaaatctcctgttacaacaaagactttttcatcgcctctgtgctgcacttcgatcaaaaaatctggctttcttctctttaaagaatatacccgatttgacgattcggaagcggcttcttgatctaacagcgaagatttttgatccgggatttctttgagtttggtaattgtatatcccaataattcatcaacgcccttgttcgttaccgaagaaatagcaaaaactggataatttttctctttaagtttctgtgtaacctcttcaagaacattttgatctgccatatcagctttagataatacgacaatttgcggtttatccaacattttaggattgtattgcttcaattcattattaattttctcaaaacaattgatcgggtcctcaccgcttaacaaggctgtttctgaaacatccaaaaaatgtaaaaagagcttagtccgttcaatatggcgcagaaaacgaagacctaatccgacaccttcactggctccttcaatgatacctggaacatcagcaatgacgaatgaatcgaaatttttccactccacgacgcctaaattgggatcgatcgtcgtaaacggataattgccaattttggggttagccttcgtcaccacagacaaaaatgtcgatttcccgacatttggaaatccaagcaatccgacatccgcgatcaactttaattcaagcagcagcgtgcgttcttcgccctttgatccaccctgagcaaatcgtggtgattggcgtgtcgacgttgtaaagttataattacccaaaccacctcgtccgccttgagcggcgacaaccgtctggccatcttcgcaaagatcagccagtacttctccggtagtccgatccttgacaattgtaccaaccggtacttttacaatcacatcgccgccattttttcctgagcttttgctggacgcgccgtcaccgccatctgtcgcctgaaattttttcttgtatttaaatggcgcgagcgtacgcataccgtaactcgcctgaatgataacagaaccgccttttccgccgtttccgccgtcgggtccgccctttggaatatattttgcacggtgaaaagtcattcctccgtgaccgcctcgtccgccttttacataaatttgaacttgatcgatcataaatactcccagaattaataaatttctttaaatatgaataaaagctgccgcaggacgctgcgacagctctcacttgacttaattattcagctaaattacgcggataaacagagcactgtttcttatcacgccctaaacgttcaaaagcgacaacaccgtcaattgtagcaaaaagcgtatcgtctccgccttttccaacgtttttacccggatgaatttttgtcccacgctgacggaccaaaatattacctgctaaaacgtgagcgccgtcaccttttttaacgcctaaacgtttagattcggaatcgcggccgttctttgaactcccaaccccttttttatgagcaaaaagctgtaaatccatttttaacatgatcattacctccaatttttaagtcaacgagtttcatcaacttcgatgatatttacaaaatcactgtacgtttctgcgattaactgaatattaatgagataggtctgaagcaatgtttttaaattactttgccgttcctgctcattttcagctgtagattgcggcacacaaatgcttgttgcgcctgattcgtatttttctacgatctcattttcagagtactgcaaaacttcagtcatcccgttgatcaatgcaatcgtcaggacagaaacaccagcacaaacaatatcctttccactatcttcatatccactatggcctgttacatcaatatgtgtaatggctccatcgtgataagtgatgcggacttgaatcattatttttcgatcgttgtgattttaactttcatgaaaggctgacgatggccttgtttgcggcgatagtcctttttggctttgtatttatatacaatcacctttggacttttgcaaagttcaagcacttcacctttgacagtcgcaccttctacaatcggtgttccaattgaaagatcagcaccttcgccaacggctaatacatcatcgaacgaaatttcatcgttgactgaaacgttcttcaacttttcgatttcgatcacatcatctttggcaacgcgatattgtttgccacctgttttaataattgcgtacatgaaaattcctcctcataccagtctcgccactataggtacacgtttgtttaaaccataagtgagcggcttcataacgtgattaagatatcatacttattctttagcgtcaagttttttactttattttttaaaccgatattttttctggaaatcaaagcattcctctgctaccttgccagataagaccagtaaacaaatcaaattcgggatcgccatcaaaccattcatcgtgtcggaaatgttccaaaccgtctgcaatgctgttgtcgcgcccacataagtgatgagagaataaataatgcggtaaatttttgttgcaataggatggtcaattaaatattcaaaggatttttccccgtaatattcccatccaagtattgttgaaaaagcaaataatgcaattccaattgtaacaatcaatgcaccgaagtgtcctaatgcgctggaaaaagcagcaatggtcagccgcacacctgtaattggatttccctgtgcgtccagttgtcccagtgtgccagatgatgcgataacaagtcctgtaacggaacaaataataatcgtatcaaaaaaagtacccgtcatattgatgtatccttgacgtgaagggtggtctgttttggcagcagccgccgcaattggcgctgaacctaatccggcttcattagaaaaaacacctcgtgcaacaccgtagcgaagtgcctgtgcaataatcatgcctcccgcaccgccagcagctgctcgcgtagaaaaggccatttgaaagattttttcaattcccgggagcaaattggcatgattaataataataacgacaataccagccagaaaataaaaaacgcccataatcggcacgatcgttccgcatacgcgtccgatactttgaatgccgccgactaacacaataaaaaccagtactaagataattaaaccggtaatccagtttgggacattaaacgtgctcagtattgcgtcagaaatagagttggattgtgtcatattaccaattccaaaagacgctaacgaagcaaaaagtgcaaataaaaaagctaaaatcttgccaatctgcttttgcggaaatccctgttccaatgcgtacattggaccgcctgccatttgcccattggcctttttaactcgatattttacagccaaaaccgactcgctgtatttggtggataatccaaaaatagcagcaatccacatccatactaacgcacctgggccacccaaaaccattgcagtcgcgacgccaacaatattacctgtcccaattgtcgccgctaacgctgtcatcaaagattgaaaaggtgtaatgtcgccgttggacccatctagatactctggtctcgaaaaaacggacttaatcgcatatcccaaattccgccacggtaaaaatttcaatcggatggttaaaaacacgcctgttccaactaacaaagttagcattacagggccccacacaaaattatttactgccgaaataatctcgtcaaaattcaataatatcccttctttcaacgtcaaactattcttgctattttagcataaaaccaattctctgtcattttaatcttaacaattaaatgatctatacttaattattctaaacaaatgagatgaaaacgccaaaatccaacaataatccaattcaatgttttccccaaaatgcatccagcctttctcgaagctccgagatattccgaacgtgttccggtgtattaatgtatttaggaaacaattcttgatatcgtctctctttatagcgatcgtcaattagaagcgcaacgccacgatccacctctgttcgaatgacgcgtcccatcgcctgaagcactttagaaaatcctggatacatgtacgcgtaattgtagccttgatggttttgattttgaaaataatcgcgcagcatgtcattttctcgactgatcatcggaagtcctacaccaataatagcgacaccgattaaagattcacctgtcaaatctatgctctcaccaaaggaactgcccaaaatcgcaaaaccaactaaactctttttctggtcttgctggaattgatctagataagcttctttttcttctgaagacatctcctggttttgacgaataatatttaacggttctcgtttggctttcccaataaaatcttgataaaccaaattcatataggcgtaggaaggaaagtaaaataaataattgcctttatgtccttggacaaaggcaatcagcatttcagaaatctgtttaaatgtctgctgccggtatttatatcgtgtcgaaatttgatccgctgtcaaaactaaaaaatgatcggcgttgtaaggtgaatctaaattaactagggacatctgagttccgcccaaaaaacgcttgaaataaaccaatggagataaagttgcagaaaaatagatgacggattgacacatctgtgtactgtcaaatatcgccgaggctggatctaagcaatgaataccaatgtgaatatcgctatgatcatcagatacggcaaaagacgttcgactttcctctccatagctatcgcatattactaaaatgcggcggatttcaaaataaaaatctaaaactttctcatcgattgatttcctttgctgcgtgaattgagagatcattccatcccctgcctgcgctactcttctaagatgttgtaataactcattgggaaattgtttttcaacgtgccacagctcatcatgatccgttaatgccacgcgctcctgctcaagataatcggcggtttttgtcaaagccttataaaaaccattaatttgacgaacttttttgcggatttccaaaaagttctttttgcaaatcaaatgattgctgtacatgtctcgtaccctctcaacaaggtgatgggcttcatccaccagcaaaatggtcttaactccattttcactttcattcaaaccttgcaatgcaatgaccggatcgtaaatgtaattatagtctccaataatcacatcacaccattgtcccaaatacaaagaaagttcaaacggacataaacagtatttttttgaagccgagatgagcttttggctatcaaatttctgctctgcgcgcagtaattcatacactgccggtttaacgcgatcgtaaaaatgatctgcaaactggcaatcatcaggattgcactttctggtttcttttaaacaaattttatctttagcgacaaaagtcacatatcgaagggataatccgcttctttcctgcaggcatgtcagcgccttttctaccgcctctgcaccggttgttctagctgttgcataatagattcgattgccatttccgcgagccaaagcgtgcagcgttccaatcaatatacccattgttttaccgattcccgtaggtgcctggcaaacgagctttccttttttttcaattgttcgatataccgcgctggcaatttgatgctgtccctttctccatccttcaaaaggaaaaggcatgtttcgaatactgttattcctttgaatcgttaattgatctcgcaaattgatccatttcgaccagtcttgaaacatcttgtcgacatattcgcatagacttttaaatgaatccttctctttgatttgacgaatcgtgccactaggaacctggtaaaaagtcagctgtacttcgatttctttcagtcgattctcactgcacagcatccatgcataggtcctcgcttgagcgaaatactccggatagtcattctctgaaatcatcatgacattgcgcgtggtcgttttgatctcatcaactaaaacaggaatgccatttcgaaaaacgacaccatctgcacgtccccacaaattaaaaacatgattatgaaaaattctttgatattttagtgtaacttctgcctgataagaagaacccatgcttttttgaagcctgcggtgaatcatcgcaccttctcgagcgcggctggctcctccaaatcgcgtgtcgatactgccgtgctgataagcgaattcaacaaagtcgcggacagaaagtgtgatcatgttctgattttgtttgtcctgttccttttgcatcagtctgtatcaggttctggtaaaggcatccatgccgtaatttgagatgaaatggtgccatctgactcaacgacttgtccattattaaaaattacattatccatatctttgctattggaatgggtcaagaaaataaatacaccatttgtttgataaggtggaatataaacagccaacgccacttcatgatcggagacgtgtgtaaaatttttctgcgaagactggtgcataatgctaactaaacaaactcgctgctgttccggcagcttatccttgatttttatccatttctgttctgccataattaaacttcctctctatttttttatatgaataatccgactgctaggccgcatgccgcgccgacaagcacatcagaagggtaatgtacaccaccgacaattcgaataagccctgtcaaaaaactgataatcaagagaagcatccctaaaattggaaaaacctttacgaatgccatcgcaatcaccaccgaagaaaatacatgtcgactcggcatcgaacagccttttttctctttcacaattaatggatcaattttccacgtctgatagggtcttgcacgattaataccccttcgaaataagcttaaaagtataaaactcacagcaggaaaaaataaaattcgcaaaaaaatcgaatccttctgtatccaaagaaaaacaagcaaaagcggatacatcacaaatggaacgattgtcagtcctctgttaaccttcttaagcaccttaaccgaattgggatgtttccgaaagggtccgcttattttttcataataatattgataatttttttcaggatttttcatttggaaaggttaagatgttccattatttcccaatgagattgcacaacagcatctgcctcagaggcgtcaactaatgcagcatccgcactggcaaacagccatgcatcagtaccggctttctttccagcaaccatgccattagttgcgtcgtcaatgaccagacaatcctcagggcggacacccataatcgatgcagcagtttccataatttcaggatcgggttttcccgcttttacgtcttctgaagtaacgaatccatcaatatacatcctgatctttaaaagatcaatcaccttttcgacaagatatcgttttgatcccgaagcgatcgataaatggatacctgcgttatggcaagcttcaaaacattcttggacccctggaaaaaccgccggtctttcctctggcacatccagcaaatcaaaataacgtcggctttcatattctgcctgcgctgctgggtcaatatctaaatgataagtatctctcaaatattgccaccaattttcacagccacgtcccatacttttcgcgatctcatttttcgttggctggataccagctgcatggtacatgtcagcttcaatacgcttgtacaaacgttccgaatctagcaggacaccatccatatcaaaaatgattcctttgtattgtttcatatatccctcactttatttgcttaagattattatatcaaattgtctcttgtagccaaacaaaaaagtgcagcatccagaaaacaccatgctctgaatactgcactatcatcattctaatgaacttttattgacctgcgtaacgccaatattgcggatatgaacgccagcttgttccaacacttgcttccgtacctgtctggtccccagtttctggatgacctctgttagtatggaatcctgcggatgtaccgcctcctaatgacaactcaacatgactggacggatcaagcataatatcgccgcgttgtggtgaactgacacgtacccaacccgcactttgcaaagccgctccaagatcatgcgttgaattcgcattaattgaaaagcccgccattctcagtgaataaataattgaagaggagcagtcgaaatctgggccccagcggtttgcttgtgagtaaccatggctgttgtcattacacaaagcaaccataatctgaatgaatttttcaacttttggggaattggatgccgcaattgaactgacatctgctggtacggaaaacgtccctgcactgcttgcttgagcggagagctctgataactgttttgtgagctttccctgctgcgtctgttggagctttgtaatttcttccttctgctgctgcagctttttctgattttcctgaatcgatttcgtcgattcttcaagttccttctttgcagtgtctgctttctctacaatttgattatcactcgcgtatacatagcggatactggccacattacttaacatctgagaaaaactttttgctgagaaaatgtattcaagcgcagaagtctgtcccatcatatacatcgcacgaacgcgtttgcccatcaacttcttcgcggccttatattccgcttcccgctgaggaagcagcgcttggttaatggtcaattcttcgttcgctttgtcgatttgagattgaatgtcttttaatttttgagttgtttgagccagttcctgttttgattgttcgacatcctgttgagtcggcgccgccaaggcggaaattggtgtacaaatgatcgctgcggacaggatgaacgctatcaaacgcttcaaactttcacactcctttatcctatactctaaaattctatattaattaagtttaacggattatgggcaaaattacaaatcaattaaaaaaaaactaaggttttaagcaccatgtttataagtacatactattattcgtaaatttttacttaaaagacaagaatatgatgtctcatacataaaaagtgcggtataatataaaaagaaaaatttgcaaattaaagggaggttctatacctatggcatcaatttttgaaggctttaaagaacagcttaaggcgaatccaaaaaccatcgtcttccctgaaggcgatgatccaagaattcttcatgcggctaatcaattattaaaagataaaacattaaaagttattttacttggcgacaccatgtccgtattcaaggcgactcgcagcgaagaatacgatcacatcaatgacgctgaatttatcgatccggcgacttatccaaaagaagatatggatgaaatggtcaacgcgatgcttgaactgcgtaaaggtaaaatgactgaagaacaggtcagagaagcgctgacccacaccaattattttggaacaatgctcgtaaaaatgggaaaagcggattgcctgctcggcggtgcgacctattctacagctgataccgttcgtccagcattacagctcattaaaacaaaaccagatgctcacctcgtcagctcttcatttattttgatgagaaacgatgaaaaagaacgtctcgtcttctccgactgcgcaatcaatatcgattacaaagatcgtgtcgataaagaaggcaacgtgacactcagtgcagcaaagcaattagctgaagtcggtgtcgaatccgcaaaaacagctaaaatcttcggtatcgatcctaaggttgctttcctttcattctcaacatacggctcaggtaagggcggcactgttcagttatcacacgacgctaccatcgaagctcagaaaatggcaccagacgtcgcgatcgacggcgaacttcaatttgatgctgcagtttcccctgaagttgcgaaaacaaaatgcccagactctaaagttgccgggcaggcaaatgttttcatcttcccgttaattgaagccggcaatatgggatacaaaattgcctctcgtttaggtggatttgaagccattggtcctgttctgcaaggacttaacgcaccaattaacgacttgtccagaggatgtactgaagacgaagtttacaaaatggcgttagttactgctgcattagcataaattttataaaaataaagccttcaaattttactattaaatttgagggctttattttattttttcaagttcattttccaactgcttaggctcagaaaataattgaatgtcaattttctcgttatgtaaaaaatctaatgcaaattgctcagattgcgcgatttcttttaatgcgtaaatgggtttgtgatatttttgtgcataacgcaatgtatggacagttccactattcctgtcaaactctgaagtaatcacagcatctgatgccatcgcctgaagacgatctctttgaacataacagtaattctgcacgagaaaatctttatcacttggcggatattctgaaagaaggcatcctcctgcttccacaattctttcagcgagtttgcgattagagatcggaagtacctcattgactggactgggcaaaaaggccgcagtcttccctcccacgttcaaacatccaaggtgagctgcttgatcgcatccaattgccagtccactgacaatcgtcacatttttttcagcaagcttttctgcgatctccatatttgattggtatcctatttcagttgggtggcgcgttccaatcacagccgcgcattttttttgatttaatacggataaatctccaagataatataaaataactggatattcacccatatctttctcaaaataattgttcattttaaggcgtctcgggaataacttcgaaaacggtgtaataatggacacattctccttctcacactgttcgacaattttttcagctttccgataaccttccataaaaaaagaaatcggcagcattcctgtaaactgattggattcgattccgatttgaattaaatcaaaataattaagctcatgattcaaaaactgatgttgttgaatgtgcttattggctgttttaaccaagcgatttaatcgctgttggccaaatccctttaaacaggaaatggccaacaatccaatttcaagattattcatctcttaactgcgcgtttaattttgtctgcagttcagaaacaatcgcatccatcacttcattaatttcctgatctttaagtgttcgatccgaatgacggaaggtaatcgaataagctaagctctttttatttttcggaatttgttccccgcgataaacgtcaaaaagcttgatactttcaatgataccaccgcgatgtgcatggataatatcccttactttaatcgccggaatattgttatcgatgacgactgcaagatctcgctgtgaagccggatatttaggaagatttttgtattttacagtgtgcccagcgtttaattctgtcagtttatcaaaatctaattcagccagataaacacgtttcggtaaggataactgttttgcaacgactggatgaatttctccgaaatcgccgatctgttcgccattaactgtgatgatcgctttgcgacctggatggaataaatcgcgcccacccatttcaaaccgcacatcttgatttctaagtaatgcttccagaacgcctttcatcgtataaaaatccccggcgttatacattgagagcactaaatgatttctttgaatcggcagttctgctttattttcattttcatgatacgtcgctgcaatttcaaaaaactgacctgaaggatttttgcggctgtgattcatcgcaatcagctcaagttgttgtccggccaatgtgaaacgcataatagacgtatcttcccccagcggatttacaattttgattggattttcgctgccttcaagtctcattgcctcgatcattctaggtgaagtgaaagatgttgtcatcgtctgataatagcctgcaccaatcaggaaattttcaacctgctgctgatatttttgagcggcagttttctgcccaattaaagtgctcccctgcattaatgtattcggaattttatcgtatccgtaaatccttgcgacttcttcggcaatgtcttctcggattcgcaaatcctgtctttcatttggcaccgtaatcatcagggtatgatcatctaaaacattgacgctaaggaaaagacgtttgaggatcgaaacaatttcgtcttcgctgatttgaatccctaaatagcgattaatccaatcacagttgactttgatttgataattttcttcaggatttggataaacgtcaatcatcccaggaactgccgtgcacgcaccgattttttccaacaaatacgccgcccttagtgatgctgtttcacacaattcggcatatgagcccttttcataacgtgccgacgcttctgtacgaagtcccaattttcttgaggtcgtacggatgcttgttttgtcaaaaaatgcagattccaaaaccatatactgcgtttgatctgtaatttcagaatttaaaccgcccataataccagcaatcgcaataggtttttcgccattggtaatcatcatcatctgattatcaattttccgtttttccccgtcaagggtcgtaaaggtcggatcatcgacgcgattcaccacgatttcctttgtaccaatatgatcataatcaaatgcgtgaagcggctgacctaattcgatcatgacgtaatttgtcacgtcgacgatattgttgatcgggcgaactcctgaatttaacagcttccgctgcatccaaattggagacggctcaattttattgaccttaaaaaccttagccgtgtatcttttgcaatgaggatccttaacagcaaccttcagataattttctatttccgaatcattttctgttgattgatataattcaatcggtttgatcggctgatctaaggcagcagctgcttcctttgcgataccataaatcgactggcaatctccacggtttgctgttaactcaatatctatgatatggtcgtcgacccaaaataattctcgaacatcaagtccactttccgttccttctgggaaaatataaacttgctgtgtcgcctccttgttaaacaaggatgtgtctaaacccatttccttaacggagcacatcatcccttcagatcgaacccctctcatttcggaggcattaatctgtgttcctgtgtcaataattgcaccgtcaagagcaacaggaacaacagccccttcgtacacgttttgggcatttgtaataattggaagtgttttattttctccgaatgccaccgtacacacacgaagacgatctgcatttggatgtttttcaattttcgtgatctttcctgtcacgattcctctgactttttcattgacaggtgtgatcgtttcgacctttgtccctgccatggttaatgtatcaccaaatgtcttaacattctggtcaattttcacaaattcttttaaccaattgaaagaagctaacatctatttcctcctttatttaaactgcgaaagaaaacgcgtgtcattttcaaacagcagacgaagatctgaaataccatatttcgtcaatgcaatacggtccaatccaagtccaaaagcaaaaccgctatattcttccggatcaataccacaagcgcgcagcacattcggatggaccatcccacaacccaataattcgacccatcctgagttgtcgcagacaggacatccttttcctccgcatttaaagcaagtaacatccatttccgcactaggttcagtaaaataaaattgatgcggtctgaattttgtttttgtcttgttgccaaaaagttttttagcaaaaaggtccatggttcccttcaaatcagacatcgcaatacctttgtcgatcaccaagccttccatttgatggaataccggtgaatgcgttgcgtcaatttcatctgatcggtaaacacggcccggcgaaataatacgaagcggaggtttttgagataacatcgcccggacttgaaccggcgaggtttgcgttcttaataccatatcatctcgataatagaaggactcctgcttgtctcttgaagaatgatccttcggcatatttaaatcatcaaaattgtatttaacccattctatttcaggaccactgacaatcgaaaaccccatgcctaaaaaaatgtcttccaattcttctgtgacaatatttaatggatggtgtgctccacatttgcacggcttaccgggtaaagtcacatcgattttttcgcgttccagacgcgcttccaatacctttgcttcaatatggccttttacgctgtcaaggttatcctgtatttcttttctaacttcgttagcttttttgccaacgattgggcgttcttcttttgaaagcttacccattcctttcataaattgggtaatcgctccttttttaccaaggaattgaacgcgaagctcttctaaatcctttatatcttcaatatggctaattttttctttaaattcgtttttgatttgatcaagctgatctttatgcattttttactccttaattttcaccataaaaaaaagtccttgaaatcaaggacgaaattttccgcggtaccaccttttttatcttataaataagatctctcgactgtttaacgcaacagaaaacgttttagaatactgatttcatctaaaaagctcaaaagtgaaatttcacatcaacatgtccgcaatctttcagccgtggattgcttctctcttgaacagtggttcatgctatttgctttgtcatcgctattaattgttattttacttcttgtcacctattaccgtcaagtacatcatgatacctgccgccacagcaacatttaaggattctgccttgccatatatgggcagcttccatgaaaaatcacaaattgcttcaatctgtggacgaacgccatgggattcattgcctaaaatcaatgcgtttttggaatgatgcggcatcggcgattcttgagataaatttccatttaatgaagtggcacaaacaaagaaattattttgctttaatttttgaataaacgcttcaaatcgatctgttttataaattggaatatgaaaaaaagatcccattgttgcccgtataactttatcattataaaaatcaacggtttgatccgaacaaatgataccatcaaagccaacaccatccgcagtacgaataatagtccctaaatttcccgggtcagccaattcgtctaataataataggtgctgtgatcgttttaaatcgatttgagcgtcaaaatatttcgcaatgcaaaggattccctctggatgcttttggcgtgataattgatcataaatgtggtcttcaaccacttccacaggaatttccgatgaaatggcatctagctggtgacgatttgtatccataaatcgacgcgcaactagtatgcctacaagtggcaccgcactttttaacgcttcttcaaaaagcttttttccttcaaaaacaaagcatttttctgtctctctccctttgtgtgaaaagagttttcgaatttgttttattttgcggttttgtttagattgaataaccactggctttccttcggaaatttaattaatacgattatattataagttttcttttgctaaatcagctaattttgcaaatgattcagcgtcgttcattgcgagatcagcaagaattttgcggtcgatttcgacattagctactttcaaaccatgaatcatacggctgtagcttaagccgttcatgtgagcagcagcgttgattcttgtaatccacaatttgcggtagtcgcgtttcttctgtttacgtccgctgtacgcagaacggagcgcacgcataacagcttcattcgcagggcggtacaatttgctttttgcgccataataaccctttgcaagttttaaaatctttttatgttttttatgagcattaacgcctttttttactctggccattttttcctcctaattgtttatctaaaatgaatctcttactttaacagcattttcttaacgtttttagcattgcttggtactaaatagcctgcttttctaagatttcttttgcgcttaggtgattttttatttaaaatgtggcttttatacgccttcgatctcttgataactcctgattttttaattttaaaacgtttcgcagatccgcgatgtgacttcatctttggcataattgtcctcctaaatttaatatatataatatttatttgttgtctttactgccctttggagacaaaaagatagacatattccgaccttctaatttaggacttttcgtgactgttccgtagtccttcaaacgatttgcaaaatctaagagcacttgtcgtccctgattagtgtaaatcatttctcgtcctctgaatcgaatggtcagtttaacacggtgaccttgttgaagaaatttttcagcatttctcgctttaacctgaatgtcgtgttcttcaacacggaccgacattctgatttccttgacggtcatcgatttctgcttcttctttgcttctttctgtttacggatttcttcatagcggaatttaccataatccagaattttacaaacaggcggcttagcgtgtggagatactttaactaagtcaagaccggcttcttctgccagtttccgcgcttcagccggtttcatgattccaatcatttcaccatcagcatcgattactctgatttcacgatcgcgaatcatttcattgatttcatgttgaacatctcttgctattgtaatacacccccatattataaaataaaaaatgtgcaggcaaactaaagcacctgcacataaagcatctttatcgcaatataacccgttcgcattttgcgaaacaaggtgagaagctttattgcctctgctttaatttacgttttaattttactgaataaaaaattagatgtcaagctataaattatttttctttattgtcctttttgtgaactgccggcatacccaccattgttcatgtttggatcttgagctgaaaatgagaaaactttgtacgtttttcctgattttctaaatcccaccttagcttcataatcgtcagataattttaaagtcacttgatattctaagtcatccgcaattacaataggatctgatattgaaaccggtgtgtttaccgttgtataggatgaaatatccttcgccacagaagcatcgttgctttgattttgatcaactgcctgttttaaactctcggcaaaatctgaggtcatgtatttttccgcttgatcataatctttattataaataagctgataaaacgattttgcatcgtccttcatttgattcaaagaactggacgaagtatcagaagtggatgttgctttttttgtggatttattgcgcggtactttaacactcggtgagttggttccctttgatccagaattgaatgaaaaactagatggatgggtacgccaatatccgtatccggcaatacccgcagcaattaagatgacaataatacctattattgtttttcttttcatgatttgctcctgctctttataaaattaaaaaaactgctgagctttaatacactcagcagtttataatcaaatggtcggagtgagaggatttgaacctccggcctcatggtcccgaaccatgcgctctaccaagctgagccacaccccgatgtgtgatttgcaaatcaacgatgtttattatagaataagagcaaaagaaaatcaagtacttttagcgaggttttttatgaaaataataaaattttcttcagagcagtttgaagatatggcagatataacatctcaagtcgtagattacgttgaatctgaacgtattcgcgatggtgaaatcttattgcagacaccggaaagcagcgtcggcatcacccttgccgacccaaagaataaagatatggtcaaagattatctgaaagctttagatcatgcatttccccgttttaacggcatgcagtataccggcccatccacacctggcatcaaagctgcaatggttggacaatctatgcgtctaacagtccacgaagggacacttgttctcggactgcatcaaggcatctttgctgcagactttggcggacctaaaaaggaccgtatgatttttatttctcacgtcgggtcacttctaaaacctggcgaaaaagctatcggatcaccactgttaaaggcctataacgctaaagttattgaagaagaacagaaagctgcagaagaagaaaaaaggatgattgaagaaatgcggcgcgaatatcgcgaacagcatccagaatattttaaaaacgatggcaaatctattttaaaagatcacatgaagccgcaggcaaagaacaataaagaaaataaataatcttcgaggttaaaatgtctaaatcaaagcatacaaaaaataagagaaagaaaaaaaccaatactacaatgcatcaatccgaacatcaaaccattaaaccctggcaccgcgtcggcgcaattattctgattatcgctttagtcgttggtatggttgtcatgtacggattcagctacatttaatattactaaaaggaatttatcatgagcgaaacatcaataaaagaaaaaagccaaaaggccaatcaagctgcttttattctttctgcggtcgacgtcgaaacgagaaaccgcgcattaaaaaatatcatcaaacatctaaaagataatattgatcggcttcaagcggtcaatcaacaggatttggaccgtgcagaatctgaacaccttgcagcgccgctgtacaagcgtctcaaattaagcgatcaaaagcttgctgacgcaatcaatggtattgaagatttaattgcactgccggatccagtcggcgtcacgcaaatggccactgaattagacaaaggattagatttataccgtgtcacctgccctattggtgtgatcggtgtcatctttgaatcccgcccggacgctttcattcagatctcttcattatgcttaaaatcgggcaatgccgttctgctcaagggcggacatgaagctttaaaaaccaatcagttcttataccagttgatcagtgaagcaactgaagaagccggtattccgtctggatggatccaaaatttagagtcccgcgacgatgtcaatgaaatgctcaaacaacgagataccattgatttgatcatacctcgaggatccaatagtttcgttcaatttattatggatcacacttctatccctgttatgggccattcagaaggcatctgtcacgtctatatcgataaagacgctgaccttaataaagcacttcgtatcgccgtcgactctaaggcgcagtctgtatccgtctgtaatgcggcagaaaccttcttactgcatcacgatctgcctcaatcgtttattcaatctctcaaacaggctttagaccaggaaaacattacaattcgcggagatgaaaggatccaaagcataattccctgtgaacctgcaacagaagcagattggcacactgaatatctcgaccgcattgtatctataaaaatggttgatagtgttgaagaggccattcaacatattaatcattacgggagcaaacatacggattcaatagttaccgaaaatgacaaaaccgcccgtaaatttttattggaagtcgactcggcaggcgtctaccaaaatgcatcgacgcgttttgctgatggatttagatacggttttggcgcagaagttggcatttctacaggaaaactgcacgctcgcggccctgttggactggaagggttggtgacttataaatataaattaatcggtcatggacaaattgtttctgattacgtcaatggctcagcgcattacacgcatcagccacttaaacaagactgtccgctttaacaattgcaccattatttttaggagtttcttatgacagccatcaactcattccctgattacccggcacgaattattatcgacagctgctctgaggtggcccttcagtctgatcatcacaatatttcactgacacgtgtcccttttaaaatttacatcgacgatgatgaatttgttgatcaggaccttaaccgctccgaattaattgaccgcatgcacctgtccaagaataaagttcgaacggcctgcccttcaccccaagctttttttgacgtgatggatcccaatgctgtgaactttgttgttaccatttccagtaaattgagtagctcctataattccgcttgtctggcaaaatccatggcagaagaaaagggctttggtgatcgcgtttatatttttgactctctctctgctgtcagtggcgaagacttgaccgcgctatacattatcgaaacgcttaaacgcggctttaaaccgaacgatttatttcatatcgtccgcgattatatcacgcatatgtctacatatttcgtattaaattcctttgaaaatttagtgaagaatggacgaattaaacatagtgtcgcactcgtcggcaaattactgaaaatcaatcctatcatgaaaggagttaatggcgaaattgagttaaaagaaaagtgccgtggtcataaaaaagcattgttttcacttgcaaagatcatttcaaatgaagtggaaagtccacaaacaaaaaatctggctattacacacgttaacgcgccggaaacggcgttaaaacttaaagctgctgtggaaaaaacagaaactccctttaaaagtatcttaatctttgaatcgggagggctgggaacagtatacgctgaccaaggcggcattgtcatcgctttttaaataatttgagtttttattttatcctaaaaaacgtcagcagatatttaatccgctgacgtttttaatttcgcttaaaccaatactatttttctatttcgtcgtattgtttcaaaaatgcgtcgaccttgtctaagataacctggcatcctcctggcgtgtcagattcaatattcgtcggcatcttgggttcatgaaggctcaagcgcatcaagcaccatccgttgccgtgatcggcatcacaggcgactcgcacaccttcataattaggctgaaccagcgaccacccttcttgattttcagcataagttttgaaatcttccagtattttttcgcccaattttctaaagtgatcaccattgatatgataacgcacttctagtgattcagctggttcttctaaatcttcgacaaaagtcgataatgtttggccttcttttttaagatggcaaagttcaattaatgccagtgtcgctaaataagcgccgtcatctaaaaaataattgtcttttaatgctccgtgtccgctcgtttccatagctagatacgcaggttctccagacttattcaatctaatcgcttcgttgattacattacggtatcctcttttaaaacgatgatgatgtccaccatgatgttcaataaattttgtcaaacctgtcgaagtgacagaatctgtcacgatcgttgaattgggatatttgtcgagaacaatcttcgatataaaggcaataaacgcgttgcggttaatgggatctcccttttcgtctatgatggcgctgcgatccacatcagtatcaaaaataatgcccatgtcggcatgatttctttgaaccattttaactgcggatgccattgcttctgcattttcaggattcggaatatgatttggaaagtgtccatccggatttaaaaactgagatcccttcgtttcagcgcctaacggttttaaaacgtcgtcaacgaaaaatccaccggcaccattgcccgcatccactacgatgtgaagaccgtcaagcggtttaatttctttcgtttcagagcggataataccgacgatatttgcagcataagcctttaaaaaatccgatggaatgcgtttgccgccataaaaagacgtttcaatttcttccgcttcttttaataagcttgtcagctcattcttttcgattccaccgcggcgtgtgaagaatttaaggccgttgcgatttgctggcaaatgacttgccgtgaccatcacagcgccgtcgcatttcaaatacggatcgactgtcgtcataaacattgcaggtgtcgtcgccaatccgcaatcgtacacaaccgcaccagaacaaacggcacctacgcatgctgcctgcgctaaaaattcaccggaaacacggctatctctcccgatcgctaatttaatatgctgtttgcccgtttgctttttaatgcgctctgcaaaggtgtagacaattttcattgtcttattgtcgtctaaattaacttcttctcccggcacaccctttgctgcgacaccacgtacatctgttccgttttgaagctcaacgattcctcttaatatcatctcaattcctttctattcaacgattggctttcccttatcgtccactttattttccgctaatgttgcacacatcacagctttaatcgcgtgcatacgattttctgcttcgtcgaataccttggagtatggcgctctgaaaacccgatcggttacttccatttccgtcaagccatacttttcgtgaacatcctgagcaaccttcgtatttaaatcatggaaggatggcagacaatgtaagaagattacattcggattgtttgttttcttgatcatttcttcattaacttgatagtcttttaataaagcaatccgttctgccgttttcgcttcttcccccattgaaacccaaacatctgtataaatcacatccgcattttggacagcttcgtcaatatcatccgttaatgtgatggaaccattggtttctttagccaccttttccatggccgaaaccaattcttcatctggaaacagcgatttaggcgctaaggctacaaagtgcatgcctaattttgcacagccaatcatcaacgaattacccatattatttcgggcatcaccgacaaaaacaagttttcgtcccgctaaatcaccaaagttttctctgatcgtcagcatatccgctaaaatctgtgtcggatgataggtgtctgtcagtccattccaaacgggaacacccgaaaattcagctagcgccttgactgtatcctgtgagaaccctctgaaagcaatgccgtcataaaaacggcccaatactttagccgtatcttcaatcgattctttctttcccatttggctattggttaaataagtcacgttggcgccttcatcgtacgcccctacttcaaaggagcaacgcgtccgggtagaggtcttttcgaaaatactcacaatgtttttgccttccaataaatggcctcgaatgcccttctgttttttttcttttaatgctgccgcgtaatcaattaaaaatataatttcatccggcgtaaaatcccgcagagttaaaaaatttctatgatagagattcaatgatattgcctcgcattctatagtttttagagtatttttattttatctaaaatacacaggtgattcaactaaaaaaccgaaggattttcatccctcggtctaaaattactcagcatcttcgattcgaatcgttgcgattctttgatcttctaaaggtttgtcccacatgtctctttctgcagaaacaatttgatcaaccacatccatcccttcagtgactttgccaaacccagcgtagtcgccatccaaatgtggtgcgtcagcaaccataataaaaaattgagaacccgcagaatttggatccatcgctctcgccattgataatacaccacgcgtatgcttgagatcattcttaaatccattcgataagaactcgcctttaataccgtatcccggtccgcccatgccgttgccttccggatcgccgccctgaatcataaacccaggaataacgcgatgaaaaatcaagccatcgtaaaattgatttttaaccaactttacaaaattttcaactgtaattggcgcaatatccggatacaactcagcgcgaatcgtaccaccgttttccatttcaattttaattttaattgtttcgctcatattttctccctgaaattatttatatagagttacttctattttcgcatttttcatattatctggcaatttatttgacaatttttttcgaatgatgttttccaattccgaatcaaacaaatcatcgatatgatcgtgatcaactaaatgaatatgaaaatccgtattgccatcgtaccgcatcacatcattttcatcatgaacacgcataattaatccgtgctcttcaaaacaatctaacgtattgtatatggttcccattgacaaatgcagccctttttcgttaacttttttcattaacatttctgctgtgggatgacggttcgaatcaagaatgatcttaagcaatgtcgtgcgttgaagcgtcgcgcgtaatcccgctctgcgaattcgtctggcaacatcctcttgattgaaatcccgtttttccatatacactccttttattctttaatgagatttattttaataaagatttcttaaatatttattatttcagttcaacaatagttgcgccagttccaccttccgaaggattgccaaaacgaaaagacttaacaatagacgaatgctttaaataattttgtactactttctgcaacaccccggttcccttgccgtgtatgatcgttaaattgttggtattcgacacaactgcatccgaaaggaatttttcaacggcatatctcgcctcgtcacccgtcatacctctcaaatcaagtctgctgctcattttgtgacgatcggccgcattaatctttttggggtttctctttgtttttttctcgtagtgttgaatttgtgaaagctggctcgttttgacctgaagcttcatcggaccaatttgaaccgtcgctttgttttctccttgcttaatctcgacgatttcgccttctttatttaaactttcgacaaaaacgatatcgcctttttttaatactttaggatttgcttttttctttttgtattttttctgctgatccttttgtacttgtttcttcgacagctgtgactgacggttaatttcctttcgcagtgattccagctttttattgtcaatcgaagccatcgtattttcttgaatcgcgcgaatttcctgataaattgattcagactgggcttttgtcttttctacaattgtctccgcttcttgatgcgcctgtctaataatagcatctcgtttttgataaacatcacttgccttttcttcggcgtttcttattttttcttcagctgttcgttcttttagctcggcttcttgtaacgcggcctccatttcttttctcttttcatcaattaaatccaatgttttttcaaatcgaacagatccggaattgataaattgtctggcctctgaaatgatctggtcgttcaatcccaaacggctcgcgatttcaaaagcgttcgattttcctggaataccgataattaatcgatacgtcggtttcaaagttttgacgtcgaattccaccgatgcgtttgtgattcccggtgtcgtcaaagcgtattccttcaactcagaataatgggtcgtagctactgtaatgacatcgcgtctaaacaattcatttaacaatgcaatggcaagggcagcaccttcagttggatcagtaccagcgccaagctcgtcaaaaagaacgagatcgcccttttgggcttgagccataaaataaacaatattttgcatgtgcgctgaaaaagtcgaaagagactgctcaatactctgctcatctccaatgtcggcaaaaatatttttaaaaatgccagtcgcactgccttccttaacaggcacaaataaaccagattggatcataagcgtcaataacccaatcgttttgagtgtaaccgtcttaccgcctgtattgggccctgtaataacgataactttaatatccggacgaaacacaatatcgctcgcgacagctttcttcggatccaaaagcggatgtctcgcatttaacaaagagatcgggccgtttggattgatttttacgcgcacactgccgtttgataaagcataccctgcttttgcaaaaataaaatctaatctagagatcatatgaaaatcgcgttctatgacggcgtgataggcactaactttccccgttaaattttcaagaatcgtaaagatttctttttcttcttccgccctgagtaatttaagatcgttgtttaaattaatcactgacaacggctcaataaaaacagtagagcctgtcgacgatttatccaaaacaattcccggaattcgattgcgatattcctgcttaaccggaatgacgtaacgattatctcgaaccgtaaccagccgatcctgcaagatgctttcatagctggacgatgtcacaatacgatttaatttatcggatatctgattgtttttcgcaataatttctcgacggatgctggctaattttggcgtcgcattatcagccatctcattagggccgataatcttcttagaaatttctctttccaaatctaaacaatcatcaagggcttcaaacaatggcaccaaccgatgcagctcattcttctcgatatctttatcgtagtaatcaattaaatctttggtaagacgaagtgttgaagcaacttcgagtaatgaactcatatccaaaacagagccaatttctgccaattgtaatatatgtaaaatattgtgaattcgggcgagcggaggtctaccatttcgaagcgacatattgaccgcttcttctgtctcgtcaagtgccttcataatctcgtcgaactggttcatcggttttaaatttgaggcaaattctttacccgcctctgtgatacaaaactctgccagctgctttaaaatcttaggatattctaaaacattgatacttttttcattcatcgactattgtattcctctgtgaaaatttccagttgttaaacggtgttgactattttgcagatgatcagttgcagtactcgggtgtcggtaaaaggcaattgcctctgcaatttctttcggttcttcatttaagacgttgattctatagacgtcaacacagtctaaaccttttaattctttactcgttaagcataatttatctgcattgaaaatatgaaccttttgatcttgaaggacaaacggaaaggaagcgcccttttcatcgatcaaatgatagcgtccattatttttacacgatgtacagtcgttattttggcaattgatcacacaattatccgataccatcacttcctgaaatccgtaaacattaaggctcaaaggcaatacggtcttttcgtttaatttttttaaggatgatccgtctaattcacaagatactgcacatcgatcgcacccccaggaattaaaggccattgttgaaactgcattaaacacttgcaaattggtatctgcctcaaccgagtgcattgttccatgacggcggcaaatctccaatccctcgtaatttcgcactaaataaccatcaatttctagattgtcaagcatctcaaaatgctgatctaacttaagacctttctgtgtattgataatttctggtaagattaatcttaatttctcgcctttattgtgaatgtcctgaccgatttttttaatgtatggtatctctgagatgtgttccagcggaatagcccattcatccacttgcatatctgcgaacttagcgtattgtccgtaatgccataatcttaatgagatttgaggattattctgaacgcttacttctcgatgtttcgtttcgagttcgtagcgaagttgctgcgtgttctgctgtattttggtttggttaaccaccggatcaatcgctgcaatgatctccctcctgatacgatttaaatcggagcgggataaaaacaaatttccgttaagggtcacagaaaattcagaaagataaaaatccgtatcccccaacttctgaatttgttgtctaaccatttcttcagtcagtgcatgttttttcgctaaagacggtttaatttccttgatttcaaaggcttgcgtttgccctgtatttgcattttttacttgaactgaaaccggttcttcttctgaaaatgataagctaatatctaaaggtattttattaaatgaaagtggccgttcagctttctctgtgaggctttctgccaattttacgttcttattacgataaaccggcatgcctgttttcactccacgtatttgatttattttaaccgtacgttctctttgagaaaaggacgttaggctgcaaccaacctgagcatttttcccaaaagcaagtccatcgcctcgattaagctgaattgaaccatccaactgaattttcattacacctttctcaatgttttcaatttttccaatataagctccgcgttttttctggacgtctgtatttaaatgatttttattgctaaacatccatcccggtgtaaaatcccttccaaaaacggaatccaattcttgagatgaggtcgattgtccttttccatccacaagctgccggtacagttgtgtgacttgataaacgtaatgagggctttttaaacgtccttctattttaaacgcatcgataccggcattgactagctctgctacgtgatttgaagtatttaaatctttcatagaaagtagataaccttgtttgattgtcctgccattctcgtcggtcaatcgatatctttttctgcagggctgggcgcacattccccgattaccgcttctcccaccgatcaagctgctcatcaaacactgccctgagcgcgcatagcacaatgccccgtgaataaaaactttcaattcaatgtcagtttgttgtctaatctttttaatctcttttatcggcatttccctcggtaggacagtgcggaaaaataccaaattttcaaaaaacttgaccccatttaatcctccaatagaagcctgtgtgctggtttggagcttaatcatcggataatttgctctgatccaaaaaatcagaccagggtcctgaacgatcatcccatcaacatcagcgagatttagaaaatcaatataacggatcagttcggcccattcttcatctttcacaagcgtattcaccgtaatatacaccttcacgctgtattggtgacacagcctcaccatgtgtttgaaatgatcaatgtcgatattttccgctctcagtcgcgcattaaaaaaagggccgccaaaatagacggcgtcagcaccggcattaatggctgcaataatttcagcttcattacctgccggtgctaatatttctggtcggttccttttatttttcatcgattaacctgtctttttctattatttgaattactcggtcgtttttttctccttgcctttgcccttgctcttcccttcttgatttgctgaacctgataatatcgaaaaataagaaatgcaacaaccaatatgatcaaaattatcagcagataatcgacaaagccacggcggtgaatggtttttgtcgtgtataaagaaatgtgcttcaccgttttattgttattttgaacaagtaatgtccccactttttgattagctttgaccgtttgaagcagtttataggcatctccatccctttcaaacaacgattgattgagtttgagttttgtggtgtattgatccttctgatttttgtcaatataagacgaaacctgctttttagaagtcaatgttaattgttttgaattcgcaattctaacattttttaatcttattgttttataggtcccatcttttttagtccagttgacttttgaataatcaatatcaaatgtattgatgatgccatttgcttgactccagatattattatctgaatgtaaaatgacggcaaccatcgatttatttttatatttggaagaaaacactagacaatggcccgctttgtctgtatggccggtcttcacgcccgttgcatatggattgtatttcttcccatcgtgtgatgaacctgtaaccagcggtagatctttcgtgctaatgattaaggcattggtattgatccattttttatcgccgctcttaagatggcaagtgtaaactggctgcattacaattttgtcaattgccttgtatttcatcagctgtgtaccaattttaacgagatcggcagcagtcgtataatggttatcatcatgatagccatgtggattgacaaaatgcgtatcttctaaatttaacgttttagcttctttattcatcaaagagacaaatcgtttaattgcagcatcagcactcaattttgagtcttttgcatccaaacgtcccacattcgccgcaattgtcatggccgcgtcgtttccagaaggcaatagcagcccgtaaagcagctgccgccaggttaatacatcccctttgcgaatatctgccttcgacgaatctccgctgatttcatttacttcattacccacggtgactttttgatcgagcttattctgcacatagtgcatggccaccagagctgtcatggtttttgtcgtacttgcaggatacatcttttgatgtgcgttctgttcgacaatgacatcgccggtattcacttcaactgcacacaccgcttcatcattgttaaatgcgggcattgccgcaaagacggaattgccgataaaaagaatcgacaaaaccgcacaacaaattgatgctaataatttatttcgattgtttttgaataaatgtaagttcattaaagagttcctgatttttacgaattttttcttcatttccaatgacacagagcgcattttgatgcatcgccgcatcgataattttaccgcattttctcaaatcagcttccgtagtgctgagaatctgatcgcgttcaatctgcgtccattcctgcgtttgccttgttaagaactgtcggtctgctacgtaagactgcatggcaagcgaaagcggatgatccttcgctgaaattgaaccgataatggccttttccaattcccgctgactgatctgcatatcactgacatattgtcctgcttcgtcgtacgctttaagcgtatttgcaacgtgaggatctcggtacgaagtaaatatcagatcgccggcttttgaaattgaaaagcccgtcccataggcgcctcccttgatgcggacacgattccacaaatatcccatatccataatggttttaagtacgaaaagactgccattgtattcatagcctaaacgcttaatattaaaccctttagtcacataattaaccttagatgaagtcataaatccttcatttgctgtctttgtatcaaattgataggtatgaatcggctgttcactattgtcaatggattgcagatgttggtttactttgtggtaaatcttattttgctgcgccggctcgcaggtgatcgacaattttacatgattgcggttaattacctgcttatacacgtgtaagagcttttgcgataattcatcaaaacttgtatcataactctggcatatggcggacagcttacgtccgaaatcaataccgcctaattgctgatacaacgcagcggattgtgaataataggattgcagacgctgtgaagccagcacatttccggaagtcaaaaagcgattttcaaatttcgtgcgatgttcctgtaaaatcgcttcaataatttctttttcatcaaaatgagaagccgtcatgccttggaacaacaattcaagtaaataatccacttgatcgattaatgctttcccgccaattgacaaataagcttggtattgaccttcacactgaacatcatctagcacttcaagatttgttgaaataccgccagtgtgaatttggatcatttgatccatttcatcaaccccgtacaggtctgtccgaacattaaataacagcttattgagtatgcctaagactgctaaatcttcctgtgcaatggtgcggatgtcaaaataaaatttaaggtagacgatcccgtctgttggcgctggatgccataaaacgaagcaatcgtccatcatacctcgagcaatttgagacgtctgtaccttagcgttcaaatctgataattccagtttcggaatggtcgccaaatcttccggtgcatcttcacgattttgataagctaataaatctttagtttctttaacgattccatcaatctcttgttctgataacgacgattgatacttcgttaaccgatcggacaatgcttttgcattttttgccgctaattctggatctggctttaatgtcacgattgcacgatgctcgttttgaatcagctgtgtattgatcaatttttcgaattcgccattttcagccattgtcttaacatgcgcaatggcatcatccattctgagatgactcaatggatcttggtcgtaaagccaagtgtccatcagctctaagccaaacatcagtcccggtggatatgagccgaaatctttttccttaatttcaaaagcagctgaattgatgcccgcttcaagcatctttttgtcgatgccttctttaaccagtctttgtaaaacctttttaattgttgatcgcacccgatccttgttttcagtaccgccaaccatatttttaagtgtaatagcaaaataaggctgtctcattgcggtcgtgtaggaataactgatgtcttcgcaaatattgagatcgagtagcgccttcttaagtggataagaattttcgcctaataaaatattggtcaaaatatcaaaggccagccaatcatcttttagattattcagcacccacccaattgttaaatagtttttattattgagctctgttgcaccagataatggataatacgccgaagattctgctggctttgaaaaaagtggctgcagtgcaatttgagaatcgatttcctgataatcaaaatcagataaatacgcttcatccagatattttagatgttcctccatatcaccatcgccgtaaaaataaatataggcattagaaggatgataaaatttgtgatgaaaatctaaaaattcatcgtaagtcaaatcaggaatattatccggaaaaccacccgactcttttccgtagatagaatccggatacaactgcttaaacaattcattttgcaagatttcttctgggctcgaatagacgcctttcatctcgttgtacacaacgccattataagtcattttatcttttggatcttcgagatgataatgccagccttcctgttcaaatatttttttattctgataaatatttggataaaatacagcatccagataaacatcaatcaaattcataaaatccttgtcgttggtgctggctacgggatataccgttttatccggataagtcatcgcatttaaaaatgtattgacagaccccttaacgagttcaacaaaaggctctttgactggatatttccgagagccatctaaaactgagtgttcgatgatatgtgcaacgcctgtgctgttgtttgatggcgtgcgaaatgcgatatgaaacactttattgttatcctgattggacagatatagcaaaggcgtgtgcgtcttctgatattcaaagtaataagctgttccttgaatttctttcaaatattctttatggcgtaatctaaaaccgtgaataacttggtcgatttgatattccatgatttctcctgtcctttatttagactctttcagtctttgaagtctttcttttatttttttttcatatccaatagaagttggcgaataaaattcggcatctatcaaatcagtcggcaaatactgctgtgacacataatgatttggataatcgtggggaaatttatatgtcgtacctctgttcagctttgcagatccttgataatgcgcatccttgaggtgcgccggcacctgtccgttcgaatcgtaacgaacagcatggcttgcacgttgaataccgacatttgaagcgttagacttaggcgcagatgctaaaaatgtaacagcttgacttaaattgattcttgcctccggcagtcctaccatatctaaggcctgcgcagcagaaacagcgaccactaacgccattggctctgcgtttccaatatcttccgaggctgaaataatcattcgtctagcgatgaattttggatcctctccggcattaagcattttcgccatccaaaacagtgccgcgtcagggtctgaaccgcgtatactcttaataaaagcagaaattgtatcgtaatgattgtcccctgtcttatcgtagtccagtgcttttttctgtatacattcctgcgccacatctaaatcaatttcgattaccccatcggcgtttttatctgaactcaaaaccgccaattccagtgcatttaaagctctgcggacatccccattcgccattagagcaagatgatcaagcgcttcatctgtaatttgaacgtgcatggcgcctaaccccttttcttggtcatgaactgcacgcaaaatgatctgtctgatatctttttctgttaaagggaagaactcaaacactgtcgatcttgaaagaagagctgaattgatttcaaaatatgggttttctgttgtcgcaccgatcaatataatttcgcccttttcaacgcttggcaataaagcatcctgctgagacttgttgaatcgatggatttcatctataaataatattgttttgcggttgtataaagcaatattattttttgcctgttttatggccgcttcgatatctttttttccggaagtcaccgcatttaatattttgaaatcggcttttgtttggtttgcaatgatattcgccaaagtcgttttgcctgtccctggcgggccataaaagatcgcagacgttaagcggtccgtccgaattaagcggttaagcatttttccctgccctaccacttgttcttgaccacagaattcctcaagcgttttgggacgcatccgagccgctaaaggctcattctgctcagtattacgatcgtaagtcatatcgaaaatacttgcctgcatgatataattgcaaacctcctttcatataaacaaaaaaatccggaatgagatcccggaatcttaaaaatattattatgcaacaataacagcgtagataaaagctgataacatgaatacaattgcggaaacgatcgttactttttcaagaaacgcatcaaatccacgtgccttatgttttccgaacaatgtttcagcgccgccttcaatggccccaagcccttgggttttaactggtgacattaatacactgatgattacgacaaaacttgagataatcattaatgcaaccaaaaaagtatccaaatacataacctccaataatttttatccgtattattttatcacaacgataattagttgccaagtcaggaaattcacaaaatattaaaggaccatgtttttcaacatggcccttgaaaataaactaagtttagaatttaacgatttttgcaaagtcaggtgtcaagcttgcaccaccgaccaatgcaccgtcaatgttttccattcccatcaaatctttaacgttatttggtttaacagatccgccgtactgaatacgtgtggcttcagctgctgcttcgccaaacatatcagcgattgtttcgcgaatccatccacagacttcatctgcctgttctttgcttgctgtctttcctgtaccaatggcccaaatcggttcgtaagcgacaattacttttgtcacgtcgtccacaccggccaaatcctttttaatctgtccgacaaccttgctctgagcatttccagcttcgcgttcttcaagcgtttcaccgcagcacataattggtgtcaggcctaatttcaaagctttaattactttcttattgacactttcgtctgtttctgcaaaatactgacgtctttcgctatggccgataataacgtattttacaccaagatttttcagcatttcacccgaaacttctccggtgtacgcacctttttcttcgtagaacatattctgcgcgccaatgccaatattggtacctttggttaattcaacggccttcggcaaatcgataaaaggcggagcaaaaacgacttccgcttctgcaccttcaaccaatggaattaaagatttaatcaaatcttctgtttcttccacatttttgttcattttccagtttcctgcaataacaggtcttcttgacatgactttccctcctcgttttttacttatcttctaaaacagcgattcctggcaaaactttgccttccatgaattccaaggaagcaccaccgcctgtagaaatatgatcaattttatctgcaaagcccaattgtttaacagctgcagcagaatcaccaccgccgataatagtcgtggcttcagattcagccattgctttcgcgacagcttttgtcccttccgcaaatgtcgggaattcaaaaacgcccatcggcccattccagataacagtttttgcattcttaataacatcagcgaaaagttcgcgcgtttttggtccgatatccatccccatttgatcgcttggcatagcatttgaatcgacaacagttggtgtggcatctgccgcaaattcaggcgctaccacgttatcaactggcagatagagcttgacgcctttttcaccggcttttttcagcaggtcagctgccaagtcaaccttgtcttcttccagcagagatgtgccgatttcataaccctgcgccttgtaaaaagtataggccataccaccgccgataatcaaggtgtcaactttgtcaaggagattggtaattacaccgattttatcggaaacctttgcgccacctaaaatcgcgacgaacggatgctgcggattatctaaagcaccaccgataaattttaattccttctgaatcaggaagcccgaaacagccggcagatattttgcaatcccttctgtggatgcgtgtgcgcgatggcaggatccaaaggcatcatcgacgtaaatatctgctaagcttgccagatcttttgagaaatctgggttgtttttcttttcttccggacggaatctcgtattctgaagcaataatacttgtccaggtttcaaatcagcagctgcttttttggtcacttcaccaacgacttcgccatcgtcattaaaaataacctgaaggcccagcttttcagacaatgcttttgcaaccggcgccaaagaatattttggatccggttcgtttgccggacgacccaaatggctcattaaaatcagcgctgcattttgtccaagaatgtatttgattgtgggcaatgccgcttcaattcgggtatcatctgtgatttcgccagcgtcattcaatggcacattgaaatccgctctcatgatcacttttttaccttttaaatcgatatcttctaccgtttttttcatgatttatatcctctgtgaaaaaataagggccgcaataaaaacggccctcgttgccactaacaccgtttagtattttcgaaataccagttgttagtttaattctgcgaagtatttgatggttctgaccatctggctggtgtatgaattttcgttgtcataccaagaaacaacctgaacttcagttgtgccattttcgagtggcagaaccatcgtctgagttgcatcgaataatgaaccatagcgcatgccaacaatatcagaagaaacaatttcatctgtattgtagccaaatgattctgttgaagcagccttcattgcttcattaacctgatcgacagtgactttgccatcaacgacagcggtcaaaatcgtggttgatccgtctggagtcgggacacgctgtgcagcgccgattaatttgccgtttaattccggaataaccaggccgattgccttagcagcaccagaagaagtcggaacaatatttgcagctgctgcgcgagatcttcttaaattgccttttttctgcggtccgtccagagtcatctgatcgccagtatatgcgtggattgtgcacatgatccctgactgaattggagccagatcattcagagctttagccatcggtgccaagcagttagtggtgcaggacgcagcagaaataatcttgtcatctgatgttaaagtttcgtggttgacattgtaaacaattgtcggcagatcgttgcctgcaggagcagaaatgacaactttcttagcaccagcttttaagtgagcacttgctttttcttttgaagtgaagaaaccagtacattccaaaacaacatcaacatctaaatcgccccaaggtaattctgacggatccggcttagaataaatttcgatttcagtaccgttcacgacgatagaatgttcttttgcttcaacactgtcagcatatttatatgtgccgtgtgctgtgtcatatttcagcagatatgctaacattttcgggctggttaagtcgttgattgcaacaacttcatagccttcagcatcaaacatctgtctgaaagcaagacgtccaattctaccaaaaccattaatcgcaacttttacagacataattgcctccttaaaaataatatactcatttatttaaatgacggacgatttcctttgctgcggattcatccgtaattaacgtaacccccggctgaagtctgcagacgccgataatcgcatcagccttgtctacaccccctgcaattgcaattttttccgggatctttcggtaatcttcaatgtctacaccaattgtgctggacggttttaaaatatgaccttgataatcaaaataatatccaaacgcctccccaactgcacccgcttctgtcaaagcctgtctttcatcttttgaaacattacgccactgagaaagaacatcggcacgaccgacaccaaaaacgaagacatcaatatgttccattttatcgaaaacccgtttgatttctggataatctttaagtgcatcgagtagatgaatgtcgatattatctggcaaatgaagtaattcatatttagcatgaagcttcaaggccatttctgctacgacattgttggcttgagtcgcatggctttttccaattccgccacgcgcaggaataacataaacgtccgggtataacgcttctttcatttgttccgcgacagctgccgtacttgcgcctcctgtcaatgcaagcacatctttgtatttaagcactgtcataataaaatcagcagccgatttccccataaaattaatcacttgatagtttttatctacatttccaggacaaacaattgctttatttaaattgagtttgtctcgtaatgtattttccaactgttcaagtccattgtaggtatacagcattgattttaaatcttcaatgatactgtcacccaattctgtcaaaattacaccttgtcgttcaacatcaatcaatttttgatcctgaagaaactctatttcattacgaatttgtctttcactcatatcaagcgtaaaagctaaatttcgtctaccaataggctcttcgcttttaatggtagataaaatatcataccttagttcaattaaagcactgatttctggaacaacaagccgctgaaggtcaactaattttctgctgatttccaaatgattatcggccatctttattctcccgtgttttttatgtcgatcatctttatattgaagatggttaattccgttcccaccttacgaatcttattataagctaatttcaagctgaaatcaagaagattctcgctgtttctatgatttttttgatatattaagaaactttttgctgatttttgatctatttttaacttttttgttttttcacattttattttgtttcaattttaaaatgtgtatgggacaattttgttcccatttattctttctgtgttcattttattctgtacttgtattccacactgctatttaatataatgtctttattattaatctgaaggagtttatacatgagagctgtaataaccgtaatcggtaaggacaaaattggcatcatttaccgagtttctgaaattttatcgaaatataaaatcaatattgaagacatcagccaaacaattctgcaagacgtctttacaatggtgatgttggtcgatctttctgtatcaacatgtaaatttactgatttgaaaaacaaattagaagatttagggaaagaaatcggcatgaccattcgaatccagaacgaagatattttcaacgcaatgcacaccatttaaagaggagacttcatggctttatataaagatattattgaaaccgttcgtatgatcgaaaaggaaaatctcgatattcgaacgaccacaatggggatttctttattagactgcatcgacagtgatcagcataaatgccaaacaaaaatttatgataagatcacccattccgcagagcacttggttgaagaagcggatagaatggcagctgaaacgggcgtgcctatcgttaataaacgtatttccgtgacaccgattgccttaatcgctggttcaacagacgcctctgattacgccccttttgccaaaacactggaccaggcagcaaatgaagtcggcgtcaactatatcggaggattttctgctttagttccaaagggagcaacaccgggagatcaaattttaattcagtctattcctgaagctttagctgcgacagaacacgtttgtgcgtcagttaaccttggttctacaaaatctgggatcaacatggactgtgtcagacaaatgggacacattgtcaaaaaatgtgctgagctcacaaaagacaatgactcgatcggtgcttcaaagctcgtcgtcttctgcaatgctgtcgaagataatccatttatggcaggcgcctttcacggagtcggccagcctgacaaagtattacatgtcggcgtcagcggtcctggcgttgtaaaagtagcgcttgaaaaaaatcaaaatgccacaatggacgagcttgctgaaatcattaagaaaaccgcatttaaaattactcgcgctggacagttagtcggcacaacggtcgccgatcgtctcggcatccccttcggcattcttgatttatctctcgccccaactccggccatcggtgattctgtagcaagaatcattgaagaaatggggattgaacattgcggcggtccgggaacaactgctgctctggcgatgctcaacgatgcggttaaaaaaggcggtatcatggcatctacttctgtcggtggcctttccggtgctttcatccctgtctcagaagatgaaggcatgatcgatgcagcgcgcaatggtcacattacaattgaaaaactagaagcgatgacttgtgtctgctccgtagggctcgatatgatcgccattccaggtgatacacctgacgataccatttcggctattattgccgatgaagcagccattggtatggtgaacaataaaacaactgcttgcagattgattccagccattggcaaaacagttggcgatgaagtgacatacggcggtctgtttggttcggcccctattatgccggtcaatctatctgatgcctcggtctttgtcaacagaggcggaaaaattccagctcctattcactcatttaaaaattaatttaattcggatataaaagcaccattcggtgcttttattcattcatacgcaaatacctatttaggaggaactatggacaatacacatcttgaaaagaacacgtcttatattgcctcacaggatttattagacgctgtcaatattgcagtcacgctgcaaaaaccactgctcgtcaagggagaaccgggtacaggaaaaacaatgctcgcccacgccgttgctgaaacgatgaacaaaccactctttatctggaacattaaatcgacaacgaaggcccaggacggtctctatacctacgatgtggttcagcgcctgtacgacagtcaatttggtgaaaacgtcgatgatatcagccaatacatccattacggaaaaatgggtgaagcctttatggccgatgaacaagttattttattaatcgacgaaatcgacaaagcggatctggaatttcctaacgatttgctttgggaaatggatcaaatggaattctacgttaaagaaacgcatcagaccattcgcgcaaaacaacgtccaattgtcatcatcacttcaaatgcagaaaaagaactcccagatgcctttttgcgtcggtgcatttttcattacattgaatttcctgatcctgaacagatggaaaaaatcattcacgcacattttgaccgaatcgatgatgagcttgttaagcaggccatggacactttttatcgcattcgcgacgtaaaaaacatctctaaacggccaagcacctcagaattaatcgactggcttcgcgcactgattgcaggcggcgttgatccagctacaattcgcaaaaatctgccctacagtggtgtcatcttgaaaaaagatcaggacatcgacttagtcgaaaaagaattccatcccaacatccgccgtcatgttcgttgatttcttttattttctccgtgatcacggcctcaaggtttcaatcggcgaatggctgcttctgctggaaggcatgcaaaaaggactgcaccacaataccctccacggcttttatattttatgccgtgcgatcgtcgtccgaaacgaaacggaatacgatcttttcgatgttgcttttgaagaatattttcacgatctgcctccccaatctgagctgcctaagcctctgcaacatatcactcagcaaagtattcaagaactcgaagtagaatcacagcatgacgccgacgccattgcatcggaacacacaagcggagacgaaaatgcagcggcaactggaatggaaatgccaggttccggatccagcggcgggaaaaccgccattcgtggaaggcgcaaatttagagattttcgcaaggataatcaccttgataccagacaatttcaaatggcttttcggcttttgcgcaatttgtcaaaccaaaatgatacctctgaattggagtttgacatcgatcaaaccattcagaaaacctgcgatatgggcgggatgctccatgtcgtctaccgaaaaccccgccgcaacaacatccgcgttttgctctttattgacagcggcggatcgatgagcggttacgcgcggctctgttctgagctttttcaggcagcaacagcatcccgacatctaaaagaactaagaactttttatttccacaactgtatttactctgcaattgacaaagaaccgacattatccatgaaaaaaggcgtatcccttgatcaactgatcgcagagtgcaatgataaataccgtgtcattatcgtcggtgatgctgaaatgcatccctacgagctttccggaagtgaatacgactgggtggccgacaaaggcggagaaccgggaatcgaatgtctaaaaaagattaagcgtcattttccgcacaccatctggctgaatccaacgccgatgccgacgattcacgatgcctggacggacacacattttgaaatagccgatatcatcgatatgtacgacttaacccttcaaggtcttgaagaaggttttaaatttttactcagcggcaaaaaataataatctctcatgctacattccgggatggcagacacacaacagcctctgctttcgtgtgaatctcgccatcctgacgagccgcctgcatttgtatttttacaagatattcttttccttccttgtatttttcagtcacaacaccactttgaattgaaagatccccataatataagattttacggcattggcagtctaaaatctttagtacgccgtcatctcccatccaatcgcttacagctttcgcgatcagcgcctggctatgtatcccatacgcgattgcgcgtttggaaccttgcttttgtgcaatgatgtcgctggcgtggcggtcaatgggatctctgtacgcgcctgtttcgggatcgatgaggccatgcgcgcgccattttctcagtgatccccatttcgtcgcaaaggcgttcgcagcaccaattgctgccatgagtgatcggccatccgcttcatcgtacgggcccacccattcctcgggcagagaatctccgatctcgacctcttcccaataacgcggtgcatttccccgtctgaattggccgtcaaattgattgtctaaattggtgtatagcttttctaatgttgcttctgaataacgcggccgcgattccgctggtttttgtatcgtttggattttcgattgtctcagagtttctaaagatggacatttgatgatcgttcgcgcagttataacagctgcgcattcatttcttttattaatcagcataatcgcatgctgccgcagcagtattcggtctccgtttttattttttgaaagttcctctaccccgagatacttgttttctgcccgaaacgtatcatttggacgaattggcatcaatctttcccattttgttccagcatcaaacacctttactcccggcacagatggaaattttccttttacaaaagtcgaggcaatgcagctttcaattaatggtggcgcgatgattccgttccagcgtgtttttttagcgtaaatcggatcagagtaaagcggattggaatcgcccaaggccctcgcaaatcgcccaattgtatcgattgttaccgtttcattgtaaagtccaccccctaagcgattatgatgatcctgacaataaatgcgataaaccggtaaaatccttcctgattttttgttttcttcttcaatatacgtgtctattcttgacagccattcacgatcattcatctattttcctcattaaattatttttgtgcgctctattacgcttcccatacaaacttttataaaaaataaaaaggcgcaacagctgaaatgcactgctgcgccatatgaatcgaaatcttctttttctaatgaaacttaacttagaaataataaacgcccaaatcagcctggaggccatttcatatctcgtccagccaaaaaatggaaatgcagatgcggaaccgtctgtccgcctgctggtccacaattgttgaccacacggaaaccgtcttctgcgactcccatcttaattgctaagcggctgattaccgtctgaatttttcccataatcgggtctccagctgggacagctaaaatcgaatcgtaatgctgcttcggaataatgacaagatgaaccggtgcctgaggatcaatatccttgaaaactaatatatcatcgtcctcatataccttatcagatggcacttctccatcgataattttgcaaaaaagacaatcttctgccactttcgtccccccttttttaattattgatttcagtgcctgtcatattggcactgccttgttgatagtgtatcacgatttctttaattttacccaaactatctgggacggccttcatttctaccggaatatagttcggtgtatgtcctgtcattgttccatcttcatgaatctgttcaaataataccggctggacccgctgatcgttttcgcgtaaaaaagcctcttcctgtttctttgacaatgctatcagcctttggcttctctggtgttgaatggacgggtcaatctgatctgggaaatcgtaagctggcgttcccttgcgacgcgaatatttaaagacgtgaatcttataaaaattgatcatttgagcaaattggatcgttcgttcaaattcatcttctgtctctccaggaaagcctacaatgatatccgttgtgagcgctggaagcgtgaaatactgacgaatgtattgaacgatttgaataaactgcgctgttgtatattttcgattcatgcgttttaacgtcgtatcacatccgctttgcagcgacaaatgaaattgcggacatatctgaggaatttccgataatttttgcacaaattcctttgtcatcaacaacggctcaattgaacctaatcgaattctcttaacacctgggattttcgcgacaaattgaagcagcgtgagcaaattgattgaatcgtcaaactctttaccgtatgaggcgatgtgaatgcccgaaaacacaaattcttgatagccatccgctaccaatttttctacttcctggcagaccgacgctattgaacgacttcgtacccgaccccttgcatatgggataatacagtaagaacagaactggttgcagccatcctgtactttaataaatgcccgcgtatggtgccgctgctctgcaataggcatatcttcaaaggttttgctgtcccatacattttcgacacaaatttctcgttgatgatcttttaaaaagctctcgacttcttcaactattttatggcgatgcgtggtacctaaaataatatctacctcatcaattgccgccacttcatctggcgcaacctgagcgtaacagccagtggcaacaattactgcatcgggatttttccgtctcgcacgtctgagaatttgtcggctcttccggtctcccagatgggttactgtgcaggtatttacaacgtaaacatctgccgtactgtcaaaatcaacaatctgatagcctgactttagaaaaagggctcccatcgattccgtatcaaaatcattaactttgcacccgaggttataaaaagcaactcttcctttattttccatatcgtcctttattctaatgcataattaagttgagcacatagtgccattcctgctgtttcagttcttaatattctctttcccaaggagacactctcagcgccggctttttccaaagtactgacttcttcttcagcaaagccgccttccggcccaatcaatatattgatctgatcaaccggatgctcccattgctgaacaacttcttttaaagaacgttttttctcattttcataagcaatgagactttttccatgaaatttgtcgagctttgaaagaaaaattggcaaatggacttgaggaatacgaccgcgttttgactgctgtgctgccgattttgcgattttctgccaacgtgcaacttttttcttaattgctttggcttcttttaaatgaacaacacaaaattgggattcaaacggaatgaaatcacttacccccaattccgtgcctttttgaataatctcatccatctttttccccttagccaagccctgatataaaaccagtcgataaggtagctcgctctctgaaggataaacatcaagaatttgcgcagtcaatcttttttcagaggatatttgttcgccgattttacaaagataatctgagccatctccatcacaaattacaaatttttcctgattttgaatgcggaggacatcgataatatgatgaaaatcttcccccactatttctattttatcgcgatgaatctgatctggtgatacgaaaaaatgatgcattattccccctgtttcttcgcgataacagcgtaccactcgccttgattgtcgacctccagtatttcaaagccgtgtgcaatcagactatttttcacatcgtctacatatttttcgataataccggaagaaataaatagaccatcttctttcaagtacatccgaattgagtcaatcaaacgaataataacttccgctaaaatattcgaaacgataagatcagcctgctgatcctttggaataacatcgagcaaatccccttctttgatctctactttatcctgaaggtcatttaactggacatccgctacagccgcgtcaaccgcaaccggatcaacatccacaccaataactttcgccgcacctaatttggctgcaatgatcgacaaaatcccagaaccacatccaacatcataaacgcagtcagaatccttaacgtatttatctaacgcacgtgtacacaattgtgtggtttcatgggtgcctgttccaaatgccatccctggatccattttaataacgacttcttcaccagatggctcgtaattttcccaaattgggacaatgacaacacgatcaccgatttttgtcggtttataaaaagcctgccaagccgttgcccagtcttcttcctttactgacgatacgttaatctgataatcccccggatcgagaccaaattgacgaatttgagcaatatcatgctcaatctgatccaatttctgattaaaatcgttatcgtctggcaaatatcccgtaatctttgagatatttggatcaaaatccaaaattttctgatcaaaataattaatcgtcggatcgtcttgaacggctatcagattttcaacagactcaatcgctgttccttttaagccggcttcatataatatattggttacggcatcttccgcttcacgtttaatgattatttctatagctttccaatccatatggcgtatactccctttcaatctttgctatattataccagaataaaaaaacttgtcacttctggaacatcagtattttgtcctttcccggcaaatatccgttatttcatccttttctttattaaaatgtggtaaaataaacaatatataaaacttaaaggagaaaattatgcctagtttagataaagatagagaagggatttcccgttcgattcaggaatatgtccctggtaaacaagtgactctggcccacgtaatcgcaaatcccaagcacgatgtttacgtcaaattgggattggaatctgaccgcgacgacgcaatcggcattctgactattacaccaagcgaagcagccattatttctgccgatgtcggtacgaaggctgctgacgttcaaattggttttctcgaccgtttcagcggctctttggtcattacaggaaaaatcagcgatgtcaactctgcagtacgggaaatcatcaatttcctgcgcaatacgcttggttttgatgcaccagatcatattacacattcgtaaaaatggccagcaataaaaaccgcgtcgctttaatgggtcgaatcagaagcggaaaaacaactttaatgcaagctttgcagaataaagagctgaaatacgcgaaaacacagcaagtgacgtataccgacaactttattgatacgcccggagaattcattgaaatgtcgattttcgcccatcaggctgtttccgtatctttggacgcttcactcatcattatggtcagttcatgtattgatacgcagaattcaattcgcccgaattttatcaccatgttcaatttgcctgcaattggtgtcgtcacaaaaattgaccgcgaagacggcaatcgtaaaagaagccgccactatctccaatacgcgggtattcccgacaacaagattttcgaaatatcgtcctacacaggtgaaggtttggacgttttatctgaagaaatccacaaatacgtcaatcgcgacggacatgatttttcttaaatatattcaaattgataaagccgcattcaaaagaattgcggcttttattaatattatttacttttatcacctgaacacactgctgaggcatcatcttttaactgatcgtgaagaaaaagatcaatcgcggtatctgcattccccgatgcgcctgcaataatctgaatgtttctgtcactcagcatttgcctagcttcttttcctatttttccgcaaatcagcacatcagcgccgattccctttaaaaatccgaccagcataaatttattctgttctggcgcatcgacaacccacgttgtttttaccgattcaccttccgtattgtacactttaaattgtttcgttcttccaaaatgattaaagactgtgccatgatcgtaagagactgcaattttcatattaacgcctgctcaaatcgctaaaaaagctaattacatcgttttaacccaggtatccacttcatcctgaaaagctgtcgatgaaaaccgctttgccgcaactaggacagctcccggtgctgacgctttgagtgattcccaagcatcatctataccactggaccctgacgttgcaaaaagggcaacttgttttcccttccattctgcaccttcaaaaaatgtattgacaatcgtcggtgctttataccaccaaattggaaagcccacataaattcgatcgtattcgctgatatctggcgtcgtttctgccatcggcggtctaaaatctggctgatccttcatttctacggatgaacggctcttatcatcctgccaatttaaatcttctggcgtgtacggcgtctccggttttatttcaaaaagttctgattttgatgccttcgcaaccatttctgcaattcgtttagttgtacctgttgcgctaaaatatgcgactaatgttttcataaattgatcctcctaatttaattttaccactcttttgtatttaaatatctttcaacagaagcgacagcattggcgccgtcacccacagcagttgctacctgacgaacttccttctgtctcacatctccagctgcaaaaataccaggtgcagaggttctgccgtcttctccggcaataatatagcccttttcatcacatttacaaacttggtcgaagccatctgaatttgggacaatcccaactgcgatgaatacgccagacacgtctaagagttgctcttcatttgtatttttatcttttgtccgaaggccattcaccatgccgtcttctccgacgatttcgacaggaagatgattccaaactagttcaatgcgatccgattcaaaaagtttattctgtaaagccttttgcgcgcgaagctgatctctgcgatgcacaagataaacctttcggcatgttctcgctaaaaagatcgcatcttcaaccgcgacgtttccgccgccaacaaccgcgacatccttatccttataaaatgctccatcgcaagttgcgcaatatgaaacgcctttgcctgcgtattcagcttctcccggaatatttaatagactatgcttcgcaccggtcgcgaacaaaacggttttggctgtcaaggtttcttcagcagtaatgacctttttttcttctccaaggtcttctattttttggacatcacccattttaaactgtacgcccaactgatccgcatgctctctcattttctgagccaagtcaaatccattaatactcggaaatccaggatagttatccacttcgtaggtatcgacaatttgaccgccgctcataaaatttcgttctattacaagcgcatcaagtcctgcacgctgcgcgtatattcctgctgtcatgccagcaggtcctgatccaataataattaaatcgtacatcgttcgtccctctttatatttacatcatgctttcaatgatatctacagacttcggtatttctgccgataaaaccacaggtcctgcctctgtaatcaaaatatcatcttcaatacggacgcccatcccacggtctgccatatacaggcccggttcacaggtaatgaccattcccggttttaacgtcactcttctgtcttcgcaaagatcgtgagtatccaaccccagcgaatgaccgataccatgataataataatcatcgatggttttttcaggatcaaacagatccgttgcaaggccgtattgattcagcagctctctggatttttcctgaacatcccgcatattcgttcccacttgataatagggaatgatatcgcgttgggcctggagcactgcttcgtacaatgctcgttgatctcttgtatagtgtccgtttaccggaaacgtccgactaatatcggaacaatatccgcgataacgcgcaccgagatcaaagagaatcatggtatgatcaaccattctctttcggttcgtcatgtaatggagaatcggtgcatcttcacctgaaaccgcgatagtaccaaaagccgtttcttctgctccatgacttaaaatcgtatattcgaaaatatcttgagcttggtattcaaaatcaccgggttttaaatttgccaagatctgattaatgcctagatgtgtcaggtgaatggcgtggcgcattagtgcaagctcttcttcggatttgactaatctcatctttgaaaggagtggtaaaagtgaatgtttgtgttcaaggccaaactctcttttctgatgatctggaaccgtatcatcttcgtaatagtcgagtccttttaaatctgaacagaaagattcaaattcatcgagataacgaatatcatcgatccctgatttctgatgcgctgcatcaattgaaatatgacggccaaaccacttttctttaaagggatctggcttacggataaacaaagttgtcgaattctgtccgtgcatctttgccaagaccaatatgccttctggctcggttaaacctgttaaatataaataattgttgttcacgtaaaatggataattttcatccaacgatttgctgacttcgcagcccgcgccaataatggtagcgctctggtccggcagtaaatcgtacaacgcttcccgcttgttctgataaaattcttgtgaaagttcctttaccatcattatgcctctcttttgctcatcttggtaatatataacgcttaattatttcagccacgccatcatgatcacaatcgcatggtccgatgatatcggcattttttattaagacattgctgctgtttggcatcgcgatgccgattcctgctgttttgagcaattgcagatcattttcgtcatcgccgatcgccacaacctgtttaaacgaaacatcataatgcgcacataccttggccaatgcctgtgctttatttagcgactttggcgcaatttcaacaattttgtctccgccatcatatgaaacagcaccatttgtatgaattaggcgagcggctgttacttcttcttcgtttctgcaataaaatataatcctcactgggtgatcaatattttcaatgtgtgccgccctttgaacgtaaggcttttttagaacctgtttggccgtgcgacttgctgtttccgtcgacgcgttttcataataaaccattgaaacagtgtcgacaaaataaaataatgaagtccttcgtatttgtttcaacaacacttgaaacacatctgctgcaaagcagttctcacgccagagcagcgaatgacctgtatagatgcctgcaccgccgttgcacacgtgccaattattttgaacttcgggattcagctgatcagtaaaatcgatctgtgaatgaaaaaaccgtccactcgccgtaacaacatgaattcctgccttttcgcactgcacgagcatgcgtttgttttcttctgaaatgatctttttagaatttaaaagcgtgttatccaaatccaatgcaagcaggcgaatatccgggttcatcatgcacccactgccatcaagccaaaggcacaaagtgatgtgacaatgatcccagcaatagcagaacctaaaacggccgacaacacaccttgcttaaaatccatttcaataagcgaggcagccagacagcccgtccaaacccctgtccccggcagaggaatagcaatgaaaatcatcagtccccagaacttatatttggtaatgcttttcgatttgttgatgccgcgagtatgcagccattctgcgaaacgtcccaaagcgccctttttccctctcatccattttaaaaacgccggtaaaaattttaaaataattggcgctggaacgatcgagcctgcccatgcaagcaaaaaggtctgcagatagggcatccgcatcaataaagtccccactgggatcgcccctctgagctcaacgatcgggatcattgaaataatgaaaacttcaagccaatttggaagaaacgaaaaaaattgtataattgaatgtgccaaatcaatgctccttttgtattgtttccttattcgtgttaaaatgacaaatgctatgacatatattttacaccaaaaaggataaattacaattgatagtttactatttaaaggatcgttaatctatgaaaaaaatattaggaccgatgcgccgtgctatccaacaattccatatgatcgaaaatggtgaccgcattgcggttgggttatctggtggaaaagacagcattgccttattggcagcactggcgcgatatcaaaaatttgcacctgtacaatttgatctggaggctgtgaccattgacgctggtcttgagggaatggatttttctccgctcatcacctactgccatgacatccatgttccctataccatattaaagacatcgattgcgactgttgtatttgacattcgcaatgaatcaaatccatgctctttatgcgcgagaatgcgccgcggcgcattgcacaatctgtgccgcaggctcaactgtaataaattagcgctggggcatcatgcagatgacgccgttgaaacctttttcttaagccttttttttgaaggccgcatcaatacttttcagcccgtcacttttttggaccgaaaacagatcactctcatccgtcctttggtttttgtcaaagaaaaagatattatttacgattcagagtgccaatcattacctatcattggatcaacctgtcccgcagacggatttacaaagcgcgaagatgtcaaaaactttatcgccaaaatgcgtgccgagattccggatttgaataaaaaagttttatctgccattcaaaatccgcatccttttattccgtggacaaagaatttaaaaaaatagaagcatcctaacacttagaatgcttctcctaaattccttattgtgccttaaaaatactcgaaaacgaaataaacaggtcccgataaatcgaaactttaattctttgaggagaattgtaaatcttaggaataaaagcgtttttcttaaaattatattccaagattacctgtttttgaggatcaatgatccagtattcctttacgcctgcttcagcatagatccccgttttcatcaaatagatcatttcttcttcttctggagtcacaatttcaatcacccaatctgggaatgagctgccattgacagtgaccgaaagtgaagggcgcagctgcgtattgtgcatctgccccaccatcaaaacctcataaggatccgacagctggtcgagtgggcgatgactgagatgatactgcttcaaaattgaagacaaatatttaatgatcgccttcgcagatggatctgtcgtattttttgcgtattcttcaccatttataatttcgccctgaggggtaaagatcggttcctcctgcgcattttgttctgtcataactgcgtcttcagcaatagaatcgtgattgttatccatttttatcttttactcctttatttcatctctttaatatgtccaacttccgattcgatttcacgttttaataaaataagctgaatcaaatcttcctgaaccgatatgcggttgaattctgaattgtattcatcagccagctccggcctctgaagacggcgcagtgtttcaatattttcaacaatatcattcacggtactcgacttcattctaaacaatttctgggctgacaaaatttcatctcgaatcgtcgacatttccgtatccaacgactggaccgtattcgctgttttcgtcaagcgctttttaatcacttccggtagtttagctttatacttgtaattaagcgaatgttcgacaactgcccaaaaattcatggcaagggttcgaatttgaatttccacaaaaatttctcgataccccacactgctgaaaactggatattttacaataatatgatagctttgataaccgctttcctttggctttccctctccgctgtgaaaagctgaacggtcctctcccaggagataattcttcacttgataaaccgttaaatccttattattgcgcgagtaaatcatatccgccacttcgtaaatatcttcaacaaattgacagataatacgaatgcccgcaatatcgcggattttttcctcaacatcatcaacgcgataatgatatttattgattttttctaatatactcgacagcgatttaacgcgtcctgtaacagattcgatcggtgaggtttctcccaattgtgcacgctgatcctttaaatgattgaatttaagcagtaattcatcaactgcctgctgataaggaattagtatgcgttgccaatccttcgctttcatctctctccttttctctcctattataacttacaaaacaatttttccaataagtttctgtcgattttttcgataagcacacccttgcatcaagtgctgggcacgcattcgatcgattaacatttctctaattttccaccagctgatatgccagtttgtctgaatcgaatcctgctcagggatacgcccaatgacgcgttgaagtgcaatatccggcgctaaatgcgttaaaaataggacgacgcgatcgatataatcgtcaacacttaatagctgtacttgatttttttggtacatctgagccaatttcgttcctcgttccacgtaaagcgcgtggcacttaacgaaatctgttcttaataccgaaatcaattcagctccctcgacagcatccacttcgtcgtcccaaggtaaatccaaaatcatatgggtgcaaagttgtaaatgatgcgccttgatccttaaagccgcatcgacataatcggaaagtgaatgctgccgattgagaatacgcagtgttttcgcattgattgtttgaagcccaagttcgatacagatatcaatatgattatcttcgctaattcggtttaaataatccaattgctgatcactgatacaatccggtctggttgaaatggcgatgcctgcaatttgttcccccaaacaagcttcaatatgagacttgaatgtttcaaaatcgacataagtatttgaaaaatcctgcagaaacgggatgaataaattggcgtgatatcgcttgctaatataagcttcattccttttgatttgatcttgaatggagatcgatgctgaaagcgtttcattcccggcccctttttctccgcagaagatacatccgccataagataacgtaccgtctcggtttgggcaggtcccccctgtattgacaggtattttataaaccttctgcccatagcgtttttttaaccatgacgcataggttaaatacggcaaattcgtttgatatggatccttcatgtaaatctttctaaatatctccacaaacagataacgccgaatgtatgagattcacacaatcggcgtcttgaataatcccgttaatagacaaaaaagcgaatttatttataattttttatgcattccggaatttcgttttcgtcacagctcaggctcagcacgaatttcacatcctgctttttctgaataacatctaaacgtttcaatagaccttcaacatcttccggtccatctgcatccagaattcttaataaattatcgatatagactgtatcaacatcgtaattgctgcctaaaacgccacagataaaaccgaacaattcatcttctcctttaatgccaaagtcgtcactattgatgaaacgaattttcgtatcaactgttacgcgatatttatctctgtcatttataaaaagaatttgacctttggaagtttcaagttctgcattcgccatgtcgatcatttttttcgtcttgccgcttccctttgctccatatacaaattcaatcatttaagacacctactttctacgttgttatttttattataacggtgaaaacgatattattcaatgcttttttttgcctttttccttattgcttacggctcagcatatatgttaatgtatataaactgtccgaaatattgacatcctcaatcatgacatcgtcgggcagtgtcaaatcgatcggaacaaaattcataatgccttttatgcctgtcctcacaacttgattggccacactttgtccaatggctctcggtacacataatatcgcaatattaatcatattttccttaacgtattcatcaagataatccatatggaaaatcgggacgccgtcatgggtctgacctaccttctcagaatcaatgtcaaacatggcacgtatccatatcccttcattcctaaagccttcataatgagaaattgcgtggccaagattacccgcaccaataataacacagcgataaggtcgattaagccccaataaatcgtggattacatccttcagttcctgaactcgatagccgtatccctgctgcccgtaggcaccaaaagaattcagatcttgcctaatctgagaggctgtcaggcccatcattttcgacaattccatcgatgaaatcttctgaaatcccctttcattcaagtcggtcaaaaatcgataatatttgggcaatctccttatgacactcatcgatactttttttgaattttttcgcatacgcgctccatttatctctaaatatgcaatcatttaatttgattgttataattataacaaaagaacctttataaatcaattaggcataaaaaaactacttaagacatcttagagagacttaagcagttcaattcaaaatggtgcggatgaaaggattcgaaccttcatacacgaggtaccagatcctaaatctggcgcgtctgccaattccgccacatccgcaggcagcgttactcgagacggcaagcgctcgtatgtaacgtgctattaaaaaataccataaaaaagcagcaacttcaagaaaaaattgctgcttaaacctgtgaatttcctttagtgttcaaagcccaaaaccgtataatctttatcttcaatggctttctttaattgcgcatcatcaatttctttgttaagagaaacgacagcgtttcctttctggtgatcaaccttggcctgttcgacttctggaaaactttcaagtgcttttttcactgtcgcttcacaatgttcacacatcataccttcaattttaatagtttctattatcatgctttgatctccttttttgtctcttattcctgacttaacggaacagattgaatatccacaaccttgtaatctaatcgttctatcgttcttctaatggtgtcatccggcacttcacgatcttcggatatttttgcaacgcccttcttccagtcgaccttcgcagaaacgccatcaattcgatccagctgtcgttgaatgcgtttttggcaattttcacagctcattccctggattttaacttctttttctgcaatcttgggattcgttaacttcttatcttcttcgacccattcatctccgccgccaccacagcagctgccatctcccgaaaagcgttttctagcacttttcaccgcaatcaaaacgacaacggccaaaactaaaacaataataattgttgcaatcatggtgttctccctttctatttcattaatttcaaaatgacacgaacgagttcatcaaccgttccttctttgtcagctttaatatcttcaacgacacaagtccgaatgtgatcttccagcaacactttattgaacgacttcatcgctgccgtcactgctgcgctttgaactaaaatgtccggacaataggcatcattctcaaccattctttttatgccgcgaacttgtccttcaattctactgagtcgattaagcatatccttatatttgtccggctctctttttttatgccgaacacaacaagcgttatttttttcttcagccattattatctcctcttaatacccccaccgaggtattttttatgtataaagtatatacccaggtgggggtattgtcaacccttccaaataaaaaaatcttacccttacacattattatatctgtaaagataagattaaatcatttatatgatattttgaggatccccttccagccaacatctaatattgtcaaaaacgatttccgcacgccgatacagcgcttcctgagttgcgtatgcaatatgtggcgtcatgatgcaattttttgctctaagcagcggatgatcaggcggaagcggaggttcctcctcaaagacatctattcccgctccagcaattttgcccatgttaagcgctttcgctaaagcttgataatcaatcaatgcgccacgcgctgtattaattaaaatggcattctctttcattttattaatttgatgtgcgtcgatcattcgtgtcgtctctttcgtccaaggcacatgtaaagaaataatatccgcctgacgcattaactgatctaacgagacgtattcaattcccaatgcttgagcttctttcttttgcgtcctgctgtatgcaattaggcggcatccaaaggcctttgcgatttttgcgacctgaaggccgatggttcctgtcccgataattcccagcgtctggccgtaaagctcgctgccaattggaaatttgctttttccctgcatcaaaatgtttcggctctcagagatctttcttttgatatcaatcatcagtccaattgccaattccgccactgcatgtgtcgaatagttagccgcattgcaaatcgtcacacgattcgatttgagatagtcaacatcgatatggtctatcccagtgaatgccacatctaccatctttaattgatgacaatgtttcaatacctcttttcttaaaggctgattggccaatacaataatattggcatctctgacgcgttttatcagtatttcttctgtctctgctttgcggtcgtatgcgataatttgatggccatctgcttttaataacatggtaagggtctttaaagcgtcatcgctgattcccaaaggctccatgattacaatttgcagctttgttttttgatttggagtcttattcatcaaattctccctcttcttttttttcatccataaacgcgtagatttcagaattgggaaatccgcgtgacagtaaatttctctgtacgcgcatttgaagctcccatcctgtataccctttagatttctgcattcttaaatatttttgataatctgcttcgatattatctctcctgatctcatcgtcatcattttcaacattttcttcaaaagtctcttgttttcgggatatctgcgtgctaatcatcgcgtagggataccccctcctcatcatccaattcgcaactttacgttttcttttttcataaggttcatttcgatatcgttcaaacgctgcatcgatcaattcctcgcagcagtgttgttcttcttccttagtataaaataaatcgatgtcgtcaattttttcccttggaatccccctgtgaatcaaatcctgcgctagtcttcgtctgctgtaccgctttgcgcttttattcaattcgcatgcattttgtatgtactgctcgtcattaatgtatccgtatcgtattaaagcttccatacttaccgcaatctctttttccgaataatttttatcttgaagatatttaacaatttccgcttcagtgcgatcacgatacgttaaataattcatcgctcgatcaaatgctgataatttagatgtcctttttttatgctcttccaatataactttgcctcaatacccttaaatttttctattatttatcaaaaaaggcctctcgaagaggccttgatttcgctattcagctaattccatttttttcgcttggtctgtcgtgatcaaagcttctatcatttcatcaatttcaccgtctaaaaacgaatccaactgatgaattgttaatccaatccggtgatccgttacgcgcccttgtgggaaattgtaagttcgaatacgttcgcttctgtcccctgtcccgatttgactctttctttcagctgaaatttcactttgctgcttttgcgtttccatatcgtaaagccgagcctttaataccttcattgccttggctttatttttaatctgagatttttcgtcctggcatgtaacaaccagccctgtgggaatatgagtgatacgaacagcagaatccgttgtattgacgcattgtccgccatttcctgaagcgcggtacacgtcaattcgcaaatcattgggatcgatattgacttcaacgtcttcaacttctggcaagacagcgaccgttgcagtcgaagtatgaatccgtcctccggattccgtttctggaacacgctggacgcgatgaacgccactttcgtatttcaagcggctgtaggcaccttgtccattaatagaaaaggtgatttctttgatcccgccgaggtccaaaatgtttgaattcataatttccgtctgccatctgtgccgttcagcgtaacgcacgtacattcggaacagatcgtgagcaaaaagtgccgcttcatctccaccagcacctgctctaatttcgacgataacgctcttttcatcgttcggatcctttggaaggagcagtattttgatttcatcctctaattttttctgcttttctgtctgttccttcacttcagcctcgcacatttccttgaaatctgcatcgatcgatttgtcagacagcatttcctggctttcctgaatagccttttcagttgaacaatacgccctgtatttttgaacaattggttcaagatgggcgtgttctttcatcaagcgctgccaattctgctgatcggaaataatatccggatttgaaatgtcgcgtgtcaattgaatgtatttatcttcaagggcttctaatttttcaaacattttattttcctttctactctgcaaaaatccatttacattaagatcttagtgactttgctacaatggtttttgatcgtagaagaaaactgtcattgaccccggaccaatatgcgttccaatcacgggtgccaaaatctttctcgaaaaattagtatttccgtattgttccgtcagctgattttgaatcgcctgaaccaatcgatcctgatacgcatcgacaaaatagatgggttgatgagcaatgtcgtaactatagtcagcaatatattgaacaaattttttgaccagtcgtttttctcccctgcatttatccgtaatttccaattttccttcagaattcacgatcatgaaaggatgaattttcaacgcattgccaataaaagcggatggccgactcaaacgcccgcctctacaaacatattccaaattcgtaaccgtgaaaatatggtgaatatgttcatgacagcggtttgtcaattgaattaaatcatccattgacatgcccttttgtgcctgttctgccactacgtcaacaaccatgcctaaaccgccagttacagcctttgtgtctacaacccgaatatcgacgtcaggatattcttcgatgatttcttttctagctaagcaggccgtctgatacgttcccgataagccgcttgaaaaactaagcaggagcgcatcttgaccggcttctgcataagttttaaaacaatcgtaatagtcttggtaagggatttgagatgttttataaacaaccccttttttcatattttcgtaaatttcttcaggctgaatatcgattccatcccgatatatattttctccctgcgtcacgtacaacgggagcacttgaacctgcagttcctccaaacgttcttttggcaaatcgcaggctgaatctgtaataatatgaatgcgcatttaaactctcaccttaataaattttttcgtttaaagtttatcatatgaatccacttaccgcaactatgtgatcttaataccagtcttcccctttttcctggttttgtatattttgaacttcctcttggagatcttcttccttttctttggccttttcttctaggtgattaattttttctcgttctttttttcttttggcctctttagcctttctgcggtcttcctctttattgtgttcttcaatattattgacaaaaacctgagcagaacgatagcccgtttctttcattcggttattgatcgcagcggtttcaataatcgccgctaagttgcgcccgctggataccggaatcgtcacaagcgggatatcaacgcctaaaatattggtcgtttgatcatctaaacctaagcggtcgtatggagaatgttcgtcccagttttcgagccggataaccatgtcgatatcaactgatcttttgactgatttggcgccgaaaagcattctgacgtcaatgatacctatcccacggacttccatataatatcttaacatttccggcgcttcgccaattaaatgattgccatgatgacaggtgatatcgacaacgtcatccgcgatgaaactattgccacgtttgattaactccaacgccgtttcactttttccaatgccgctcgcaccggtaatcacaacgccaacccctctgacttctaccaaaacgccgtgtatccctgttctaggcgctgtcttgttgtcaatataatcgatcagacgatagttgagagaggtggttttttccttactcttcagcaggatcaccttatatttcgcagctgccttttcaaaaagcgccgtttccggcaaatcccagcagacaatcaagcaaggaatatcgtggctgaaaaaatcatcgatgcgtttttccctgagtctcggatccagtgacattaaataagaaatttcgactttaccgaccaactggatacgccggttatcaaaatattcgtaatatccgtgcagctgcagacctggccgattggtaccggaatcccacaattcaaaataatcaaccggcacaatgattttttccagatttaacgacttacaaaattcttcaacttcaatcgtgcataaaggttccttctcagtcatttttttctcctgatgttctaaaatactgatacacagcatcggcagatttttgattcatgccgttgactttcagcaattcatcccgactggcattttttatattctcaagtgtattaaaataacgcatcagcgcttctcgccgtttcttgccaattccaggaatggtttcaaggcgggaggccaacatgcttttttttcgtaattgtctgtgataagtgattgcaaaccggtggacttcctctgaaatttcatttaaaaacgtacaaactggtgtgccgtacgtcaattggtattcctgatcttgataaatcacccctcttaattggtgatgatcgtctttaaccaatccacagaccacactgttcaattccggatacatagataagatagactgtgccgcgtccacgtgtgttttgccgccatcgatcataaagacttccgggaatggtaaaaatgaactttcacccggcgttttgccttcttttaattccctcattccgtgctcaattcggcggaacagcatttcctgcatactcgcatagtcattttggccctcaacggtttgaattttaaaacgccggtatgcttttggctggggtttgccttgttcgaaaaccaccataccgccgacgttgttcgtaccggatatgtttgaaatatcataggcttcaatgcgtttcggtatattctctatatttaaaagattctggagcgattcaactctattttcctgccgtttttctttctggcgtttttcgatgaaatattgttcgagagtcagtcttgcatttttctcgaccatttgaataaaacggtctttctttcccttttgcggcacaataatccgcacgcgggagccccgctgcgcggtcagccaatcctctatactggccatctcatcgtctagaggacaggataaaataatttcctttggtaaaaagtgtgagccattataatactgcttaaccacattagtcataattgcttcgtctgtttcgtctttaacgccgtcaaccatcatgcggttacgtcctaacagcttgccatcgcgcacattaaaaacctgaacacaggcaatattttgatccacctcgcccgataggtttgtctccttctgagatttgattcgataaaacgcgatgtaatcctgattctgctgattttcacttactattttttgtttagacaccacaaaatcgatcgcctgaattttatcgcggcagtctgcagccttttcgtattccatattttctgaagcctgcatcatttctgctgtcagctgatcgacaatcggcttatttttcccgcttaaaatcgcgatgtccttttgaacattttccccataatgttctggttcaatcttcccggtacatggcgcgagacattgccccatatgataataaatgcacggccttccccgtttgacgcccttcgccacctttcggttgcatcgacgcagcggatacactttctgcaaagcttctatcgtttgtttcaccgcagtgctgctggtaaacgggccgaaataacgccccccatcccgttgatgattgcgcgtcattaaaattttaggatatttttcctgagtcgtaatttttatataagggtagcttttatcgtccttcagcataatattgtaccggggacgatgctccttgatcaaattacattcaagaatcaacgcttccatttcggtatccaccacaatcgtctcaatagattcaacatgagatacttgaatctgtgtcttaatcggaagatttttgggattttgaaaatacgaatggacgcggttaaataaattttttgcctttccgacataaataatgtctccggcatgattatgcataatataaatgcctggttttttggggatgttttttaaatttttgcgatcatacatgctattatcatagtcaaaatactgtattttttcaatctttttgttataataatgccacatcgacttgataaggaggctcgtatgctagaaaattttgaagcacaaattaaaagcggcgaaagcgccattatatccaacaatcaattcgaggttgaagtccgtccaagagtttatgaccacggttataccatcaccaaacgcgcattagataatcctctgaacatcattgaaattcgggatattcgtctaccgctttcaatctcccaattgttaaaatctgccaaagaaatgctgaatgcccagtacagcttgtctgcccatgcgtcattataaagccattctctgggatctcgacggcacgctgatggacaccggtccgggcatttttgccgcatttcgccacgtccaaaagctgaaaggctggcatgaaatcgacgatgacacgctgcacacccttgtagggcccccgcttgtccaatcctatatgaaaacctttgatctttctgaagaagaaggcatcaaagcggcgcacttacaccgcctttatcaaaagcagtacagttatcagctctcgatctcttatccaggcatggatcaattattaaagcatttaaaagataggggctattttctggctgtggcgacgttaaaaggtgaacttatcgcgcggaaaactttagaggccggccatttagatcaattttttgatacgatctgtggggttacaccggatcatgtcactgccaaaaaatctgatattatgcagcgcgcccttgaggaattgtctttaacgacgcacgatgcactattcgttggcgacagccagtacgacgccttcggcgcatgggaaaagacgatgccctttgtcgccgtcacatacggatatggctttcattcaactgacgacgctgagccatggcatcctttgcatatctctgattccgtcgacaacctgcacacattcttatctaatatataatgaacgaatacattgaagaacaagattatgaaaaaaaacaccacttctcaaaccaacaattccaaaaatacgcagcgatctcctttattcgaccgcgcttccggcattctgatgccggtctctgcactgcccggtgatttcggcatcggcacctttggcgcttctgctaaaaaatttatcgattttctcgtaaaaatcggttgttcctattggcaggtgcttccttttggaccaattgacgcctttaactcaccctatcaagccgtttctgcttttgcaggcaacccttttttcatcgaccctgaacgtttgaaggacgctggtctcctgacagaagaagaggtgcagacggcgcgatacgatgaaacgccttggtctgttgcctacgattttgtccgtgaaacccgaatcgatttattccgaaaagcctttgaacgcgtcgatgatcaactgagggaaaaaattgtacaattcgaaaagacacagccttggctcgaagactacgctctctacactgcaattgcggccgacaccggtgaagaatgctggaccaattgggatcccgatttgagagaccgcaaggctgcagccattcaagaggccaccgatcaattggctgatgagattaaatttcaaatctttctgcagtatttattttttacacagtggtctgaaatcaaagcgtacgctaatgaaaatcacatcaatattatcggcgatatgccgatgtacgtcgccttgcagagtccggatgtctggacccatcccgaatgctttgaactcaacgccgatgggactcccaaaacggtagccggtgtcccgccggattatttttcggaagacggtcaattgtggggcaatccactgtacaattgggatgagctcaaaaaacaagactacaaatggtggattgaccgcctggatatggcgctgactttatttgataccgtcagaattgaccatttccgagccttttctgcttattggtctgttcctgcggaagaaaaaactgccaaaaacgggaaatggctccctggccctggcatggatttgttcaaccgtgtttttggaacttttaatttctcaagtccccgtattatcgctgaagacttgggtgtccaggatgatggcgtcaggaaattgctggctgattcaggatttcctggcatgcgcgttctgcaatttgcttttattgacgccggcgacggcattcattggccacacaattatattcccaatactgttgcctacactggaacgcacgacaacaataccttgttaggctatctctgggaattaaatgaaggcgccagaaaatttgcctttgaatacagcaactacaactgtcagggagatgaatggcagcagggcggcccgcacagtgcttcctgccatgcgctgatccgcttactctggatgagcagcgcgcgtctcgccatcattccgatgcaggatttactgggatacggcgcagattccagaattaacacgcccggccaagctgaaggaaattggaaattcagactgcctcaggaagccattgattccgccgacaccagatggatttacgaaatgaaccggatctacaagcggatgaatccgcattctcaaagtgccttttaattaaactaataaatcccttacaaacgagaattctcgattgtaagggatttttggattattatgcttttgttcgtttaactgtccagcttcaatacggacataaatgcctcctggggcacttcaacgcttccgacctgacgcatccgttttttcccggctttctgcttttcaagcagtttccgttttctggtgatatccccgccgtagcatttggctaaaacgtctttacgcagcgcagaaatggtctctctcgcaacgatgcggttgccgattgcggcctgaattggaatctcaaacatctgtctagggatcgtttccttgagctttttgcaaatcgcgcggccccgcgcaatggccttttctctcgggaaaatgaatgaaagggcatcgaccatctctccattgagtagaatatcgagtttaaccaaatcagcaggctgataggatttaatttcgtaatccagtgacgcataaccccgcgttctagattttaacgcgtcaaaaaagtcgtacacaatttcgttcaggggcatctcataatgaatatttacccgtgtttcctcgagatattccatattgatgtaagtcccccgccgttcctgacaaagttccatcacctgaccgagataatcgcttggcaccatgattgaggcatcgacaatcggttctttcatttctgagatttcggaaggatcgggcaaattggccggattatctaccatcaacgtctggccgtccgttttgatcactttgtaaataaccgacggtgcagttgtgaccaaatctaaattgaattcccgttctaaccgttcttggataatttccatatgaagcagcccgaggaaaccgcagcgaaatccgaatcccaaggctacagaggtttcaggttcatacaatagtgacgcgtcgtttaacttaagcttcgccaaagcttcctttaaatcctcatactttgcgccgtctgcgggatagattccacaataaaccatcggcaccacttttttgtaccctggaagcggctctgccgcaggccgtgccttttccgtaatggtatcaccaacctctgtatcaccaactgttttgacacccgcaacgacgtagccgacatctcccgcctgcagtttttctcccgggtagagtttattttcaaaaaagccgacttcttctacatcaaagtccaaaccgcctgccattaggtgcaccttcattcccgctttgattgtcccttcgacaacgcggacagaagcgataacgcctcgataagtgtcgtaataggaatcaaatatcagcgcttttaacggtgcgtccgggtcgcctgtcggcgccggcacattttgtacaatatcttcaaggacatcttcgatattgatgtcgttctttgctgaaatgagcggtgcctcatcagccggcagtcctaatatgtcttcgatttctcctttgacgcggtctggctccgcagaaggcagatcaattttattaatgactggcagaatttccaaatcattgtctaaggctagataggtattagcgatggtctgcgcttcaatgccctgtgaggcgtcaacgacaagaatggcgccttcacaagctgccagcgatcgggatacctcgtacgtaaaatccacatgacccggcgtatcaatcagatttaaaatgtaggattccccatcttttgctttataaagcagacggatcgcctgaagcttaattgtgatgccgcgttcccgctcgatatccatattgtcaagcagctgatcttccatatcgtgagcagagatcagaccagtcttttcgatcaagcggtctgctaacgttgattttccatggtcaatgtgcgcgataattgaaaaattgcgcgttctttcctgttgtgtttttgccatttatgcctcttttattgtattcttaatttaattgatccagggtattttatcataattccccggccatatcaccattttatcaaaagattcgcgtttttgcttgtttctccgtagatgttgtgctataattcgttcgttaaacaataaatgaggaggtctgctagaacatggcaaatatcaaatctgctattaaaagagcaaaaaccaacgaaatcgcacggatgcgtaacaaggctgtccgcacaaacttgaagactgttgaaaagcagttccaggctgctgttgcagaaggcagtaaggaaaacgcacagaaggcatacaacgtcgctgccaaacaattggacaaggctgttgccaaacacgtgatccacaaaaacaaagcatctaacaaaaaaagccagttggccaaagctcttaattctgttactgactaattctcgtttattccctaacacgtgtctcaaggtgatcccaatcgatcaccttattttttttgtcttgataaacgcatcatgagcaaagatatagccagttccggatcgatttttcccgttttcatcgacaagtctaagtcagctaaggtgatcatcattttttttagcggcaataatcccatttggcggcagcgctgtgccatctttttaaccacaaacaaagggcgcttcacctgtttggcaatttgagacacagaaatgcgccgttcagagagcattcccacctctgtcatcgtcctaatctgcccagtcatcagaccaaaaacgccaaagggtgactccccttgatgatagaaaagatcaagcatctgaagagcctgaccggtttcaccgccaatagccgcgtcgatcattttaaaaatattatcgtcaatggcttctggaatcaccgcttcgaccgtgtcgatgcttactgaactttcagatccagcgaaatcgatcatctgcgccgtccaatgatccatcatttctacgtttacattttcgctttgaaggtaccggcttctctcgattgcatgccgcaacgccctgctgctgatcgttttattttcccgtttcagccgcatcgccatccaattttccaattcaacaagcgacagcttttcaaaattaactaattccccattttttatgaattgcttgtatattttttttcgcttgtccggtttactgtcgagcacaattaatatcgtggtcggctcaggcgatgcaagatagtccgaaaacgcctctactgtttccttcgccgacgtccgcattaatcccacttcttctctcacaacgacgacccgataggcactcatcatcggcagctgtctgcaaatttcgataatttccgaaatctccgtatccttttcggaaaacgacatcacattgagctgatgcatgccttccgacacggctgccttaattaagttgcccaccatcatatctgcgatgtattgttccggtcccgcaaacagatataggggtgacaatttattttgtttgatattttttaaaagctgttggtaattcatgatgctattttatcataaaaatacacgtctatcgcgaataggtcctaacctttatgattttcccatccgttgttagactgactgcgccattttgatctgtcctcaaatacgggatacgctgttttttaagtctttttagaacttgaggattggggtggccgtatcgattgtacgcgcctacagaaatgactgcaagagccggtcgaacttttttcaaaaatgctgtggaagtagccgacgcagatccatgatgtccgattttcagtacatcggcctttacacttttctccggcagcatcgcttcagtcgcaaggccggcatctcctgtgaataaaaatttcttttttcggtacacacatcggacgaccatagaatgttcattctgttcgtcgtccggcaatggagcaacccacgtgtccggccataagatctgaaaatccacatggtcgggtgattcaatatgtgcgttttctccaagctgtgtaatcggggtatgcttttggttaagcaaaggtccattgtacttggtgctgacgtaaatgcggccaaccggtatttttccgtcaatcaactcttccagaccctgggcatgatcagcgtggttatgactgataaacacgccgtctaaatgatcaattccttcggaataaagtgccggcagcagaaccgattctgaaatagggtctttttgagctgtcgtactctgcccgggaacggccggctcgtatcccccaccgtcgatcatataatgatacccattcggcgtctcgattaccgccgcgtcgccctgccccacatccaaataaatgatttttaattttccaggcaacacggccggtaggatcatccaaatagagagaagtgaaacgcaggccagcagggcggcttgatctctttttcgatcgagatcgatgtagccggctgcgtaaaatacgaaaactgcgagcattacgcttaaaggcaaaacaaaatcaatgaattttccgctcgaaaaattgagaaacctaagtcgattaatcaactttgtaaaatcaataatgaccccagacaaaaccgcgggaacaaatccaaaaatgactttaaaatcgggaaataaaagtaaaagcggcagcacaacccacgaaacgattaaaagcaccccgacgatgggaaccagcaaaatattgccaaccaagccgatcacactgacacggtgaaaatgcgccatcgtcgccggccaagtcccaacaagcgcagtcattgaagtaagtatagtcgacaagctctggccgtccatcgtctcttgatcttcgatgtgaaacacttttgccacacgataatacaaaggctgattgaataatacaaaagcgagaacggcgccaaaactcatttgaaagctcgctgtaaataggcagtagggccaaatcagcaggatgaccgacgcagccagtcccagcgctgacagcgtatcgacgtgtcttttaaatactcggcctgaaaacgccgccagcagcataatcgaagcacggatcacagataccgaaaatcctgtcagtgcaatatatacgagtaaaacagtggccagcgcgctgaaggtttttcgatcgtctaactcaaaaaagcggcacaggaccaagaccagcatacacaaatacccggtgtgcagtccagatacagctaagacatgcgcaataccggcgtctgagaactgctgcctaagctcagtatctccttgtaattcgccaaagcagatacctgtgatcaagtgagcggctttcggcgcaaaagcgtcattgcagacatcgatcaatttttcccgaactgctaatatgctgtaatatggagaccgccactcaccgatcttggtgacagaagaaccagatggcagatagagacaggcgtcgatatgcttggatttgagatacacgtagtaattaaaaccaccggggttgtgcttgcctcgagccaaactcatttggcctattcccctaatcactgctccaggtcttaatgctttgatatctgggtcttgattataacctgaaacagtcacctgccattctctcggtttctcatgccggacgttctttaatacaaaagtggttttgtgatcggcagactttatcctcgaatcgacaataccgacaaattcaacctttctttctttataaggcggcggattgagatgatcgcaaaaaatacagccgtaactaagaacaacaagcatgatcacgagagttattcccagcatcggccttttcatcgtttttctcctgttgattataagattttcaaatagtatatcacgtttttttaggtttttaaacgattactttttcgcgaatacaagcaaaaaaacgcagtgcttttgaaacactgcgtataaatagataatgcttggcttatttactttttatgctctggctttctgaatcgccttggtgatttcgaccaccgcaagtggtgcgacagaagcgagaacaactgtcacccactgcactgcattgagtgcagtcaccgtaaagaatggatgcagtgtaggaatcagaatgacgatcagctgcacgcaaacagaaatggccatcgcgccccaaaggtagcggtttgtgaaaagatgcttaaatgccgattgtttttcgctgcgtacattcaatagatgagccagctgtgataagcccagcacacaaaagaccatggtgcgccctacagcaagaccgtacgttttttctgcggtgacaaacacgatcaaagagatgaggaacaacacgatcccttgaaagatgatccgtccgccaagtccatgagcgaagatgctgtcgcctttccgtctcggtttttctttcatgacgtcgtcgccctgtttttccataccaagtgctaaagccggcagactatccgtcaccaaattgatccacaaaatatggaccggcaccagcggctgagggagtccaatcagcgtcgcaacaaaaataaccaaaatttctgcgatattgcaggaaagcagaaaatgaacggcctttttgatattgtcgtaaatgcctcggccctctttaacggctgagacaattgtcgaaaaattatcgtcagtcaggatcatatccgcggcttcttttgacacgtctgtcccggtaatccccatcgcacagccaatatcagcccgtttaagtgctggcgcgtcgttgacgccgtctccagtcatcgcgacaacatcaccatgacgctgccaagcctgaacgatccgtaccttatcctccggcgatactctggcgtagacgctgacacgcgcgatcacatcgtccaattcctgatctgtcagctggtccaattctgttcccgaaagtgccagatctccgtccttaaatatttcaagatctcgagcaatggcaacggccgtctgcttgtgatcgcctgtaatcatcacggttttgatgccagcctgatgacaatctctgacggaatcccgaacttcttcccttggcggatcgatcatgccggtaagtcccgcaaaaatcaatccattttccaacttgtcttctgaaattggcggtttttcctgatattgctggaacgcatatcccaaaacccgataagagtcgttagccagcgtatcgttggccgaaagaatttctttccgccgttccggcgtaagctcgagaatttcatatccttttaaataatgtgtgcattttgccaacaggcagtccggcgcacctttagtgaagctcaaataagtgtcgtgataatggtgcaccgtcgtcatcaatttgcggtctgaatcgaatggcagctcgcccacccgaggtgcttccttgatgttaatatttttttcaaatcctaaacggtctgcataatcgaccatcgcgacttcagtcggatcccccacttcaactggcttttcaggatccttaatgacttgcgcgtcgttgcacaattcgccaatccggacgacaaatttttccgacggcgtaaaaccgtcttctttaatggcctccgcgtcaataatcccttcattcgcgtagacttttttgatcgtcatccgattttgggttaacgtccccgttttatccgtgcagataactgaggcacacccaagagtttcgacggcgggcagctttctgacaatcgcatttttcttagcgaggcgggtcgttcccagagccagcacgacggtcacaatggccgggagcccttctggaattgccgcgactgccaaagataccgcggtcaaaaacatttccagcggattgccgccgcggagcagccccactacaaagacgacaccacagcaaatcaaagcggcaagtcccaacgtttttcccaattgattgatattctgcgtcagcggcgttgcctgagattctgtgttctgaatcatgccggcaatctttccgatttccgtatccatcccagtcgccgtgacaacaaatgtacctcggccataagtgactgaagaatgcatgtaaaccatgttcgtccgatccgctaagggtgttgattcgttaaactcaccgcttaatgttttctcaaccggaaccgattcccctgtcagtgcggattcctgcactttcaagcccgctacctcaattaaacggccatcggctggtacggcatctcccgcctccagcagaacaatgtcgccaggcaccagttcttctgatcggacaacttgatgcaccccgctgcggatgactttggcctcatgtaccgtcatttttttaagtgaggccatcgcggattccgctttgttttcctgaactaccccgatgatggcgttgagaaccacaatcaataagatcagaatagcatccgatacttcacctagtgcgcctgatataatggcagctgccatcaaaacaagaatcaggaaatctttaaattgatcgataaattttctaaataggctgacttttttgccctcagcgagttcattctttccgtattccagacgtcgtgcctgaacttcccgctcattgagccctttctcgcgatcgattttgagagcctgatcaaagctgcggtcatccatcaaatcgtaccgtattgatttttgttttcccatgttttctcctttaagtgaaataagttccggataaaaataaaagacccttatccggattgcttccgaataaaggtcttactcgcaaaaaaactttttgcgttcaaccggagctaacgctcgaaatgacgactgaacgaaggtgagttactcccctttaaacttttaacggtgcaagtttaccaaaacaatttgaaactgtcaagcttttaaagcattaattcgtgcgacaacctgcgccagtttgtcttggttttcttgatctttttgacgttccttttcaacaaccgccgcaggcgcattggcaaggaatttttcgttgcttaacttcccactcgtctttttcagatctttttcaatcttttctttttctcgattcagacgttcgagttcctttgccttgtcaaccaaatcgttgagtgcgaggtaaatggtcgaatcttccacaaccgctgagacaaaatcttctcgtatttcatcttgtccgattttttgaatcgattcaacaccagccattttatcaagcgtatcaagggcattcgataagacattgacatccttctggttttctgtcgtaataaacaaagcggcttttttcttgtttggaatattcgattcttttcgaattttccgaagcgcacggataattcccattaagtagcgaatctgtgcttcctcttcagggaaatcgtaagctgggtctgcttccggccagcttgcgataatcagcgcttcacccgctcccggcaggtaatgataaatttcttctgtaataaacggaataaacgggtggagcatttttaatatattctgaagcaccacgttcaaaaccgttaatgccgcgcgtcggctgtcctgatcgtcgccattcaaacgcggttttacaaactcgatataccagtcgcagaattcattccacgcaaaatcgtaaaccttctgcgcggcgatgcccaattcgtatttgtcgatattcgctgtaacttcgcgaataatctggttcattcggctcaaaatccacttatccgccgattcaagggaaaccttggacaaatcgagtccaatatcgtcgtccatgtacatcatcacaaagcgggccgcgttccaaatcttatttaggaaatttcggctggattcgattttatcctgcgtccatctgatatcattccccgcagaattgcctgtgagaatggcaaaacgcatcgcatcggcagaataatcgcgaataacttccagaggatcaatcccgttgcccagcgatttgctcattttgcgtccctgtgcatcgcggattaaaccgtggatatagacatcggaaaacggtggttcacccatcgtatcgattcccatgaaaatcattctggcaacccagaagaagataatatcgtaccctgtcaccaagacattgttaggatagaatttttcaagatcggcggtgtcttctggccagcccagcgttgaaaagggccaaagggcagatgagaaccaagtatccaggacatcttcttcctgtttcaagtgatgaccgccgcatttcgggcagacttccggcgtttcttcactgacaatcatttcaccgcaatcgctgcaggtccatgctggaatctggtggccccaccacaattgtctggaaatacaccaatctctgatattttccatccaattgaaataaattttagagaaacgctttggaataaattgggtttttccttcgcgcaccacatcaatcgccggttttgctaaatctttcatgcggacaaaccactgttcactggtcatcgtttcaaccgtcgtgtggcatctgtagcaatgtccgacattgtgcacatgttcttctgtcttgacaagatagccttgttcttccaggtcctttaatatggctttgcggcattcgtagcggtccatacctgcgtatttgccacagcgttcgttcatcgtcccgtcgtcattcatgatcttgatttcttcaagattgtgacgcttgcccacttcgtagtcattcgggtcgtgtgcaggggtcattttaacaacgcctgtaccaaattccatatcgacatagtcgtcagcaacaacaggaatttccttattgacaattggcagaatcaccttccggccaactaaatccttatagcgttcatcgttcggattcacagctacaccggagtcgccgagaagtgtttccggccgagtcgtcgcaatgaccacttcgccgtttccatcggcaaagggatagcggatgtgccataaatgcccgtgttcttcttcgtattcaacttccgcgtcggacaaagccgtctgacagtctgggcaccaattgataatgcgcgttcccttgtaaatgagacctttattgtataaacggacaaaagtcgctttaacagcttttgaacacccttcatccatcgtaaaacgttcccgatcccaatcgcaggatgcaccaagctttgtgacctgcttgcggatacggtttcggtaaaagtttgcccaatcccaagcgtatttcaaaaactcttctcgagtcaaatcactttttgagcggttttctttttctttgatgctatttaagaccttaacttctgttgcaatgctcgcgtggtccatccccggcacccaaagagcagcgtagccctgcattcttttgtaccggatcagcgcatcctgaagtgtatcgtcgaatgcgtggcccatgtgcagctgccctgtaatatttggagggggcataataatcgtataaggtttaccgttcggatgaacctccggcttaaaatatcccttttctctccaccaggaatagatacgattttcgacttcgtctggttcgtaaaccttggacatttcctttttcatcagctatatttcagacctttcagtaataagattgtttaacgtaatgcgttcattttatcgtaaatgatacgttatttcaagtttgactgtgaatgctcaagcttctgtgtttcacaaagatgcgcgagcgggcacacctcgcattttggatttcgcgcagagcaaatttttcggccgtgccaaattaattgatggtgggcagatgaccaccgggattcgggaagattctgccttaatcccttttcaacctctaagacatttttccctttcgccagtcccagccgattcgacacgcgaaaaacatgggtatcgactgcaatagctggaattccaaaggcgttactcatcacgacattggccgtttttcgcccaactcctggcagagaagtcagctccttcatcgttttgggcacttctccgccgaattcagagagcaaaagatgactcgtcttcaatatattctttgccttggtgttggataaaccgcaggatttgattttttcccgcagttccccttcagtcagcgacagcattttttcaggtgtattgtaatccttaaataattcagctgtcaccttattcacgcgaacatctgtgcactgtgcagaaagcatcgtcgcaattaataattcatagggcgaattaaaatccagtccacatttttgcgtcccataaacatcctggagaattttcaacgtttcgttaatttcactttgattcattttttccctcaaaaaaaccctgccgtaacgtcggcagggtcatacttaaatttttgtgtacgcttactgaagaccagtaattaatttatctgaacctaaagctttcatatagcttccgtaggtcgccgcggaagtggcaccgtatccgccgatcgctttgttgtccaggttaccagtccaaacggctgtggttaaattaccggtcattcctgtgaaccacaaatccttcccggaatccgtggtccctgttttaccggcagtgccgtatacattcgcattagtcccagtcccgcttgtaacgaccttgcgcagaattgtcttcatcgtcgatgctgtcgaggatttcattacttgatgggtatccagatttaaatctgagctcgtaaagacggtgctgccattactattcaccactttcgtcacaaacttcggctggttgtaaataccgttgttattgaaaatattaaaggctgccgccatttcaatcggcttaatcccatacagcatcccgccgacacaagtattgatattgtaatcgctagattgaaaagtcgtgatgcccatcgtcttcatccaatcgaccgattcattgacgccaactgtataaaaaacgtaagctgccggtgggttgagcgatttaaccaatgccgtggtcaagtcaaccgtgctgccgccgccttcggctcttggcgtccagttgccgtatgtcccgtaattgtgaagctgagaagttgctgtgaagatgcccttgtcaattgcagcactgtaatacagcggtttaatattggaccctggctgtctggctgtgttacacatatcgatttgcgtgttgccgccgtaatacgctctgacggatccatcctgatcgagggtgacaattgctgttgtcgtaccgctgccttccggatatttgctaagcgcgactttcatcgcgtcgctctgcatacccgtgttgatggtcgtatagattttgtaaccaccgctggacacctgcgtccgcgtgtatttaatggcttctttcttcgaaatgccctggcgcttcatcacgttcggtgcaaccgcttcggcatattgctgaagcgctttgttgacaaatttttcgtaaccttcggtgacttggttatttaatttcgatgcatcccacttaacgacattaacttgttctgccttggcctgtttagcttgggctttcgtaatgtaccccacactcaccattcgatcaagaacctcgccctgccgttttttagccgcatcgtaatggacattcggcgcgtaaccggatggcgcctgcggcagaccagcaagcatcgcacattcagccaaatcgcaatcccaaatgtctttgccaaaataggttttagccgcttcttcgatcccatacgctgatgaaccaaaataggtttcattcaaatacatttccaagatctgattcttagaatatttcttgtctaactgtctggcaatggaaatttccttgaatttacgattaatcgaatcgctcattgtctgttcagtcgagatatccggcaggaacaatgttctagccagctgttgtgtcaacgtactggccccttggcttctcgtattccgatggagcaaattgaagacaatagaccgggcaatcccataataatcaacgcccccgtgatcgtaaaaacgactgtcttccgtggcgattaaggcatttttcatattgtccggaatttgattgagcgaaacgtaagttcgattttccgtgtacaattctgcaatcacttgattgtctgcagaaataatttgtgttttttgtttttctctgtatttatagtctgaaatatcgacgcggttccgctgatacatagcaaaaataccggctgacccagctacaaaaagaacagcgaggataatcagcaccttttgccagactttgaattttttccgcttgcgtttccggctcggcaggccaccattggttttctttgccgttttaagcgttttagcgtcgcttcgattttgacgacgattggttgttttcttcttactcttcatgctcatactgtcaatctcgtgaagctttgaatcgtaagcgcctgcttcgatttgatctactcttcctgaagtttcgttagattttttgttccttcttggaagtccctgacgcttacgtttcacaggcgcttcagaatctttttgtgaaggcatatcttgagaaacggcttgacttttcgcttctgcctgtttattttctggcgcagaggggtcttgttcagcctcttcctccatttgcgtcatgatttcttcgacatcctgatcaacttgactagcatctaacggatcagtctgatgtgcgtcagccgcttgatcaaagtcagataacgcagcttcgtcatccgattgattctgcttttctccatcagtcgtcgttggtgctaatgtttcaatggttgcgccaacatctgcttgttcgatattgtttgaatccaatacctcttcaatctctttttcttctggtgtctgcgatgaatccgcatctgaagcctgatcggaaggttttaatcccttaaagcctttgaacgaaaaatgcttttgattttcttttgattgatcttgtggattgtttttcttatcttcttccatacctatccccagtcctaaagactttttaatctattttccaaagccaataaatcggcttttaatggtgcaatgattgtgatattcccctttttgggaagtgttgtccgcatttcactggaatgcagcgccgttctggcaattccaagatcctgttcaatcggattgtaaagatgatcgccaataatcgggcagccaatgtgtgataaatggacgcggatttgatgggtccgtccagtttctaaaagcagtctaacttttgaatactgtttttgtccgtacgtctccaaaacttgataccgcgtcactgaaggtttgccgtcagcccgaactacccggcgaataccatcctctgattccagtccaatgggcaggtcaattttacctgaaaacggaaccggacagccattcacaaaagccgtgtaatattttttcgatttttcaatggtctgatgagactgcaaaaaatgttgaacgtatttattttttgcaattaaaatcatacccgaagtatccatatccaagcggctgataaacctaaccttggccggctgatgggtttcgataaaatacgccgccactctgtttcccaacgtatcggtgccgtgactttttgtaggatgcgttacaacgccggcgtctttattgacagccagaatttcgtcatcctcatatagaatatccagtggacctgaagtcggtgtaagatcgacgtgttctgtcggcatttggatgaaaatctcatcgccatttttgacaaaatccgtcgaccagcacggttttccgttaactgacatctctccttctctgatgattctcgtcatgagccggctggaataagcgtacttctcttttaaatatcgcttcagtggaaccggcgtatctgtcttacagatgtatttgtattgattaaaatttttgtatgtattcactggaatattttatggcatcttgtatattaaatcaattgatttttaaattttcctaaaaataatcgtgctctttaaagctaaaataatcttcggcacaatccgaaactacgacatgatcgaggacttcaatccctaataactttcctgcctgaaccagccgctctgtcaattcaatatcattgctgctgggcgtggtgtctccagagggatgattatgggccagaataatggatgtagccctttggcggactgcaggattaaaaacctcccgggggtgaaccagagaggcgttgactgtccccacagaaatcaattctgtcttaaaaaccatattttttgtgttcagaagcagaattacaaagtgttcccgctcgtagccaaacatctcttgacttaaataggcggcggcatccattgggcatttgatttgaaccatcgtttttttctgatgcttaacgcggcttcctagctctaaagctgcgatgattttacaagccttggcttctccaattcccttgagttcctcgttttgacaaagctcatcaacggaaaccttgtgcagccgctccaaattgctgtcgtaaaaattcaagagcctctgtcctaattcaacagccgtcatatttctctggccagagccgatgatcacggcgatcaactccgcattgcttaataagcttgccccgtgacgggtgattttttctctaggcttatcgtcttccgacaattcccgaagcgttaaatgatttttcatcgtctcaccgattataatatgtaaatttcaataccgattaaattaagtatactgaaaataataattattataccatgtttggttttctttctcaatttacaatctttttgattcttgttataatgaaagaaatctaaatgaattatggtgataataatatgaaacaatgtatggattctgcaaatctgcatcgaagactcagcaagatagaaggtcaggtccgagccatcgaccgcatgattgacgaagatattccgtgcgaagatattctctcacaagttaacgcggtaaaatccgcaatgcataaggttggtcaaatcattctagaaggacatcttcagcactgtgtcaaagatggcattcaacacggagacgcggataaaaccatcgcgagttttacaaaggctgttgaacgttttgccaatttaaaataaaagttctgaaattttttcagaactttttttatgattatttaagtgaataaagtgttaagccattgaacaagaataaattcggtgtttccaatgcgtaatcgagtaaatctttttcaaatggatagacagagaacacgccgtatacacattcataggtgccgtattttttattgagaaattccagcgtactgcttttttctttgaatttttcaaaatccgacttggcgtaggcatttgtatcgtaaacgcaatccgcgatgaacattttatgattggtgtggtcaagtgctaaaatcggaatccactgatcgttttctgtgtatgcaccaacttcatcaatttccaatccaattttctttttcatcgaagccttttgaagcatttcaatcaaaattttattgaaccatttttgaatgtacggaatcatgccagacagtgtgtgccgcttataatactgaggatcatctttgagcagaccgtattcggggaacacgaacgtataccaaaaatcgataaaaggctgcgcaatctggtattgcttattcgctttttgcaaacgctttttagcttgcaaaaaagaagccgcctcaatatagcctaattcttctaaatgggtcagcattttttttacatccgcttttttatatccggttgtgtctttaatttgttctaatgttttctgccccattgtgattgacgacaggatagcatgataagcgttaggacgccagacctctgtctccagcagattcgctacttcagcaaacagctttccataaggattgaggatattctgcaaaatcgattttttgatttgtttgatattgacacagtgattaaagaaatgccaataccccgggacaccgcctgtaatggcgtaaacaatcatcagctgattgaaatcgtgatggggatattctgacatcatttcggtaaaggacatcgccgacaaatggatttgatcggtccagatttttttcgcgctgtgttctgactgtaaaatcctgttccagctcgcctcccgcgccgcagcaatcactgttaccccattggtcttaaaatatttctgccacgcttttttaaagatcttcaaaaacgatttgttttcaaaataaagctgatcaaaattgtcaataacgagtatttttccgccgtcttctgttttctccgagtaaagtctaaatagttccagccattccattgcgctcatctcggaagacggggcttgaataccaaaatgagacttaaaaactcgttcaaaagccacgcgattgagacggtcggattgcggccccacttcaaaatataggtgattcttatctttgacaaattccttaatcaagctcgtttttccgaaacgggggcgtcctgtgatgagaatcaacgcatcttcttttttccaagcttctgttaactgctttagttcctgcttacggccgataaatcgcactgcactaactcccttttattgattttctaaataatataacacaaaacaaaagacttccttatgaaaacacaagaaagtctttagagcgattcataattaaaaaataggtccattcagttttaaaccgcaggattcacaagtccagtcgtgtccaactgcttttgtttcacccccgcattttgggcaaatccctgtgcccccttttttaaactgaaaatcttttacttccatatctacaaattcatccggaccatcctgaatgattttgaattttaaaattggcttaggtgcatcgctgctcattgaattcgcctcctctattcatatgcttgattatattttaccacattttctgctgaatagaaacgatttcaaaacaatattatgctctagctttttcgtaacgatcgatcatttcgtcaaattcatcgaccacttctgcttcaggagccttaaaatgattgacgatcaaaatggttaaaacattagcaacaaaacctggcaggatttcataaatgcctgttccaaataatgtggcggaaagtcctgttgctttccacaaaataacaaccagtgtgcctacaatcatacctgataaagcggactgccagctcgtttttctagagtagagaccaaacagaaccaatgggccaaatgctgcgccaaaaccgccccaggaataagagaccaggctcataaccgtcgaattcccattaaacgcaatgataagggctataatcgaaacgccaatgacagaccagcggcctaccttaaccgcctgctgatcggttaattcctttttgaaaataattttcgataagtcttcagataagacagatgaacaaaccagaagctgagaatcgatggttgacatgattgctgccatgatcgctgccaggaagacccctgcaatccaaaccgggaagaatctgtgaatcatcaagataaataccgtttcttccttgccaccggaaagtcctttaaacagtgggattgaaagaagaccaactaaaagcgcaccggttaaagaaatcaagcaccacacaatggcaatttttctcgcctttggaatatctttaacggagtcgattcccatgaagcgaaccaaaatatgcggctggccaaaataccctagtccccagacaactgcggaaataatggtcgctgccgtaacgcctttgccgaaaagcgacattgaaagatgctggctcgccatagctgttttggtcgtaccaaatccgtgcatttcaatcatggccaaaatcggaaccaccgcaatcgcgacgaccatcaaaatcccttgaattaaatctgtccagcacaccgccagataaccgcctaaaaacgtgtaagaaataatgactaccgcgccgattaacacggccacattgtagttaatgccaaacatcgtcgaaaaaagtttacccgaagagaccattcctgaggcgcagtaaatcgtaaagaaaaataaaatgacgatagctgaaatcgtttttaaagcacctgtcggatctttgtatcttttttcaaaaaacgtcggcaatgtgatggcatcgacctcttcggtataaacgcgaagtctttctgagaccatcttccagttgatacacgtcccaatgaaaagaccgattccaatccataattgaggcacaccgcctaaataaatggcgcctggcaaccccatcaagagccaaccgctcatatcagaagcctgcgccgaaaaagcagttacccagcttcccaagcctcggccgccaagtaagaagccttccgatgaatcggaagaagcattataaaatttcaggccgataaaaatcaaaacgactaagtaggcaataaatatacccaactcaataggatttacagaacccattgtattcctccattctctttccgtaattcatttaagtttaccttaaaatagacttaatgtaaagaaaaaagcgtccacataaagtgaacgcttcatcaaattaaatcatttattgaatgtagaaatgctgtccgtcataatcgacgaccatgacatcgccttggcttaaatcgccttttaatattttcttagccaagagtgtttcgatattttgctgaatgaatcgacgcatcggccttgcaccaaaggatggattgtatccttgatcgatgatcgcttgttttgcgtccggtgtcagtttgaaatccaactgctgttcgcttaaacgcttgcgcacatctttcagcatcaaatcgacaatcttgcccaccgtatctttcgacaacggtttgtacagaatgatttcatcaattcggttcaaaaattccggtctgaaatattcttttaacagctttttgaccgtttcctgtgtttccggcttaatgtctccattggcgtcaatcccgtccaaaatgtattcactcccgaggttgctggtcatgatgataatcgtgtttttgaaatccacaacgcgcccctgagaatcagtcacgcgcccatcatccaaaatctggagcagaatattaaagacatccttatgcgccttttcaatttcatccaacagaatgacagaatacggttttctacgcacggcttctgtcagctgaccgccttcttcatagccgacgtatcctggaggtgccccgatcaaacggctgactgagaatttttccatatattcggacatatcaatccggatcatgttgtcttcggagtcaaacaaattcgccgcaacagctttcgccaattcagttttcccaacacctgtcggacctaggaagaggaaggagccaattggtgtatttggatttttaatgccggcccgcgacctcaaaatggcgtctgtcacctttttaattggttcttcctggccaatgacgcgttcttttaaggtatcttccagtttgagaagcttttctctttcgccggacatcactttactcagaggaatccctgtccaattcgagatgatttctccaatttcttcttcacccacttcttcacgaatcaaatgttcttcgtgatcgctttgagagctggcggagtcttcaatgcttttcattttcgctttgagctttggcagttcgccgtatttaagttctccagctttttcgagatcgttatctctctgcgccatttcaatttgatggttcaactgatcgatctgttctttaatattctgaacttcatcaaccgatcgtttttcatcttcccactgcgccttcatagcatcgaatttttctcgatcgtcagccagttctttctgcagtttcgccagccgttcttgactcaactgatcgtcttcttttttcagtgccgattcttcgatttcaagctggatgatcttcctgttgatttcatccatttcttccggcatcgagtcaatttctgtccggatcatcgcgcaggcttcgtcgatcaagtcaatagccttatctggaaggaaacggtcggtaatgtagcggtctgacagcgttgctgccgcgacgatcgcattatccgaaattttaaccccatggaaaatttcgtaccgttctttcaagccacgcagaatcgcgatggtgtcttccacagtcggttcatcgaccataaccggttgaaaccgtctttcaagagcgggatccttttcaatgtattttctgtattcgtccaaggttgtcgcgccaatacaatgcagttcacctctggccagcatcggcttgagcatattgcccgcatccatgctgccgtcgctcttcccagcgccgacgatggtgtgcagttcatcgatgaacaagataatttcaccgtttgaatccttcacttccttcaaaacagctttaaatctttcttcaaattcaccgcggtatttagcccctgcgaccaaagcgcccatatccaaagaaataatgcgcttgtttttcaggccttcaggcacgtcgcctgcgacaatccgctgagccagcccttcgacaatcgcagttttcccaaccccaggttcaccaatcagaactgggttgttctttgtttttctcgacagaattcgaatggtatgacgtatttcattgtctctgccgattacaggatccagtttattgtcaatacaatcctgaaccaaatcgtgaccatattgttttaaggcttcgtaggtttcttcaggattatcacttgtcacattttgtccatttctcatttcactcaccaccttttcaactgctgagcggttaatgccgaattgattcagcatttctttcacatcgttgtgttccggcaggctgaacatactgagaagcagatgctccacagacacgtactggtctttcagattctgagcgatttgaaaggattcattgagtacctgattcatttccggactgacataaatctgtccaggctgagaacccggtcccgaaacacttgggcgtttatcgatttcccgatcgatatactgtttcatctcatcgatcggtttgcccagccggctcataattctcggaaccagcccgccctcctgcgagagcagcgcagacatcaaatgatcggtttcaatctgttgatgctgatgttccgatgcgatcatttccgcatttttaatggcttccagcgatttttttgtgaaagcattcatgtccatatttttcaccttcttactttactctttcatttttccttgtgtcacaatcgatcaaacaataaaacacctaattattaaagaaataacggtaaatcgagtccaatcgatcgttgaggtcgtcttgctctgtactgtcaaaataatgatccatcgcagaatcaatcatttttagatatctcgtcagataatccgtcagatttttttcatcgcgttgaatcgatcctgcatgcttaaaggcgcgaacaaacttgtgattggtttgttcattgccgctgtcgcaatccggctgctgatgattttgttcaatcacactgatgcggttgaaaaaatcattgaacaacgcgttgagattttgattttgcgttcttgagctgattttcagtacagcgtactgcccgtcattctcatttttaaattcgtacatatagatgattttaggcctgtatttgtacttcaagctcttaccaaaatagatgctattattttgattggtgtgattgacattgagttctccggccatattttcactgattgattccaaaacggaatgaattttttgctccggtgttttgattccaagataacttgccaatatatcattgaccagctgggaacgatttgtgccttgagcaaaagccagatcgtcaatctgctcgacaatatcatcaaataatgtcaagctgtataggcttttcttcatatctcccacctcaggtacaattatgctctcatttatttattttgtcaatcattttatataaatttatatacaatttatttattcttaagaaaaaagccgctcacccattttagggtgaacgacttgatcttgcttgattctatacgacaatcaaatccttcaattgctcgtacaatttatcacctattcgattgacatttttaatttcagccggatcgctgaatgcaccgtttttttctctatagtcaatgatattctgcgccaaaacttctccaattcccggcagagccataagctgttccttcgtcgccgtattgagattgacctttgcttccgaagccgttccagccgtctgaacctgctgcgtctgcgacttcgtcgggatgtttaatttctgtccatcttttagttttgatgccaaattaactgcgtctccgtttgcatcgccggtcagtccttttgccgcattgaccgcatcaatacctctggcatccgcttttaattgataaacacccggctgattgaccgcgcccgtcacgtgaacgtaaatttttgaactggacgtctcagaagatgtctcctgctctgactgcgcggtagatttagacaacagcagttcatttttctgataagacctgacaccgtaaaccgcaaccaacaacccgatgacgacaacaccaatcaggattttaatcctgtgccgcttttgacgtttcaaacgcgcatccatggctgatctcctaaattaattgttttttaattgctcaagccagcgtgtaaattgttcctgcacttcattctgtgtcaaaccgatgaccgaaacgttgtgatgaagactctccagaaaatatacgaattgattggcccaaaaagccgaatcaacctgtttgatctctttcttttcaccgccgtacaccaaaacctgttcaattgtttggattaaacggtcaatctgctttcgtttaaccgctctcttttcaggatgggttttgaaaaacaaattgtagcgatccatcatgttaggcttcgaatcccaaattgctttttgataaacgctgaaaatttcttttatgatctcgacagccgaacgctgctcccacatcgaaatcgatacggcgtctaaaagcgcatgggaatcgcgttcaaaaagcgttaggaagatttctgatggtgacgcaaaatagcggtaaatcccgccgtgactgatgccacacgcgtcgataatcgccgtcatcgtcacctgatcaaaatcgcgacttaaaaatatttttcttgcctgttctaaaattaaatctctcttcttttcagcttttcggcccaacgcttaaacctcttcaatgtgataattatagtcattatacaggaatttttgaaaacgttcaaataattatatattgatttacagtcggatcttttcagcttgatccacagcctcttgaatcatacgttccgcatcatccatcataccggcctcacctgcagcaatcttctttaaatttggatgggtttccggatgctttggcacgaaaattgtacagcagtcttcatagggcagaatggacgtttcaaaagtgccgatatcctgtgcgatttcaacaatttcctgtttgtccatgccgattaaaggtctgagaacttccatgtcaaccacactgcctgtcgcggacaaactttcctgagtctggctcgccacctgcccaagactttcgccggtgatcagcgacaacgatcccgtttgtttcgcgatcttttcagcgatgcgcatcatgaaccgacggataatcaaggttgtctgccgttccggacaaatttgaacgattttggtctggatatccgtaaagggcaccacgtacaaatcgaagtgccctgtgtaacgtgtcataatccgaccaagctcaacaaccttttctttcgcacgatccgatgtgaacggaaaactgtgaaaatacacagccgtcagcttgacgccgcgcttcgccatcatataacccgctacaggactgtcaatcccaccggataagagcagtgtcgcctgcccagaacagccgactggaaggccgccgcgtcctttgacaaattccgaataaatgtatgccgactcgcgcacttcgacccaaatttcgcggtctgcgcctttcattttgacttttttcccttggccatcataatgtttgaggaccacgccgcctaaatgccgtccaatttcaggggatgtcatcggaaaacgcttgtccgaacgtttgacacatactttaaagctgtcaaagggcgcgcggtccgcttcttctaaaacaaccggttcgatttggtccatctggcttgcgacaacagtcgccgggctcagtgagacgacgccgaatacacggctgaccgcttctacaccctgatctaattcgtcgtcgctgatatgtacgataatgcggccctgaattttcttcacttccgcgctgtctaaatggctgagcgcgcctcggatatttttgaccaacaaatcaataaaagtgtggcggtttagcccttttaaagcgatctcgccgtaccgtacaagaataacgtgttctctgttttccatcattgttcctttacttaataaattttgcgaattttctgagtttctgcgcttctccgacgatgacatcaacgccccgtttcacttcatcaaaagtcgtcaatgccgagaaagaaatccgaatcgtgccttctgtataactcggggacaacccgatggctttttgaacctggtgtttttcttttttgtgcgtcgaacaggctgagcctgttgaaatataaaccccctgtgcttcacaagcgtggaggaggacctcgcctcttaccccgtcaatggcggcactcatcaccgctggactgcgtctttcttcatcctcagggccgagaattttaacgtgttctaaggcctctgtcagtgtgtcagcaacatagctccgatactgacaaagcctttcgatcacctcgggcgattcccagaacttaactgcttcgtcaaatccgacaatgccctgaacattttccgtcccgctgcgcaggccgtgttcttgcccaccgccgaaaatcaacggtttaatcggccatccttctctcaaataaaccgcgccgattccctttggcccgttgattttatgaccgcacagcgtcacgccgtcaagctttgccttttcaacgtcgattgggcatttcataaaaccttgtacaaaatcagaatggaagaagcagttcggattttgatccttgatgattttgccaaatgtctctaagggttggaaagtccccagttcattgttgacgcccatgatcgaaacgagcagcgtgtgcgcgtcaaccgcttgggccaaatccttagggtcgacaaaaccttcttcatccacaggaagccaaatcactttcaccccgcgtttttcgtagtctaaaaagacttctctcacagctggatgttcgatcgcagtggtcacgatcgttccactttctaaaagagctggccgttttctgtctaagatgccgcgaatcaacaggttatcgccttcgctgccgcctgatgtgtatataatctggcgttctgcgtctcccttcccgtgaatcgcagccattaaatgggccttgcagccctgtatcactttttcttcggtcagtcctggtttatacatcgccgacggattaaaataatcttcctgaaagcttttcatcatccgttcgacgacctgcggcgcggacttcgtcgtcgccgcattatctaaataacatatctgattcattcaattctcctaagctttcttgcgttctctctatcttattacaaaaaaaaagagccgtcaattgtacaattgacagctcttttgtctgctttaggcttcagccggtttttgtttcggctgaggttttttaacaggttttaatcctttgcgcggtgcgaccttccggccttctttaatcaaagcgtgggtcggacatttcttgacgcaggcgccgcaatttgagcattttgaataatcgatcacggctaaattgttctgaacgtgaatggcgtcgaacatgcaggttctttcacacatgccacagccaatacagccgacttcacaattggcgcgaaccagttttcccttttctttcgactggcagtcgacgtgaacaatttgatcttttggaatcagcgtcatgacatttttgggacagatgtcgacacattttccgcaagcgacgcagttttcaatattgacattcgggatcattttatccgtcatgtgcagggcatcgaattcgcagacagatacgcaggagcctaagccgatacagccaaaacggcagccctttggcccgccatttgcgacgacagcttcgttgcagtctttcaatccgtagtattctgtctgtctcggcgccttatcgcagtcgccgccgcagagcacctgtgccacgttaggcatcgcgtcagtgaccgcttctcccatgatggcaccgactttttcagcaaccgccgcgccaccgacagggcacgcgttaaccggcgcttcgcctttgacaatagctgccgcacatccgtcacagcctggatagccgcagccgccgcagtttgcgccaggcaatacggcacgaacctgaggaatgcgttcgtcttctttaactgctaatttttgggacgcaatggccagtgcaacgccgataatcagcccgattacgcctaatattataactggaacaagaatttgacttgccatttatcttcctccttctttctctttatagcataccagaaaatccgaggaacgagatggccatcaagctcgctgtgatcatcgtaattggaaatccctgaagtgcttccgggacgtctgagacttcagctctttcacgaatggccgccatcaaaacgatggccagcgtatacccaataccgccagcagcgccgctgacgactgattcgataaaattgtagttgttctggatgttcagtgtacaagcacccaaaaccgcacagtttgtggtaatcagcggcaggtaaatccccagcgcctgatacaaagacatactcgtctttttgatgaacatttcgaccagctgaaccaaagccgcaatgactaagatgaacgcgatcgtctgcagatattccagtcctaatttagataaaataccgtactgaatgacataagtaattgccgaagccagtgtcataacgaagataacggcaatgcccattccgatggaagtatcaaccttttttgaaacccctaagaatgaacaaatccctaaaaatctcgacaaaagaaagttattgacgaatacgccggcaattaaaattgtaaaaatttgcataatgaatgctccttctctttgctacgcttattctgcaacaacttcttcgctggctgctactttttcagcagcagctttagctttagctcttttacggctaatgccgacctgattgagaatcgccattaaagtcccgtaagtcaggaaagcccctggagccaagataaagattaatgctggctgatagcctgctggcatcaggtgaatgccaaagattgaaccagccccgattaattcgcggaccgctgcaataaaggtatcagcgagtgtaaatccgacacccatcccggcgccgtccagaatagaatcgatcgggccatgagaataagcaaatccttcagcacgccccatgatgatacagttaacaacgatcaatggaatgaaaatgccgagcgtatcgtacatcgcaggcataaatgcgtgcatcaccatatcaacgatcgtaacaaaagatgcaatgatgacgacaaaagccgggattcgcacattatctggaatcacattgcgcagtaacgagataacaagattcgagcagatcaaaacgaaagttgtcgcagcccccatcgcaatcccattcatcgcggccgttgtaatggccagcgtcggacaggttcccagaactaaacgaaaaatcgggttttcatcgaggataccgtttgtaaaatatttaatttttttcattatttggcctcctgagaaagaactttatacacttgatcggatgtatttaacccaagtgtaaccgctctggatgtgatggttgcacctgcaagcgcttcgatctgattatccgaatttttgcttccgtgttttacaaccgtataagtggtatctgcggacaagcctttaaactgcttctggaaactcggttctgtacatctagccccgaggccagcggtttccgagtttgaaataactgtaatcccagtcgtctttccagatgtattaaagccgaagagcagttccacttctccgccatatccctttggtgagaccttgacggtatatccaatcagcttgccgtttttgtagcctttgtaggcttcgttgacaatgcccgcgttggattttgctgcctttttcgcaatcgacttaatgtctttgacttccgtaaatttgtccgcgtcctttaatactttctgacgcgcttcaatattagtctgttctacctgtttcgcaattctcgattttgtcaccgcgttggtcatgccgagcaatgctgccgcaactgcagaaataatcaaaaggactaaagcgacgtgaacaacgtgttttacatctattttatctttttccatgactcacaccttctcattcgcttttttctttttcgtaaccgtaaactctcggtctggtgaatcgttcaatcagcggcgtcgcaacgttcatcaaaagaatggagtaggaaaccccttctggatagcccccgaacatacggatgagcatcgtcatcagcccgcacccgactgcgtaaatcacctgacctgtcgctgtggtcggagacgtgacgtaatccgtcgccatgaagatcgcgccgagcatcagcccgcctgagcagatcatgaaaatcggatcctgcccaaatgggaaagaaagcagtgcgacggtgccgatatagattacaggaatgcgccaattaatgacttttctaataatcagataaacgccgccgatcagcagtgctaacgctgaaatttcaccgatggcaccgtatacgccgtgcaggcctaagaacatatccaggttgctcggcagcttcgacaaattggccccttctttcaaaagacccagcggtgttgccgatgttacagtatctgtgagcggaataaaagcagtccctgtcatatgtgtcggccaggaggacagcagaaatgctcgtccagctaaagccgggttgacaaagttatggcctaagccgccgaaaatttgtttgacgacgacaatcgcaaaaacactgccaacgatgcacatccaccacggtgcctgaattggcaggttgtatgccaaaagaatccctgtaaccactgcactgcagtcgttaattgtcacatcgcggtgcatgattctttccgtaatggcttcagatgccacgcaggccgccacacacagcgctacaatcaacagcgcctttgcgccgtacacaatcaccgccacaatcaaagccgggatcaacgcgataacgacatcacgcataatgcccgcggtggtcgctttcgcacggatatgcggcgaagatgagactgtcaacatcatattttcattatccattagacttcaccgccttcttttttctttcagctttaacttgacgcttgccaacgcgaattgacgaaacgatggttcgtttagccggacaaataaacgagcagctcccgcattcaatacagtcgagcgcgtggaattcttcacagcggtcccagcgttttttctgagcaaacgcactgatcaaaaacggttgcagatgaatcgggcataccgacgcgcatctgccgcagcggatacacgctgttggttctgggatataagctgcttccttcgacaagcacaaaataccggaagtccctttcataaccggaacatccgtgcgctgcatcgcgacccccatcatcgggccgccggaaatcacttttccaacctttttagaaaagccgccgcattggtcgatcacttcctgataaggtgtgccgaccttcactaacatcgtgcagggttctttcactgcatcccctgtacaggtgacgtaacgatcaattaaaggcatgcctgtttcaaaagtatgcgcaacctgagctgctgttccgacattcatgaccaccacaccagcatctgccggcaggccgcccgctgggacttctcggcccgtaatggcggtgattaattgtttttcagccccttgcggatacttcgtcgcaagtttttggacttcaatgccgtctaatccttctgccgctttcgcaacagcttcgatcgcctgtggtttgttggtttcaatggcaatcacgccctttgacacatttaaagcgcgcatcgcaatctgaagacccttcaccacgcgatctggatgatcctgcatcaaatgatcgtcagccgtcaaataaggttcgcattcagcgccgtttaaaatcacggtatcaacgtgtttatccggcgagacggtcaatttgacgtgagttgggaaagtggccccacccataccgacaataccggcatctctgatgatatcgatgatttcctttgagctgtactccgtataaggtttgtacggctggatggcagggtcaacggtatcttttccatcggattcgatgacaactgaaagcacgttgttcccgtttggatgcggacgttcctctacagcttttaccgtcccagagacactggcaaacactggcgaagacacaaagcctgtggcttcaccaaccatttgtcccatataaacggtgtctccctttttaacaaccggtttgcaaggcgcaccgatatgtaaagacatagggatcgtgacaactgcaggttctttcgctttccgaaccggaacggcattcgttaattccttattataaggtggatggataccacctcgaaaggaattgatttccgttttttgcaagtcaaacacctctacttataaattttcctcattattttaacattcttaaaagaaaatgaacagcaaattttatacagtctagaaaacgtttgaaattctatatatagataatattttataaataaacaaaataataactagatattgtatgtctgtaaacatttagataattaagaaatctgcgtattaataaaaaaacaagcggctttttagccgcttgtctgttaaatcatacgtttcctcaccatttgtcattaaagaacgtacggtaagctttgtaagtcatgtacgcgtcaatcttggtactttgttcccacggcgcatgcattgaaagaatcggtgtaccgcagtcgaccacttccatatcgtaggctgccagcatataggcgatggtgccgccgccgcctaaatcgattttacccatttcgcctaattgccaggtcacgccgccttcgtcgaaacattttctgagcttgcctaaaaattccggattcgcgtcgctgccaccagattttccccgagcgccgccgtatttattaaccgcaacccctttgcctgcaaacgtcgcgttgtgcatatcgtgggtattcgggaaattcggatcgtacgctgctgtgacatctgcagacaagcagaacgaacgggacagacagcggcggacagtcagggaattggacgcgtcagactggagcgccaccaattccgccagcgtattttcaaagaaacgggactgcatgcctgtgttgccgtagctgccgatttcttctttatcagccaagatgacacattgcgtcttctgcggcgtatccgtcgcgtcaagcatcgcgcgaacggacgcataagaacagattcggtcatcctgtccaaaagcgagaatcatcgagcggtcaaagccgatgtctctggcctttccagccggtacaatttcaaattctgcagacgcaaagtcgtcttcggtcatttgataatgttcatttaaatattttaataccgttgccttgaccgcttcgccgtcttcttctccgctcagcggtctgctggcgatcatcggattgagctgttcgccttcaaaagcctcagctactttcttttgattaagcttttgggataaatggggcagtaaatctgaaatgcagaagaccggatcatcaggtccatcaccgatggcaattttcaccaccgatccatctttcttgacaaccgtgccgtaaagagccaacggcagggtcagccatgggtatttcttaatgccaccataataatgggtttttaaataagcgatgttcgaatcttcgtacagcggcatgggcttgaggtccagtctcggacagtccatgtgtgcgccgacaacagtcatgcccttttccaacggctcagcgccgattttaaaaagcatgacggttttattccggtgcagtgcgtaaattttatccccgcttttcaactcgcccgattcaattgcctgttcaatcggacgaaagccggcttccttcgctaacttcaccgcgttttctgcgcagagcctttccgtcttgccggcatccaaaaaggccttgtaatcttctgcgtaatccaaaaccttttgatcttcacctggctccagctttttccagcccaatttgaattcagcgccaagtgctttattcatcgtttgtgctgccatgatgacctcctgtcttttttcttatgctttaacgccttcaactgcgatccagcgctttcctgatttgacgtgaattgcaatatcggcaaaacctgttttttcaaaaacattgacaaatccgtcgagatttaaattgcgcatatcgtaggcttttatattgtccaaaaccgactgcggcagtccttcgtgatcgtacacttctgcgatcagcagaaaatgtccgcctgatttcagaacccgataaacttcctgcatgtccgtttcgaaatccggccagaaataatagctttcaaccgtcacaattttatcgaattcgccatccttaaaaggcatatcggacacggaagcctcaaaaacctcaagcttgcccgcatcgatgagcgcctggttaaactgctgtgtggcttccaccgacgttttcgcgtaatcaatcccgacgaagctgccattttcaactattgtcgaaagacgagccaggcaagcgccaccgccgcagccgatgtcgagaacacgatcccctttattaaactgcaggtgcgataaagcccactgcgtcatcggtccgtgactgtcgttcatgcgctcgagcattgcccgtcccgcatcgccagtcgaatgattgggacgcccggcttccgtaatctgctgttctgaatattccttttttaacttttctgttaaatctgccacgtgctgcctctctgcttctgtgtaatcttcctctggtttgaggttgccgaaattcaacgcgtcaatttgtttttgaagatgagaccgtaacgcctgcttctctttcttttcttgatccgtaagtgcctgtctcttttgcttgtgttttaatttttttaatttcgacgcttttttattcaatcttttaaaccctgctttctcaatccaacgtttgaagcttatcctgtgccacaaagcccgcatcgactaattgctgaagagagagcattaagccgagcttgccgtgggcgtgggtcagaccgccttgaaaatagacgatgtagggttcgcgcatcggcgcgtccgcggacaattcaatagatgatccctgaatgaatgcgcctgcggccataatgaccggcacatcgtatcccggcatatcccacggaactggcgtgacaaaggaatccaccggcgccgccttttgaaccgcctgacagaacacttcaacggctttcggatctcccaaacgaatactttggatgatatccgaccgataatcgtccacatccggacaaaccggatagccgagatttttataaacggcgcccactaaaatcgccgttttcatcgcttgagagacaatataaggtgcctggaaaaagccctgaaggaaggttctggtaatgcccagcgtcgctcccgtttccccgccgatgcctggcgccgccagacgattggcacagagctgaaccaaatccgcccggcctgccgtgtagccgccggtgggcgccagcccgccgcccggatttttgatcagggatccggccatcaaatcggcaccaactgcgactggttccttttcgtctaaaaattcaccgtagcaattgtcgacgaaaatcacaaccttcggccatttggctttgatcactgcgcagatcctctgaatttcagccaaggtgatggccttccgccagctgtagcccgtcgagcgctgaatatacaccattttcgttttttcagaaatggcgttcatgattttttctgtgtcaaaaatcccgtcgggcagcagctcgatctggttgaaaatcacacctaaatcggtcagcgtgccgtttcctttttcttctccctgtgcgccgataaaggtccgaactgtatcgtaagggtccccgctgatcgacaggagctcatcccctggacgaagcaccccgtacagacaaagcgaaatggcgtgtgtgccgcaggtgatctgtggacggacaagggccgcttcgcagccaaagacatcggcaaatattttttcggtggcttcgcggccttcatcgtcgtagccgtagccagtcgtcgggtggaaatggcggtcactcagaccaaccttctgcatcgcctgaatcaccttaaactggtgatattccgccaaccgatcccaatgggccatccgatcggcaatttgagcttccgatttttcaacaaaatcgatcacatcctttgagatgtgaaaattttcagctaagtatttttcaatggtattatcgttcaatgttgtgttcccctttgtattgctcaatacattgtaacatttgagcagccaattgttcactgtctttattcttttctgcactgaaccagtgaatatcttgattttttctgaaccacgtcagctgacgtttcgcaaaatgccgcgtatcccgcttgaggatcctgacctgttcttccaaagacgactgccctttcaaatacggcacgatttctttgtaacccaatgcctgcatcgacacaagtgaaggatcgtagccgtcgtttagaagcgcacggacttcctcgaccaggccgtcttcgatcatcacatcgacccgttgatcgattctttgatagagcacgtcccgcggcatctgaatgcctaaaagcagataatcaaagggcaggtcgatttttcgcacctgactttcccaataagtcttggttttgcctgtcgtctcataaatttcaagggcgcggatcacgcgcttgcggttgtggggatgaatttttgccgcagcctccggatcgatttgctccaaccgtcgataaacagcctctggcgtctctgtcttgtacgcgtcgttcagcttttcccgaattttaggatctgtcttgatatccggaaatccccatttctgcgtcagcgcgttgatgtacagccctgtcccgccggcgacaatcgctgtttttcccctcgctgtgatgtcacggatagccgcaacggcgcggtccttatagtcagccacgctgaaagcctgatccggctctacaaaatccatcaaatgatgggggatcccctgtttttccgattcggtcggtttggccgtaccaacgttcatcctgcggtaaatctgcatcgaatccgcagaaacaatttccccgtcgaggtgtttggcgatttgaatggcaagattggttttccccgacgccgttggaccgacgatcactgggacgactggtttttgcgctttctgctgagttttcatgaaaccacccttttaaacaatttttccaattggtatttttttaaatacaaaatgatcggccggccatgggggcaggtgtacgggttttccagcgtcattaaatcatccaacagctttctgatttcgcgttcgtttaaatcctgattccccttgaccgctgccttgcaggccatcgtcgcaatcctcagccattgcttttctttaagttctggatctcctgtcgttagattctcaatccacatcggaagcagcgcggctgattgaggctctcccaataaaacgggcacactgtgcaccatcagcgttgtctctcccaaaacttcgcagcggaatcccttagcctcgagctgagcctgaacagcgtcaaactgcagcaccatttctctcgagacatcgacagcctgaggcaccaaaagcgcctgcgacggaatgcgttcgctgcctgtcatttttttctttagattttcaaacatgaaagcctcgtgtgccgcatgctgatcaattaagaccgctgcgtcttctttttccagcaggataaaggttttaaataattgaccgataattcgcgtgcccgttaaatctaaatgcggacgcccagattcagcagcctgttcattgtaaagcggcctttgttcggccgatggcggcttaatccattgatctgctttcttgggagcagcatcctccgctggtcgcttctgatgtcgattccgatcttcattgatagaaccataaaatgaacgctgcacttgtggatccggggcagccgtgccttgagcagccgaaaaggcgatctgcgacggcatttcgctcaccttcggcgacggcacttttgattcagcgtacgcttctgtttttttaggctccggcgccgcttcgatcttttcacccaaatcaaccgtcaggtccatctgctgaacggcgcgccgaatttcctgacgaaataatatatcgaccagactttggttcaatatcccgatttctgttttggaggggtgcatgttgacgtccagcattctgcccggcagcgtcataaaaatgatgcccacagggtgtttgtgattcattagataaccttgataagcttcttcaaacgcccgagaaagagctcgattttcaacggtccgcccgttaatgaacagaatctgccgatccttcgagctgcgcatgctggtcaaatccccgatatagcctcgaagaaccatcggttcgtttttcgcgtccaattttctgagggatttaaaaaaagaacgcccgtacagacattcgatgacactctgcagccgcccgtctcccggcgtcgaaaagattttccgcccatccgctttaaaatcaaaggcaatttccggatgggataaggcgatccgccccatcagctggtggatgacccgctcttccgtcttatccttcatcatgtgcttttgtctggccggtacattgtaaaataaatccctgacacagatatccgtccccttatcgtacggcagcacccgctgtgccgcgcaatgtccgccttcaaaaatggtttcgctgccgagctcctccgcctttgaaatcgtgcggatcgtcactcgcgataccgccgcaacgctggccagcgcctcgccgcgaaagcctagggtttccaaatgatctaaatcctcaatttgagagagcttgctcgtggcgtgacgcgcaaaagccaattttacctcgttgtaccgaatgccctctccgttgtcccgaatgcggatactccgctttccgccctgctcgatatcgactcggatgcggtcactgctcgcgtcgatggcgttttcagccagctctttgacgaccgacgccggacggacaatgacctcgcccgccgcgattttttcgatggtcgccggcgccaacattttgatcttcaatgtctctctcctttgtgattacgcctgctgctccgtcatcagctctgtttttagtgagctgagcaggttaagcgcctgaatcggcgtcatgctgtttaaatcggcatcgcagatttgcgacagcacgtccttttcttccggttttattgcattgtcaaattctggttttggcgattgtgccgccatttccgtgtaaaaactgatctgatcgtcattttcagcagccatatccgcagacgatggatcttttggatacaagctggcaaccggcgcctcatcctctaattcttttaagatcacccgcgcccgctgggtcacgattttgggaaagcccgccagctgagcgacctcgatgccatagctttgatccgcaggctggtgacgaatcttccttaaaaacacgacaccttccggcgtttctttgagaccgatgcttaaattctttacaccaggctgctgattttccaattgggtgagctcgtgatagtgggtggcaaacagcgtccgcgcgccaatcgtcagcggattcgacaagtactccgcaacagcccacgcaatactgacaccgtcaaaagtgctggtgcctcggccgatttcatccaagatgacaagtgaatgctgagtcgcattttttaaaatattggagacctcagacatttcgaccataaaggtactctgtccagttgtcaggtcgtccgacgccccaattctcgtgaaaatgcggtcgcaaatgccaatatgcgcgctgtccgccggcacaaatgacccaatttgcgccatcagcgtaatgatcgccacctgtctgatatacgtggatttgccggccatattagggccggtaatcagcatcatccggttttcagccagatcgagcagacaatcatttgatacaaaggccccttcatccatcagcatttcggccacgggatgccggctgttgtacatctcaatgacgccgtcgtccgcaatttccggcctgacgtaatgattagagaccgcaaccgcggcgagggaataaagggcgtccaaaaaggcgacatcgtgggcgcgctgctgaatccgcttgatctgagccatgattttttctctgatatcggaaaaaatctgatattcgagctgggacaaacgttgttcagcgccgagaatcttcgtctccatttccttcaattccggcgtaaaaaatcgttcagaattggccagcgtctgtttgcgaatgtaatgctccggcactaaatccaaattcgttttagtcacttcgatgaaataaccgaatacccggttgtatttgaccttgagtgatttgatgccggttttttcccgttcttcgctctccagatctttcagccagtccttgcccttgctctgcgcctctctataatcgtcgatttcctgattaaatccggttttaattacaccgccgtcttttaacacgaagggcgcgtcatctgaaatggccgacgcaataagctggtaaatatcttccagatcgtccgcctgaccaaaagccgcctgaagcttcggggcgtcgatgctgttgatgcagtcctttagtgctgggagcataccgaccgactgcttaagggacagcatgtccttcggattaacggtgccaaaagaaattttgccgcaaatccgctccaaatcgtaaatctttcccagtatcgtcttaaaatcctgaagtgcccctggattatccaccagctcggccacatactgctgacgcgtctcgattttatctcgatcaatcaatggcgcttcgatccattgcctgagcattctgccgcccattgccgttgtcgtctgatctagaacccaaagcagactgccgcgcttttcaccgtgtctcaaggtttcagtcaattccaagttgcggcgcgtcggcagatccaaaagcatgtactcgctcgttttgtaaaaggatacgtgattgatatgggccaaaacttttttctgggactcttcgatgtaattcaaaagcgcgcctgaagcccgaaccgccgcgtcatgatcctttaatcccagcgcatccagcgcaaaaacgtgaaactggtttttcaccacttcttctccagaatcgcgctgataatgctgatcggcgtacagcgaaaccatgcagttaaaacgcattttcagttgctggacaaattttgactgcttgtacaggctcgagctcataatgatttccgacggattgatcttcccgatttcacccatgagctcattctgacccggtgtgttagggatttccgtcgtattgaaatcgccagttgtcaaatccacgtaagccagcccgacgctgcttcttccgccataaagcgaagcgagataattgttttccttcgctttgatcgcgccgtctgaggtaatggtcccgggggtgatcaccttgatgatttcacgcttgaccaatcccttcgccagagaaggatcctccatctgttcgcacacggcaaccttgtagcccttctcaaccagcttagcgatgtacggctctgccgcatgatggggcacgccgcacattggcgccggctcatccagtccgcactgcttgcccgtcagtgcaatttccagcacctttgacgccgtcaatgcatcgtcaaaaaacgtttcaaagaagtcccctactctgaaaagcattatgcagtctggcacctgctcgtgcattttcagatactgctgcatcatcggcgttaaacccatcttcaccacttctttctaatttaatgaaccaatcgccgtgccgtcaaggctgaaggtcttggcccgatcgatgtgaacggggataatcgtcccaatcgttgccatgtctccggtaaaattgaccagcttgccgtttagggttcgaccggacaatttgtttggattgtgcgcacttttgccttcgacaagcacttcaacatcctgatcctggaaccacgcattctgatcattgccgatttcgtgcagtacgtccagcagccggttcagccgctgatgcttgacctcatcaggaatctgatcgtccatctctgccgcaggcgtaccactgcgttttgagtaaataaacgaaaacgccgaatcaaaccggcacgcccgaaccacgtcgagggtttcttcaaaatccgcttcggtttcgcccgggaaacccacgatgatgtcggtcgtaatcgccacatgagggatgcggttgcgaattttttccaccagcgcaatgatctgttcctttgtgtagccgcggtgcatcgcctttaaaatgcgcgttgacccgctctgaatcgccagatggatggacgggcagaccttgtcacaggtcgcaatggcttcaatcactgcgtcgctcatatccttggggtggctcgtcatgaagcggattctccgcagcccttcgatggcgttgacatcacgaagcaaatccgcgaacccgtaaccgtcccggcgatcgttgccgtaggagttgacattctgacccagcagcatgacttccaaacagccgtcttcaaccagacgtgtgatctcttcgataattttttcatgcgggcggctgacttcccttcctcgcgtgtaaggcacaatacagtaagtgcagaaattgttgcaccccttcatgatcgacacataacttttaaacgggtattttcgatcaaccggcagattttcaaccagcccctgatcatcatcgtaaatttcgattgtccggctgcgggtttcaataaattcctccagcagctgcggaaaatgttcgatgttgtgcgtcccaaagacaatatcgacctgcggatttttttctttaatttgtttgacaatggcaggctgctgcatcatgcagccgcagaccgccagaatgagatcagggtttttctttttgatgtgtttaaaattgccgacattgccgaaaaagcgttcgtccgcattttcccggacactgcaggtgttcatcaccacaacgccggcggtcttttcgtcgtctgtcggcgtgtagcccatttccttcagcatgcctgatattttttcagaatcattctcattcatctgacagccgtaagtgataattttataggttttattcattcgcattccttttagtcgttttaaagctttccggcagcttgtcaattaaatgcatcgcattcaatgcacattcgccaaattgctcagccgccatgtcgccagaaagtccgtgcagatagacaccgagcttggccgcgtcttccggccttgatgtctgtgaaagaagccccgcgatgatgccggtcaaaatgtcgccgcttccagccgtcgccatgcccgggttgcccgtcgtgttgaaccaaatttcgcactgcgctggatcatccccacggggaacgaaaatccgtgtgcggtaccccttcagcacgagaatgacctggtatttcgcggcaaattccgaagcgatttgggtgctgttttccttatattcatccttagtaatttcgcagagtctgcagaattcgccagcgtgaggcgttaaaataatcggacccgcgtgttcagacaaaaccgatttgattttggagagatggtataaaccgtccgcgtcgatgaccaccggttttcccgtttcaatcagccacttgatcagatccgcgtagagcatttttcgaccgatgcccggcccgatcacgtaagccgtcgccttctgctgcttgagctggctgatgacgttgtcctgcgtgtagggcttgaccatgatttcccaaggcatctgtgccgccacaatctcgtaaatgctttccggcacccaggttgtcaccagaccggcgcctgatcttaaacaggcggctgaactcatcaaacctgcgccgatcataccgcggctacccgcgacgattgaaactgcaccgtagtcgtacttattggaatttttcaggcgtttcgctagtttggggatactttcgtcatctaatacttttttctgtgaatccgtgtactgctccgaaatgcccacatccagcactgtcggttctcccagaaagtccgggccatcctccagcagcattcccacttttggattttgaatgatcaacgtccgatccgcccggatcgcctgaccaacggtcaagccattgctccctctgagcccagaagggatgtcgatcgcgtaaatgacggccttagactgattgacatattcaaaaagcgcggcgacattcggataaaggggccggtttttcagaccgttgcctaaaactgcgtcgacgatgacgtcggcgtcccgaatcattctttctgtattgtcatcgagttctgtaaagaaagcgtaagggacgccagtatcctgcaggcgtttgaaattgcgctctgaattcggcgtaaagtgatcgggattgccgacaaacaaaacctgaacgggcctacgctgattaaagcacagccgcgcgacaacctgaccgtcgccgccattattgcctgctccgcacaaaaccaatattttggcatcactcgccgtttcacggtcgatcacatcgaagcagcagtgtcctgctctttccatgagttcataatcggcgattccgtgagcgatggtctggcgatccatttcactcatttccgccggcgtcaccactttcatatgtgctccttttctttataaatggtcataaaacaacaaaaagcaaggcagatgccttacttttttgttcgcaatattcttattgattattcagagaagatgtcggcttagccccaatattaatttgataaacctgctgaatgccgtccttggttaattgaattttactggcattgttgtagacatcgccgatgacaaaagaggacatcaaaaaaattaacgcaaaagccacaataaaatatacgactaaatcgcgtactttatgttcaccttgtcccataagaacaccttgtccctttcttatttagattacgtaaaaattacgcctcggcccaattgtggaagacttcctgaacgtcgtcgttatcttcgaacatgtcgagcattttttccattttctgaccatcttcttcagaaagttcggtttcggtcgacgggatctgagcgatttccccagaagcgaccttgtacccagctgcctgaatttggtcgagcacgttggcaaaatccgacggtgccgtcttgatttcgtagccatcttccgacgtttccatatcctctgcgccggcgtccaaagccaccatcatcagctcgtcctcgtcgatatcgtctgatttctcgattagaattctgcctgcccgctcaaacaaatagctcacgcagccattggttcccaaattgccgccgtttttatcgaagatatgccgcacatcgccagctgttcggtttttgttgtcggtcaacgcctgaacgatgacagctgcgccgcccggaccgtatccttcgtaggtgatttcttcaaaaacagcatcgcccaattcgccggagccttttttaatggcgcggtcgatattgtcgttcggcatgtttgcagcctttgcctttgcaacggcttcacgaagcttagagttcatttccggatcgccgccgccttcacgagctgcaacggcaatcagtttcgccatcttggtgaaaatttttccttttgccgcatcctgtttcccttttctatttttaatgttgttccattttgaatgtccagacattgctatacctccgaattatattgattaatattaccatcatttcatgaacatttattatagcataggtgaaacgatgattcaaatttgcgcaaacaaaaagcacagcgtccgctgtgccggttccgcattatagatccatatcgttgagaatatctttcagttccgctaattcatctgtcgtcaaagtaatccccttgcgcattctttcgtggttcggcgcccagtcgcggatgtcgtatttcggttctctcccattccaactgaccttgttgagttctttctgccagccgttgctgccttcagacagcacgccgcattcttcgacgacttcgtattcaaatgccattgctattcctccttattgttaacggccttttattcaagaccttctgattcgtaaagtgtaaataaatcatcgcagccgcccacaaatttgtcgttaagaaagacgtatgggacggtcgtctgaccggtcttttcgattaaagcctgtttctgatcatcttgtccccatatatcgtgatccgtgtaagggatctgaagctgatccagtaaccctttggcccgtttgcagtacggacaggtcggccaagtgtagagttctgctttttgtactttcaccttattatttcctttccattttggatgcgttcaattaaattagtatgcattatttctcaaattatagcgaatgctttcgctattttcaattcttttctaagattttttaagcgtctccttcattcttttggcatctcgggcaaagtacacggcggtttgatcggaaattgcgccgtctttccacaatcggagcagatcggcttccatcgtctggctgccaaatcggctctcggtcatcataaaattgtagagctgctctctttcattctgccggattaaattctgaaccgcagtcgtcgccacaagcacttcagacgcacagacccggcccgtccgatttttattcggcagaagctgctgccacagcacagcttttaaattcatcgaaagcacctggcggatctgcgccgcctgattttgatccggaaaaagtgaaagcatgcggtcgatcgcgccgtcggctgtcggcgtgtgcagcgtcgaaaaaatgagatgtcccgtttccgccgcttccaacgcaatttttacagtctcggcgtcgcgcatttcaccaattaaaagcacatccgggtcctcccgaagggccgcgcgaagcccctgccggtagtcgatcacgtcgctgccgatttcccgttgatgaatcatcgctctgcccttagggtaaagatattcaatggggtcctccagcgtcataatgtgaacaggcttggattggttaatttggttgagaatcgacgcgagcgtcgtcgattttccggaaccggtcggtccacagatgaggacaagtccctttggaatctgccagaatcgctgcacaatcgacggcagtcccaaggtttcgagtgcagggatcacctccggcaaaagccgaatggcggcggctaaggatccgcgctgcgagtaaacattaatccgacagcggatttttccgacatcccgcgcaaaatccaccgacccatgctgttttaatttcttaatcagcgcgccgttttcaccgatcaattccctcgccaattccctgcagtcctttcggtccaataccgcctgatccaaattgcgcagagtgccgtctattcggcatttcgggtgttcatcgatcgaaaagtgcacatcgctggcgcggtgacggtacgctttctctatccatttgtatgcttgcatgattttctccacatcatgttgtcaaggttaggtaatcgtttgtattttataacaggtgccgtcaaaaatcaatccgtgaaccataaaaagacccctgactgtccatctgtttcaatgtcagtcaggggttaaatgcgtgacaacttaattcacaacattcatgagcgtattattgccgtacttcttacggtatttttccaaatacggtctgagttcatcgtcggttttgccgtccggcgcgttcttgagcaagtacagcgaccgattgcggttatgcttatcaaacatattgttgtacagcaccttttgatagttctgaacctgcgtgttgtatttttccgcatcgtctagtgtcagataatcgccatccgacgtgatggcgcccttataattgagcactggcatcttgtcgtacatcgattgttcatatttgtcgtaagccgttgttctgagtcccaacgtctggagcagtgtcgtctgtagataattgaccgataaatttttaccgctctgcgaattgatatcgtagttggtccagatgatatagggggtgatgtaccgctgctgaagctcttcgttgctccagctgccgagacttttacccttgacgtcttcgtaaaaagagttgtccaatctcggctgatgatcaccgaagaaaaccaccgcgaccggttcatcctgcgatttaaaatagtcgatcatttccttcagtgccgtgtcgctttccttaatcaacgtcaggtattcatcggcatcggtgtgttctacactgcctttctgattgggcatgctggtgatttttacctgttccatgccgttcgtccccacatcgtatccgccgtggttggcaatggtcacgtcaaagataaactgcggcttgctgcctctgttcttgtacaaatcgataattttctgataggttgcccggtcactgacgtagctgttccgcgtcaatgccgcattgctgaaagagtcttcgtaaaaataagtgtggtcaaaaccgagatacgggtaaaccttattgcgcttccacgccgaagatttccccggatgcatggcgtaggtttcatagccctgcgccttcaaattctttgccaggcttggggtttggtaattgacgtacatctgataaggccgggtattttccggtacgaaggccgtggaattgcccgtcaggaacgagtattccgtgttgcaggttcccgcgccatagacgtccacgtacagattgccccgcacggtgtttttcgacaagctcctaaaaaagggcatatagtcttcgttcgtctgaaaatttcccaacactgaaagatcggaaaagctttcattcatcaccgcgataatcgtcggtttttttccgctggctacggcttctgtcgcctttttccccgcagccgtggatttcttcacttctgcgcttgcctttttgctgccgtttttcacaatatttttcgctgccgtcgccgaataccccgacggttttttcacgtgcagcaatttggcattggtcgtaaaagctgtaatgtattgattactggaaggcgaccacgaatcgtaaacatcttcaaggggcaggactgcgatcagtacggcgatcgccgctgtggcgccaagggcgcccagccgcagtctccggcttttctttttgtcatccgcaaaatattttgttttgacattcgtgctgaccgcgtaggccgcaatcgccatgtaaatgccggcaataatggtgccggaaatgccaatcgcataatttttcgccacttccaatcccgtgttggccgtcatcaggtcgccgagataaaatgggtcgcctctgaatttcagcagaaaataatttacacaggacaaaatgaagagcgcgatcatgacgatgcggatgcttaaccgcagtcgatttgtgatcgcaaaaaataacagaataagcgcgccaatgattaaaactgctaccccaaactggaaaatccccagcggatcaaatcggctgctcgtccaaaccggcatgccgcatgtggtctgatgcatggcgatgattaggaaaaagatcagcacacctagaataatgcgccaatttcgcttcgcctcgccctcaaatttaaaggtgatggcgataaaaagcgccgtgatcaaaatcgccacagccgtcgtcccccaatactgcgagggaatctgcgtctgttcaaactggccgaaaaccgccattaaaataaagcccgctgccaaatacacgacagcaaaaatcagccgaaggatactggtctccaccggcagctccagcgtcatccttcggttttcttttaattccttcagtgttttgcgctttttcttttctttatgctgtttcgaatcgtcttgatcctgcagctggtcttgctcttccatgccaaacctccatactcaaacattaaaacgcccattaaaaaaagggcagaactaacaaaaaatatagtatagtctaccctttttatttgagaatgtaaaatgtatttgactaaagtttttacaccgttaaagatagtttaaagtgttaaccttagagtttacggttgcggacagcgccttgataaatcatcccgttcagcggatcgacggtgatcagcttaccttccgtgatgacttctgtcgccttctgtacgcccttgatcactggaatctggtaatctctcgcgacgtgatcggcttctgaattttcaccaacttctgatgtgaccaccgcagcagccttttcaatcgcaccgtaaatccccggtgtaatgacgcgcgtcacgacaatatcgccttcgtcgaaatcgtcaagggtatccggcgtgacaaacttcgcaaagccggtgaccagcttgtcgccaatcccaataccagaaagcaccgcgttgccgaccgttctgacgcggatggtattggtattcccctgaatgccaaatggaagaccggccgccgcaacgaccaaatcgccggttttgaccacgttcatggtttcaagaatccggttgacgtcgttgaccaaatcgtcaagttcggtcatcttcggcacgtacaagcagtaggcgccccactgcatgcagcatctgcggacggttctcatgttgtcggacaccgcgaaaatcagacaattcgggcggtatttcgacagcattcgaggggtgtagccgctggtcgttggcgcgataatcgctttaacgcccagcgattcgacgatgttgacgacggccgagcagaccccgtttgtaatggtcatttcaccgtgaggcacgtgatcgcgatgcttgtactggggtgaattttcagttttcaagacaattctcgccatggttttgcaggcttcaactggataatcaccggctgccgtttcccctgaaagcataacggcatcggtcccgtcaaaaacggcattggccacgtccccgacttccgcacgggtcggccgcgggttgcggatcatagaatcgagcatctgcgtcgcggtgatgaccggtttgccgacgatgttgcagcggtggatgatgttcttctgaacgattggcacgtcttctgcaggaatttcaacccctaaatcgccgcgcgcaaccatgatcccatcggacacggtaataatacggtgaatgttttcaaccccttcgcggctttcaatcttagaaatgatcttgacgtgttcgccaccggcattgttgagaaccttgcgaatagcgatgacgtcctgcgccttgcggataaaggatgcggagacaaaatcaatgccgtgcttgacgccgaagatcaaatcttcttcgtcttttttggtcaaacccggaagattgatcgacacgcctggaatattgatgctctttctgcttcccaatgcgccgccgttgtcgaccacgcagttaatgtctttcccattaatgttttcaacggtcagttcaatcaagccgtcgtcaattaatattctatcgcctttcttcagatcactgggcagatccttgtagctcacagacactcggctggcatccccttcgatgtcttctgtcgtcaaggtaatgtggtcaccttgatttaaggtcaccttgtcgtccttgagcacgcccgttctgatttccggtcctttcgtgtcgagcatgatcgcgatcgcaatgcccgaatcttttctcgcctttttgagacgggcgatacgcttcgcgtgttcttcatgagatccgtgggaaaaattcagtcttgcgacattcatcccgtgcgtgatcaattgttccaagacacctggacggtccgtcgcaggtcctagggtacaaatcattttcgtttttttcaatacttctggatttggcatgctatcctataacctcctctttatctctgattcgattcatgccgacttatatcgacaaaatctgaatcatttcgtacatttcttcatcgaaaacctttggcgtattgagggcttcttcgagatcaaccgcttcgtactttccatttcgaatgacgatgacaatcccggtatgcccttttgcgatttcttcaaccgccatgtaacccatgttgctcgccaggttgcggtcaaaatggcttggcgagccgccgcgctggatgtagcccaggttggtgcccttggtttcgacttttgttaaatcctgaatttttttgcagtaatcgcggtagccgccgcagccttcagccagcatgatgatgctgtgcatctttccgcggtcgcgcccttccaccaagcggctgcagatggtttcgaggggcacatccttttccggaatgatcatgccctttgcgccgcaggccagacctgcgtacatcgcaatgtcgccgcaccggcgtcccataacctgaaccacattgatccggttgtgagagaaggtggtgtcgcgaattttgctgatcgcttcaatcgccgtcgaaaccgccgtatcaaaaccgatggtgtaatcgctggcgccgaagtcattgtcaatggtgcctggaatcccgacaattttcacgccgagctcctggagcttcagcgcaccggtcaagctgccgtcacctccgatgacgaccagcacgtcaatttcgtattccttgagaatttccgccgcacggtgaagccctgcgtttgtcgggaaaaagtcggaacgcgacgtctgcaaaatagtgccgccgcggtcgataatattcgccacagagcggctgttcattggataaaaatcctgttccaaaagaccggcgtagcctctgttcacgccgtacacttcaaagccacgataaacggctgtccgcacaacggcacggatcgccgcgttcattcccggcgcatcaccgccgcttgttaagagcccaattcgtttcatcttaaactcaccttatcctcgccgaggattcctttcaattttttgattaaacccgaatccgcagtgacccacaaagatcgggctgcgccgaaccgcttgtgttccttttcaaattgaaccatcactggtgtatcacctggcgatgccttgagcagcggtttaatccggtttaattttcccttttcactgtaatcacgaaaagccagcactaatttttcattggctactctttccttattataacttgacttttcctcatgaattgtaaaattttgatgattttttggttgattctgtctgcgtacctggtccagcttttcaatttggtcggcaataatcgacacattcatttcttcgttgtaattgattctcccgcggactaaaaccggttcgctgtcgtgaagcagcgccctgaattgattgaagattctcgggaaaaccacgatctcaatatgaccgaacagatcttccaacgaaaggaacgccatctgctcgttgttcttcgtcagctgaatcttaagaccgtcgaccataccgccgacgcagaccttatccccgtctttgatgccgctttccaccaaatcttcgtagctgtccaacatgctcgcattcaaattggtttcgctcgccagcaccccggtgtaatgttccagcggatgcccggacacgtaaaggccaagcacttctttctcgtgaagaagcttttcttccttggtaaagggttctgtactggggaagcgatctcctttgtaagcgtccagctcgcccatatccaacagggaaacctgccctgaaagccgtgtttttttctcatcggccacccggttgagcacattgggaaaacccatgaccatttgcgagcgctcgtagccaaggaaatcaaaaccaccggccaaaattagattgagcaccacttttttcgtcaccaggtgaagatccacccgttcaaaaaagtccgtcatcgtcttaaagggaccgccattttctctcgctttcacgatatcgtcagccggatgctgtcccatgcctttgatcgcgccaaatccgattcggatgtacgtcttattctgcgcatcaaagccaacggaaaatttgtatcggctttcgttgacgtcaggcgcctcgatgagaatgtgatgctttttacagttgtcgatatactgtgcgatcttcttttcattgtccattaccgacgacatcagcgcggccataaattccgctggataatagcacttcagccaggccgtttgataagcaacaactgcataagccgccgcgtgggatttgttgaaggcgtatttcgcaaaatccttcatttcctcgtagatctgccgagcgacgtgttccggaatgccctttgccactgcgccgggcaccgtcacattgcctgcctcgtccttttccccgtggataaacacttcaccttcggcgtccatgacatcgcttttcttcttagacatggcgcggcggaccaaatcgcttcgccccatcgaaaaaccggccaaatcccggaagatctgcatcacctgttcctgataaaccatacagccgtaagtcacgtctagaattggcttcagctccggcgtcaaatacgtaatgtgcgatggatcctttttgttggcaatgtaccgcggaatttggtccatcggcccaggccgatacagcgaaatccccgcaacgatgtcttcaaaatgctgtggattcaattcccgcatgaaggccatcatgccgcggctttcaagctgaaaaatccccaaatcgtcgcctgaggcaatcaattgataaaccttcggatcctccatgtcgatttgattgatgtcgatgtcctgtccgcgggtctgcttgatgttgttcaacgcgtcgtgaatgactgtcagggtgcgcaatcccagaaagtccattttgatgagtcccaggtcttccaacaggttcatcgtgtactgcgtggtgatcgcgtcgccattgcggtacagcggcacgtattcggtcagcggcgcgtccgcgatgacgacaccggccgcgtgagtcgacgcgtggcgcgccaatccttcgatctgctccgacatatgaaggagttcgcggacgttgatatcctcatccgccatctttctgaggtctggattttccttcaaagcctcttcaatcgtgacattctggcctggccgcattggaatttccttcgcgactttgtcgacgtccgaataggacatgccgagcacccgcccgacgtcgcggaccgctccccgagctgccatcgtcccaaaggtgatgatttgcgcgacgcggtctttgccgtatttgcggatgacgtaatcgatcacttcctgccgtctttcgtagcagaagtcgcagtcaatatctggcatggttacccgctccggatttaagaagcgttcaaaaatcaaattgtacttgagcggatcgagagtcgtaatatcgagcgcataagccacgagggaaccagccgccgagccgcgccccggccccaccgggataccgtgggttttcgcgtagtggataaaatcccaaacgactaagaaataattgtcaaatcccatctcgtggatcgtcgccagctcgtaatccatgcgttcccgaatttcaggcgtcaccggatcgtagcgcttggccaatcccgtttcgcataaatacttcaaatatgcgccggcgctgtcgaatccctctggcagctcaaactgcggcaggtgggcgctttccatatcgaaggtcacatcacagcgttctgcaattttgaccgtgttggccagcgcttcaggatgatccggaaacagcgcggccatctcatccggcgatttgaaataaaactggtcgttcggataccgcatccggttttcctcgtcgaccgtcgcacccgttccgatgcagagcagcacgtcgtgagccttgtagtccgattgattgacgtagtggcagtcattggtcgcggcgaggggcacatcgtatgcttcagcgaatcggtaaaggacatccctgaccttcgcctcttcgatgagaccgtggtcctggacctctaaataaaaatgatcgtccccgaatatcgactgatattcccgaaccaaagccagcgccttgtcttcctgtcctcccaaaatagcctttgggatttcgccggaaatgcaggcggacaggcagataatgccctcgtgatactgcttgaggacttgatgatccacgcggggtttgtaataaaacccgtcgatgtaacccttggaaacaatttttgacaaattgcgataacccgtgttggattccgctagtaaaataagatgactggcttgactgtcgatccgtcctgatttttgatgcagtccccgtggtgcgatgtaaacctcgcatccgataatcggcttaattccggcagactgacaggccttgtaaaaatcaatagcaccaaataatacaccgtgatcggtgagtgcaatcgcctccattcccattttttttgcagtctgaacgtagtcattgatccggccgaacccgtcgagcagactgtattcagtgtgcagatgtaaatgtacgaatggagaattcattcactcaactcctatattttgtgcctctttattaaatccaatatatttttttattatagcatattctgtttagctttcaagcatttaccctgcttggacaaaatagttcccggccagaccaataaaaaaagcactgcctgcgcaatgctttttgtgatttctcataccactaagtttaaaagtcccagtacaaacccgataatcgcgcccaaattgacgatcatgtcgaattccttcttcatcacagacaagaccatctcttcgagctcatcaacgctcatggcgtcaatcgcttcggctacaatatccgagacgttaatttttttaaggatccgatcgaccccttcttcagcgatcgcccggtatttgtttctgatgacgcgctgaatctgttcgtgctgaacgtcgacgcgctgtaaaagggattccggcgaatggccgaacaaatgatcgaccttgatcgccacctgttcccgcaccaaatcgcgcccgtcggtttcaacgtaatcccttaacgccgacgcaatgggtgtgacgaaactattcagcatattatccgtcacaaaggcgccaattaaactgccagccagtttctgcttgatcatcgcaatgcctttgtcccggaccagctgttcgaaatcaatctgctcaatcgagctgacgatcgagtcggtcatcgacgcggttattttttccttcatctgcgccgatttttcttccgaatgtcccgcattggtgaccatttccccaatcgactgcgtaaacaacgattcgattcggccgaccatcgcctcttcaaactccggttccgtcatccggctgacaacggcctctttggtgattaaacggttggcaatgacgtcgcccgcttttctggccagccgctttctgcccttgggaattgccccaggggtaaagggcaggcgtttgccgaaaatgcgcacctcgtatttggggaagaacagcattttgaccgcgatgaaattggtaaagtacccaatcagggccccgatcagcgggcccgaaatggttctcaaaatatgcataatgcctccaaatttaaagaatagagatcattataacactaaagtcaagttttattgaccaaattcaaccatgcggtcaatggctgcgcgggattcttcaatcgtctgttccggcaattcaatctgttcgccgccgtccccgttgaggctgtgatagacatccatcagcgtggtcgctttcatgttcatgcacacgcacattttagaaagcgggtagaatcgtttttccggatgggcaaactgaaggtgctgaacgatgctgttttccgtcccgatgacaaattctttgctgtcgctgtctgccgcgtacttcatgatgcccgtcgtgctgccgatgtaatccgcctgttctgacacttctgtcaagcattcgggatggacgagaatttctgcgtcagggtgttccgctctggctctcttgacgtcttccgctgtcattctgcagtgggtcgggcagccgccgttaaagaatttgaaggtcttttctggtacctgcttggccacccaagtgcccagatggcagtctggcacaaataagatcttatccgcatccattttcttaatgatcttcaccgcagaagacgaggtgacgatcatatccacttcccgtttaaaatcggccgtcgtattgatgtaggccacgacggtataatccgggtattttttctttaattcgattaaatcctgacggttcatctgcgccgccatcgggcaggctgccaacgaattggcgagcactacgttcttttccggtgagagcaccttgcaggtttccgccataaagcggaccccgcacatcacgatgttctgatgcggatccttcgccgcctgaacggccagtccgtaggaatcgcccacgtaatcggcgacttcccagatatcctggctctgataagcgtgtgccaaaatgcacacgtccttttctttctttaactgaatgatcttttcctgtagttcctgaatattcaaaataagctccccctttgacgtcgcttgaaatttgatgccttattatacccacagtctctcggcgttgtcaattgtcttgtttatttttatttgtcagctgtcttgtcagctttgcggtgctgtgctataatcattagcaatttcaataaatttctagaaaatcaaggaaatcaactaaccaaaatgaaaacaacagatattctgatcgtgggcagcggatgttcagggctttacgctgcgctgaacctgcccgatgataaacagatcaccgttatttccaaatcggatctggagagcaatgattcgttcctcgctcaaggcggcatctgcatgctgaaggacgacgacgattacgacagctattttgaagatacgatgaaggccggtcactacgaaaacgacaaaaaatccgtcgacatcatgatccgttcttctcaggatgtcatccacgatctggtcaactacggcgtcgaatttgcccgagacgaaaacgggcatttcctttttacacgggaaggcgcccattctcaccaccgcatcctcttccacgaggacatcaccggcaaggagatcacccgccatctgctggctgccgcaaaggccaagcccaacatcaccttttacgaatacacgacactgctcgatattgtcgaaactgacaacacctgctacggcggcatcgtgcagaaatcggacggccatattgaagtcattcaagccgaaaccaccattctagccaccggcggcgtcggcggtttgttccagcactccaccaactaccggcatctgaccggtgatgggctggccatcgccctgcgccaccacatcgacttgaaaaatattgattacattcagattcatccgacgacgttctacgatccagacacgacgaagcggtcgtttctcatttctgaatcggtccgcggcgaaggcgccaagctctacggcaaggacatgcagcgctttgtctacgagctgctgcctcgggacgtgctgtcacaggcgatttacaaaaaaatggcggccgaccacacccatcacgtttgggaagatcttcagcccattcccaaaaaggaattggaaagccacttccctaacatcatcagacactgcgaggaaaaaggctacgatccagaaaaggaatgcatccccatcgtgccggcacagcattatttcatgggcggcattgccgtcaattacgaaagcaagacctcgatggaaaatctctacgctgtcggcgaaacagcctgcaacggcgttcacggcaaaaatcggctagcgagcaattccctgctcgagtccttggtctttgccaaacgtgccgctcatcacattacgataaacggcgcgatcttgccggatcccgaagcgcttgacgcgttaattcaagccattccactggatgtctacgcaaacgtcaagcaaatcgaaaaaaattatcatcaaattgtcaagaatgcgattcaggaacagcgcgaccaacgagatgaccgcgattcccacgaaccgttcgcatttaataatcaataaggagctatcaccatgtttgatcccattacgataaaactcaatatcgatcctctgctgttgtccgcgcttcaggaagacatcccggaagaagatgtttccaccaacgcggtcatgcccaatgccgttcagggcagcgtcgagctgatcgctaaggaagacggcatcatctgcggcctgcagatctttgaacgggtcttcactctgcttgacccgaaaacgaccgtcgattttaaggtccaggacggcgactttgtgaaaaacggcgcgcttctcggcgtcgtttacggcgatatccgcgtgctgctctccggcgaacgggtcgccctcaactatctgcagcgaatgagcggcatcgccaccaacgcgcaccacatggctgccctgctcgagggcacctcgatcacgctgctggatacccgcaagacgacacccaacaaccgcatatttgaaaaatacgccgtccgcaccggcggcggaaacaatcatcggaccaatttatccgactgcgtcatgctcaaggacaaccacattgacgcggccggctccgtcgccaaggctgtcgcgatggcccgagattacgcctcctttgtgcggaaaatcgaagtggaagttgaaaatcttgacatggtgaaagatgcggttgaagccggcgccgatatcatcatgctcgacaacatggaccacgacacgatggcgcgggccatcgccatcatcgaccaccgcgctgaaattgaaatttccggcaacgtcacggctgaaaaaatcgaagccattaaggatttggatgtggactacatctccagcggcgccctcactcactcgtcgcccattctcgacatctccctcaagcatttaaaaccggcagatggaggcggcaatgaaaggtgatgcccgacgaaaggaaatcttccgcctgctccagggcagtgaccgaccgatttccggttcggccctggccaagcggctgtccgtcagccggcaggtcatcgtccaggacatcgcattgatgcgaaaaggcggcacccccatcctctcaaccacgaaaggctacgcgattcaaagcagcggcgcctactcccgcgtctacaaagtccgccactccgatgagcagaccgaagaagagctgaacaccatcgtcgatctcggcggacgcgtcgaggatgttttcgtttatcaccgagtatacggcattctccgcgctgatctcaacatccgctcccgccacgacgtgcatctttatctcgaacgcatctccaacggctcttcaaagctcttgaagaacacgacctccggctatcattatcacaccgtttccgcggattccaaagaaattctggacatgatcttagaagcactcgacgaaaaaggatttttggcgaagctccaggattatgagcctgtcgatttctgggcgaatcccaattgatcacatcaataaagcagatgaatatctcgattcaacgatcgatattcatctgcttttttagtgaattgaatattttagacccatttttacgaaattttcttttttgtcttatgataaagaaacgcctttcgtcgaagtggacgaatggcgtttttgtcatactttaaaacttttcgatttgagtgaagcaattgtctttgcctcaaaaccattttatttagcgcttggtatgattatggttgcgatggctgacataacgatccggggttttcggtgtctctgtttgacgggacgtttcttcccttgaatcaaaatcaaacaccctttcattcagcttatcgcggtcgttcttcggcacagtcgtgcgtttgacaggcttcttcatcgccatttgacgattcgttctcctgacagcctcatcgagccgcgcacggcgtttttcctggcgcagcctttcattttcctgtgccttttggtagcggagttcacggtcgcgttcgttgatttccttcgcattgagccacatggtttcctgtccaggataggcaatgccatcattttctcccacttttgccgcagtttcaggcttcgccgtcttttgaacaaaatgattggcaagttctgtcttgtggacaataaaaatgaccactaacaaaaagatatgcgcgtagaacagattgaacacgacgccgtactgttcctgcagataatgagtgttgaacccaaatgcggccatgatcgatgtgcacatcaacgcgagcagcagaatcggcagattatccttcacgccgttcatcgcttcctggaaactttccagcgaggcgtcaaaataaacgaaacggccgataaccagcgtaataaaatacatgatgatgttgtcgtaattgctgtccacgtagaaaaatttgatgtaggcaaaaatgatcagcatataaatcatcccaagcagccgcatggacgcgcgttccccagggcggatgtgattaagaggaatgattttattgtcgacaaaagagttcaggatcacagaacctaaaataaaaaacagcagaatgatgccattgtatttgctccatatcgttttatccgtcgtgccaaagccaaaataatcaatggcaaaatagatcgcgacaaacatcaaaataaacgtgctggagaaaatcagttcgtagaagcgttctgtcaaactgatggtttcgtcgatcaaaaaagtctgcttcgtcgcttgtgaatacttgttggacatgacccttgctgcaagcaggatgatgccgatggctgcggcaatgcagacagccgccatcaacagcatcatgaaaagttttcccggctgcatcaaataagccatatattgtccgaatgtcagggctgtggtgctacccaaaaccaatcacctctatcatttaatattattttatatgcgttattttcaattatgtgctattatacggtgcaattattaaatgaaactaaaaaaccctttactttgaatcagctcactcagcttcttcgtccagagcctccagcagaaaactcaccggccgaaagccatcgttgcaggagagcatcgcagatttcggatttttcatccagccgttgtaaaaattttcgccgccgtgagcaagtgtcatgacaaaaggcgataccgtgtcccacgcactgtcgcaaaagccctccggctgctgccagccattgcagatgaaggtctgccccaactgcatgtggcaggcgtcctcaatcggattttcgtacgctgccattaaatcgtcataatgcgcgatccgcttgaccgtgatccgtactttcttcactgaattatcctttgcttgttaatttttagtcgatcttttcaaaggcttcctttggcagaccgcacaccgggcaggtccaatccgccggcacatcttcccacgctgtgcccggcttgacgccgtgttccggatcgcccttggccggatcgtagatgtagccgcaggggcattgccattttggaagggaaggcgtttcttcttctgccgcttctttagatgctgcaccgtctgctccgattaattcctgtaccaaagctggaatattcgcaaaatcgtctgcgtccggattccaggaggatctgacttccggctgcacgacttcgaagccagcatctgtcagtttttccctgaggattttgttgccttcgccgctccagccatagcagccgaaaactgccgcctttttgcctttgtatttaagagacttcaggtagtagaggaacccttccacgctcgcaagaatgccgttcaaaatggtcggcgaaccgactgcaatcgcctttgacttgaagacttcgccgataatatcgtccttttccgtgtgatcgacattgaaaaccttcaccaccgtgtctggcgcctgcttatgaatttcatccgcaatcgcgtgggcgattttttccgtgccgtgccattccgtggcgtagacgacggtaatctgatcttcctgataagcgtctgcccatttggcgtaggcttccacgatcttcatcggatccttgcgccagatcgccccgtggctcggcgcgatcatctcgatcggcaggttcaaggctgcaatttcttttactttttttgtgaccaatggcgagaacggcgcgacgatattggcaaaataccgctgtgcttcgttccaaagcgtttcctgatcggccttatccgcaaacatttcttcaacggcgtaatgctgaccgaaggcgtccatcgagaagagaatattgtcgccggtcagatacgtcgccatcgaatccggccagtgcagaaagcgcatctccacaaagatcaactgcttgccgttgccgatatccagcgtatcgccggtatggacgacatggaaatcccatccccgcttgccgtactgaccttccagcgatttcaccgcgttggccgtgcagtaaatcggcgtgcctggaattttttccagcaatgccggcaagctgcctgaatgatcgttttccccgtgattgaccacgatgtagtcgatctttttcaaatcaatttctgattccagattcttcaagaaatcatcctgatgcggcgcccagaccgtatccatcaacactgttttttcttcttcgatcagataggcattctgcgaactgccgctgtgaatcgtgaagtcatccccgtggaacttctgcagatcccaatccatatagccgatccacgatacattatttttaacctgttttctcatttataatcctccctgctgcgtataatatcttggacaacgcgcttgcttatttttttatatttttatcttgatgataccgctttttgtatgattttaatgttgttaaagccacggatttcttttttctcactctagatttgtataatttcagaaacatctttcgatacgggaataaaaaaggagcagatacactgtaacacggggtatctgctccaatttcgcttatgtatccaatctactcaagatgaagaaccatctgaacatgcgggatgccgtcttcgaggaattcgtctgatacaactttaaatccctcccgttcataatagccgatcgcgtagctctgcgcttcgatataaattttcttgcaaggcattttcgccttgatctgctttaatccttcacaaaggattccgccgccaagccctgtgccgtgctttaaagtcagcacccgccccatctgcaccacgtctttttctttgtaaaacgctcttaaataggcggtgacggttttgccttcttcataaaaaacatgaaggcttctgtaatccaaatcgtccagatcctgatagacgcaattctgctcgacaacaaaaatggccgatcttgccttcaacatttcatacaattcggttgtggttaattcatcaaatttttttgcgatgagctgcattaattttcacccttagattttgagtttttgtattcgagaatcggcgcttgtgcctctttgtgcgcgcctatgattttctccatccaaatcatgtcataccatctgccgaacttataaccgcactgatggaatcgcccaacttccacatatccgagatgtgcatggaaatctgcgctgtttgtcgttaaataggcatctggtgtttttggatatccaatgcaggcgtaaagatttaaaatgcccatctttttgagcgcttgctccattgccgtgtacagcagccttcccagcccctgttttcttgcacgatgatcgaggtagatcgtcatctcacacgaccagtcgtaagcggctctcccgacgaacggtcctgcgtacgcgtacccttgaatttgaccatccagcaggatgaccagatagggatagcgctttgtgatccgcgccatacgcgacttgaactcgtcgagcgtcggtgtctcgtattcaaaggtaatcgccgtgttttttacataataatcgtagatgcccaacaatctctctgcatctgccatcgaagcgtctcttaattcaatcatgatttgctgtccttgttcctcaatttttttctatcctattttagaacttcgttatttcgaaagcacttttttatgataagcccttttgccacaatacggacatttcatccttctgcttcttccgatatgcggcgccaaaatgatggctttcatcgtaggggtataaactgctccgcattttggacatttgtaatatccggcgtcatgctccagtttcaggcaggagaccaaaccgattaaaaaaatcaaacagcccgccgcaatcaacacgatgcgccatgtgatattcgcaacagcaaaggatgcggctaagatcatcagcagaaaagaagccgagcaggtatagccgattacattttccaatgcgagcagcttcttgtttgtccgttcctcctgcccgcgcatttcctgcaggtgctgtccggccattttttgatattgatccatcacgcatttctccccgattgaaaaaattcattgattataaaaatgattaaaattccaaagcttcaatttataataaacttaccaatagatttatacaagcgaaaatcataaaaaggttttcagaaaaacagaacaataatattggcacggctgatccgcggataaaaaacaatgacaaaataaaaaagccacctgtctcaaaggcagatggccaaatcagctggcttaaatatcggcttttttaatgacatcggcgagcacatcagcggattgtttcaatgccgcctgttcttcatcactcaaatgaatcggcacgagaccttcggtgccatttttgccgacaatggacggcatactcaatgcgaccccgtcgacgccgtaatcgccatgcatcatactggaaatcggcaaaatcgatttttcatcccgaatgatcgcagagcagatccggacgaccgacatcgcaattccataataggtggctttcttcttttcaataatttcataagcgctgttttttaccttttccgcaatggctttcatggacgcctgatgttcgtgatgcccgcgcatttcacagaaatcatccaatggcacaccggatacattggtgctgctccacgccgcaatttcactgtcaccatgttcgccaatgatgaacgtgtgtacgcttctcgggtcaacatccaaatgctgtcccatcagatatttcagccgcgccgtatccaatgtcgtgccggaaccgatcacacgggattccggcatcccgctgtatttcactgcggtgtatgtcaaaatatccactggattcgcaacgaccagcataacaccttcaaaatggcgttttttatttccggcataatggatttaaaaattcccgtgttctttttaaccaagtccaaacgggattcgcccggtttctgcccggcaccagccgtcacaaccaccacggcggcgtcggcaatatcatcgtaatcacccgcgtaaatttccattggatttgtaaacggtaaaccatggctaatgtccaatgcttcaccttccgctttgtctcgattcgcgtcaatcaaaaccatttccgaaaatagaccgctttgcatcagcgcaaatgctgacgaagcgccgacaaacccacaaccaataatcgctactttacgtaaattaaccatgataatctcccttcttattgcttttatacattttgctcatcacaattgatttctctttccaatcgatgcgtttctgatctcttgacgaatcctattatagttcgatttgctttctcgttatgttgtttttacaacatttaaggattttttatttatatatttctgcttttctttcgtatcattttctaagacagttattacaaagaaattgaaattcagcattttggcaaaaaataagagcagatgcgccatcatcataggctatctgctccgttttcgtcatacaaatgggaataaacccgcttacgagattacaaaaaattcacgttaatttttcaacgactcgttgatttgctttaattcttttggggtgtgtcggctgcttctgcacgccagatttgcctgctgccgaaaccttccttcttaaagtcagaatttagacaggtgatctcggtcggcacgatcttcaaaagccacatgggttccggcagttttttcagcgcctccagcggaatctttctgaaggccgcggccgcgttgtacgcatcggtaaatggttcgacaattgccgcgtcgccctcgatctgcatcgacttcaaaccgccgaaggaagcgctcgtctcaaaaacggccgctgccacgtgatgattttcccgcagtcctttgaatttcaatccgccttcagtaaaaatccaaagcgctccctcgtgccaagtatattcgagcggtgtgcagcggataaagtcactgccgccaaccgcaagggccaaaaccttgtgcgcggcaaggaaagtgtcgatccaatcgtagagcgttctctgatccattttctttgcagccgcatccttccgcgtccaaaaggaaactgcctgcgcgtattgttcgtctgtcatttgttcacctcaaaatctttgactcgatcaaaaatgtctgccgtgataccaaagcaccgtcggatcgaattcatctactgtggcgacgtttgtataacccattatctctttcagctggctgttcatctgacgtatcttcttttcaaccgcaggcgcaccttcttttaaaagccctggaaggatggctcgtccggttgagacggcgtcggcgcccagcgccatgagcttataggcgtctctcccgtcgtctacggaacagtcagcaaagatcttcatttttcctgagaccttcttgatgtccggaaggatcatcgccggcggtacggcaaagggcagacgcccgtgatggtggctgaccacaatggcgtctacccctgctttctcgcaaatggtggcatccctcgcgctgaggacaccctttgcgacaaacggcacgcccaattcgtgagcagcccctgcaaaggcttcgagatcctgagctgtcagggttccgagctgttctccatcgaccacatccacatcgccattggtcccaatgctgtggtcgatgtcgataccgaccgcaagggcgtggtgtttcaccgcaaaggccatttgtgatctaatcttgtcatggtcggcaaagggcttgatgatccgaatcgtctccgcgccgactgctgcaatttccgcgtaatccgcatcggactccatcccgacccagttgacaataccgagagcctttgcggcccgcgcgtattcctccatcggtttatggtcgagccctgccttatttagatgcgaaaatgccggcatcatgatcggcgaggtaaaatcctttccccacagccgcatcgaaatatcggccacgtgcgtgccgatgatccgttcctctattaagatttcgtctagaaactttctggtatgccagctcgcgttcgatgcgtccttcggcagcgccgggatcaatccctcaggccccggccaatgtgcttctttttccatttgttgaacctcctggcttctctccgttgttaattattcttctctaggaaccggaatataaacttgtttaagcggaatcatttttctatatttatcactcaaatctttgtagtatttaagaatgagatccaccaattctgttccatttataccacgaataataggcgtgctatcaagatatttttgtgcgttttttgtgtaatttgaaagcgtaacaaacaaaccgtaatcaccttctcgcattgcaccctttaacgactgtatcgttgattccctaatatcgctatcggtactttttacctgaacaagaatgcgaggcggcaactcatccttatatgcagtaatatctatgccactgtcgccacctttggctgatacagtggtcctgtatcccatggcacgaagaagatctgcaacgaaactttctaaatcatagcctttaagctgacgactcagttctttcaaaataaaatcccttgtgctctcaacgatgtcatctgccgttgcgccgacgctttcatcctcagaatctgatgaataattcttattaaaatttttatcaagtgcacctaaaaactcatccgcgtaatttttgacagaaaacagtgtcaatgctgacccaatctcataaagagcgccttgtgaaaatgccatacgcggcagatgtttcaaccattttactttcctggtctgtacatactcaatctgattaggatcataaacataatcaccctcaacaatgccaatgtttacttcacggttactctttgaaggaaatatcacataatcgccaatctgaatctcatgacagaaacgatataacatacctgcaccagtagcaatattaccttttttcgcatctggataaacctgtgtatatttttccttgaaggcatctctatttgcatcgatgtcgctcaaatcccccatcgcattccatccgatagcaatgattttatccctaaggaacagacgatcatcttgagtatgtattccccagattctcttttcttcatttgacatattaaagtccatcttttctataaaagttctatgttcatttctgaaactctttgcgcaaaatctcttttggcggctcaatttcattggccagcgtattctccgtcaaacctgacagaatcttgaacttcgcattcagcatctccctcatacaattgggaacatgctcctgatgtgcgcgatggatggccacgcactccttgcaattaccatgatatcggcaagccttctggcaggggcagtgatccttttccgcatattcctttcgaaattcagcggcaaattcctcctgcaatctgagcccttcctgtcgattgcctttatgaaattcccgcatagctgctatctctttttcattgtgctcgatttgcatcctgatgtcctccttgactcgaaattaaaatttttgtcttttatctgacttttcattccagaaaaatgctgctgcgaagaacgatgatttatcttctctacatccatctattacactcgtctagatagcgtaagccgggtcgttttacctcgctgatcacaaagtcgagcatctctgccacgtcacactttatacaaatagaatgtgattagatatatgatctgttcccgcggataaaaagccagaaatctgctcggctgatccctctttctctttcatgcatgatataataaaaatcaaaaattttgcaaagagagaaaccattgaaaaaagcgttaatttgtggcatttcagcttcattattttttgcctttacctttattttgaatcgaagcatgaacctgagcggcggctactggctctggatttcgccactgcgttatttaatcactttcgcaatcctcgcgctggtgctggcccttcggccgaaaaaagggatggcccgggcgctttctgccgtaaaggcacagcccggaccgtagctgctctggagcaccgtcggattcggtttgttttacctgcctttgacgctgggctctgtgtttggcgaatcctggatgaccgcgtcaacctggcagctgaccatcgtggctggggtgatgctgacaccgctgttcgggaagaaaatccccgtcaaaaatctgctgctttccacgttgatcgtgatcggcgtcttcatcatgcaagtgccgcatctccattcgaatcatctcacaggaaatctcatggcgctggtgccgattctgatcgccgcctttatgtacccgctgggcaaccgcaagatcatgacgatctgcccgccggagctggacaccatggaacgcattttcaatatggttttctgttccctgcccttttggatcgtcatcgcgcttgccgctttcttgaccggcggcgcgccttcctccggtcagctgctgcagtctctgggcgtcgcgctgttctccggcgtcatcgccacaagcctcttttttcacgccaccgatttggtcaaagacaaccccagacatctggcggtgattgaagccacgcaatgcggcgaggtgattttcacactgctcggcggcgtgctgattctgcacgacgcggcaccttcgatttggggttatatcgggatcatcttgattgtcgccgggatggtagccaatagtttaaacagcaattgagcccacactccagccatttcgctcatcgcgatttcaattagatctactttaacgtttcctcgacatcatctaagattttattgaacttcgttaacgcgcgttccatcggcgccgtcgtggtgaagtcaacgcctgcatgcttgagttcgtctagtgggtaggcactgccgcccatggataaaaattccagatactttgtgacggcttcctgcccgtcattcaagatggcttctgacaacgccactgccgcgcaataactggtcgcgtacttgtaaacgtagaagggccgatagaaatgcggaatccgagcccattcgtactgaacttcgtcgtcaatgatcaatgcgtcaccaaagtaatcctggattaaatgccgatacaggctgttcaaactttctggcgtcagagcttcccctctttcagccatcgcatgggcgtctctttcgaattccgcaaacatcgtctggcggaaaacagtccctttgaacccttcgagataatgattgagaagcgctagccgttctttaggatcggttgtttttgcaaggagctgttcaaccagtaaattttcattcacagttgaggcgacttcggccacaaacagcgtataatccgcattctgcggtgcctgtgtgtgattggacagccaagtatgctgcgaatgccccatttcatgggcaatggtgctcacactgtccaaggtgcccgtaaagcttgtcaaaatgtatggatttgaatcgtacgtcccgctcgagaacgcgccgccgcgctttcccgcattgggatacacgtcgatccatcgatccttaaaagcctgcttcacccgattcacatagtcttcaccaagagggcgtaccgcgtcgagcaccatctgctgtgcttccgcgtaggtatatttcttagaagagccggcgaccagaggcgtgtagacgtcgtaataatgcagttcatctaagcctaatattttctttctcaagttgacgtagcggtacatcgcgggcatgaacttcctcacagttttgaccaaatcatcgtaaacgtgttccggcacgtgttcatccgccatgctcatcgctctcgaagacgggtaatgtcgcacatgggcgttcgcgacggcctctttgacacaggcgttataagtcgccccaaaagtattgatgtgtgctttaaaacccttgtagaagctttcgaaggcgttctttctgagcacccggtcttcatccatttgcagtaaaatgtaattggactgcgtcacttcgtggctttcgcccgcgctgtccagcgccgcgtcaaatttgaggtccgcgtcctgcaggttttcgctgattttccccggcgccccgagcacttcggtgaaggccgccagcagcgcttcttcttttcccgataaaacgtggggcttttcgtccaataacttctgcatcgtgaacgcgtaaggtgccaaagcctcgtccttcactactgcttctaaagccgcctcatccattgcgagaatctcaggttccgcaaaactcacggcctgcgcgtattgggcgtagatcatatacgctttagcctccatggctttgccgtcattggatcgggtatcctcgcaatttctcaaactcgcataacaatagtaatttgataactttctgcttaattctgtatccagatcgaaaaacgccctgatcgtctttgcgtctttcaattttccctgatacgctgctaatttctgaatgttcgcgtcaatctcagggagtgctttttcccattctgcatcactctgaaataaactcgataaatcccacatatactgcggatctaggtctttgcgttcctttatcgttttgttcatcataaccttctttcatcatcgtgctttgatccactatcttgacatcaatgccactgtctcctcatggcacgagacaagcacctgaatgtctggatcccggacacatttccgcccgttcgcgggaactgctctaagccaaaaaacggcgcttttacaggtgctctccgtttgcgggaactggtccacgtgttttttctacttataatacggcgggcagggagagaagccatcgtctcgacctgctctcctctgcccaatcggtttgtgatcaaggtctaggcccagtatgccgttaacttggtcggtatcttgggttccggctgttcggattcccagtctgatttgccgaggacgtgatagtactcctgctgccgggagtgaatcagttcttctatcgacagccagtaaaatatctcatccattttcccagaagcagacaatgccacatcctgcccatccggccatttcagtttctctcgccgagggaggaacaaatgacgagtccaaccttatgagtctttgtcgttcgtgtcacgagaagatacaccgcgaacgcggagacagataaaaagcaatcctcgaatggagagctgccttttgtcagtcatagagattcattttgtttaagaccttaagctgatcacgctttgcataaatcacattcaggacatagactcttccggatacttcatccgggcgataatagatgtagaagttcttcgcgctgatcttacgcacgcctctggagtgccacggctcacgttcctccggcgcaatgctgtctgccatgtaggaaagcttctccatctccttgcggatgactcggatgtaatttaaggcaacatcaggtaccagcagagtctcagctatgtaatttttgatctcataaaggtctgcttccgcatccggtgtgacgatgatctcatgggcgttcacttatccaaggctcctttccagatcatcgaacacatctccaagcttccttccttcaccggcgaccgactgcgcatagctgtgctgaagttttgcgtcaagctccgcatccgacatcgcatccaatgttcttggctctgacggaacagtcagtgagaacggaatgccatgacgataaatgatctggcggtacagggaattgatgactacggagacaggaattccaagcttttgaaggatgtcttctgcttcattttttacatcggcttcaacacgtgcgcttactgttgaatctttcatataattgcacctcctgctgcttatattgtaattcattgtcttgctgattgcaatacaaactatatggactgtttgtgaatttatacattgtcaggggcggtcaaaatctctacgacccttttccccggaaaacggcgcgggggctttctgtgcgaaaagcgaaatcaaacaggtaataacccagtccttatatctatttgattccattttgccttataatttccatgtccggcagatgcaggagaacatcgcaaaagcgataacaaccgccgacacgatgagcccggacggtatccaggcacggctcgacgagctgcaggacttcatcggaagtcagcaatccgaaatcaccgaattcgacgaaagccccgtccgaaagctgatccaacagatcaccgtttacgacggccacttcaccgtggaattcaagtccggcatcacaatcgatatcgaagcataaaaaggctcctcgccgccgacgcatttgccggtagtgaggagctttggtctcgtttagaaaatctgtcccggaagttttaacttcttctttgtggggaatcccttgtcgaatttctccacatcggaagcatctacataatatccctgcggtgtctggtatacgccagtaacgccatcgaggtatcccggaatcagttccttgcagaggaaaaaggagtcatccgcgccttccggcaggtcatggtagcggataccaaactcacgggcataattaaagccacacttgccgtagaagccgatattgccctcgaacagcacagcgccgtagccgagtcctgctgctttctccaaggagtaatcgagcagcgccttaccatagcccttgcgcttgagctccggcgtgatgccaattggccccatggtcagaaccggtattgtccggccattatcagcttcgatgatcgtcctcatgaacatattttgtccgatcaacctgccatcccgctccatgacaaaatccaattccttaacaaaagccaaatcatcacgcagtacatggatcacataatgctcactgcatcccggacggtacacgttccaaaacgactctctgacgaggttctcgaccgctctgtagtcttcgtttctttctaaacgaatgatgtagtcatttgtattcattgtttttcctcctgaaaattgttgactgtcaattgcctttcagcgggaggtttgttcgattataagcaaacctcccggtcagcctacaatctccagtgtgttgtactttctcaaacagcactctccttaaaatgatatttataatcaagcctgacggcctaattattctgatgatacaatcttaattctatttcttcttcgtagcgggaagctcctcgtacattgcttccagtagttttctcagaaactccttgttatccacgtcatccacgagcagcattttctttgtgccgtcatacggcagttccatttccgcattcggcatcattgccacagcgaactttgtgggcttcacaaggaagcgatcatcgtaaatgccgccgaccaccttaccacgatagtaaatgatgtattctcccatcatcgctcgataggatacatcatccagttcagaaagctgttctaatatgaaatccaggtattctttgcttgatgccatctttacctcctgatgccgctccccaccgccgtgattggtagtgaggagctttggtctgccctgtccgattatcgttttttatatagaacgagatctggattatctccttctttctcgtaggtacagatcaatatgaaacccatattggcaaggatgccgaagcatctttcgcctccgaactctgattccagctgattcccgagataggtcgtctgatcgttcaggaattttaccttcattccatttggtaatcggtactcaagattcacatatttaccgacaagcgcattcagtttttcgaccttgggcatgccctcgatatgaagatcattgatttcttcaatgagtttctgcttgaaagcatcgaactgtccgtcatcactcagttcctcatacctctgccagtaatccaacgttggaagcagctgcttcatataagcacgaacctgttcttccgggaagtctttattggccatttggccgacgcagacatcgatcagttcatccatattactgtaggtataggttccgtctgcataacaccatttacagtaattttcattaaaagtaccgtcggattctttgctgataacttcatcttcactcaaaggcatgccgcagcactgacatataagctgcctcggactaccgagaagtgtattgatcgaaacatcaaattcctttgacaatagcttgagtgtttctgtgtttggctgtgtctctcctgtctcccagcggcttactgcctgccttgtgaccataacacgttcggcaagctgatcctgagaaagaccgtgcttttcgcgcaggtttttaattatatcctgtacagtcattaatccgcacctccatattcattgttcatttatattatggactatcaatgcaggactaacaagcaacgagctgttgcctttgagtcttatcgtttcggccatgtcggttacagtatgcgtagatacaccggattccgttgatcttgaatctcgtctctgcattcccttcaggatacagtttctcaaactgcactccatgatccgagactgcttcaaggaacgagatatagtgatcctttgtcataggatgattgaccgtaacataatattcatcctcaacgatttcgatcctgatggtgtggtcatcatctgcaggctccggatcaagcggcggcagtgttataccacagcagcttacaactgcttccccagtcgacctgatcacattgccgcagaccgggcacacatagaatttacctttggccatattggacgatcggttcaggttcctgatatcctctcccgacaacagttcgatcacagaaatgtcgagtgctttggccagcggttccagcaaactgatgtccggaaatccctgccctgtttcccatttgctgactgccttactgctgacataaacttttgaagcaagttcctcctgcgtcaacttcttcttttcacgaagccttcgtatcacggctcccgtaacatatctgtccattgcttttgcctccttacaatacgaatctatcataagggcaccaaagatggtacctacgcatcgtggagtttcattaccacaccagttcaccgtcaccgcccatcagtctggtcatctcctcgatcctttctaatgggaacggcggtgatgaaacaggcttcatagccagtgacatcagcttcattggattatcatctgctgcgattcgattagagcttaagtgcccacatactttgcagcgatggataatcgcccactcgccgttttttcttacccatactgcaatcggctccatcacgccgccgcagtctgatgccctgtcacccggttcattatcaaggtgttggctgcaaagacagtagggacagtggttccgatggtcacttcctgcaccggtcggtacaacggttctgccgcacactttacaaataaaagtgtcattacttggatgttttttatagtatcctttatcaaatgattttttcttattttctctattcattgagattgccctccaaaaagttataatcttaaaccttctgggaggcttgtctgactacagcaaacctcccggttatgctgcaatctccaatgctttgttaattctcttcaaaaaacaattctccttctatactatcgttacttcactttggctattagaaagccctttatgaccagaaacgaaaagcagatgatgcctgcatacggctgcctcgccacaatgaaaactgtgactgcaagtattgacaggacaactcctgtaacaagccggtgtctgttccaaaccggattattgaaattggcgatgatcattccgcagatcccattcaggattgtgaggccgatgatcacaataaaaacgatcttcaccgccggattgattccggtcagagcaagcattgataccgtctcgttggattccattccgttcccaaaggcaggaataaacatcagtatgaccagaaggatatccagcgcattacatataagtgaaagatatttattggcaaactctctcttttcattctctgccacggagatcatctcgtctgaacaaatcagatcatcgatcgttacagagaaatagcgtgagatctcttttaacgagtcaatgcttggatatcctctcccggactcccacttcgaaatagccgttcttgagacgaacagagcctctgcaagttcctcctgcgtcatcgatttgctttttcgtaattcctgtagtttttcactgaactccatttgatgcctccagcttcaggttcgttttcctatagccagtatatgttaccatgaaccgataaatcatatacaggccggagcttaggaaaatggagcctataatatccgttgcccagtgaacacctgagatcagtctcccaatcaccatgtacaatgagaacacgattacaaaaacagttattgcttttctgagcatcggatttccaactcttctatcagcctgatatttcaatgtcggcatgacactcagaactaagagtgtagttgaagaaggataagatgcttccagattgccgtctatcagaataggtctgtaattgattggtatcatctcaaacaacaggtagcccagaatgaccagcacgtaatatgctcccaacagcaggatatctacatcaaccttcagcaggcttcttcgttttaccaactggacaaatcccagagtcccaaagcacaaacatacgatgataggaacaagtccaagccaatcggtgatcgtatagagcgacatatgaacgcccgtcatacgatgaaaccagacattgagcgttgcgaacccgatttatgttccgctcacacctgctttctgtacatcaatatgctgcaccagcactgtccacacaatgaaagcagccagtaatatgattcccggcagcaactcctttttctcgctatctttcatcttttctccatcctttctctttggcatttgtcaaattgatcgtaatggatcgttgagaacgatgaaagaatcgctccgtcacatcaatgatacgaatcgtgtcatctacttatttttaaccaaatatccttcctgaatcgccgctgcagttgcaaccacgcatccaactacggcactgtacttcagatctatgaatgccaaagtcagtggcaaaacgaacagcattcctccggtcatcttgttcatcacggaatgaacagatatgaactctctctgtcggataaatcctactgtgatactcgccaccttaatgaatgcgatgatagcaatccatatataaagccagaccggtatatgtaatacaggcaacagtttaatcaggcataccgctacgaatacaatatctgcacctgtatcaagccttgagccgaactcactgacggtacctgtttttcttgcaacagcaccatcgatcatatctgagaatccggcaactatatacagtgcataaaatgatggcgataatgctggacagaacatcaaagcaatgcttagcactattctgattccggtgatgatatttgccatgttaaaccggtgtccctacttctatcagatttccgtctggatcatagaaacgtataaccttttgtccccagctgtgcgtcatcagctgattgacgtatttcacatccggataatacttttcaagcctttccacaaagccttctatgtctcgttcctcaaaatagagctcgcaggaattattctccggaatgatatctctcccaagaaactctttccagtatttttcttcctgcagcaccaacccttccgtcaggatcatattcccgtcattatcaagaaccaacccaagaccgaacagatcatggtaaaactgtctggatctctcgatgtccttaacgacaatcagtacatttttcagtctcattcttctctctcctttattggaagacgaatcacggttttcaacttttccggagcgactttccttgcgtcactcagatagatttcatggtgtaagcgctgatccgtgatattaagatcataaccctgctcctctatgtattcatgcatcatttgaacagtagcaggctcatcatcataggatcctatatgcatgcactggacgcacagtccctcatcacaagtaagaaattccacctttgagaaatcctgtttctttttcgttgttgcctcttctatagcccagtcgaagtctgctcttgtaacaaagtccggcaggcggatcacagagatccagttgaagtcttctttgtgtgcatagtcgactccgtctacaccttcctgccaccagaagccctcaagcggcggtacaacataatcgaaatatcccttgatctgatgatctccttttttactcatcttgatcgtaaaggcaatgccatacaacagaccgattgcccgcttatattcgccgtcttcctgatttgggtcgccttgtccacgaacagcaatatagttcatgctcggtaccgttacgatagacggcttgttcttcggcatgtaaaaatccttatattccttcttataatcaaaagccatttttcattcctccaaaacatcctgacatctaaacaaccgtctcaaccctcgacatctaaacagcccactcaaccctaccgtttctgacatctaaatggcacactcaacccctgacatctaaatggcctactcaaccctgcggcaaaatgagctgtagataagttcccgtcgagcgttttttgagcttcctgagtggccgactcgataggcgctaatttcataaaccgcttgttctcaagcctttcagcgactatttgccgtcgacccttgacatcagggccaccgtctccacatgcccggtccccgggaacatattgactggtgttgcttcaatcagttcgtatccggcttttttcaaaatccccacatcccgggccaatgttgcaggatcacaggaaacgtacacaattttggggatgcggcaggcgatcaaactgtcgagcaaagttcgcgcacacccctttctcggcggatcaacgacagcgacgtcggcgcggctgccctgtctgatctgctcgggcatcacgtcctctgccttgccgcagataaaggaaatattttgaatgtgattgcgcttcgcatttttgcgtgcatcttcgacggcttccggaacgatttcaacgccaagcacccgtccggcgtccttagccatgcaaataccgatggtacctgtcccacagtacaaatcccagagggtttctgcccccgtcaaagctgcataccccttggccttttcataaagtttttctgcctgaatggtattaacctggaaaaaagactggggtgaaatgttaaaggtgtagccgcacaacccttcttcgataaacgcttctccggctaaaagctccgttttcgttcccaaaacgcgattgttgggcttggtgtggatattgagcataaggctcttcaattgtggcaggccttcaaaaatttgcacagtctgtcttttctgctcggatgataaatcgtgactgacaaccggcaccaccatcacgtcgccttggcggttcgtccggagcaaaaatccgcggacatcgccgcggcgttttatttcgtcgtagggcttgagttttaaatccgccatccatttttggcagactgcaatgatcggcgccaacggcacctcctgattcatacaatcacaaatcggcacaacctgatggctgccctttcgataaaagccaatgcccgcttctgagaccttaagctgcgctttgttgcgataatggcacggcgggtccatgccgatgatcggacggaccttttcttccgcgtcgtcaagcccgccaatatgctttaaatcgttgaccacagttgcccgcttgagtgcattttcgcacgccgacgttaaatgcagccattgacacccgccgcactctggaaaggccggacagtccggcgccttgcgattcgcagaggtttcaatgatatggctcaatttgccctttaaatattgagatttgactgctgtcagttcggcctcaacggtttcgccgacaaccgcgccatcaacaaaaagggcctgccccataaagtggccgaccccttctccgcgccgcgtcatatcggtgatcgttaccgtgaggtgatcgccgacgcagggcttatttttattcttttgcgttttattcatcttcgtcttttttattgccgttcatttcgctgatggcctgccggcggagcgccgccttgatcgctgagaacgtctcgtcactgatgatgtgttcaatgccgcaggcgtcgttttcagccacctcaggtgaaacgtctaggaagttgcggataaactgcgtgatcgtcacgtggcggtcgtagacctctttcgccgcctgaagtcccgcgtcgctgaggtaaatccgaccgtagcgttcgtggcggaccaatccgcggtccttcatttttttaacggcatcggtcgcgctggccttggtcacccccatcgcctgggccaaatcagtgattcgaaccccggtgttgctgccgatataatccaaatagatctcttcgagataatcctcgatcgattctgtaaaacccttattggttctaccgctgatttctggtctgtacaccatattattttcctcccttacggtttcgacggcttcttttatttctgattggcctttgttgttgaggatgaacgaggcatttgcgccccgggccgattaaatcctcccgtccacattttttaagcgcctcaataacaaggcttctgtttttcggatttcgatattggagcagcgcgcgctgcagccgcttttcatgccccttcgggatatgaatcggcttgaaagactcgagatcgagccccgtataatacatcgctgtcgcgcgcgagcccggcgtcggataaaaatcctgcacctgctcaggctcgagatgatgatcgcgcagatattctgccagtatcaccgcatcctgcaatgtcgagcccggatggctcgaaataaaataaggcacaatgtactgcttcaaatggtatttgtcacaggcacgattaaatttctggacaaatcgatcgtactgtttaaatgtaggtttgcccatgtagtgcagcacgcggtctgacaaatgctccggcgccacgcgcagctgaccgctgacgtgataacgcaccaattcgttaaaagccgcgtcggtctgatccgccatcagataatcgtagcggatgccggaacggacgaaaaccttccgaactcctggcagctgccgcaccgctttgagcattgcggtaaattcgctttgatcggcgtcgatattgggacacacctccggaaacaggcactcccgatggtcacaggggccggttttcagctgctttgcgcatgccggatgcaggaagttggccgtcggcccgcccacatcgttgatgattcctttgaacttcggatcctgggtcatccgtttggcctcccgcaggatcgacgcgttgcttcggctggagacgatccggccctgctgcatgccaatcgcgcaaaaggcgcagctgccaaaacagccgcggttcgacgtaatcgaaaaacgcatttccgacatgccggtaatctccggtccgccgcccagctgacagttcgtgtaaggcagatcgtagacgtcatccatctcctgagtggtcagcggcatctgcggcggattctggacaaagtaccgatcgccgcaggcctgaatcaacggcgcctccctaaaaggattggcgctcagctcaatcatattcgtcatctcggcaaaggcccgcttgcccccgcgtgtccgctcggagactgtctcgtaggacggcagcacataagcgtcgtccggcgcctgcttggccatcacaccagtgccgcggatgtaggtgatttgatcgatgggcagaccggcgtccagcgcttctgctacttcggcaatggccttctcgcccataccgtaaacgagcagatccgcgccggaatcaaaaaggatcggccgcctgactcgatcctgccagtaatcgtaatgggcaaaccgccgcaggctggcttccacaccgccgatgacgatcggcacgctgccccacgcttcccgaatccgtccacagtacgtgatcacggcacggtccgggcgcgcgccggtcttgccacccggcgtgtaggcatcgtcgtgtcttctttttttattgaccgtgtaatggcaaaccatcgaatccatattgccggatgaaactaaaaaggccagccggggtctgcccagcacccgaaaggcttctgcactgtcccatttcggctgggcgattacgccgacgcgatagcccaaatcattgagcactctggcaatgatggctgggccaaatgacgcgttgtccacaaaagcgtcccctgacacgaaaacgaaatcgcagaccgcccatcccaatgccgccatctcttgacggtcacgtgggaagggcagactaacatcatgactatttttcggtgcattcatattcaaattataccatacccggcacacctatgccaagatgctgtaaaatcaaaaccaccacaataaaaaaagcttgcgtgatttcgatcgtcagcccaatggtatcgcccgtaatgccgccgattttgcgcttcaaatccgccatcatgatcaagttcaaaacagcggtaatgccaaaagcgcaggtcagaatcggcgcgacgaaccaggagaccgcggcgatcgcggcgagatagaccacgacgtgccagcctttggtgatttccgtgatccgtctgcccaagccgccgccgccttccgcgtagcttgaaaagcagcaggtctgaatcgcacaataacgcccgaccaccggcatcagccacagcgccgctaaaaattgactatcgatcgtgtaccggtagccaacccacatcgtcagcattaaaaggatcaagctaattgccccaaaggaacccagacggctgtccttcataatggtcatcattttttcgtgatctctcgctgaaaataccgcgtcgatggtatccgcgacaccgtcgtaatgcaggccgccggtgagccagatgtaaaaaatcagcatcagaatggccgccagctctggaatcccaatccacgagacgcaccagccgaagccccaaagggccgcgccgattacgacgccgatgaccggcatcaaaagcatcgaattgtaaaactcatcctctgtcacattctgaagctgaataggcagccgagtgtaaaacgacaaaccgattaaaaattcccgaaagaaattcaaataatgctcctttccattttgagcgtaaaaaaacaaaagactgatggtctgttcccctcagtctttcagttacatttcaccctattgatttttcattcatctggcatgccaaacttattttcaatcaacgatgtcaaacggtccatcgccgctttttcatcgtcgccattgacttcaagtaaaatttcatcgccctttgaaactgccaaaatcatcacgcccatgatactcttggcgttgacacgagttgatcccttactgatataaatttcactcgagaattcattcgccgtttgtacaaaaagcgaagctggttttgcgtgcagccctgctttgttcgttaccactatattttttgtaagcataattccaccccttatatattctgtcacaatcaattatacacgatttcattatttatttcaagccaatttcgggactctttagcaataatcgataatattttcacaatttcacatcaatggcgtcaaaatacgtcctgaccacgtccaaatccggtaaaatcacctcggtctttgccttcatttcttcatccggcgctttcagatccggcaccatgatcggacgaagggccgccgcgtgggctgcccgtatcccgttgtaggaatcctcaatcacaaaaccgtctgtcggcgcgatcgaaatcgcctccgccgctttgaggaagatgtccggcgccggtttgctgcgcttgaccatatcgccgcagatcaacgcgtcaaaataatcgataatgtcggcatccttcaattctcggcgcaccacttcctcacgggtcgacgtcgccagcgcaacgggcacgtcccgcgattttaaatccaataaaaggccctttacgcctttttttaacggaaggccgtggttttcgtcgtaccgccgatagaatatttcccgcatttcgtcttcgtattgatcgaaaggaaaatccgcgccgtagtagtcgtcgaaggtcttccgcgttgcctgaaaatttgtacccaagcaggccacaatcacttcctctatattagggatctgatgcttggcggccactgcctgccaggctgacagcacctcacgctcagaatcaaagatcacaccgtccatatcaaagatgacgccggaaaacggcgcgggcgttttggacaatgcgcttttcagagcgtactcggcgaattcagcgtctgaaaggcagaccggcccgatgtccgtctgaaccatctgtctcttctctatatcctgcataaaaacctctttcattgttcttgccatcattcccgctattttgttataatgttagcacattggaggagaatcatgaacgaaccgaaaataaccaaatcgatgggcattcttgaagccgtcgaaaaatatccagaatcccagcgctattttttaatggctggcatgtcctgtttcggctgcatggccgcgcagtttgaaaacattgaggaaggctgtctggcccacggtatcgacccggacgtcttcgtccgcaacctcaattttttcctttcgggcgaaaagccgacggaaaccaacctgccccgcagctgagagctgacgacaccaaaccgcatcactgcggtttttttattgcctgaattcgtcctgaatctgaatctgcttcagacgtgcgcccgacgcctgttcgcggatggctttcagctcatcgattgaaaattgataggtactgccgcagaaatggcagcgcacttcaatgggttcgccgtcctggatgatgtcgtccagctccttgacattgattgcagcaagcgcccgactcacccgatccttcgagcagtcacagacgaaggcggccggttcttttcccgtccattccaggcccatcggtcctaaaatagtttcgagaatatcttcaggtgtcatccccttttccatcatttcagtgatcgaatcgatcttggcgatttgattttcaagagcggctaccacactttcttccgcattgggcatcagctgtacaataaagccgccggcatcttcaaccgaaccgtcctttgcgacgcggacgccgagcccgacggccgaaggcgtctgttctgagacgttaaaatagtaagcgaggtcttctgcaatttcgccggaaatcaaattgcagattccgttataaggttcctttaaccccatatcacggatcaccgtcagcgttccgttacccacagcgccgccgacatccagtttgcccttgtcgttaatcggcagatccacgtagggattgacagcgtagcccttaacctggccatggcgattggctgtgaccgttaatcccttggccgggccgtccccgctgatttgaagggttaagacgtcatcgtcgcccttcatcatcgaccccatcatggcccccgccgagagcaggcgccccagcgccgccgtcatcacgggcgacgtgttgtggagggtcctcgccttttcaactaattctgtagcatctatggcgaaggcgcgaatgctcgcattcgcagccgtcgccgtcacaatataatctgacataagtatcactttcttctgtgtaaatagactttggcgtttattatatcaaaatggagaaagaaataaagaaaaaatggccaatttttcgcgtttgtactcgaaattgaccatttcgcatttgttttattgctttattttcaaagcaatagaacaatttaagaaatttatttctattttttagtttttcttagttttgttgtgccgatcatctcggctggctcgtctaaaataccaaaccgccagcaggataaacgcgccgatgatcaaaatccgcagcccgctgaaaagcgaaaaaataatcagcgctaacgcaatgagtaactcaatcatctttcgattacccctcgtgattcgggcgtttggacgtcggtctgagcgtcatgccgatctggcaaagcagctgcccgtcactgctgtcaatatcgacgcggtaaacatttggctgcaccgccttgaattttgcgctgatcacatcgccgaatttggcctgttccttgtacagaatatcgaaggaggcgacttccacctcagcgatcatttcaggcggaatcgtttcgaccgcccaggccaaatagcggacgttgtttacatggccgttgtagtcaatgtccaaatagcgcaccgtaaattcacggttgccgtcccattccgatacccgcttgagcctcgggattttgtacttttcgttctcgtccttgaactggtacacctcgttgatggcttcatcgctgacacgcacgatatgctgcttatcaaaatccatcatcatccaatgggactgcccattggctaaaaccttcccgtctaaatccttcagcacaaacccacggttagcgataaagccctgagccgcgcctgcccaagtgccgacccggacagtctggagaaatcgcggatattcgagaatgtcgatgtgatatttaacgaccatccacgccaaatgcatttgatccagctcgtacggaccggcattcaaggctgcgctgtgttccagcgcaatttcctgaaaataatttaatacactcaccggcgacgcgcagtaattctgcaggcaatcgtaagtgtagattttctgatcctgatagaaaacgcgtgattcgtccaatcgttcctccataacttttctaaaattgtcgatgaaaaaaccgctgcagctgcaacggttttgatccaatattataatcccggtaccgcgtctttaaagcggaccatgtctttttcaaaggcttcagaatgatctttgacattctgccagctctgttttttataggcctgtgcgcggcgggacatcccggcgatgtagccttcgttctcaaccacgtgaaccatctgcgccgcgtgcagcgcctgcagatcgtcaacccgcgcgctcatttcggcaatcacctcatcctgtccaagacgcagggtttgattcatcgcagccatatccttaacgagcgccttcgcccaatcgacggctagaatttccttcccgcctcggtgtagaatcaggaaacgatcttgtccgttttccgcgacgcgccactcgttgtcatccgcttcagcctgatcgctgtctgcgctgaacgcctccgcggtcatgcaataaagcagcagcaggtgcatgatattcatatcggtttcgctgatcccataagggtcaaaaggattgaggtccatcgtgcgcagttcgatgtacatgacgccttcttcggcaagcgagcggatccaatcttcctttggatgaaccggcttcagccgcgcctgcgcgtaaaattccttcggttcagacaattttccctgttccacgaaagcttccaaatcgtcaatgaaatgacgaatcgtgtcgtatcgcggatacagcgcttccgtgtttttgtaacccggcgagccacttctaaatgaaatgccctttttggaatattgactgccccgaccgtcggaccacggcatcagcttcaggcattcgtcaatgaaagagctgtgcgccgcaacggacgcgcctgtcatgtaaattaaaaaccatcggtaagtcagatagtttttcgcgattttcaaatacaattgatttttgaagctctgaagggtctgcgctccgtcttcccgtttcgcctgccgatacaatttatcgaccgcagtcaagccgagcgaataattgaaatgaatcccggaaaacatctgtttcttggcaccgtatttcttcgccagattttggcggtagcgcattgcctttcccgcgccgggtgcgccggcgtaatgagcgatcggcactttctgatcgtccggaaggacacagggcaccgaattgggccaaaggtattcatctgacggcaggaccgtgttaaccatgtcggtcaatgtggcgagcacgtggtacgcttcatgggtcgatgtgcacggcggcgtaacaatttcaacctggctttctgaaaaatccgtcgtgatatagggattggtgagcttattgccaaaggctgccggatggggcgtcagagaaagctgtccattcgcataagctctcaagccttcccgttcaacgccaaaggagccggacataatctcttctggcgtcaatgccgccttcaatttgtcaatagtaaaaaaatcgtctttcatagccctctgccactttgaattgtgttaaaccgcccactcatctgcagatcacttagatccacgtatctttcgctttaacgcctgtccagtatttatcaatatccgtgtagacgtattcgatggtttcgttttcgcccgctttcatcagacgtgcattggacggatctggaatggtttccttgatctgtgattttttgacgtagtatcggccgagcacttccttggcgcgttccgctaattcttctttgtccgttccggaaaaggtttcaatttctggcagatccggaaaacgacaggtgattttgtcaccttcttgtttgtaaatagctgggtaaatctttaacatagtgcttcctctctaatttttattttttattcaaacatttgtttggtcttatcaagggccgaggcaataaccgcgtccatatcgtaatatttgtactcgccgagacggccgccgaacaccacttggtcttctgcgtcccccagtgccttgtactgttgataaagcgcactgtttttgtcgtcgttcaccgggtaataaggttcgtctcccggctgccattcagaggaatattctctggagatgacagttttcggcagatcctgtccattttcatccttgccgaattcgaaccatttgtgttcgatgatccgcgtccatggcgtttccgaatcggtgtaattgaccgcggcgttcccctggaaattatcaatgtccaaaagttccgtttcaaaacgaaccgaacggtattccaaatggcccaatttataatcgaaatatgcgtcgatcggccccgtgtaaatgacctgatctgccatttcgttaaacttttcccggttttcgagatagtcggtattgagttcaacgcggtccacatcagcgatcatgttttcgaccattttcgtgtacccgccgattgggatgccctgatacaaggcgttgaagtaattgttatcaaaagtcagacggaccggaaggcgcttgatgataaacgccggcagttccgtgcacggacggccccattgtttttcggtgtagcccttgatcagcttttcgtaaatatccgtaccgaccaggctaatcgcctgttcctctaagtttttaggctcggtgatccccgcttccttacgctgggcttcaattttcgcagccgcttcctgaggtgtcaccacaccccacattttattgaaggtatacatattgaagggcagcgaataaagctcgcccttgtaattggcgacgggtgagttggtaaagcggttgaaggtcgcgaaacggttgacgtaatcccagacttcttcgttgttggtgtggaaaatgtgcgcgccgtattcgtgcacgttgatgccttcgacctttttggtgtagacattgcccgcgatgttgggtcttttgtcgatcatcatcactgatttgcccgctgcttttgcttcgtgcgcaaagacggcgccgtacaaacccgttccgacaatcaaataatcgtatttcatcctattctccaaaacttgtaattttacgctatatcaagctcatcaaacctgaaactgccccgacgacgagtgcaattcccagaagtccgacgaataatctgatcaggcagcctgtcagcttcaattcaattctaatcacaatcaatgcaataatgactgccacaatataagaaataacgttgctcatattataacactttctattgatttcacaaattgacattaacgcttattgacaatttcttttgaatttttcacaatgctgttcggcggaatgacacctcggacggaagtcgtcgggtatacattggtgtgggggccgatcaccgtgcccgggttgagtaccgcattgcagcccacttcgacgtaatcgccaagcatcgcgccaaattttttccggcccgtttcaatttcatttccgtctgcatgcaccagcacgttctgacgatccgccttgacattagatgtgattgaaccggcacccatgtgggcgtgaaaaccgagaatactgtcgccgacgtaattgtaatgcggcgtttcgacgttgtcgaataaaatgacgttcttcaattccacagaattaccgacgacacagttcgcgccgaccaatgccgattcccgaataaacgcgcagtggcggacctgtgtctgcgccccgataatgcacggtgcaccgatataggccgacggaaatacgtcagcggtcttgtgaatccaaaccccttccttcggatgatcgtattcatcttcagaaagggtttcgccgattttgtaaatcaaatccttaatccccgaaagcgcctcccacggataggtgaagccttcgagatatgctgcggcctgtgtgtgtgttaaatcgtaaagttctttaattttaatcatcgtttctcctaatggcgtctgtagcgccgtgaattgcggttggtcgttttcgcgctgggactgccgctgttctgccgcttctgctgtaaaagtctggcaatttccgcagcctgcgtgtcagatgtccgcgacaagccggccggccggcttgtccgattcgccgtcatcggcgtccgctgcacggctgcgcgctggctggccgtctgccctgacgtccgtctgcccggcaccgaaggtgccctgccgataatggactcgatctctgaaattggaatgtgccgcgtgttggcagtcaagaaatccttgtcgtgttccgtcgcaaacaacgccacgcctaaagccagccagaaggtattgtaattgatgcccaatatcagctggtcaatgatggcgtaaagcgtgtagcccgtcgaaacaaaaagcaggtaatattcacctcgtttgtacattttccacaagccgtaaatgacaatggccataaataaaatactgaaaataatcccgtattcctgcagaaccaaaatgtacaatgagtcaataaaattgtaaccaggattgaaaacgcctcctgccgttgacattggaaatgcccgcggccaccacttaatacctctggtcaaaagggacgtgtgttccaatcgaagccgtcctgacaaggtatcgttcaattgcgaccacctggggatgttggcgtcgtaatgataccccatccacaggcagatgccgccgaaaatcaacggtgaggcgaccatcgcgagccatagcggtttcattttatcggccggtatcgttcggtattcggaaatgtacgcaaatgccatgaccaaaagcgtcaaataaaacggcagtctagaatccgtcataataaagagggcaacattagccggaatcagaatgagcagttccaatttgcccagcttttccttccgaatgtagacgaccaatgcgctgatattaaacaacagcgtcggtccgaatgaggcgtagcggaatccaacccaatgtcttggacgcgccacgtaggaatcataatgattttcaatgacgccaaaaagcgagctgaacaccacaactgccagcataatcgagctgatgacaatcgtcagacgaacgaccttttcgtaatcgatatctctggcgcagataataaacgcgataatccaggttacctggtcggtcacgacgtcgccaatcgtgaaattgatcaccagtaagaacgcaaaaccgagcagtacacccaatttttcgttcgtggaacgcggcgtattgatgatttccttgcacatcaaaagtaaaatactgaacgtcagcaattgcgtaccgatggcaaactgatagttcacgacgaaataagacgtgttgataatggaaacaaacaggtaaacactgtaagaaatataaaacagccagctgttcagatccgtattgacaaagcgaatgagtttctctttcattcctaccacgttttcacaaaggtctgaagtttcttgatggatttcacttcactgcggtctgaaccagatactttgtaatatttcggcgtgccgttgctgtttttgaccaacgcgcttttgccatcaatattgaaggcaatcgacgtacagtaattgtcctgatcaaatccaaagaccaccgtcggagccgtcgcatccttcgccgttactgtgattttgtgatttgcctgatcgccagttgtcgtaaaggtcgaggtatccaacgcattcaaggattccagcgtttcatcgtaagagcggctttccgccacaaccccttgatttttcatgaacacatcctgaaacagcgcggtctgttcatagtggtggctggcactgtccgtcgacgatttcgattttttcgccgtcgacgtggtagactgctgcccgcaccccgccgcaacaaggatcagggctgctgctaaacctaatagccaaattctcactttttttttcattactatctctcctagttttgtttattctttttattatatttcgtcatttccgctttcgaccgagtgcacgtttcggaatgacaagccgatatacgacatatcccaataaagtaccaagggtgttattaaaaatatcatcaaattcaaacatgccgcaatggaaaatatactgcattacttcaattgacagtgagcagataaatccaaagagcagtgcttggccaaaacagcgttttccctttgccagcggaaacaaaaagccaactggcatcaacatcgcgatatttaaaaagatttgcttggcataagaccagctgtgcatcgcaagcatgctgcggtattcccaaaataaattgagattcgcctgggatgtcgccgtcggcactctggagaaaaccgtcgagccaaacatcagatacaaatacagcaccagaaaccagccgaaaatcaactgactgattcgaatccgccgtttgacgcacattacgacgccccaaatcagcgctgccgacaaaatcagcaagccgacgcggaccatattcggtgtccaaactggatggtagccctcccagacacttccagcccacgccttcatatcggtccgctgcagtttcgcggccaacgcgttgaggccgcgggtcaacagatcaaaaaaatttgtcattctcaattttcctgcctatctcaactttgtttattttgtttatgcattatagaaaatcaaatttaatgctttctgaatcatagccgattcttttcaaaaaaaaagctcttccgaagaagagcgtaattttaaaatggagcggaagacgagatttgaactcgcgaccctcgccatggcaaggcgatgctctaccactgagccacttccgcatcgatggtgcgaggaaagggattcgaaccctcaccgctgtataaggagcgacaggtccctcaaacctgcgtgtctgcctgttccaccatcctcgcatctgttcacaacagaacaatatttattatagctgatctttttaaaattgcaagcttttttttaaatattatcgatttttttatattattttgattaagcggatgttttgctctaaggtcaacgtgtcccggctgttgtcgatcacaatatccgcccggctgaccatttcctgatccgacatctgcagatcgagcattcggcccgccaaatccctatcgatatgatcccgtctcacaatgcggtcaatccgcgtcgattttctgcagaccacgaccgcgatgcggtccacatactgttcctgatgggtctgaaaaaacatcgggcagtcgtaaatgaccgcgggcaccccttgacaacgataagcctctatcgcgtcgaggatttcccgctgtaaaatcgggtactggatcgcctcgagctgttttttgacgcctggatccctgaccattctcttccgaagcagctcgcgattcagttcacccgatgccgttaagacctcttttccaaaggcctcgacgatcagcggcagcgctttgccgccgggtgctgtgattaggtgcgccatttgatccgcatcgacgaccggcagattgaactgccggtgaagaatttcggatacggtgctcttgccggagccgatgccgccggtcagcccgatcacaatcgtgtttgcattatttgatggcataccatgaatctccttgatgggcatcgacaaccaaaggcactgccaactggacggtgttttccatttcttcgatgagcagcgccagcacatcgtccgcttcgtccttcggagcatcgatgatcaattcatcgtgaatctgcaaaatcagatgagagcggaagctttctctctgaagtcggcggtacacgtggatcatcgccattttcataatatccgcagccgttccctgaatcggcgtgttcagcgcaatgcgctcgccgcttttacggatcatgccgttgcgggactgtatttccggaatgttgcgtctgcgtccgaataaggtcgtcacgtagcccttttccttcgcttcctcgacgattccttccatataggcctgaactttgggataacgggcgaagtacatatcgatgtaattttgagcctgctggcggccgatgcccagctctttgccgagactgaaggcctgcttgccgtaaatcaagccaaaattgatcgctttcgcgtggctgcgctgttcccgtgtcacctcttcaaggggcacgccgaaaatttcagaggctgtcctagcgtgaatgtcttcctgtcgaataaaagatccgattagattttgatctcctgtcaaatgcgccagcacgcgcagttcaatctgggaatagtccgcgtcgagaagggtccggtctggaccttctgggataaaaaccttccgaatttcccgccccaaatcagtccgcactgggatattctgcagatttggatccgaggacgagatacgccccgtcgccgtcaccgtttgattgaaatgcgaatacactcgatgagtttggggatcgacgtatttgatcaatcccgcaccgtaggtggagtccagcttcgtcaccgtccgatattcgagaatatccggcacaatgtcgtgataaggcgccagctgttcgagtacttcgaccgatgttgagtaacctgttttcgtcttttttatggccggcagctgcaagtcttcgaataaaatctgcccgagctgctttgtcgaattgatgttaaattcctggcccgcttcgtcgtaaattttttcagtcaattcatggatgcgggtttcaaaggttttcgacaacgccgtaagctggtccacatcgatttgaaaaccgatgctttccatactggcgagcacactgatcaatggcatctcgatatcgcggtacaactgtgtcatgccctcttcttccagacacgtggccagctcttcaggtagatcggcgaggacctgacattccgctgccatttgggcgcgcatgaccgctggttcgattccatcgagttttttgcgctttttgcccttgccaaacagggtttcttcatcgtcaatatgccgatcgagatatttaagcgccaaatccgacaaatcgtaccggcggtctgtcggttcaagcagataagctgcgacgtaagtatcaaagcccagattgcccagtgccgcgccgtaggcttcaaaatcgtgaatcagcgcttttaaatcgtgccccacgacggccaaatcatccgcatttggcagatcgtcaaattcgcaaataaatcgggcgatcagttcaggatcatccacgacccagatctttttaaagtcactgaaagccaaataggcgctttcttcttctcttcggagatgaatcacaatgcggtcaagtttggacaactggagctgcacaaaatacaaatccttttctgaatcgatacttgagaacggcacagatgcgttattgccttgcgctgccgcctcgccgctctgcccccgggtgcgctcaatactgcggataatagacgaaaattccagatcgtttaaagtcgtcatcacctcaggattgaataagtcgcgcatctgcatcgcgtcttcgtcaatttcaattggggcttctacgtcgattcgtccgaggaacagactcaaataggcgctgtccttccccgcttcgaccttttctttttgtttgccctttaattcgtcaatatgttcgtaaagaccgtcaacagtcttgtattttttgacgaatttgagcgccgtcttttcaccgatgcctttaatgcccggaatattatcggacgtgtcacccatcagcgccttgacctgaatcaattcaatcggcgcgatgccatatttttcgtcaatggcagccggatcgatctcttcaaactgcgagccgctacgcgttgtcgtgtagagaatgtggatgttatcttcaaccagttggaaggaatcgcggtccccggtgataatctgcgccaaaaccggttccgctttgtgcgcgaaatgcttggacaccgtcccgacaatatcgtcagcctcgtagcctgccaatgtcagcaccggcacctgcatttcagccagcagttttttcatcaaatccagctgggtgatcagctcttccggcatcttgtcccgcccggccttgtagccgtcgtattttttgtggcggaatgtcggctccggcaggtcaaaagcgacagcaaggtagtccggacgcatttcattttgaatctgctgaagcaatttcacaaaaccgtagatagcattggtcggcacccccttggtgctggccataccgcgaatcccgtaaaacattcgaaacaaaatgctgttgccgtcgattaagattgccttcttctgtgacgccatcctctactcctattcactcaatcttatttgcgataaccgtccgggtttttcttctgccaattccaggaatcccggcacatatcttccaagttgtgcttagctgtccagccgagcacatccttcgctttgtccgcgttggcccagaactgcggcagatcgccggcccgtctcggcccaatttcgtacggaattttgacaccattggcttcttcaaaggcgtgaacaatgtccaaaacagaatagggtgtgcctgtccctaaattaaagatttccgtacccttgtgattttccgcgtattcgaccgctttgacatggccttccgccaggtcaaccacgtgaagatagtcgcggcggcaagtgccgtccggcgtgtcgtaatcgtcgccgaaaatcgtcagatgatccagcttgccgatagccacctgtgaaatataaggcattagattgttcggaatgcccttcgggtcttctccgatcatcccgctttcgtgggcaccgatcggattgaagtagcgaagcagaatcagtgtcatgtccgggttggccacaaccgcgtcctgcagaatctgttccatcatcgacttcgtccagccgtaagggttggtgcagctgcctttcggcatcgtttcaacgtaagggatcgggttttccgagccgtaaactgtcgcagacgacgagaacacgaagcggctgacgcctgtttctgccatgcattccaaaagggtcagcgtcgtatcgatgttattgcggtaatacagcaccggcttttggactgattcaccaacagccttcaagcccgcgaagtgaatcacgcagtcgatgtcattcgatttaaaaattttcatcattgcgtcccgatcctgcacatcggcttcgtaatgcacgatcggtttgcctgccagggcttcaactcgtttcaccgcttctggcgacgaattgtaataattatccacaatgacaacatcgtgtccgttttcgatcaaggacagcgccgtgtggctgccaatgtaaccggctccgccggctaaaagtatgttcatgggaacctcctcggaatctttatattcgtgaaattagattctattataactcatttattttataatgccaattgatcataggtatgcttaacgtttattcaacaaataaaagcctaattgctaaaatatagcagtcagacttttatcacttaaatattttgttccttcatatcttttatcattctgcgatatgcttcttctaatcccacttcaggttgccatcctaaagcttgaagcttgtcagaatttattttcattttcgtatcggcagcgtatccatagcgattatcgtcaggtatatcaaatacaactttgatttcattgttagcgattttgtctgcaaccatattagccatatcaacaatcctcatatgagattcaggatttgcaacattgtacgcttctccatttttccccttgagtaaaatagtaaacaatcccgtcacacaatctgaagtataacaataattgccttcagattgtcccttgctatgtagaacaatgtcctgaccattaatcgcacttcttgcaaattgcgcaaatacacgattttcgcctggtaatattcccgcaccaaaagtttgcgctaatctcgcaattttcaccggaacatcatattctgaaaaataggcttcacacatattttcacaaagacgtttactctccggataattacttcttatctttaatggatcgacataacctagatcagtttcccgaacctcatgatctaaatcgtcaaaggctccgtacatttccatagaagacacatagacaaccgattgacagtttttttcttttgccaaattcaaaacatttttggttccctcgactgaagtaaggatggtttcaaccggtttctcaatcatggtttttgacgttgtaattgaagcacaatgaaaaatataatcaacttgttctgaaatatcaatttcctgcgtcacatttccgacaacaatttttaaattatccgaactggtttgtttaaaaatatttttcgctttttcttcatttcggacaaacgcgagcaccttaatcttgccaattgttaaaagtgacctcaccaaagatacaccaatcagccctgtcgctccagtcaccagaacggtttttcccttcattttttggtaaggcagctggcaacttgccacgttttttaagtcttcagataaaactgttctctccatcaattcatcctctattaactttctaatcatccaagccatacagctgatcattttcttttatctcaagaatcgttctagccataaaaaagtcctctggtgtcgtgatcttaatgttctgatttggtccgtctatgagatgcagcttatacccgtaatattgcatcattgtacaggaatcaataaagtctttttccccttcacttaacgctttttcgtgagcattcagtatatccttcagccaaaaactttgcggtgccttggctactctcgaattatttcggcttggaatataatcaatagttgattccgattcttctaccactagaatggtttccttaaccttcgccgtcgtaattgccgaaccatattttttcactgtttctatattgtccgtgattaatttttcattaattaaaggtctaacaccatcatgaatcaaaacaatagattcttgttgaccagcaacattttctgccgcctttaacccattgtatattgaaagctgacctgtttcgccacctggaacaacctgctttacttttttgattctatactgatcaagcagctccattagataagccatccatccttcaacgcaaaccacaacaatggcatcaattaacggatgccgttcaaattgatcaatcgtatgaataataatcggtttattatacatattcaaaaactgtttaggtctgtctttactgtgcatacgacgcccaacgccgcctgcaaaaattactgcaatgttcatatcgatctattaaccccaagtattgaaaatatattatctattatttgattttatcacaggctattttaaagatgaagtgattcttttcctctgaactattaaataaattataataaatgaatgatgtaaatctttatcttaaataaagatgattaaatcccttaaaagtttaaaagataataaagagtggccaaagctcatttagtataaaatagaattctctaaattatctcatatattttatcttaaattggttaattaatgtggttgctgtttgcagcattttcggttcaaatagcacttgccgtaccatatctattgctgaaccgacgataaatacaactatcacaactaaaaaagcataaagcggaaaccatcgacttgcataaagtaaatcaactttaaaaattttatcccaaattaaacttctaaatggaccaaactcatgaataaggtatattccaaaagttgtacttgctattttatttattaattcttgagaaccaatattgatagactcaaataatttaaaagaggaaactgcacaaactggccagcaaatagatatttgtacctgggaaattaataaatattttatcctgctaaaagttgaaatatttaatgcgtttaaatatatacaatatgcatcaataacccaaaaaataataaaaaatacgataagaaatattcttctcttggattctatcttttttccaaataaccttatgaatcctccaatactataaaagaaaatagccgttgttacgtaataataaggcgtacctaaagatcctattgagtaccatattatccaaaatattactaaaaaaataaagtagccttcctttgtaaaacgattcaaaagtttattaaaaaaaggtaataacaaaataagcatcacataagctgaaataaaccaccatacaccacctgtagcaggattaaatacagctaacattatgggaattaatatcgaatttactttactttccggcataggaagtacaccaacataaagaagaattatatagataattgaattaattaacccataaaatgctccttcaaggactatttttttcagcgaaaacgaacgtttgttaatcaaaaaatatcctgtaagcatgaaaaaaattccaacgccaatcttacctcctggagcgaataagcaatccactattttatttaacaaacttccatttctccatatcacataagctgtacttccctcaagatcatgttgaattccatggccagcaaaatgatgcgcaataatcattatcattgcaatgactcttaataattcaaaattagattttcttgtcctaactttagctgcatgttgcatcaaagcctcacttaattacttgttttttacatcaataagcccttttgcaaattattgcaaaagggcttaaattcaatctttgtttatcttaattagaaattcgaatacgctttattcatatcaatactgcctgacaaccccggcacgcttccctggtcactgtactgccaaatatcaatatgattactgtactgcggtttcgaagaactattccacgaatacggatactgtgcataccaaatcttataatctttaatcatactgtaatctaaatggttgttaagccaattttgatttgcataaatcatcggcgtgtatcctgcttttttcacttcttcacagaaggcgatagcgtttttcgactgctgtgttttactcaaataagagattcgatcgtcctccaaatcgatacatatcggcatctttaggcttctaccatttaacaagctgatagcgtaatccgcttcttgacgtgcttcattttcatcatctgcgtagctgtatacataaacaccaaatggcatgcctgctgctgtcgcgtttgtgtaattgttattgaactgcttatccatcgcgccatttcctgcatgtccccaagcaatacgcagcattgcaaaggaataccctgcatttttcgctttacgccagttatctgtgctaatgtaaccctgccattcagatacgtcgatacctaaattgcctgtcttaactgaactcagcgacacatagggttgatccgtgcttcccggcgcggcggcagtcttcggtaaaacacaaatctgaacagcttctgcccgcaatccaccgtttaatgttccggcccatacaccattttttgtccagccgagccaaccatatttttcactatggacacgataccaaacattcattgtactcgaggcattcccttgcagcttaatctgaaccgcttctatccgcttgccttggcccgttgtacctgaataagtatcagatttactgctgtcggtccaattcgattctgtccctttatcctgaacataggcacgatacaatatagatgaatcgcccgatgctgtgtcggataacttaatttgcagtgcctccattcgaagagaccgtccagttgtgcctgaagtttgcctcgaagatgtccaactctgccatccaatatcttggacatgactccgataagatatcgtataattttttgttaaatagtccgaagaaagctccgctgcactaattttccccagctgttgtggtgccgcatctccttttggaaccagtttaattacaatcgcttcgatccttaaactatacccctggctcccagcggtctcaccgtttttcgcccagccaagccaaccataattttgtatgtgaaccgcataataaatatcatattgttcgctgattgaactgtctaatttgatctggattgcttcgagacgtttggattgccctgtcgtaccggaagtctgattgttattacgccagcttgtccaacctttatcttgaatatgcgttctgtacgaaatacttgtggttgtattttttaaattatctgcggtaagattgatttttaaagcttctaaccgaagggattttccagtcgctcctgcaaccgtgccatctttaactgtttttgaccatcctgtattttgttgatgtacactgtattgaatatgcggattttggaggtccgaagcgttatagctgctcttcgatactttgcctaaagcgttcggtgctgttactcctttgttgacaatcacgacttcaatagcctctacccgcttggacagcccaaccgttccagagatttctccatttttagcccagtttagccaaccataatcttgaacatacgctgtgtaatatatatcatatttacttgagtcatttccagttaaacttatttttaatgcctccagacgtttactttgtccagttgtgccagctaatgcgccagttgatttggtatcttgccaacctaaatcctgaacatgtgctgaataagaaattcccaaattagactgacttgttttcaaagagataccttctaatcgcaaattctgtccgatagttcctgcaacctgcccgccattaaccgctttcaaagttcctttgttttgcacgtgggcctgaacctgcaaagacgtatttgctgaactagaatacgttgtttgtgttccaatttttatcgtaaacttttgggctgacgagctgctgttttgataaagatcgacatttgctccgtttgtagccgtaccgccctccacattcataaccttgtcatctgaacatgccggctgaagtgtatacgttccgtctgattctaaatttaatttccatttttgagcagacgacccattatcgtcgtaaacttgaatattcgtaccgtttttatcggctgcattattcacgtctaaggccttctggactcctttgtttaaaatcttatactggccatttccaatcgggataaactcccaaaattggtccgcgctgtaagtattattttcaaggataattacattgttaacatctctcgaaactgccttatctccaattaatatctgcgccgtaaagctgtcctgtggcaagcttgaagctgcgtggacagttccagttgaaaacacgaagaaaaaaacagctaaacaaaaaatcattcctatcaataaattgcgagatatacgctttaaaccactcatgtaaccatcctttcaagtaagttaaatctattatttcatttttaattatacttaaaatatttttttaagtaaagccacttctcaattcttaatttggtttttcgcttttttcttgaaaaataagatgagcacatttagaataaaagtattacagtaaattttaagggagcgaacatgaaaaaatacatatattcactttatataaaatataaagaaattatcaattatttaattgttggcgttttaacaacgattattagtttagccgtttattatctttgcactattacttttttaaacccaaaaaatgcatttcaattacagcttgcaaacgtcatttcatggatcgtctctgtgacttttgcctattttacaaaccgtaaatacgtttttgaaagcaaaaatccgcatatttttaaagaagcttctgctttcttcttagcaagagtcggaacgttgctcatggatatgggaatcatgtttttatgtgtgaccttaatgggcatgaatgataaaattgccaagttgatttctcaagttgtggtcattatcagcaactacattttcagtaaactgtttgtctttaaaaaagggcaaaatgaaaaataacaattttttatattaaactattttagaaaaatttgttaagaataaaattaatatggtgtatagaaaggcaaaataattaatggaaaaaaatataaaacaatcctctaaattaataattatcaagatcgtaaaagatcattggaaagaattaattgctgctgtgatctttgcatttattctttattcagttatgatcacgaatgaattaaccaatacatatgatggtatgtggaaaggtgtttacggatatgctggtgcttgggaactatcaataggaagatggttttggctcacacttgatcgagtacgtttaggtgtaacaactgaaccaggaatcagcctgctctctcttttgattttttctgtcggaaatataattgttgctgatctacttcaaattcagggaaaattatccaaaatcattttccatacatttatgctggcaaatacagctgtttgtatttttctttcataccggtacatgactttgacattcgccttttcatatttattgagtgtattaggcgctcttgcgatcatttcaatgtatcaatacaattgcaataaaatagtatactcaattttagctgttgtatttatcacactatctttaggactttatcaagccaatattggatgtacttttgttatgcttctagtcgttttgattaaaaatttatggattaatcaaaataactctatcaagcattatataaagataatgatccacgctattttattaattggatgtgcttgtattgcttatgccggaatttggaatctatgtctttctctgatgcatgttgaaaagggcaattatcatggtgctggctcagttagcgttttttcaatcctctccaaattaccaaaaacgattcatctaacatacacttctttttgtgcgtattttttgcccggacagtggcaaaatatatatcaagctcattacattttttccgcagcagtttttattttgttcattatcattatcatttactcgattttcaatagaacaaaatggtcttacaaaattctttcattaattagtattattttattaccgttattagcaaacacttgtttactgcttgcaccagaatcaggcagtatgcaattgcaaatgacaatgccaatggccatgattattcccggaattttcggattaattagttctatcgataaaaaagatcataatctcaaacttgccacgccagtttctatcatttattttatgtttgttatatttattgcttttggaaatattatgatggtctcaacagatcaacatgttatgctgcagtcaaaaaataacagcattactttaatgaaccgtatcataacaaatacttcggaagagttaaatgccgcaaatgaaaataatatgccagtaatttttgcaggtacccccgcaaatagtccactttaccaaaaagatttattttgggataaatcaaatcactttgcacactacggcgaattttggataggcggtaattgtgtaactcaaagctattatggttttctacgagattgtggcataaatattaatttactcactgatgatcaaaaatatcatcaaattactgattctaaagaagttcaaaaaatgccaatgtatcctcgaaatggttatgtaaaagaaattgatggatgtttagttattaaaatttcacaataatataaatcataaccaccggctcagccggtggtttgtgttagccctataagggcctgttaccgaccaacatcttaagatgttcgaaatagttcgctttccgctccacttctttcttctgtaactcttttcccgactaaccctaaagggttactttattttcttcccactaatggatctatatattcttttatattatttgatcctctgctattttctttgtattcttccaactgtatccacatagtatccgcgacaccaaaatgcctatttccatatttatatttcagattcgcatatttatcaaagatcacaacgcacttttcccttttaaatatccgactatcggcgatactgaatattgggtggtatgtgaacaacatatggatgtgatctggacaacattctgcttctattatttcattcctttcctttggcataacagcctgagaatctttcctatatctctttttatttttccgtagattactcttcgtctaatttcggtgcaaacactatatgatacttacaattccattttgtatgtgctaaactatctttatcatttttcataatgatttaacctcctttatgaaatgttcggttggcgaaccgccatctttttagcataggaggttttttgcttgaagctgaagctttagtaaactcaccggcctagccggtggttctttgattctcctcgtttctctcgtcgaatccttcgctaaagctaaacaaaataaggacttctatgaaataaatacattaatagaagtccttttaataaaagagaatattaaattaatttaatcaattattttttccaattatctgtagattttgaaataatatatcgtggtctatgcttcgattccatatacgttttacctacgtactggccaattacaccgaggctcagcaactgaatgccgcctaaaaaacaaacaatacacactaacgaagcccatccgctcacagtcacccccatcaatccccttactattgcccaaataatgcctgcaaaacccaacagactcacaaatattccaatatttgtaataatttgaatcggcttgattgacaaacttgtaatgccatcaacggctagacctaccatttttcttagaggataatgactttctcccgcaattcgctcattgcgcttgtaatacaccgatgtgcttttaaaacctaccaatgggaacatcccccgaagaaacaaattaacttctttaaattcagaaaaagcctgcaatacttttgaagaaacaaggcgataatccgcatgattgtaaactacttccgcacccattttattgagaaacttgtaaaatccttgcgctgttgtgcgcttaaaccaagtatctgtatcacgattatctcgaacgccataaacaatatcagaaccggataggtactcgtcaaccattgcttccatagcgcctatatcatcctgaccatcgcaatcaatcgaaatggtaatgtcacattggtcttttgattccaacaaacccgctaatacagcattttgatgtccgcgatttcggctttggctgattcctgaaaaatgttgattttgttttgatagatcttctatgatattccatgtcatatctcggcttccatcattaacaaataatatttgactatcttctctaattttatttttagcaattaaatctaataattcattcaaaaacattttagatgtaattggcaaaactttttcttcattatagcatggcacaacaacaactaatcttggaatcttattctcgatcacttttactcctttttatattaatttttcaatttagatatattattttcaatcatatatcttttttcacctcaattattatttttacatacttcgatcgtaaagaagtgataactcctgaagtcgccaaattaatttttagattacgactccaaagaattatacttaattcaatagaatgaaaacagagaaaaattaacgaatatctccccaaataataaatagagatttcgtcagtatttttgctacatatataacaatgtaatttcctatgtaaactccagctatcattgcaaaagaattgataaaattctgtccttccaatctctattaaaaatccctacaaaacactttttgataagatccaaataataaataacagcaaaaattttctgtcaggaaatatactcaaaattttgtattttcgacacaaagccaatctgaagaaaaatcgttatatacgaagcataatggaaaaaatccaaaataattacgcgaccaaattaccaaacaaaaagaaaatatccatttttaataaaactctgcaaagaaagagccattacaaatcaaattggaccaataaatgaaatttcaaaataacactcttatcttaaactgacaaaaaacatcacaaatagtggttgtttcaaataaaatagtgaaaagatggttcgctatttcaaaccctttgataaaaaagaccaaatatattcttacaatttcaagcaacaataaaagtagcttttcgaaaaaacaaaccatctaaaccctattttttagtaacgggctttatttaatagactttgatttttaccattattattcgaatttaaaagtatcctttagcccgagccatttctgatccttatcggataagttcaacggtgtgccgtcttcaagggtgtagccttccgcgctgcagctgccctggtattcaccgacgacctgcggccatttgatgccgatttccggatcgttccacgccatgccgccttcatcgttggggtgccagaagtcgttgaccttgtagcagaattcggcggtgtcagacagcacgaggaaaccatgggcgaagccttctggaatcaagaactgcttcttattttcttcagagagttcgacgccgtaccatttgccgtaggttttagagtctgagcgaagatcaaccgcgacatcaaacaccgtgcctttgatcgcgcggaccagcttgcattgcggataatgcttctggaaatgcagaccgcgcagcaccccttttgtggacatagactgattgtcctgaacgaagttgatatccagcccggcttctttcatgtcgttttgattgtaggtttccataaaataaccgcgattgtccccatgaaccgccggcagaatcacgcacaatccttcgatgccgccgacatttttttcgacttgaatctgtcccattctttctctccttttcagctttatttattaactttcaacacttttaaataacggctcaaggcgtctgtccatgtgggcagcggctcaaggccgttttccgtcagcttcgatttgtccaaccggctgttaaacggccgtttcgccttggacaggccgtattcctcggtggtgaccggcgtcacttttgtggtgtacccagcttggcgataaatttccttagtaaaatcataccaagagatatatcccgttttcgtcccgcagccgttgtcctgttccagctcgctgttcgtcgcatgatacgtgccgtattgttccgtttcgatcatgtcgacaagcagcttcgctaaatcgtaagtgtaagttggtgtcccaatctggtcattcaccactctcacttcatcgtgggttttcccaacattcagcatggttttgatgaagttgctgccgttgatcccaaagacccaagcgattctaacgataaaatattttgttaaatatttacgaacggcttcttcgcctgcaagcttggttttcccataaacattgagcggtttataatccgtttgatcaggctgccaaggtgtatccccttgaccatcaaagacgtagtcggtgcttaaatataccattttagcgtcaatggctgcgcaggctttggcgatgttttctgtccccttgacgttgaccgctttgactttttcttgattttcttcatcctccgctgcgtcaactgcggtccaagcggcacagtgaaccaccacatcgggatgaatggtttttaaggtttgcgcgacctgcgctgcgttggtaatatcaaggctcacgtagggcatacgtgtaaccggactgtcgtcagcgattccctgatacgtttgtgccaaatctgagccaatcccttcatagccgcgtttgtaaagctcattcatcacgtcgtggccgagctgacccgcaacacctgtaacaaaaactttcaatttctcctcacttctcttatttgcgaaatatttcgatacagtcttttatatattcatttttaaaatcataatgatccaaatattttttataagaacctactgcaaatatctgacttttatttttgtcttttatacttcgaattcttttttctaaaaatttaacgtaatctacaatatcaagtttatatgatttttttatttgaaattgattaacaaaagccctcaatacgtctaatcttctttgatatttatttaagtcgtttttatattttacttgtaaatcttgtattgttcttcgcagtttatttaaccgagaagttggcaatcctccaatttcattatggccttgtcgatatttcattaacactttgggaattggatatatttctccaagcgtaagtgccgtgagagctaaccattcatcatgatatgatttttcaaaaaaaggcctactttttgtaaaaacaattttttttattgcacaagcacttccttgtacaacattgccaagatataattttttataattgtgctttaaaaaggtggtgtaattaaattttaatgtgtctttccaaaaagatgaatacatcatattcaaatcttgatcaaccaattcagaatcatgaaaaaccatcactgactcaggatgtttttcaaaagtttgaatcataatatcaatcttatgtttgtcccaaacatcatcctggtcacttaagaaaataacgtccccatgacataatccaattgctttttcaaaatttttaacaaatcctaaatttttttcattttgaataagggaatattttcctccccaattatttaacagcgttttggcaagttctttagtatcatctttcgaacaatcatcacagattacaatctcatcaggctgtcgcgtttgccgaaaaatgctatccagttgttctgataagtacttacttccattatatgtacacatagcaactgagatcgtatttactttattatctgtttccatacatcttttgataataattctgataatcgccgtcgataatcggctgccaccaatcttcgtgattcaaataccaatcgatggtctttttgatgccatcggcaaactttgtttccggcagccagcccaattcgttgtggatcttggtcggatcgatggcgtaacgccgatcgtgtccctttcggtcggtgacgtgttcgataaggctttcgggtttacccaatgcctgacagattaatttgacgatatcgatattggccatttcgttgtgacctccgacgttgtatacttcgccaaccgtgcccttgtggatgatcaaatcgatcgcgcggcagtgatcttccacgtagagccaatcccgcacgtttttcccgtcgccgtaaaccggcagcttttcgtcgtgcagcgcgttgatgatcatcagcggaatgagtttttccggaaagtgatacggcccgtaattattagagcatctagaaattgtcacaggcagaccgtaggtgcggtgataggccagcacgagcagatcggctgaggctttggatgatgaatagggacttgaggtgtgaatcggcgtttcttccgtgaagagtaaatctgggcggtcgagaggcagatcgccatagacttcgtcggttgaaacctggtgatagcgtgtaatgccgtatttccggcaggcatccatcagaacggaggtgccgagaatgttggtctttaagaaaattgaagggtcttcaatggagcggtcaacgtgggattccgcggcgaaattgaccacaacgtccggtttttcagtttcgaacagattgtagacggcgtcccggtcgcagatatcggctttaacaaatttaaagttcggcgcgtcgaggatatcttttaaagtgggcaaattccccgcgtaggttaatttatccagacagatgatcgtgtcttccggatgggccttgcgccaatgaaaaataaaattactgccgataaaaccggcgccgcctgttacaatgagtttcatatcttctccttaatattttacatgaccgtctgcaacgcttcttaaatgggcgccgtaggggctctttccgtatttttctgccgcttcgcgcagctgcttctgatcaatccactggttgatgtaggcaatttcttctggcgccgaaatggcaattccctgccgcttttcaatggtgcgaacgaaatcagctgcgtcgacgagactgtccatggtccccgtatcgagccaggcaaagcctcggccaagaagtttgacatttaagacgtcttctttgagatacatttcattgagtgttgtaatttcgagttcgcctcgatcggacggctgaacagctttagcctttgcgctgacgccggccgggtagaaatatagtccggtaaccgcgtagttggatttcggtgcggccggtttttcttcgatggataagactttgccgtttttgtcgaaatcgacgacgccaaagcgttcgggatcggacacgtaatagccaaagaccgtggatttcccagattccgcgtccattacggcagagcgcaggatcgtgccgaagccgttgccatagaaaatgttgtcccccaggaccattgcgcacgggtcgtcctcgatgaaatcttcgccgatgatgaaagcctgcgccaaaccgtccggagaaggctgtaccttataagacagttcgatgccaaactgagagccatctccaagcagtgcttcaaaccgcggcgtatcttccggtgtcgagatgatcagaatgtcgcggatgcccgccagcatcagcgtcgacagcgggtaaaaaatcatcggtttatcgtaaaccggcaggagctgtttggacgtcacggtcgtaagcgggtagagccgcgtgcctgagccgcctgctaaaattattcctttcacttttctctcctttaagaatgtgctttcattgtattaatagtatatacagaaaataaccacttttcaagtcggttagctataaacgcaaaaagggcatagtagttatgccctaacaatagtgaattataattgctttaaataaagccgcttcaactgatcttcaacttgaagatcaacccttgtcatcacggccccaacgactttagcacctgcattttttaaattacgcaccgtctgcttcacttcatcctgagctgaagcgtattgtctgacacacagtaacacgccgtcaacatattttgacatcaaaagtgtatcggaaacactagccggcgctgtatcgacaataacccaatcgtaagactttctaatcgtttcaaagaaagaatgaagtaaatctgacaataaatcatctgatgtcaattgatggatagtcccactcgttacgacatcaagattattgtaatttactgcttgagtaattaatgagtccaattcaattgtattttttatataatcagaaaatcctttttgatcaccttttagtttcagtctttttgcaatgacaccgttccgcaaattaccatcaaccaagagtactttttgtccagcctgttttaaactaatagccaaattgactgccgttgttgttttactttcccctgcgacagcagatgtaatcataagggtttttaacctttctttttgctgcagattcagcatattggaacgaagtgcgcgataagcttcttttgttatttcagaatgagtttcagtcagtaaaatatgatcgttctgatctttttgtttcccggctattaaaaaattcacgactgcctatcctttcttttgcgatccgctttctctgcactttcctcacttggaatgattccatatactggcaggtcgagcgcatcttcaatatcaatgctgcgtttgaatgatccatcatacaaccaagaaaacaaaataaccaaaattggaataagtaagccaacaactccccaaattatcgttatcactttataatgtggcgctgtttgtactgtcgatacttgattatggccaaaagatttaacagattccaccccattaagttttaacaattccggcttcaattttttggataaataaataactgcctttttacattgctgctcatcgttaccaccaactgttaaccaataagtatgagatgtcgatttgtctacatctgcttcatccgcattaatagaaacgttatcgattaattgattggtcgacatggttaaattaagagacttttttactttgtttaataatcgattatctcttaatatttcctgatacacgtccttctcacttgaggtagattttgaagtttttgtcgtcactactaaagaagttgtcgctgtgaaagattttttcataacaaaatgggataatccatatccaattcccgtgcaaatcactgtaacaataagaataaaaataatattatcttttaataatcggcctaaatcttttaaataaatttttgaattcaatttttattttccttttttaagattataaaattgttgattttttgctattcttttcacaacagttacgatcttaaattcgaataatatatttttcattaattaattatcatctaattattacattcattatttaattcagtcaaagctaaatttaatgcttttttcgtgtaataactatttctcaatctcttccctacttcaacagctgctttttttaattttttatactcttcgggtgttatcaaatttaatgtattattcaaatttcgcaatgaatcaatagttataccgcaattattttttttgacgaaccttgcaacagctgctttatcccatactatcacaggaattccacacgccaaatataacgacgttttatgaggattgtttattttcaaataattaccattaggtccctcacacttatcaatagaactgccatcccaaaccaatccataacttccttctaatatgaatggcaattcatcaggcggaaacgaaccaaaataatggacattttgtttttggtgatctccaccttgatacccaggaccatataaattaaattcgcaatctttaggaagatcgtatgcatatcctgctttaattttgcttaaggaactagctacaattatgggcttattgcaatcaattttttgtggatcataatattgatcaaagttaggaattaaataatcgaaaatatttaaatcaatcatattagatgtatcaaatcccataaattttagttgtttcctcatattttcgttatgaacaataatctgatcagcaaatcttaatgtttttatatcttcttctttaataacataacgtttaatcttttttattggtgtatctgctgtgtatctaaatgagtccagatcatgtacaagaacgataattttcgttcctctcttctttatccacttgataattttacttggagtgaaaagtcttcctagaaaaggtaattgaataaatattatgtcatttttcccaacttgcctagaaataggtttccaagctttttctatttttattttgttaaaaattttgtcaaaaaaattttctttatgattatacttgccatttatagtcacatttaaatcgataggtttaaacccctctgattttaatattttttccacgtcctctcttgctttaggacctgcattattctcaccaatttgatgttcacaaatataatatctcacttttttaatctccaattcttatccatttattttatattttatccttttatataatattttaagtttagataaaacaaactgcgtaggccatcttccatacacagtgtaaatcattttataatcttttcgatataatctaattaatcttcctattgttgaaaaataatttgaattaaatgaatttccatctgaaagatgccatatattttttataggtaatactaaaacgtcaaacccgttcttcatgcatttacatgaataatctgttgcatataaatgccaagtttcgcctaaatcactaaattgaaataatttaaagacatcgtttggaataataaacatgcattcatccaagctaaatactttttgaggtttgttataatgatgtattgtgagctccgtaccagcagcagtatgatctttcccgtccttaatttgtgttattaaccgatttctattgctgattacagttactcctgctaccccagcaataccaaattgataatgatcgcaataaaattttattttttctaatatatcttctgtttcaaaaatgatatcttgatgtaaaaaaatcaaataatcgccttttgcctgctgtcctccataatttagtgtctccgaagctgaagaaaaatgatgttccttagcattgacaaatatcgtttcatactctgcatttttctgtctttttaaagatctaacaacgcaatcttccaacatttttttgttattatatgcgcatataattgaaaacattttttctcctaaatatcatcagatattataaataatttttttgtttcttcaagactaaaataaggatatgactaatattttcaatcctttttcctaaatttattctatgtcttttaaaaaaattaatggtctgaagaccaccatcacttattattttttttattgattcaacgaaactattttgtgtacgagttagtttttgggcttgtaacaacttaattgtatataaagaaattctatagatatatgcatgatctttagctaattttcttaaactaattgcacgttcaataactctttttattccaggcttgtacacacgctcgcttgttacatttccaccatatcttctatatcccatcagactagctggataatagacaatgcttcccaaagtagcagcaaattttgcgtataaattatcgtgtgaaagatttttcgtaataggattcgaaatgtcaatctctggaacagagaaaaagcaagattggttcataatcaaattacacccaaaaactttatgtgtaaaaaaaacagcatatttattaagattgccattgttataaactgaatccatactattacatgttactttatcatcagcatcaataattctcatgtctgcatacgtcaatattggctcattgtcgatttctttttttttcgtaaactcaataaatcttgatattttgtctgtatcccataagtcatcttgatccgagaacatataataatcatagtgttccatatttttacatttatttgctaataaatgaaaattaataaaaggaccatggaattccgtgtcgttatgatatagctttatccgaccgtcttgttgacaaaatttttgtattatgtcaattgtcccgtcttcagaaccatcatcttgaataatgagtgtccaattttcaaaatcttgtctgatgattgattctatttgattcttaataaacctttcgccattaaatgttgtcatcattattaaaacagaaatactcgatttagccattattattttcctagcaattggacacttttttccagcgcattccgatcaaacttcataaccacgtgcttttcccgtttctcaataggtggaacttgcatgaaattcctgccatataaattttctaaatatttcgaataatttttcgcaattttcaccttgcgtccttcaaattctgcttcctgagtctttaagtcttctctaagatacgtttccttattaatttgcttcctaccagacgcaattccaacatattttgaattttcatctttgcaacttgaacaccatttttcaattttcttttcccacgaagaaacggttttgaaagataataatcgacctagtcttattctttttcgaatgattttcaaaaattcattattaccttttgccatctttaataattcatttttgctgtttttaaatctcaaacatgacaaaatatatcttccaagcatacatctagcttgaaataattttctgatcaatttattatctggttcattttctataataaatatatcgatagcaaaaccacattctccatcgtatgctgaatcaagaagttctttaacatatacctgtttagaaataattttgatcattaaaaaatcatagttttcagtttcaccaggtatgtgaagccaatatttattcccatatttctttttaaattcaattaaaaatttattcacatcgctacggtacatattaatatcaatatcatcatcccagggaataaaaccgtgatgtctaacagctccaagcgcacttccaccacccatttgatatctaatatggtgagtattacaaatatcaaggatatcatcgaaaacacttaaaagcaacttttggatcattttaatgtcttgatctgacaattcaacaacttgatcacttgtattattcacagactttattaattctgccagttgtgccaatttttcctccaacctctacacattgaaaagatcatcaacaatctctgcaaaatctttacagaattgcttattatgtgacatcatattaatcggcattttttttacaatattatcataatcttcaattaccgattttaattttttaatatcctcaatcacaataatgttttggtaacttttttttactgcctctgaaaattctaattggtggttattaatatgttcgttgtactttttctgtctcggaacaacaattggtatttttccgtactgcagcggtaaaataaagctggatggcccaccgtgtgtaatcgttattctagacttttgcacattttcaaccatttgtgaatatggaataaattgactccattcacaatacttcggttgaaatgtcgaataacctgtctgaataaacacttcttctgtaatcactttttctttagctaaatgatccacatactttatcaatcgatcaaatggttgctcgtgagttcctactgtgacaaatatcatataaataatccttctgctattttgcaactcaaaaaatacttcccagattaatggcctttggataaacttttttcatttcttcccattcaacaataaaacgatctgtaacaggataaaccattttccctgttaatgtcggcttatcaattctatcaaatacttctatataaactgttttgcatccaaacatttttcctaaataaaaaaacggaacagcaaccgcagcgcctgacgaaataatgagatcaggcttttctttccgaagaactttccaagcgatccgaagattaataaaaaaggcttttatgctcctattcgttggataataacaaggatacattttttcatcctttaataaacttttcgcatcttccttatcaaaggtaacccaaaaacgttccttatctttccagaaaggttttagcatataaagatgtgttaaatggcctcctgaagatccaactaaacagactttcatattttcttcctcttgcttcactttgttctctgatattaaaaaatagacgcaaacgatccaaaacgtattgtaatacggtaataaaatcaaatcatccactaccgcatgagttgccaaaacagctaatattattactaaataatattttttttgtgataacattttatatgttacgactgtcaacaaaataattaatatgaggcttaatactacaccatattcctgaaagaaacgaacatagaggcaatctaaataaaaatatttacttcttccccgcacaccagttccacttagcccatttcctctcatcggtatgatttgaccaaaaagactgagtccgtaacgttgatatgaaatacgcccaaaactcaaacgattgcctaatgatgtatttatttttgccatccatgaaatatccgaatgatagctaaaggataatacaatactaataagaccacaaagaataaagatccacggtaatccttttgaaattccaataaatattttttttaataattgtgggaaactttgacgatatctaacaattgcagcacccaaaattaataatacgtttcctataaaattgagtctcgtatcacataatctataaaaaacatatccaatgataagacaaatcatcaattctatccatttgattttgtcttttcttaaataaatatagagtgcctctatattaaacaaaatggtcgttggaaaaagacaatataaaaatccaagataatgtcgtgttactccaagatgtgttgttttgtccaaataatcagggatgattcctgcagcactgcttaatgtaataaataaaaagcaagcggtactgattattaatgaaattttagcaattttttcaaatttgatgtgacgggcaccaaatgcaaacaatacaatccacagaagcggacgccaccagacattaccagctacaataaatgtcactatcataataaacgcaatgaaagcaataccaagaatatcaaagcgtctatattcaaaattggtcagctctgcgatcactaataaaacaaaacaaagtttcatgatataaagcccaaagctactgacggaattttgataaaaggatatactcaaaatagaataaaccataaataatccaagggacaatagataaaaaaatgctcttaaatcgatatccggagaatttatttttattggtatggatacattactctcttgattcatcatataccattgctctttcaatttaacctgctgcgctttaacttgttactaagcgtcgcaataatttcctgcatcatgggttcttttgttatgaccaagaacagagcgtaaattcccatgaatagtatagctgaaataactagaataataaaagcgtgaacgcccattctttttgtccacaaagaggcaagtgacgccaagaccaatgctgcaagtacttttccatatggcaattttctaaaaataggggtcacttcttttcgaagtacatggtattgcaccaccaatacaacaaattccgctgccaaagtaccaatcgaagctcccgttgatgccaatcgcggaattaaaaaccaattgattgtaaaatctgttatcgctcctgctatttctgaatagagcacatatttttcttttccgagtggaacgagaatctgcattcccaatatatttgtcaagccaataaatataatcgtcggctgaatccactgcatcggcagaacggcgccaccataagcgggacctgacagaaagcgaataccttctttagcaaacaatatgaagtacaaagctaaaggacaagcaataaccaatacaaaattcaaagctttcttagaaattcttcgcaaattactaaaatcaccctgttcgacataataggacgctctcggtaaaagaactgcacccaaagaagttacaatactaactaaaataccttttattttcactgccgcattataatatccgacatccgtatccgtcttcataaaaccaagcatcacggtgtctagatttgtataaactgtcgtcgcaatagacatcgcgaaaaaaaccaaaaccggttttaaatgacgcttcaagcgatatccgccgaccggatgtatatagatgtgtttgcgtgcattgataaagttcaagacgttggatgctgatgctgcaaagatcgaaatgcctccatagacgacatagtcgcttttctgatgaataaacgcaaacatcgcaaccaacgcaatcgctttaaaaataattgatctgaccgtaatatacgtgtattcttctaagccttgatacagccaatcgatccctacacatgtaaagatgatattaagtgaaacgaccaaataaagtgttcggtcgccttgaagcctcggaacaaaagccaaagccaaaaataaaattgcataagcaacgccgctcatgatcaggttgataaagaacagctcatgtgtcacacgagttaattccattttgtcatctcgtgcctgcgcgcagcggcgaataccataggttggaatgcccaattgcgcaaacattgtaaaatagctgatgagcgacgtcgcaaatgagactttccctgttccgactggcagtaaaattctagatacatacggaaacgtgataaggggaaatataaattgcgacatcgttaagatggcattcatgatgaaattttttttgatcgatttttgttttggcatatataaatttcctgatttattttagactagtctattaatttttacttttttattggtacaatctcttgtatttttttgaagtttttctatcttgaagcgtatcgtaatgtgaaaaaattgtacctatcaaattggcacctgctaagtgaagttcgtggatcgctgtgcttatttcatcagcagttgaaccaccttgtttcacaaccaataaggtgccatcaatttctttggctagaagagctgtttctgcatacgcgttcacgacagatgacaaaagaataattagatcgtatttatcttttaattgttcgatacttgccgctatctttcgcgccgaaacttctttaccgtggccatagggcaatacatccatttgattttcgtctaaatgaatgatcggcaaatcttcattagtaccggcgtagtcactaattcctggtacgtccacatctatttttaagcgctggttaaaacgattattgtgaccatctacgttcactaataatacgtttttaccttctttagcgaaagtaatgcctaaattaatagctgatgttgttttcccttctccgccaatagccgaagtaatcaatatgctcgataaatgctgctcaccgataagatgttcgatatttgcacataacgtccgataagcatcagaaaaaatctgtgagcgattattcaataggatgctcttatcttcgggcgcatcctgattagttctgaatttaaagaaacccattattttgttgttcctttctgcttttctaccgtttctaccagatgaacatttggaatcacacctaaaaccggaatacctgtttcatgcgataaaacttggtctgaataataggtcgtgttcgaaatttctctaatcaatatatacaaaatagatagcagtagtcccaatatcgcaaatgcagcgctgtacttcatcccagatggcgccgtggtgctggaaactcgtactggagaaatctgaacagaatctacagcatttaagtttgcaggcagcacgtgaattgcggacttttcaattttcaataaggcattttttgttattttagaacgatcacctttaatagaaagatgaaggacatgtgaataacccgatgactgatcgtctctactacctctaacctgtagattttgtaaaacctcttttttattgtttaatttacccaaagcaggattcatgatgtgaccattggtgagtatcgcctcaaccatatcggcctgagaatctgcagaaatgccaggctgatcaataccattcggagaatttacaataatactagcacttgctgtataagtcgttgttctccgataacgtgaaattccaaaaccgatacagccaaaaacgagcataacaattaaaattggaataagattacagaacaacaaggttttaaaaattcgaatatccagtcccgtgctgcgctgtaaatttgttttttcattctttaccatttcgtccacaatatttctccatacattgatcaaaataaattattaaattatatatgtaatgccaataaataattccatctatttattctgtgcattatcctaattttttctatactttatattcgaaaaaatcacaagtggaaatgggttaaaagctaaattcattaatctcggttccacaagcgagaaaaacaagatgattaaatatattgccaacaaatacgaatcgtgatcttttatagattcataaattccatatgtataaatgccggcaacaacaatgacaaacaaaagcccatattccaacgcaatctgcagataagatgaatcgacataattatacagatgaatttcattcagtgacggtttgtttatatcaaaaccaacccatttgatctgctgtccaaacaaggtaaaaccatatctttgaatggcatcataccctaattggagccgattcgatacgattttgttgattccctttaaaaaaggattcgcaggtgtgtaatatttcgcactcaatatagccaatagacaaaacaaaatcggtgccagcagccatattttttccctttttaaatgttttgtatcttccgaatttttgtgtcgagttccttttagagcaaaatacaataagaacagactggataaagcaaaggacatccttgaatttgttaatacaaaaagaacaatattgattatctctaaaataaatgcttggatgaaattgaatttttctttttttaagaaaatataccctagcaaaaaatagaaatacagaatcgctcccgttgtcgtccacgaaaatccgagaccatgtcggagacgcccagtttcttttccaaaaacataatcctcaagaatgccaatctgactcaagccaatcaccacagcaagcgcaatgccctgaatccaaactgttaatttaataatttttttactttctacctgcaccgctgccaataaaattatgaagtataacagcattgtacgatttgtagaagcaatacagctgattgcaaaaacaaataaaacatacagaatcagagcaagagaacgtttcttgataatctgagtagaataaaaaatcttgagtccaaataccaaataggcaaaataccgaatttcttttgtcaagagcactaatgcattctgatgtgtcaaaaaaagcgcagtctgttcaaataacaccgatcccagaaacagaatccatgcaaaataaaatagtacatcttgtctctttaaataatatttgtgctccagcatcttttattatttatccttacccgcttttatcaaagagctgcacttaaaaacaatttgattagttattcgtctgcgcaagaaaacacactcttgtctaaaactagattcagtatttaccaccgacagatgtctaattttcaaatgatggtgcagaacccaaacattgagcagccgctctcccagaaacccgtacaagcggcttcgatatggatctaactttgaaaggtcaacatatttttccaattcaaacaaaattgaaaacaaccactcgcaataagaatcaaataaactgccttttgcaaacaacatgttaaacaaagtcgattggttatttttaaaaaattgatcaaaatttgataaataatttggatacagatttgaaataacctgtctcaacttttcaaaaatctccggcgtgcagcagctaataagaatttcttctcttgcatcttgtttgaaatattcaatatatggcaggacaatatcgcaattatctagaaatgtcagcatttgatcgtacggataaatcgcacttggtgaatgtaaaaaattgctctttccaaaataccgcctgtaatggaccaatcctttataaggatcatttgtatttttccaaatccagtagagtcctgtcagctcgcaaaaatttggatttttttgtgaaatgtgatcaccgctattgtcctttagatagcctaaatctaattctggatgcgtggatgccccaacttgtaaaggacgatatccttccagttcaggcgggttaaaagctttgtgtgtcgcaatataaatcaaagattggctcctctgtacagctctaaaaattgattcacggtataacgaatatcgtaacccgcctcgtacaagcgttgataattgtcttttcttggaaggtgatgcgcttttaaaagggcatccgcccaaagtgcctctgcattctccgcaatcggcaaaaatctaacttcttctgtcagctttgcttctttcgtaatgcaatccgaaaaaaggaccggcagtccggcagcctgtgcctcgacaccaacaattggaaggccttcaaaatgggatggaagcacaaaaacatccatcgcttgaagcagctgctccacatgtgaactcgccccataaaaaattacactatcctgtaaattgagatcgcgaacaagcgtctctatctcactttttaaatcaccttcaccgaccaacaacaattttgctttcggttctttttctttaaatgcttggaaggcgcgaatcaaaaaggaatgattcttttgataagcaaatcgtcccacatgaccgacgactaccgcatcttcaaaaccaagttcctgtcgaacctgatctctgatttccggatcgtaacgaaatttttttaagtctaccccattatgaataagcagaacctggcgtgcgtcaatgttgggaaacatccattgtctggcaagatccgaacacgccacaaatcgcgttccaatgtgtattaatttcgtgcgaaaaaattgatgaattttttccttagtatttcgatgtgtgccgtcaacacctgccgcgtgagaatgcatgatgatatgctttatgcctgcatccttggcggccttacctgcaacccacagtttatttgaaacgtcagaatgaatatgtacataatcgtacccctttgttctcatcagttgtttcaaatacgtgtagatgtggcgctgttttaaaatcttattgccgccacagccgacgtaataaacctgagtgcccattgcgttgagcgcgtcgatgttttcctgcttttcaaagggttcttgacaggcaatgtcaatttggagactctccggtttatgttcgatcacgtttttaactaacgcatagacgccgccgtaaccattgtcgtctacattgacttctaatactttagtcatgacgtgcattcccttcttttaacttgacgtattcaatttgcgggtgaaaacgaaacccagctttaaaagactgccgaatgactttgagtttttcggatttagcatctttcgccttaaataataccttcagcaagtgaaaagccgttctcgcgtataaatagaggtatccctttagtccttctcttcggtataggaccacctcgttgcgatacatgtagcggtagcgccacaaacggtccggcgcatcgtgttcaatgcctactttttgattgctgcccattcgatgcaccacttcactagaagggacagcgtaacaaggcagttttcttgaaattcttctggaatattccaaatcatcagaccaaataaagaactctttgatcggtaagccaaattgaaggatgacttcagccttaataaaaaacgatacaaacgtcgccataataatcggcacttcatcgctggtataatcctgcatttttttgtgaagtccgatccgttgacgattcatattgcatacactgccgtcaatccaatatgcaacgccggataaaaatccataatggccaccaagccggcggtccgcttccatcaaataatacagggacaatggcttgacgtaagtgtcatcgtccatcagccaaacgtacttgtatcccagctgaacagctttctctgcgccgacacgaaacccaccggcaccgccaatattttctccagtgttataataaagaatgctgccgtcgtcgatcagatcctgaacttcagcctgagtgccgtctgtgctggcattatcgatcaatataatgtcacactgcattttttttaggttcaataagttttctaagcagccccgaagcatcgctttgcggttgtaggtcacgactacggctgctacattattacgcgtatccattagaagctgccctcgtatttctgatgaaagaacttcgcgcggagaaaggaaaatccctttttgagccaattcgtcttttccatattcgcataaggcaaagtcttgatatcggacgccttcaaggcgccaacacgaacttgatgccccagccaaacattgaaaataatttccccaattcgtccgaaataacgtttttgaaatggacttaaatcagaggtatcgacgcggtcttctaattccgccaaaattttaaacagccacgtacagtattggtcgacaagagaacgggtcatgatcatcatgttaaacatgtgccccgaagattttttcgtgacccgatcaaaatccacgacgtaatccggataaaattgttcaataatctggcgggtaatgtctaattgaatggcgtaatgcgtgtgtgcgtagtgcgaatacagcgtttcgatatagtaccggcgctttttcgggacaaaaactttgtatcgatcgagtaacggcgcaatctcctcataagttaaaatagactgaaaacggtcgcgtttgaggggcttatggacaaaatatcgacggtagtgcacgagaccgaggaaatcagattgaacgtgtttccacgcccaatacaacccggtcagctcacaatagccctcatttttctcagaaatattgtctcctgtgttgtccttgacatatcccaaatcaagcggtctgccatctttatcggttttcccttccgcgccgacgtgcaccggtaaatacatcggatctgtcggcatccggtactttttatgtgcagcaacaacgatctgaatgcggtcattgacatctttcatgttcgtattctcccacttattattctgcaccttcatggctgaaaaccactttgattgtcttcagtattaatttaacgtccaatcccaaactccaattttcgatataatacgcatccagacgcacgacttcttcaaaatcggtaatatccgaccggccagtcgcctgccacataccagtcaagcccggttttgccgccagccgctttaaatgatgcatatcgtactgcttgtattcttcaacagtcggcgggcgggtgccaaccaacgacatgtcccctttgagcacattgaaaaactgcggcagctcatcaatactcgcctttcttaagaaatggccaatgggaatgatccgcgggtcgttgtccattttaaacatcaggccagacattttgttctgtgccatcagttcctttttgcgctcttccgcatccggatacatcgtcctgaacttgtaaattttaaaggttctgccatttcgaccgacacgttcctgtgcaaagaagatcggtcccggcgactgatgcttgataattggtccgaaaataatcaacgcaataccggtgaaaatcaaaccaaccagtgcgccgacaatatcagtcaagcgcttgacgaccagtttccactgcggcaccgcgctcatgctcgacgtcatcacgctaagcccgcctattttatgaaagctttgattcgggatttcgtcactgaactgcggcatggccacgtggaccgtcagcccggcattgacaaacagcttaatcaactgctccgccgactggtttttgttgtcaatatcgagaaaaatctcgtcgacgatatttttccgcacgtattcaaaaacggtactcatttcgcagacgattggcacatcgtgaaaggtttcgccaacctgatccttgacatcgtagaaaaccagaccgcaaagattgtagggtctgtaaaaattctgctgaaggttattgatcgcagattccgcgttttctccggtcgtgatcacaagcatctggcgttcttttttcgacgcgcggattcgccgacgcaccagccgcttccaaagcacgcgttccgtgtaattgagaacgatgctcaccggaatcatcgatacgataatcactcgggaatagtaataggaattctgcatcaaaaacatccagaaaatcaacagcatgatcgttacaaacgtatggatacagactgatttaaattccacgtaccggtcccgatatacaatattgctgtaggtcgacgagaaaaaagccgcgataatgtgcgcagggacaatcgcaatcgccatccgcttgtaaagtggtggaaacgggaaaaagacccctatcctataggcgtaaacaataaaaaaggagagttcaaaaaacaccaggtccagcagcagaaaatctagatgcttgacccagctgctcgtttttcttttgtacatgtatactccgatctaaaaattgtctatttaatggtatgcgtgtattatatcacggctcgtatcaaaatcaaaaaatcaatttaatctgttgttaagccttattcgtcggcaagtcctttatcccgaatgacttggatcaccgaatcgacgagttcttcacactgcgccttggtttctgcttccaccatcacgcggatgagcggttccgtccccgacggtctgacgagaattcgaccggtgtcacccaacagatcggcgacgcgctgcacggcctgtttgacgtccggatcattttgcgcggcctctttatccccgacgcggacgtttttcagaacttgtggatagatgtaaagtggttcgataatcgtcgacagcttcttcttctgaccgatcatggcctgcatgatttttaaactggtcagaatgccgtcacccgtcgacgcgtacttcgaaaaaatgatatgccccgactgttcgccgccgatatggcagccgtgcttggacatgtattcgtaaacgtacttgtcgccaaccttggttttggcgtaatcaatgcccagctgatcaaaggctttgtataacccaaagttggacatgaccgtcgtcacgactgtgttgttgacgagcttatcccgatctttcatgtatcggccatataaatacaaaatatggtctcctgtcacgacgttgcctttttcgtccactgcgaggcagcggtcggcatctccgtcgtaggcaaagcccacatccatgccatgttcgacgacgtatttttgaagcccttcaatatgggtagagcccgcgttagcgttgatattcaagccgtcaggattggcgttaatcacggaaaccgtcgcacccaaagcattgaaaaccgacggcgcgatattccaggctgagccgttggcgcagtccagcgccactttgatgcccttgaaagaatacaccccaagggaaattaggtaaccaatgtagcggttgcgcccagaagcgtagtcaatagagcggccgattttatcccgttttgccttgggaatgtcgccgccccaggattttccaaaggcggtcagattgccgtcgatgtaggcttcgatcaggtcgatcacttccgggtccatcttttcgccgttgtggttgatcaatttaatgccattgtcgtaatacggattgtggctggccgaaatcatgattccgcagtcgaattggtccacccgggcgatataagcgacagacggtgtcgtggtgacgtggagaatgtacgcgtccgcaccggaggcaaccaggccgccgacgagcatcgattcaaacatgtagctcgaacgtctcgtgtctttgccgataacaatctgcggcgtggtcgcgtcacccttttgtctgcgcagttcgccgtaataccagcctaagaaacggccgatctggtaagcgtgttccgcattgagcgtcacattcgcttctcctcggaaaccgtcagtcccaaaatattttcccattgttccttgtctcctcgaattttaaccttacacaatgacaaaaaaactccgaagcctcagcctcggagttttttatgtcaattattcgcccatctgtttggcaacttcttcagcgaagttttcctgtttcttttcgagaccttcacccatttcaaagcgggcaaaacgacgaatcttgacgttttcgccaatgtccatgatctgttccttgaccaaatcgccgatcgtcatgtccggatctttgatgtaaggctgatccagcaggcagatttccttatagaatttcttcagtcggccttctaccattttttcaacgattttttccggcttgccttcatttaatgcctgaaccttcaggatttcgcgttccttcgcgacttcgtcttccggcacgtcgtcttcgctcaaatacttcggatttgccgctgcaatgtgcatggcaacgtcctttgcgaagcgctggaatttatcagtctgtgcgacaaagtcggtttcgcagttaatttcgaccattgcgccgatacggccgcccatgtgaatgtaagaagcgacaacgccttcagccgcaattctgtcggcctttttagcggtcttcgccatgcccttttcacgcaggatgacgatcgctttttccatatcgccgtcggcttcggttaaagcttttttgcagtccatcatgccggaacccgttttttcgcggagttccttaaccatctgtgctgtaattttcattgaattgtttcctccaataccaagtaagaagcttattctgcgtctgctgcttcttcagcttccgcttctgctgcagaaactggaacgtcttcttcctgttcttctgccggtgtctgtccctgtttgccttcgatgaccgcgtcggccagaatgcgaaggattaatgcgatggcgcggattgcgtcgtcattgcctgggatgatgtagtcaacatcgtccggatcgcagttggtatcgacaatgctgacgattggaataccgagcttctgcgcttcacggatcgcgatggcttccttcttgcagtcgataacgacaatggcgcccggcatgccgtccatgtcttcaatcccgccgaggaacttctgcagtttttcacgttcgcggacaagaccgattacttccttcttcggcagtaaatcaaatgtgccgtcttcttccatccgtttcagatctttgagacggttgatacgtttattgatggtttcccagttggtcagggtaccgccgagccagcggtgattgacgtagtattcgccgcagcgttttgcttcggtttcgatgctgttctgtgcctgcttcttcgtgccgacgaataaaatgtgtttgccgtcagctgccaaatcgcggacgaaattgtaagcatcgccgatcattgtaaccgtctgctgtaagtcgatgatgtaaatcccgtttctttcagtgaagatgtagggtttcatcttcgggttccatctgcgtgtctgatggccgaaatggacaccagcttccaataattgtttcattgtgacaatagccatttttgtacctcctggtttttcttccacttccgtctgtggagcgcgcgactcaaagagcaccagcgcattcctcgggaaatgtgtatattcacaacttgtttagtatatcgtaagcttataagctttgcaagttaaatcaaatatttttcgtagcttttttcgttatctttcggtttgaacaccgaatcgacgtacgcttttgtgacggtgaacgtgtcttcgtcgtaatcgctggcgtaaaatgaaatttcttcgagcaattcctcaaaaacagtgtgcagccggcgggcgccgatgttttcatcttcttcattttgttggaaggcgatggccgccacttccttcagcgcctcttcttcgaatttcatttcgatgccttcggtgcgcatcaggtaggtgtactgcttgacgatcgcgttttccggctgagtcaagattttgacaaaatcctcttcggtcaggctgtccaaatgcacggacaccgggaagcgcccttggagttcagggatcatatcttcgacgttggcgacgttaaaggcgccggcgccgatgaacagcatgaaatccgttttaaccggtccgtatttggtgttgaccgtgctgccttcaacgatcggcagaatatcgcgctggaccccttctctcgagacgtccggaccgccgcggctggcaccgttgtcgatgattttatcaatttcatcgatgaagataatgccgttctgttccgcttcgcgaatccccgtttcgttgacttcgtccatatcgatcatcttctgggcttcctgattggcaaaggccttgcgggcttctgaaattttcatggtccgctttttctttttcttgccgcccggcatcagcccgtcgaaaatattgccgatttcgatgctcatgtcttcgctcatcccagccatgacgccgatagatttggtcgcatcgtcatcgagctcgacttcgattcgttcgtcctcgagctttccggccaaaaggtctttgcgcaagtcttcacggcgcgtcacaatttcggcagatgcctgttcgtcagacgcgctgctgtcgtcagccggctgattgatctggccgttgccggacagcagttcaaagggattgaccagcttttcttcttttttctgttttttgtgctgcggcacgaggatatccagaatcatctcgttggcgcgtgcttccgccttttcccgaacctcgtccattttctgctgtttgaccatgcggatcgacgtcgtcacaaggtcgcggaccatggattccacatctcgtccgacgtagcccacttccgtgaacttcgtcgcctcaaccttgataaacggcgcggacaccagtttggccagtcgtctcgcgatttcggtcttccctacaccggttgggcccatcaagataatgtttttcggtgtgatttcgtcgcggatttcttcgggcagcagcgaacggcggtatcggttgcggatcgcgatagccaccgcttttttggccttatcctgtccgatgatgtaacggttcaattcctggacgatgaccctcggcgtcagctctgccttcgttctttttttagtcatcagcgccttctccctgctcgtctaatgtgagcaccttgatgtggtcgttggtgtacacacagatccccgacgcgattttgagggcttcttctgcgatctgagccgcgtccaaatccgaatgcgctttaagcgctctggctgctgccagcgcgtaattgccgccggaaccgatcgccgcgatttcgtcatccggttcgacgacttcgccgttgcctgaaagaatcaataaggtctcttcattcatgacaatcagcaatgcttccagcttgcgcatcaccttgtcctggcgccaatccttggccagctctacggctgcccgttttaaattaccgttgtattcttccaatttatgttcaaacatttcgcacagtgtgaaggcgtcggcgacggagccggcaaacccggccagcaccttgccgttgtagagctttctaaccttctgcgcggtcgccttcatgatgacgctttcgcccatcgtgacctgaccgtctccggcgatggccacttttccattatgccgaatgccgacgattgttgttgctcttaacatcttcttctcctttttctgtcattttacttttcctgccgctcggacgtttttccggctctccatcgcattggagacagtaaacgcgtttgcgtttcccaagtcccttttggaacatggtgttgccgcaatgcggacatttttcagccaccggcttgtcccatgtcacgaaatcgcacgttggataattgctgcagccgtaaaacgtccggccctttttcgatttgcgcttgaccagatcaccgccgcatttcgggcagatgccgccggttttttcaaaatagggcttcgtgtttttacattccggataattggggcaggccaagaacttgccgtaccggccttccttgatgaccatgtgggcgccgcacttgtcgcagatcacatcggtcacttcttctttgatttcgattttgtccgcgtgttcctgagcgtgatccagctcagctttaaaggggccgtaaaattccttcatgaccttgacccagttttccgtgccgttggctacgttgtcgagctcggtttccatcttcgctgtaaactgctgatcgacaatatctgggaaatagtcttccatcatattggtgaccgtgatgcccagctccgtcggtttgaagcgtttattttccgtttcaacgtagttgcggcttttgatcgtcgcgatcgtcggcgcgtaagtactcggccggccaatgcctcgttcttcgagaagcttgatcagcgacgcttcgttgtaacgagccggcggatttgtgaatttctgttccttgtgaatcttttccagatgaatcgggtctcctttttcgagcacgggcagcggattatcctttctcgccattgacggcatggctcgggtgaacccatcgaactgcatcgtatcgcccttgactctaaatatcaaatgttcgcaggcgatatccgcacgggtgacatcgtatacggccgccgccatttgactggccaccatacgctgccagatgagccggtacaatttataatcctctggctccagctgggactgcagctgctccggcgtgttgaacagcgacgccggccgaatcgcttcgtgtgcgtcctgcacgtttttattctttttcgcggtgcggtgctgcttacctagatatttttcaccgtaattttcagtgatgtactgcttcgcttcgtccacggcctccggtgccagacgcgtcgagtcggtacgaatgtaggtcacgtggccgctttcgtacaagcgctgcgcgatgctcatcgtgcggcggcttgtgaaacccaatgccttgtacgccgtctgctgaagggtactggttgtgaagggcaatggcggacgctgctgattctttttcttttgcactgacgcgacaaccatgtccggatgcgccttgacaatggcttccagccggtcggcttcctttgcgtctggaattttcttcgttttgccgtcttccgaataaaaaaccgctaaaaattgacggctgtcgccctgtttggacacgtctaaatcgagattccagtattcttccggcacaaaggattcgatttcccgttctctgtcgacgataatccgagtgactaccgactgcacgcgccccgcgctcaaccctctgcggacctttttccacaaaaaggggctgatcgaatacccgaccagacggtcgagctcccgtctcgcctgctgggcgttgacgagatccatatccacagcgcggacgtgatcgatcgcttcgttgatcgcccgtttggtgatttcgtgaaattcgattcggcagggactgtttggatcgatgccaagggtgttggccacgtgccaagaaatcgcttcaccttcacggtccgggtcagtggccaaaagcacgcggtcgcttttcttcgcgtccttttttaactgtgccaaaagcttgcccttgccacggatcgtgatgtaatccggttggaaatcgtggtcaacatcgatgcccagacggctctttggcaggtcgatcacgtgtcccatcgtcgcctcgacctgataccccttcggcaattgctttttgatcgtcttcgccttggccggcgattctacaataaccaatgtccgcatgacgtacctcagtcgttagctggatgttccttcagccacgtatcgccgacggccttggccacagccttggccacttccgggttaaacgggttgggaatcacgtgttcttcgtcccgttcttcatcagtgacaatgcccgcgatggcgtaggctgccgcctgcttcatcgattcggtaatgcgtttcgcccggacatcgagcgcccctctgaaaatacctgggaatgccaaaacgttgttgatttgattgggataatcggaacggccagtcccaacgacgcgggcgcccgcctttttcgcaagatccggcatgatttccggcaccgggttagccatcgcaaagaccaccgcatcgtcattcatcgacgcgaccatttcttcggtgacgatattcggggctgacacgccgatgaacacgtctgcgcccttaatcgcatctgccaaactgccgtgccggtcgttcttgttcgagtgttctgccaaccagcgcatatacggatttagatccggattgtcccgagtcaaaataccgttgatgtccgacatgatcaaatcaccgacgcccatgttgatgagcatcttcgcaatcgctgtgcctgcagaacccgacccattgatcacaaccgtgacatcttcaaggcgcttgtcgacaacgcgcatcgcgttaataatcccagaggcgacgacgatggcggtgccgtgctgatcgtcgtggaaaaccggaatatccaatgcagcctgcagtttttcttcgacttcaaaacatttcggcgcgcagatgtcctctaaattgataccgccgaaggtcggtgcgatgcggatacctgtttcaacaatttcgtcggggtcctgcgtcgacagacaaatcggaaacgcgtcgacgccgccaaattctttaaacagcacggccttgccttccataaccggcattgccgcttcgccgccaatattgcccaagccgaggacagctgagccatcagacaagacagcgaccagattgcttttcgccgtgtaagtgtagacgtcatcaggattttgtgcgattttgcggcacggttccgcgacgcccggtgtgtaggcgatgctcaattcgtcctgattggtcacgggcagcttcgattcaaccgaaatttttccatgatgatccttgtgtacttttaaagcttcttgctgataatccacttttttctccttttttctctacaattattgtttcacaaattttttaaattgcttgtaattgccgttgtaaatgtcaagatcgacgaactgctgactgccgtcgccgataccatcaataaagcctctctgagaatgctgccagaacacccattggtgattgcctgaaagcttcggcgaggtattggacaaatcgcagatccaaattgtaatatctttgtacccgctcttgatgtattggttgtaggtgttgtaattggtatagatgatcgggtttcggcccgtctttttcttgattttctgaattgccggtttcaaaatgctgtcgattttttcctgactcggcggcgtcttgaggtaggacccgtaaagttcaaagtcgatcacagccggcagcgcgttatcgtctgacgggactgtgttcaaaaagtgcgcggcctgtttggcgccgcttttgttcagcgtcaagaaaaagtacgcgccgcggtaaagccccgcatcgtcggcatcgtcccaattcgttttgaaccgcttgtcgactaatgtcgtaccttctgtcgctttgatataggcaaatttaaagccctgatccgctattttgtcccagtcgatctcgccctgataggccgagacgtcgatgccgcgaaccatttttttgtcattttgaatcgtccaaacgacgacggcaatggtcaccgcaatggccgctgcaacaatcagaatcaggatagccttccagtgatttttagctttctttataaaagaagatggtgtgcgcggctcgggtatctgctccattttaatctccttttttcttaaaattccctgagtttataatctcaatttttttagtataaacgccattccttaaaaaatctttatgttataatgtcttggatattattttgcagactaaaggagatgttcatcatgaaatgggttcacaatgtggcagcttttgcgccttccaacccctacctcgctgatttggaggaaaccacctgggaagaaatcccgaagattcacaaaaacggtcaagattacgtctacgtttcagtcaaagacaacacaatgtacgaccgctacataaaaggtgatctcgtgatcattaagcttgacgaaaatccggaaacctctgtcgtcggcgacgcgctggtgctcctgccagacgatacggtctgtctgaaacagattaaatttggggcgaaaaaggtcaagctgatcgaccgcaacgagctcgatccaaaatccgtcagctacccgaaggatcaggttaaatgtctcggcgtcccgacctccgtgatccgcgcataaagaaatgcgcataaaaaaaacagacttgaaagtctgttatttgcaaatggtgcgagagacgggagtcgaacccgtacgtacgaagtacacacgcctctgaaacgtgcttgtctgcctattccaacactctcgcatcgacgacttcattataataatcttaattcaaaaatttgtcaaggcattttttaaaaaacaggagattttatgactaaatttgaaaaaaacatcattcgctggattgtcatcgtcgtgatgctggtcttcattgcgatcggcatttaccgcgccgtcgacaatcagcgcctggtgctccgtgtcgaacaggataaaaaagtcatccgcgtgctgcccttgtccaaggatcaccgcgagaccattaaaagcaaatacggcaccaacaccatcgtcatcaaaaacggcaaggtcgacgtcacaaaggctgactgcaaaaatcaggtttgtgtcaacagccggaaaatttcgaaaaacggcgaaaccatcgtctgtctgccccataaactgattttgactgtggtgccaaagagacaggttgccaatgaaaagtaggacccaccagctcgtcaccatcgcactgctgactgcggccgccgcaattctcggctacgtcgagtcgttgattcctgccttcattcccattcccggcatcaagctcggcctggccaatatcgtcacgatgctggccctcgcgcttttcaacctccccgttgccttcggcatcgtcactgcccgggtgctcttaacaggtttcatgttcggcagtctctcgtcaatcctctattccctcgccggcggatggatcagctgtctggtcatgggactgctcgctgcggtcaacaggaagcgaatggcgcccttgttttcattttacggcatctcggtattcggcgccattgcccacaatctcggtcagctgattgtggcctacatcgtcatccaaaacgtccatctgattttatactacctgccttttcttgtcctcgccgccataccaatcggcctgctgacgggctttattttcgccaaactcctcccccatcttccaataaaaaaagagaagagataaaactctcttctcaatggacggcgaatgctgttactcgtcgtcctgtttgcgatcccgaataaataccctgaagggcgtcccgtcaaaatcaaaggtttcgttaattttattttccagataacgcttgtacgaaaaatgcatcagcgagccgtcgttgacgaagatcacaaaggttggcggcttaattccagtttgagagccgtagtaaattttcagacggcggccgttttgtgaaggcggttccttcatcgccacaaaatccacgagggcttcgttgaatttcgacgtcggaatccgtttttcgctttgggcgaccacgtattcgatcgttttgtagatctgctcgacccgccgccccgttttggccgaaataaacagcatcggcgcgtaagtcataaagctcaacgtgttgcggatatccttcgtcattttctgaacggttttttcgtctttttcgatggcgtcccacttattcacgaggaaaatcgtcgggatgaatcggttgtgggcgatgccggcgattttcgcatcctgttcggtgatgccggcactggcatccaccagcatcaacactacgtccgcccgatcgattgcggcaatggcacggataatgctgtagcgctcgacgtcgtcgtaaattttctttttctttcgaagacccgccgtatcgataaaagtgtacgcaacaccgtcatgctcgaccttcgtgtcaatggcgtcgcgggtcgtcccaggaatatcgctgacgatcatccgttcctcgccgatcagccggttgaccagagttgatttgcccgcattgggcttgccgaccacggcgaccttcaaactgtcgtccgcatcctggtcttcgttgtaaatcgattcggtccggtctacaatcacgtcgagcaaatcgccaaggccgagcccctgctccgctgaaatcgggatcggatcgccgagcccgaggttgtaaaactcgtacagactgctttccatcttcaccgaatccagcttgttgaccgcgaggaccactttcttgctgttgcgtctcaacatacccgcgacgtcttcatccgccgctgtcatgccttcgcggccgtcgacgatcatcaaaatcagatcggccatgtcgatggctacctcggcctgagcgcgcatctgccgtttgatggtgttattggtttttaattcgatcccgccagtatccacaagggtaaaatggcggttctgccactcagcgtccgcaatgatgcggtcccgcgtgacgccaggggtatcctcgacgatcgctacgcggtcgccgacgagacggttaaataaggtcgacttgcctacattcggtttgccgacaatcgctacaattggtttcataattgacctctatcttatttttctggttcatagcccggcccgttgtctgagacctctgtgggcagattcagacagcgcttgacaaatatttggccgtctgtcggcacaatttccaccgggctgtgccattttgcttccaaatcttcggttgtgacgtcgtcgagaaacaaatgggtttgaaatttgaccgcgttctccggcacaaaataccgatcacacgctgcagagtccggcttttgttcgagcatatcctgtccggtgatcagtccagaaactgtgatcgcttcgccaaagaaacggttttcgatatcaaacaccgaaaacgtcacgttcggccacacttttgtaatggccgcgctgatgtcccgcagcatcggcgccgccagatgggcggtgacgatgccgatgtgcacagtctccgccgtcggcttctcggcacacagcgcattgattgtgtcctcggcctcctgcttaaaggccgccagcatgccgacgccgttttccaattggttgaagctctcgtaatacgctgcctccggaatggcgtctccagcctttaagaaaaattcatccgctgggtacacaaaatgcgtctggtgcttctcgagcatctttctttgaatatccgagataatcgcaatggtttctttagccttgtcccggtccactgcggcaatgtcctgaaggccttgccggtacttcgtcaaaccgatgggcacgaccgaaaccgttccaagctgcggatagaacgctgccagatcggtcagtgtcttttttagatgtacgccgtcgttccagccagggcagagcacaatctgagcgttcatcgcgatgtcgtgatctttgaaaaattgaagctcctcgataatattgccggcaaaccggttgtgaagcatcctgcagcgcagttcaggctccgtggtgtggacggaaatattgatcggcatgatgtgatagcggacgatgcgttccttttcctctgggctcaaattcgtcagcgtgatgtaattaccgtagagaaaggacatccgttcatcgtcgtccttgacgtagagcgtgtcccgcatgccaggcggcatctggtcgataaagcagaagacgcattggttagtacaccgcctgatctgcccggcgtcccgctcgacaatccccaaggactcttctgggtctttttcgatgtctaactcccagatttctccgttttgtttttcgatcgtcacggtcagctcagtatcggcttggaaaaattcgatgtcgagcgcatcgatgactgtgctgccgtcgatggcaaccacaaaatccccgggctcaactcccatttcttcgagaacagaaccgggctgtatcccgggtatttgatatttcatgcttgttctccttctgcacagttttcttatttaatgttttatgtcagtgcccgcttgatatggtataatagggacgctggatcagcaagtccataaagaggagtgcgccagatggcaaatttccaacacaaaacagaagataaacttattatattatacgtgctcaataaaatcaaaaccggattaagccgcgagcagctcgcctacatcattgtccaaaatctacagatgcgctacatcgacatccaggttgacatcgacgaactcatcggcgaggatctgattcacgacgagagcgccgacgccaagcttctgattacgccagatgggaccgagatggtcaagcagctgggcgaccgcgtgccggagttcacccgggaaatgctctccgcctttatcaaaaacaataaatccaaaattttcaaggaaacccgtaccgacgccacctacgaggaagtcagtcccgacgactatcaggtcacgctgagcctcatcgaaaacaacatcaatttgatgcggctgaccgtttcctgcccagacaaagcccaggctctcgcgctgtgtgaccattggaagcggtacacgcaggaaatttacgcgtcggtgatgcagagtttgattgagagtaagtgaacctattttttacaattcagcctacaaataaaggtcagcgcaaaagcactgacctttattttatggcctgttttccgtattttttaaggtacgcttcgtagcacagcccgctttttttcacttttttcgccaaatccacgccgaggtagcgcagatgccacggttcgtattcgtaaccggtgattttctcggcgcccttcgggaagcggacaatgtagccgtaatcctgagcgtgggcggcgacccatttgccttcgtcggtatccacaaaagtctgctgcagatcgccttccatctcgtcacaggtcaaatccacggccagacctgtctgatgctcgctttctcccggcttggaggaaatcgcgttggcctttgcctcccccatgctttgaacgtgctgatcgtaaatcgtcttttgttcggcgtaggagcgatagcccgaattggccgacagggtaatgccgtcgcggctggcggcatcgaacattttggtcagcgcctctgccgcttccctgcgcatttggacaggccgtacacttttcagcgacaggccgactaaatccgagggcacataatccgccaaaagcaggtgatccttgttgaccagctgctcgatcgagccgctctccgccgccttatcgttaagtgtgacgacgggcgctgccttttttttattttgggtctgttgaccttgtgattggcttttgatgaaatgcaagcttgccgtgctgagaaaaacaatcagcatcagcagcccaatgagaagccattgacgccgcttgaggatgaatgcattccgctgttcttttcgcatatctcgtctgtctcattctgtgtatttcttttattttaacacacccgccgactttatccaatcattgacagaaatgacatttgattggactccggcagatcagccagacagccgaagctctgcagtttttccatattggccttgttgacgtgggcgcggttctgcatgtcttccatcgacataaagggctttttctgcgcttcgtcataaatgtttttcgccactacctcgccgaggccgtccaccgaaatcaacggcggaatcaacgcatcgccttcgactctaaaatatttgtagtgcgatttgtacaaatcgacgttgccaaatcgatagccccggcagtacatttcccaggccagctccagcgataccaacagctgctggtccttgttggtggccttgttgccctgggcgcggatttcctctaatttgcggtgcaccgcttccttgccggaggtcatgacccgaaggtcgaattccttggcgcggatactgaaatacgccgcgtaatacgccagcgggtaatacaccttgtaatacgcgatgcggaaggccatcatcacgtacgccaccgcgtgggccttcgggaacatgtatttgatttttttacacgaatcgatgtaccagtccggcacgttgttttcccgcatgtagggttcttcgtcgtcgagcaggcccttgcccttccgaacgtgttccatgatccagaacgagcgctccggcgccagccccatcgaaatcagcccgagcatgatgtcgtctcggcagcagatgacgtctttgatcgtcgcctggccgctttcgatcagagtctgggcgttgccgatccacacgtcggtcccatgcgacaggccggaaatccggatcaagtcggcgtaggaagttggcttcgcgtcgagcaccatcttgcggacaaaattggtgccgaattccggcacgccgcaggttcccagcggaatatcgaaactgtcgtccttgagcttaagcgcctccgtccccttgaacaggctgatgatgttttcgtcgtccaacggaatggtcgttgggtccacaccggtcatatctttcagcatcttcaaaatcgtcggatcatcgtgcccgaggatatcgagcttgagcaggcgcccttcgatggaatggtaatcgaaatgggtcgtcagtgtgccgctttctttttcattggccgggtattgaattggcgtgaactggtaaatttccttgtccctcggcacgaccatgaccccgccgggatgctggccggtcgtccgcgtcacaccagcaacgccggcgatgagccggtccatttccgcccgactgacgaccttgccccgttcctcgaggtaattcttgacgtagccaaaggcggtcttgtctgccaaggttgcgatggtcccggcgcgatagaccttgcccttcccgaaaatcacctcggtgtacttgtgggcttcgccctgattgtcgccggagaaattcaagtcgatatccggttccttatcgcccttaaagcctaagaaggtttcgaacggaatatcgaagccgtctttagtcatcggcgtgccgcattccggacaatttttatccggtaagtccggcccgacgccgacctttgtgctgtcgaaccattcggtgtgcttgcacttcgggcagacgtaatggggcggcagcgagttgacctcggtgatgccgcagagcatcgcgacgagagacgacccgaccgaccctctggaaccgaccagataaccgcattctctagaatgctgaaccagctttttcgcaatcaggtacaagacagagtagccgttgccgataatggatttaagctctcggtgaatccggtcggccacaatatccggcagcgggtcgccgtaaatttccttggcgcgcttgtggaccgagtcgcggatttcgtcgtctgacccttcgataaccggcgggaaggtgccgtccggcaccggcttcacgtcgccgatcatgtccgcgaccttgcgggtattggtgactaccagctcgtaggcttcctccggatctaaataattaaattcatcgagcatttctgccgtggagtgataatacaggggcggctgatgatccgcgtctttatatccctgcccggcctgaagaatggctctaaaggccgcgtcctccggtgacacgtaatgcacgtccccggtggcgacgacgagcttgtgcttttcccgaccgagggcgatgatggccttattgatctgaatcaaatcgtcatgagtcaaatcgccgtttcgttccataaatgcgttgttgcccaagggctgaacttcgaaataatcgtaaaaatcggcaatttggtcgagcttgtgcttcggcacgttttccttgatcgccgtgtagagctcacccgcctcgcaggctgagccgattaacagatgctctctgtgagccgcgagcaaggatttgggcagccgcggctttttgtaaaagtattccacgtggctggccgacacaagacggtacaaatcgatgagcccctcttgatccttcgcgtagatgatgatgtggtaaggccgttcggttttaatcacctgctgcagatcgatcaggctgttgagcgccgtcgaggtgtgcacctctttttcctcggccaaggccatcaggcgtacaaaaatcttcgcggagcacaccgcgtcgtcaatcgcccgatggtggtgacccatgtcgattttgaaataactggccagcttcttcagattgtgccgcgcaatcgacggaatgagtgtccgggccatcgccagcgtatcgatgtaggtgatctcattgggaatctgatacttggccatcgcaaggcttaaaaagcccatatcaaaattagcgttgtgcgccacgagaatgcggccgtctgcgtattccaaaaacttgcgcagcgcctcttcttcctcgagaccgccggccaccatttgatcggtgatgctggtcagctcggtgatcttcgccgggaccttgcggtgcggattgacaaaggtctgaaaggtgtcgagaatgtgtttattcttgatccgcgccgccgcaatttcgatgatggcgtcgcgccccggataaagaccggtggtttctaaatcgaaaaagacaaactcgccgtcaaagggctcgtcctgattcccagtcgtaatcttgacgccatcgttgaccaaatagccctccagtccgtacagaaccttgatgccagttcccttggtttccttcatgatttccggataagcctggacgacgccgtggtccgtgatgccgatgatgtcgtggccgaaatccttggcctgagcgacgatttttttaaccttgctcaccgcatccattgcagaatactggctgtgcatgtgcagctcgacccgcttttccggcgcgtcgtccgtgcgtttcggtcgttcggactcgtccatttcttcaatgaccttcggcgaaagcagcttttcatgagcgtattcgtcgtacgcgatggtgccttcaatgtgcacccacgtgccattcttcagccgatccttgagggcgtcggcgtttttccccgcgaaaatcttgcaggaaatcgaaccggtgtgatcgctgactgcaaactcgagcagctgtttctcgtttctgagctcccggctctcaaagttgaaaatctcaccctcgtagccgtgacggtctttatcgagagtcaggttgtcttcaaagtcgatatctgccatcttttcaaccggtactgtgaattttttgcctaaaatcatcggtcctgtgatagtggcttgatccttattctttgaagaacctgctgcggcggctggtgcccggcgggccatttcacggttgtccgccagcgcctgctgaaggcgcgcgtcgagagccgaaagtggggcgctactctgcgccccttcgacttcgtcggccccttttttttctttcgcttccgtttcaactgtctttttgtcgtttacaggctcgatgggctcacgctttcccgtttcgggaagtgcggccgcctctaaatcaaaagattccggtggaagttctgggagttccgggggcatttctgcctccagcgcgtcgaaatcaaccggtggcagatcgggtatatcctgatcagcctggcgcttcgccgaatcgaataccaccgtcagcgattttgcaaaatcaaaaatagtggaaagttccatctgaaccccggccgcgtcgggctgggattcagactctgtctgaaagacaaaggtcaattcacattgactttcggaaatttccactcgttttgaagtcatatgatatttttcgcacagggcctgataggcctgctgtttttgagtcagttcatccatatttacatcttttctatttcttccatcatcgcatcgacgatctgatcttctctgacggttctgaaaatctgacccttcttaaacaagacgcccttgccatttccgccggcgacgccgatatccgcggctctgccttcgcccgggccgttgactacacagcccatcaccgcgaccttgagattcttgtgaacgtttttgagacggcggttcatttcttccgcgatgccgattaaatcaatctgcgttctgccgcaggtcggacaagagacgaccgtgatgccctgttcttttttgtcaaagcgcccagcggatttaaggatttctctagcggtctcgacttcagtgatcggatcccctgtgacagaaacgcggatcgtatcgccgatgccgtttagaagcagatagcccatcgcgacagaggatttaaccgccgcgctgcgcagtactccggcttccgtgacgccgagatgcaccggaaaatcgtatttttctgaaaacatcgtgtacgcgtcaatcgtcatcaatggatcagaggatttcagcgaaacgacgatatccgaaaacccgtcatccagcagataagccatatgccgttcagcgctttcgaccatgcccgcggctgtcggaccgccgtatttgtcgagcagttccttttccagcgagccgccgttgacgccaatgcggattggcgtgccgtgcgccttcgccgcgcagaccacctcgtggaccttttcccgtccgccgatattgcccgggttgatgcgcagcttatcgaccccgccttcaatagccttcaacgcgaggcggtaatcaaaatgaatgtccgccaccagcggaatcgaaatccgcgccttgattttcggaagggcttcagccgccgcttcgtccggcaccgccacgcggatgatgtcacagccagcctcggtcagcgccgcgatttggttgaccgtctggtccacattgcgcgtgtcggtattgcacatcgactgaatcgcgattggatgatcgccgccaatggccacactaccaatttgaactgttctcgtttttcgtctgttaatcttcatctttttccctctaatgcaaatacctcagcacatcgttgaccgccaccacgacggagaaaaccatcaggcacgcaaagccgacgccatttaaaatcatcgcggctttcggcgacaaatcccgtctggcaatcatttccgctagcgttacaagaatctgaccgccgtccagcgccggaaagggcagcagattgatgatgcccaagttaactgaaatcagcgcgcagaacaacagaaaggacagcacgccgtggctcgcgaaattgccgaccatgccgaccataccgaccggccccgcaaaatcgttaagggaaagtttgccgacgatgagctggtgtaggctctgataaatcgcgccgctgaaggacacgaaaagtttggaactgctgaccagcgaagcgggaaagctctggccgcccgccagataaaggccaaacaaaataataaaagcgagaatcagattcatcaaaggtcccgcgaataaaatgagcagctttttggcctttgaaatcttcataaaagagcgttccggcggcagatcctccggcaccccgtattcctcagccagctcgccgtccgcgtcgtcctcgccccacatttggcagaagccgccgatgggcagcgcgcgcacggcaaagaccgtctccttccctttgtgggaaaagaggagcggtcccatgccaatcgaaaactccagaacgtaaacaccggctctgcgtgccgcaataaaatgcccaaattcgtgaaccacgacgagcacggtcagcatcaccagcgtcaggataatcattaaagcaatattcatggtttaaagtgtggtaaatgtcagcatcgcaaaaaggtagacaatcggcagcacgaaaatcacgctgtcgaaccggtcgaggacaccgccgtgtcccggcagaagcttgccgtaatccttgatgccagttttacgtttgatcatcgacgccgtcaaatcgccaaactgggatacaatgctcccgacaacgcctaaaatcgcgtaagaaaaaatcggcagatcgaaggaaaacttcgcccgcatcaggatgccgtaggctacggtcaaaattacggccgcaacggtaccgcctactgaaccggctacggttttattcgggctgatttccgggatcagcggcgtcttgccgaaaaaccggccgatgaaataagccccggtatccgtcacaaaggcgatgatgaacacgagccagaggtaatacagcccctgcggaatggcgtcgaacagctgcagatgccccagcatcagcggtacgtaaaccaagccaaaaaccgtcgcgatcgcgcggtaaacgctgtgttccttcgaaaggatttctgtgataaaaacgacgataaaggaaatgagcagcgccggcacggtgtactgataatcgaatttcatcacaacgatcataaatgccgtgagaatcagcggcagcgcgtagtgaatcggcagctccagctttttattgaccgcgtggacgtattcgtgcattccgaccagtgccagaaacagcgtcaggccaaagacaaaatagccgcccaagatgagcagaatcgccaaaatgggcacaaaaatcactgccgtaataattcgttttgccatttatttaacccctccatatcgtctgtttcgatgctgatattcgacgatccatttgtaaaagcatttttcgtcgaaatccggccacaaaatatcgtcaaagataaactcggcgtaggcaatctgccaaagcaagaaattactgagccgtttttctccgctggtccgaacgacgaggtccgggtcaggctgacccgctgtgtacagatagcggtcgatgagcgcttcgtcgatatgatccggcgaaatgccgtcgtccgcgatgccctttaccgcgtgaaccagctcttcccgtccgccgtagttgagggccagatttaagatcatgccctggttgtccgcggtgtcgtccaacattttcttcgccgccttctgaacaccttccggaaggcctgacatgtcgccgatcactctgacacggatgtctcggtcgttcatcgatctgatttcatttaaaaagtagcggatcgctaaatgcatcagtccggatacttcctcggcactgcgtttccagttttccgtcgaaaaggcgtacagcgtcagcacttctatgcccagatccgacgccgtcgtgatcgccttgcggacggccttcatggccgaacggtgcccaaaaacgcggggcattttccgcttggtggcccaccggccgttgccgtccataatgatcgcgacgtgccgaggcagccgcgattcgtcgatattgtaaccgtctatttccatattgtctccaaatgcttaggcttccgcctgttttctcttttctttcttttcaagattcttccacgccgtttcaaccatcagcttgatgcggttgatctggttgacttccgacgcgcccgggtcgtagtcgatcggcgcgatgttggcgtaggggtagcgtctgcggattggcttgatcatccccttgcccatgacgtggttcggcaggcaggcaaaaggctgaacgcagacgatattttcaacacctgattcaatcaattccatcatttcggcggtcaggaaccagccttccccgccctgattgccgagggaaatgagctcgtccgctttttccgccttcttttcgatggtggacggcgcactgaagtggcggctttcgttcaacgcctgcttcatgttcttgcggtaatgttcaaccaccttgatgaccagctcattaatgcgcttagccttggctgtcccggagagcacgtcgtgtttatatatagcattgtacgaacaatacaggaaaaagtcaatgatgtccggcgagacgacctggcagccttctttttcgagcaccttaaccaagttgttattcgcggtcggatggtatttaacgaggatttccccgacaataccgaccttcggaatcgtcttgtcgacgcgcggcagctgatcgaattcgcggacgatatcctgaacattcttcttaaagacgcgggcgcggggacgaatgatgttcgggcgcaccttttggcgccatttttcgtaaagcgcgttggccgagcccttgaccttttcgtagggccgtgtcgcgtaaagtacgcgctggaacaaatcgccataaaccgcggcgatgacaatgcggtacgccattgccggcgtaatgctgaagcccggattgtcttcgagaccgaccgtattaatcgaaacgaccggcacttgttccatccccgcttccttcagcgccttgcggataaagccgacgtaattggacgcgcggcacggaccaccggtctgagacatgatgaccgacacgttgttcaagtcgtatttacccgactgaagggccgccatgatctgcccgacggtcagaatactcgggtagcaggcgtcgttgttgacgtagcttaaacccgcgtcgaccgccttttggtcgacagccggcagcacttcaaagttgtagccgctggcgttcatcgccgtcgagaataaatcgaagtgaatcggcgacatctgcgggcagagaatcgtgtgctttttgcgcatttccttggtaaagggcacgcgcttggtcaatgatttgcccggcactttgatatgatgcgcgtcgcgttcgagcagggccgccttcagcgagcgcagacggattcgaatggcaccgaggttgctgacttcgtcgattttaatcagcgtgtagatcttgcccttgtgttcgaggatttcctgggtctgttccgaggtgacggcatccaggccgcagccgaaggaggtcagctgaaccaacgccagctcgttgtgttcggtgacaaattccgctgcgcggtacagccggctgtggtatttccattgatccagaacgcggaggggctgttcactcttgcttgaggccagcgccgcgactgagtcttctgtcagcaccgccatgcccagcgaggtaatgacgttgtcgaggccgtggttgatttccggatcgacgtggtacgggcggccagccagtacgatgcccttgcgcttgtgctgtctcagccactgcagggtttccttgcccttttcgagcaaatcgcccatgacctggtatttttccgcgtaggctttctttaacgcttcggtgacttcttccttgctgaccccttcttcggcgaaaatttcggtaaggcgttcttcgacccgttgatggttgtccagtgccaaaaacggattcatgaacttgacgttttgctccttgatgctgtccatgttgtatttgatcgtttccggataggacatgacgatcgggcaattgtaacaattgtctgccgattcgaattccttttcttcgtatgcgatgcacgggtaccagattttcttcacaccctgatcgatcaggtcttgaatgtgaccgtgggtcagctttgccggatagcagaccgattccgacggaatgctgctcatgcccttttcgtagattttgcgggtagatttggacgacaacacaacgcgatagcccaaattcgtcaggaaggtgaaccagaacgggaaattttcgtattggttcagcgcccgcggaatgccgatagtgcctcgagtcgcttcttcttcggaaagcggtttgtaatcgaagaggcgtttgtacttgtactgataaagatttgggacgttgtccttgttgcgcacgccgccggcgccgatttcgcagcggttgccagtcacgtggcggcttccgtcggcaaaaatgttgatggtcagctgacagttgttgctgcagccgccgcagcgtctgtgcttgatagtcgtcgtaaaggaatccagttcatctgctttgagcaccgtactcgtcgtgccttcctgccatctttccttggcgatcagtgccgcgccgaaggcgcccatcaggccggccacatctggacggatgacgtcgcgccctgtgattttttcaaaagctctgagcaccgcgttgttgttgaaggtgccgccctgaacgacgatgttcttgcccaaatccttcgggttgtgaaccttgatgactttctggagggcgttcttgatgaccgagtaggaaagcccggctgagatatccccgaccgacgccccttccttctgggcctgtttcaccttcgagttcatgaaaaccgtgcagcgcgtccccaaattggagggggtcttcgcttccagcgccgattcgacaaattcgttcatctggagattcaacgacttggcaaaggtttcgaggaacgagccgcacccggaggagcaggcttcgttcaaaatgatgctgtcgatcgcgccggaacgaatgcgcatggccttcatgtcctggccgccgatatccagaatgaagtcgacgtccggcttgaaatagctcgcgcccttgaaatgggccatcgtttcaacttcgccgatatcgactttcagcgcagactgaatcaagccttcgccgtatccggtggaggccgcgttggcaatgtaagcgccgtcaggcagcttgcggtaaatatcctttaagatgtcgatggcctttttcagcggactgccttcattgctcgaataatagctgtacagcagctcgcagtccttcccaataaccgccgccttcgtcgtggtagaaccagcatcgatcccgaggtagaccggtcctttgtaagccgtcaagttgccgcgtttgaccttgtcgcgactgtggcgttcgaggaaggtgtccagctcttcctgatccttaaacagcggatcgagatgacccagtccgatttcgtctttaaagggcttgtccatgcgttcaaggagttcggagaaggcgatcaccggctgtttttcgctggcgtaagccgtccctaaagcgacaaacaggttggaatttgccggaaattccacttcttccggcttaagtttcagggtttcgataaagcgctggcgcagctcggacaggaagtacagcgggccgcccaaaaaggccacgtgcccttcgatcgtgtggccgcaggccagaccggagatcgtctggttgaccacagcctgcagcacagacgcggcgatgtctgccctttctgccccgtcgttgatcagcggctgaatatccgtcttcgcaaagaccccgcagcgcgacgcgatcgggtaaattgtcgtgtgcttcttggccagctcgttgagccctgcagcatcagtcttgagcaatgcagccatctgatcgatgaaggcgccggtcccaccggcacaggtgccgttcatccgctgttccacactcgcgccaaagaatgtgattttcgcgtcttcgccgcccagctcaatggcacagtccgtttctggaattttttcttcgacggcacgggtaccggccaccacttcctgaataaatggaatatccagccagttcgctgctaacatcccgccggagccggtaactgacacgtgtgccctgaaatcgcccagttctttagtgacatccttcagcagattgctcatgctctgctgaatatttgagcggtgtctgcggtaatcgctgaaaataatctgatcattttcatcgaggatgacgattttaatcgtcgttgagcctacatcgaggcccattctgtaagtttcactcatggatttctcttctttctgtaaatttctatctgtagatttctatttcacgataaatcgggattttcaaattatcggtgtattatatcgcaaacatctttagaatgcaattaaatctcgataatctttgtccacttattgagcgacgtatctctgcccgacagactgccgctgccacttaaatttttttaatgaaaaataaacgattattgattatacttttattaaaatattgtacagaaatctaatgaagaaaccacaggaaaaaacgatgagtgatcaaattaataaagaagtcttcggcagccgcctgaagcaattaatgaaatcctacggcgaaaccacctactcactgggagcccgctttaatctttcgccgccgagcatctcccggtatacccgagccgaaatggcgccgaaaatgacaacgatttacgccctggccgattattttgatgtcaatcccaaatggctgatgggacagtccgtctcgatgtaccagtccgacattctcgacgacagcgacatcaacgcggatcacagcttaatcgacatttcggtattcgatgaaatccgctacgatctgcctattttctccaaccaccgcctcaaggaagcgctgcatctgcctctcagccgtttaagtaagtgggggccggtttttggctaccgcatcccagacgacacgatggcgcccgttctcagaccaggggatttggttgtcattcgcctgagcacagacatcaaatcgggaaacgccgtcgcgttccacgtcaaccgccaaaacatgatgattcgaaaggtcatcgttcaagggggacagatcatcgctcagccgctcaatccttcggctgacgccgcctgctaccagatcaataaaaatcacgtccagtttatcgggcgggtggtctactgtctgcaccgggaggaaacctattttgacgcataaaaaaagcttggccaattggtcaagctttttttgattagatctgtaagccgagttctgtttaaatgatcatctatctcgttttgctgtcaccagcaaactcaagcgacctacctgagagcagcgacgggccgccgccttttaacgctcgttcttggtcttgctccgaatggggtttacccagctggcgaattacttcaaccactggtgagctcttacctcaccctttcacccttaccgcagatgcggcggtttactttctgttgcacttgccttaaagtcacctttaccggacgttatccggcatcctgccctgtggagctcggactttcctcagagttgcctccgcgatcatatgatctagtcgcattatattatacgcagacgcgctttgaatttcaagctttttattccttgaaggtgcccatttcaaaggcttcctggccatcatcggcttctgtgccggcgtcagccccatctgcttcttccccgtcgccatcctgattgaggatgaggtttctcaccttctgttcgatttcatcgcacagatccggtttatcctctaagatctgacggaccttgtcacgcccctggccaaggcgttcgccgtcgtaagagaaccaggaaccagattttttcacgatatcaaggtcgacggcgcggtcgagcacatccccttcgtgggaaatgcctttgccgtagataatatcgaattccgcagtcttaaaaggcggtgccattttgtttttgacgattttgacacgggtgcggttcccgatggactcgccgtcttttttgatttgatcgatgcggcgcacatcgattctgaccgaagagtaaaacttcagtgcgcgcccacccgttgtgacttccgggtttccgtagacaatgccgaccttttctctaagctgattgatgaaaatcgtcgccgtgttggcgttcttgatgaccccggtaagttttcgaagggcctgagacatcaatctcgcgtgaagcccgacgtgagagtcgcccatggtgccgtcgatttctgcccgagggaccaaagctgcaaccgagtcaaccactgcgacgtcgatggcgccgcttcgcagcagggcctctaaaatttcaagggcctgttcgccggtatcaggctgagaaataatcaaattgtcgatgtcgacgccgagattagccgcatagatcggatccagcgcgtgttccgcgtcgataaaggccgcattgccgccggccttctggcactcagcaatgatgtgcagcgccagagtcgtcttccctgaggattctggaccgtagatttcggtgattctccccttcggaatgccgccgatgccgagagccatatcgatactcagcgacgaggtcgaaatcacgtcgacatttttctgcgcgctgtcaccgagacgcatcacagcgcctttgccgtaggtcttttcaatatttttcagcgcagtgtccagcgctttttttcgttcttcctgatctaaaattggaacgaccggttccaaaggtttttctttcttcgccatgcgcattcctccttatctatttaacattacaataaaatctctcgaatgagtccgaagaccttcaccgctgtccgagtctggatcatccgacggttgcctctaaatttgcaagtctgggtttcggttttgccgccggcgcagaccgagatgttgaccgtgcctgacggctgaccgtcatcttcttcctcgcgaatatcggaaaccgcaatgttgacgtcgcagtcggaaatccgcgccaaattttcagccatcgccccagccgtttccgcgctgtccgcgcccttggctttcagcagcgccggatctaaatccaaaaacttaactttcatctgatcgtcctcgacggtcaatcccagcttatacacctttgcgatgtcatcgatgcccgacaggactgagcccgcgatgccacctgttccggaatcggctatcgctaacgtcatgcccttcttaatcaaaagatccgccgctgtttgagaaagggattcgctggaatgggcgaaaatgtgctgtccaaaacgcctttcgatttcatcagcgtattggtcgagcagacggttcattgcgtctggatcggtgccgttcgccgtcacgcggatcagcacttccccgggttttgcgtaggttgcgatggtcggattagtctgtccgtcgaccaagtcgagaatagactgctcgaccatggattcaccgagatcgcagatattgaaaaatctggacagcaccagctgatgggtctgctttttcaaagccggaatcaccgacaaatcgagcattgtcttcatttcttccggggggcccggcagcatgaacacctgcaaattgtcctttttgatgtagatgcccggcgcggtgccccgcgtgttgtcgatggcttctgccccttctggaatgtcgcattgtctgaaattattttcggtcatcgtgtaattgtaacggtcgaaatgggctttcagattttcaacctgatgctgatcccgcaccaagggcatgccaaaataatccgcaatggtttttttggtcagatcatcctgggttggtccgagcccgccggtcacaatgatcacttcactgcggtgggccgcgatatcaaaacaggcttttaatcgttccgggttatcgccgatggtcgtctggtaatgcaccgccgcaccgattcgcgagagcttccctgaaatgtactgcgcattggtgttaagggtttcgcccgtcagcaattctgtaccgacgcagatgatttcgcaatccattgatttttccttctttcgtcaattttatagtcaaaaaaacgcctgattgaaccagacgttttaaaaatacttatttggattgaataacgtttttgttattcacaaaatattcaattccggaaataatggtcagggccagcgccacataaatcatgatattgccaagcagccacagcggataaatgtctggcagccaggcgctcagaatcatcagaatgattgtaatcatctgagaaaccgtcttggccttgccaagtttcccagctgcgatgacgacgcccgacgaagcggccagcgttctcaagccggtaatggcaaattcgcgcgcaatgatgataatgacaatccaagcaaaaatctggtgcgattccactaagcagatgaatgcggaagccgtcaacagtttatcggccagcggatccataaatttcccaaaatccgtgatcagatggcggcttctcgcaatatgaccgtcaagatgatcggaataagatgcaacacagaatatgatcaatgcaatcaattgatgctgcggaaaattaatttccattgctgcaacaaagaacggaatgcagatcattctgaaaatcgtgattttatttggtagattcatttattacctcccctattaaatcaaatccaatcgcgtctacgattttcacccgataaaaatggcctggtttgggctgcgaggtctcgataatgacgtcgccgtcgatttcaggagcgtctccccacgttctgccgatcgcgatgccgttttcgtcaatctcgtcgattaaaaccgtcatttcctggtcgatccaccgggtactccactgggtcgaaatggcctcctgctgctcgtaaatccgccgaattctctcttctttgacgtcttcgtcaatttgatccggcatctctgcagcgggcgtcccttcctcctgggagtacgcgaaggcgcctaaacgctcaaacttcaattcacccaaggtttgaagcatcgcgtcaaactgcgcttcgctttcgccagggaaaccagcaatgacagtcgttctcaaaaccgcatcaggacattttttcctaatcaaatttactttaccataaatttcttttttgtcaatgcggcggcccattctgtgcagaatcttgtcttcggtgtgctgaatcggcatatcgaaatagggacagatgttatcgtggcggttgatcacatcgagcagcttttcgtcgatgccttctggatacatgtacagaagcctgatccacgtaaagggaatgcgtccagccagctcatcgagcagatccgccaaatcgtaatcgcgattcaaatccacgccgtattgggtcagattctgcgcaacgagaatcaactcccgaacgccgctgtcgtaaagggtctgcgcctctttgagaatcgtctcaggcgatcggctgcggtgccgcccccgaatattcgggatcgcacaataggtacaatgattgtcgcagccttcgctgatctttaggtattccgtcgtctgcccttttttaacgtagcgcttttcgctttcctgtcggatttgggcgcttgtatagattttgccgtcttctttattttgaatgatgtccggcagatcgtcgatctgattgacgccgatgaaataatcgacctcaggcagctcagccttgagctcctcggcgtatcgctgcgccatacagcccgccacgacaaaggtctggcagttctcctccggatgggtccggtaaggcagcagatcgaaaatcatctcaatcgactgttttttggccgcctcgatgaaacagcaggtattgacaataatcagcgacgcctcggacgggtcgtctgtcagcgcgtaaccgcgctggagcaggccgccgaccatgttttcgctgtccacagtgtttttatcgcagcccatggtttgaacaaatacggtttgatcagccatgataattctcccttgacattaacagcttgcgcggcttgctgccgttcggcccggaaatgatcccgcggtcttccaattcgtcgatgatgcggcccgctctggcgtagccgactctcaacttccgctggaccatcgacgtcgaaatctgtccgtttgtaaaggccagctcagccgccttcggaaacagttcatctaccgattcttcggtcttcgcttcctcggtggccgtttccgccgctttgatttcctcttcgatatgtgcatcaaaggtcggcttggcgccttgagagaccgccgcaacaacccggttgatttcggcgtccgacacaaatgtgccctgaacacgaagcggcttcgatttgccaactgggaaatagagcatatcgcccttgcccaaaagcttttcagcgccgacctgatcgaggatggtacggctgtctgtattagatgctacagagaaggcgattctcgaaggaatattcgccttgatcagcccggtgatgacgtcgaccgatggccgctgcgtcgcgatgaccagatggatgccgcaggctcgagcgagctgagcaatccggcagatcgcactttcgacttctttcggcgaggtcatcatcaaatccgccaattcgtcgatgatgatcacaatgcgcggcagcttcttctggccttcgctttcggccttctgattgtagcccttgatgtctctgacgccggcgtctctgaacagctggtagcggtccgtcatttccttgatgccccagttcagggcataagccgcctttttcgtgtccgtgaccaccggaatcaacatgtggggtaaggcgttgtaaacattgagctcgaccattttcgggtcgatcatgataaaacgcagctcttcaggacttaacttgtaaatcagcgaaatgatcatcgtgttgatgcagactgatttccctgagcccgtcgccccagcgatcaaaaggtgaggcatcttcgagatgtcgccgatgacgttctgccctgacagggttttccccagtgcaaaaggcagcttcgcctgtgacttctggaaaatcggcgtgttgataatgtcgcccaaagcgaccacttcgctgaccgcgttgggcacttcgatcccaacggctgattttccggggatcggcgcttccattcgaatgtcactagtcgccaatctcagcgctaaatcatcagacagcgcgacaattttgccgaccttgacgccggatgccggctgcacttcgaagcgggtgatcgacggtccgacgtcaacgccgacgattttagcgtcgaccttaaaatctttgagcgtcgattcgatttgatgggcttttttcaccacatcttcttttttattgcccttgttgtgaacgccggggttgagcagcgccacgtcaggcttgtggtacgccgctgtcggagcggtcgtcgaagggctcggtatctcccccgagtcgtcaccgccttcctcagacgcatcgtcaaaggggacgctgtcgtcagccgcatccggcacttcatcttcttccggttcaggtacagccgcttcttccgcttggcgcagccggtcgttgcgttctgcccgagcttcgcgtttcaaatcctcatcgtccaattggtcgatgacgtcgtcaatgttgacgtactgtgtgttgactgagaccttgccgatgtcgctgggattgaacaaattgtcgtaattctgatcttccagctcttcctgctggcgtttcagttccgcttccttgcgcatcttggccagttctcgttcttccttcatggttttgacgcgttcttcaaccgcttcttgactctgggccttcaggcggccaaagaatcccggcgagacaatcgtgatgattttataaatttcaaaaatgaataaagccaataaaagaatgattgtgcccggccgcttaataatcgtcatgaaaatataagccagcagcagtccaaagataccgccgtaggcgttcgcgcccttgagcggcagcgtgaacatatccaataatgtgtactgcatcatgtgcggcacacccatgctgaacatgatgagcaggttcgagagcagcaatgcgacgtagcccatcaggctcccgtttttcttccaattttggacaaaaatcatgacgccgactaccacgaagtacatacagtaaatgacggagacattgccgaaaatgtagcggatcacgcttttgccccagatccggtcgaatagcgtcggcgttgccgtcgagtaagaataagcgctgtacaacgcaatcgcgataaccaaaatgcctatcagccgcgcttgactcggtgtcatttcctgattttctacttttttcgtgcgctttgctgtgttttgagctgccggttttgttttcttccggcttttagtctgcttttttcttgccatcgtacttcaccatcctatctgattcaatctaatggcatgaagccggcaggtgtcgtaccctgccggctcactgatgaacaaattgtgtttcaagatcactctgcgattaatccgcgtccttcggcaggcatgccttgcgggacagattaatgcggccttgatcgtcaatttcaatgactttaaccgtcacttcatcgccgatttggaccacgtcttctacgcggttgacacgatgattggctaatttagagatgtggatcaagccatccttgctgcctggaatatcgacaaaagcgccgaatttcatgatccggacaaccttgcccttcaccacttcgccaacctgcacttcgtgaaccacgtcgtcgaccatcttaagcgccttgtctgaagaggcctggtcgactgcagcgatgtagacggtgccgtcttcttcaacttcgatcttcgcgccggattcatcctggatgccaatgatcgtttcgccgcccttgccgatgagatcgcggatcttttctggatcaatgtgaattgtcgtgatgtgcggcgcgtacggcgaaatttcagctctcggttcagaaatcgcttcgttcatgatgccgagaatgtgcatccggccgtccttcgcctgcttcagggcctgggttaaaattttccgatcgataccgtgaaccttgatatccatctgaatggcggtgataccgtctttcgttccagctaccttgaagtccatatcgcccaggaagtcttccatcccttgaatatcagttaagatcgcgacctggtcgccttctttaatcagccccattgcacagcctgcaacggcctttttaatcggcacacctgcagccatcagtgcgagagatgagccgcagactgaagcctgagaggttgagccgttggagctcaatacttcggaaaccacgcggatcgcgtacgggaattcttctttagacggcagtaccggcagcagcgcacgttctgcgagggcgccgtgtccgatttcccggcgtccagggccgcggcttggcttcgtttcgccgaccgaatagctcgggaagttgtactgatgcatgtagcgtttttccgtttccggttcaaggccgtcgagcacctgagcttccttcaaaagacctaaggtcgccacagagcagacctgggtttcgccgcgtgtgaacaagccggagccgtgaacccgcggcaggtaatcgattttggcgctgaccggacggacttccgtcatctttcgattgtccgggcggatatgatcgttgagaatcaggccgcggacttcttcgcgtttaatgccattgatgaccatgtcgatttcggcttgatgatccggatccaattcaccgaaatgcttcgatgtttcgtcgatcaaatcgttcatcgcgtcgatgcgttcgtctgcgtctgcgatgtgaaccgcgtcatgcatccgtgtgcccatataatccttgatattcgctttcagttcttctgtgggttcctgaagcggatagtctgccttcggcacgccgacttctgcgacaatttcgtcgataaaatcgatgatcttcttgatttcttcgtgtgcgtacagaatcgcgtcgagcatcgtttcttcgtcgagctcgttggcaccagcttcaaccatcatgaccgcgtttctcgttccggcaaccgtcagatttaattcggaaacctgtttctgatcccacgtcgggttcagaatgaattcgccgtcgattaaaccaacctgaacggcagctgttgggccgtcgaagggcaggtcagaaatagacaaaacaatcgacgatccgatcatcccaacgagttctgacgcgcagtccatatcatcagacatgaccatcgtgacgacgtgcacatcgttgcggaatgttttcgggaacagtgggcggatcggacggtcgatcaggcgggagaaaagaatcgcctgattggtcggacggccttcacgttttaaaaagccgcctggaatcttcccgacagcgtactgtttttcgacataatcgaccgaaagcgggaaaaagtcagttccttcccgaggttcttttgagacagccacattgcataacaggctcgtgtccccatagcgcaccattgcagctgctttggccagacgggccacttcgccgatttccacacggaacggacggcctgcaatctgtgtttcaaatacctttgtctcagaaactttcattgtacctcctcaaatgatacgataacctgtcatttcagtattttctctgaaataacaaaaagggcggaacactccgcccaataaaaataattattttcttaatcccaatcttgcgatcagttcacgataacgattgatgtctttctttttcaaatagcctaacaggttgcggcgctggccgaccattttgagcaggcctcttcttgaatgaaagtctttcttgtgaacagcaaaatgctgatttaagtcattaatgcggtaagtcagcagcgcgacctggacttccggggaaccggtgtcgccttcgtgggtgccgtattctttgataatctgttctttctgttctttcgaaatcatattcactactccttttggttgatttccctgttcctagtatgtcgtcggagtgattcgccaaaccaagaacaggcttgaatgtgtgtattctatcatttcaattatcgtttgtaaagcctttatttatcggaattttcggatgtgccgtggacgtatcgatcaattaatttttcacaaagatccagcgttttttcaggcgaataatttttcgcggcctcgttcatattgtccgaaatttcatcggcaatgttcttgtgatccatcaataaatcgacaagctttggcagttcgtcaatatctttaacgaggatgcccatgccggttttttcgagaaatttcgcgttttcctcttcctggccgggatatgtgtagggaatgatcatcggcgtacctttgagcattgcctccgtcgtcgtcaaaccgcccggctttgaaacgataatatcggatgagtccatcagctcagagatattttcgacgtagccgaaaatatccacgcgggtgtgggcattgacctttagggtgtcgtaagggatctgcgccagcttcgctctcatttcctcgttgtggccgcaaacaaccattaaatgaatcgctgcctgtgtcaggattaaatttcgaaaagccggctcgatgcggccggtgcccaggctgccgcccatcagcagcacggttcccttgatatttttgtcttttggcgttttcgaagatcccttttcattaaaggcagcccgaaccgggatgccgtaagggtaaatgatgtccggcgctatgccgcgttcgatcatatcctgcttggtataatcgctgccaaccacataggcatcgacattctgactgcggtacacgccgtgaaatttgtaatccgtaataaaggacaaaaccggcgtgtgaaaagcgcccatccccttgagccgtcccaaaacattggtgacaaagggatgggttgaaatgagaagcacaggcgaatcgttcaggatcatcgacaaaatctccggcgagatgatggatgtgccgatatggaaaattgcccgttgaaatggtgtcattttatcaaattgccggtaaagcaaatcgtaaaatttcggcgtattctcgaccatccgtcgatatccgcctgtgatcattttgtttaacgtcctggacgactgttcaaaggtatctataatccgcgcgtcatagccgcggccctcaagacccttttgaatggtccgagcggctagattgtgtccgccgcccgtcgacgcggaaaaaattaaaacaatgcgttgatcactcataaatttaaagtttagtcgtcaaaatcctttgaaaatctgtagttgacgcgcatcagtttgccgcccactttcttttctctatgcttttccaacgcgtagattacaccgattcccaaagtcaatcctgccacaacagcgccaaaggctgcaaatatctttttcattgtaagtcctcctatttttatcggtaatactttctatttacttcgcagaagggtcattcgctaaaaacaacgtccctgcgttttcgccgcctacaattttgtacagcacgttaatatcctcaccggatgtaatcagcgtcggaatgccatgtccggtcgcgtagcgcgccgcctcgagcttcgtgatcatgccgccggttcccagcttcgatgcggagctgtcgcctaacgccatcagctgcggcgtcattttttcaacgacctcaatgcgttttgcgtcatcaaatttgaaagggtccttgtcgtacagcccgtcgacgtcggataaaatgacaagcccatcggcgccgatcaaattcgccgtcatcgctgaaagacggtcattatcgccaaagcgttcctcttcaatttcgtcggtcgaaaccgcgtcattttcgttgacgatcgggatgatccgctctcttaagagcgccgcaaaggtgtgcatcgcgttgtgacgcttgattttattgtagaacacgtctttcgtcagcagaatctgcgcgacgttctggtaatagctgtcgaaagagcggtgatacaattccatcaagagcccctgcccaaccgaagcggccatctgtttttcctcaagagtcgaggggcgggtttccatccgcagacgatgcatcccgcatccaatggcaccggatgagaccaaaatgatacggcgtccctcgttttcgagatcggtgagcacgcgggccatctgatccattttgtgcagatcgacggtgccgttctcatgggtcagcgaggtggtgccgatttttatcacgagaatctgagcatcagccaaattgtcatgcataaattatcctccaattccctgatattttcgttaaactcatcccagtttagcaaatttattttaaaagttcaagatcacgcaaaatactgttcagcttcagcccgaagggttttggccgcctgataaggatcgggctgggcaaacagcgccgagatcacggaaatcccgcagattccgctgccggacagctctttcatattgtccgctgtgatgccgccgatcgcgacaactggaatgtccaccgcctcgcaaatcgccttcaaggtcgcggcgtcaaccgcgtcggcatcgtctttggagccggtcggaaagaccgcgccgacgccaaggtagtcagcgccgtggcgttctgcttcgagggcctcttcgaccgttgaagccgacaccccgatgattttatcatcgcctaaacgtctgcgcacgtcgccggcggccatatcactctgtcccacgtgcacaccgtccgcgccgattgccttggcaatttcgacgttgtcgttgataataaagggcacatgataagccgcgcaaatcttttggatgacctcggcttctcgtttaaatgcgtcagtttcgagatgcttttcgcgcagctgaatgaacgtggcgccgcctttaaggacagcttcaacatcgtctgaaagctttttatttccgagccatctgcggtcggtgatcgcgtaaagtctgaggtcttccggtcttactttattttgtttcatattttgcctcctgatccaatgtcttgccgtccatatgataaatcgcgtcaataatgcgtctgcagtaggtcgcattgccttcgtagggcgccaaatgaccgtaggcgatttctccggctacccccattgtgcacacagcggcagccgcggcgtaaagccgttctgattcgggtgcggcggcagcaaaggccgtcatcaatcccgaaagctggcagcctgtcccggtgattctgctcatttcagcgcgcccattgcgaatgacaaaggcttcatcggcactgcagaccaaatcgattgcgccggtcgcgacgacgatactgccggtttcttttgaaaaagcctttaaaaaggcgatagactgatccaaatttgcctcagtgaccgcgtcgcctacatcggcgtcaactccccgcgctttgcccgactgattggctagtgcccgaatttccgagatgttgccgcggacaatatccggtttaatttcttctaagatatgctgcgccgtccgcgtgcggagcgaactggcgcctgcgccgaccgggtcaagcagcacgacgtgatttaagcgtttcgcttcatctccggcgatcatcatgctttcgatcgtgcggtgattgagcgtgccaatgttgatgttgagcccgccgcagattgccgtgatgtttttcacttcatccacttcatcggccataatcgggctggcaccgcaggccaaaataatattggccacatcattcaccgtcacgtaattggtaatgttatgaatcaaaggctgtttttcccgcgttaagtcgacgtattttcctaacatgtcttcctcctgatacaaaaaaaccgaatgtgggttaacacattcggaaaacaaaatctatttcagaccgtaactgctttttgaggcaaccgtgttcccttggaaagtaatatttgcatttgaatccgaactgccattgccctgccaataaaagatttgaacattgaccgtgttgccctgcgcgtccttataagtagattcagacaacttggaaccgtcactgccgataatctgtttgacctgatcgtacgtcataccgttggtgattttgtcgtactgggctttggtaatagttcctgcattggctgtcgtgttcgaatttgccgcagccgtcgtgccgttgttgttattgtctgtcgtcgactggttgttcgtattggacgaagacgagctggtagatgaactattggaagagctgtctttattcgagctcttcgaactcgacgatgttgtgctgctgctgtttttcgtaaagggcagaccgtgatctctaaaatacaggaaataggacgcggcggccgccacaaccacaatcgcgatcacaatcagcgcgatcatcgggccttttttctttttctttaccggtttgtctgcggtttcggctattgcaggcccttcttccaccgtttccgctgcagactgtgctgattctacgtcttcttcctgtcctgcttcttcggatggttctggcttgtagtcaattttgtccgtttccggcgattcagcttcttgcgcttccggttcctgagcttgagtttcagattcggattcatcaggctgatcagcgttgattttcgcttccgcctgctgcatttgttcttcttctaacttttcaagctccttaatgacatttttgaaaacaggcgttacagctcgtttaaaagccgtaatcatctttggatcatcaacttgaatgaccatccgcgtttttcccatttcaggaatcatataatcaatgccaatcgggccgtgttctggatgcttgccttcgatatgcaggctgttctcgtccaccataatatcttcaacgcccatattggcaagcgccgcttctgatgaacgcatccaggcatccaattgacctttggctgtaagtgcctgtctcatgtatctgcctcctgtttcatatgttttcaaacataccactcttaatttattctattccatataattttagctgtcaagcaaaataatcggtttcattgccgaataaacacattctacggatatttacaatattttagccgatctttcgctcattcatccataatcgtgtaatgcgtatccacacaatgataatttcgatcaggggaaggcgcattttgattgactttaatataatcctgtaaattctgttttaggtcctttgcgaagcggcttgcagcgatcgctgtgccagctgttaatacagcagcggtgccaagtctcacaagaccttttgtcaataaactcattgatcctcccttttctaggcaatcattttatttattattatacaatattttctatcatcatgaaataagcatttgtagagttttgaaatttaagcataaaaaaaagacctaataaattaagtcttaaaaatggcaggggcagaaggatttgaaccctcggcacgtggttttggagcacagacaccaacccgcaaaccctgtatttaagcacctttcagcgcttttcaaatcacgttgacctcaatttgacctcaacgccgatagcttatctttatggtttaagtttaccgcttcactgccattttgtaaatgttatttatttcttcgtcgctgttttctgtttgtgttcctttcgcatatgagccaaaaagcgtggcttcttttatgccattcttttcaaatactgctatcagaagccggataatttcttcttttgctttcataattgcgtcacaatttacagatatttttgtttacagcgctgtctttcccatttatccagatcgtcagcgcggatgtaccagcgtgatttaggtgcgtcgctcaaacgaaatgctgggaagtcttcgcgatttaggagttcataaatcttatcatttgaacagtggtaacgctgtttaagttctttaattgtcagcaaatcattcaaaagttatcaccttcttttacatcttcgacataagaaaatccaagttgcttcatttctttctcgacttctcgatcttccggtgttttccaagcttcctgttgaagtgttttataatcgatgtattttttcgccggtagttcaaaagttttatattcaccgttttcaatataatgaaaaacaataacgtcaatacggcggataagttgcttcaggctgtcacgatcacgatcttcaggtttgaccatttttgtatatgcttcttcagggccataaatagatgtgatatgtacttcatcccacagtgattttatattggagtatctcgcatgcatctgtgttttgtagccatcaagcatggtcagaaaaacttgataagggaaaccgcctttatattcgtcaacgaacaagatgtgttcgccgcaatattcgtcaaaagcgcccatggtataatcagagagcagatagacatcatcttcaccgtattcttcgcaaagtttgacgtaagtatagcttttgccagtcccgctttccccgcaatgccaataaaccttgacttgacggatcggttgcgtttctttgcttcgttttgcaaaataagatttacggattaaactttcgtattttctgtattgcaatccgtagtccatgatttcatcgggtttaagtccagcatctatcaatgcagaaatcatttcaaaagtttcagcttcatgcgcatacgcagtcggtggtgtccggcctttaatttctccataatattgcggagcaacaataagtgtatgatgcttttcttcaaatttgccttgcttatgaatatatttttcggcttgttcttttttgccgcgagtcgcttctatgtgcattgtcggaaacagtttctttacgacggaaaatcttgttggatttttgctttccaagacacaatggcagtgtggtgttccggtgtcgctgatctcatagttgacagcacatgtccgactatcttcttttccgtcaatccatttgtggatcactgcttgaacgatttgttcaggtgataatttatctccaaattgcagctgtgggttatttaaaacacaaaaccatgaacggctttgtgatgttgattttattgattttgtcatttctaagttgtccttttactatctctttggttcaggttcagtcaacggttcagccttgaatgcgttgatatgactgcgattagaatggttcaggacggggtaatactatgcccgtcccatcatctggggcacgctccgctctgggcggccttgccgcccaggccccacaatcaattcaaattcttttgctgtttaactttccaaagcagttcttcgatagttgacacatcatcaatccatggggcatcaaatgtctgcgggatggaatagccttgaccggggacataaagataacctgatccggcgggtctgtattcgtatcgcatgccaggttgagagccaaaaaccatcgtataacctgtgctatccatttggcctaaaatcgccctcatagaaagttgatctcttatgtcagtagaaagaacctctgcagatggtttttgcatcgcaatgataatgaaacatccggcttggcgtccaagtaaaatgattcgcctgatatacttctttgcttctttcaaaagttttttgtcatcttcaatatcggcgatataagccgcatattcatcaaaaatgactgtcagaggctgtaagccaagatcacgatatgtcactccaggctgtccaaacgcatccatccgctcgtaacgtgccatcaattcatcatgtgtttctcgaagtagtcgcccgacttgtcccggcgtcgtcgctacatgcgtttcaggtaatagacgtttcgtcacttgataaaggtcagaccgttttggatcaattactcggatctgaccccgtttataaagttctaacaacagatataaaagaaaacggcttttgccaccgcctgttacgcctgacaccaaagcgtgcggggcttggtcaatattccagaccagccccggcgcaatagttatgatattgttaagcatcgacggttacacgccgattctttagagtagagaaaatgtagtcagttttgtcagcatggatttgtttatccacataacgaagaccagagaaaagcgaacttagttgtacctccatctcctgaatggattgtgaataaggtagcccgtgagcgtccaatgaaatgatcacatcagttccgtcaagatgataacttgctatgacactgtctgtgatgcgacctgctgtatctgtaacataatcgcgattcacccaaatgaaatggcttaatccgcttatcatctgtcgatcccaccgatcataaccttttactgcaaggattattttgtcgcggtaaagatacatcaaggtaacggcgatcacagcgagcgatccaccaataccagagtcgatatttattttggggtagtagacgtgaagcgcaatagaaagaacaattaccataattgctacgatcatgatgattgctgccatcatgttaacttcgtaaagtttgttcgatttaatgctaacttctttttcatcaccataagctttgacacatggtatatagtcattaaaatttcttaacatttaaaagtcctttcattgatatgcaccgccgacgatatatgccagcggtgcttgctgaatacttttagaccagttcgattgattctgctgcgaaggtcacgccagcgttaccgccgacctgccagatacgagccgacagacctttcactttgacctgctttaaaccatccgacaaaacaccagatgagaagacaggcggaccagccatcgtcacacgcaggcggtcgagatcatgtttcagagaagcaatctgataatccacgcgaccatcggccagcgcctgcatcttggtcaacaaaaatgtttcgccatagatggaagtgtcgatgacgacatccgtaagcggcagttgctgtaagcggcgctgcgcctgttgcggctgtgggttgacaacatgttcaaccggcgttggcttttttggtgcttcgaccgctttttccgtagaatcaacggaagctttcacttcgttggaattcattgctgtaggtttgtttttttcaaatgccatataaatggcctcctaattttagaaatgtttttctcgagataaaacattgaatccgtgacggattctgctattattatgcgcctaataattggacacggtgagacaccaaaaaagcctctctgaaattctcagagaagcttggaatttagccatgatattgttttagaatatttttttgtatttttggattgagatcttcaattatcgccttttttaaccagcgcttgatcgtttttctgctgacgctttcttctgattttccaggaaataccgttgctacttctacctgatccagtccaacaagataatataaaataaacgcacagacgattcgtgaatctttttcgtattctaaaatacaaaaggcagcttgttttgttaattgagcaagaatttgttcctttgttacacaagaaatcaatatagaaagttggcagcaatttttattcaattcgtttagtttggtgctggaaatatcctctgatttgagaattacttcgactaatttcttttgctctgataatttgcggttaagttgatgttttagttcattatgatcagaatataattgttgatcttcaaatatttttttaatgtaggatagtgcttcggattgggttatatgatcattatccttttcattgatttcttcataaatggttaaatcatattctgataatccagataatttcagcgattgattttgtaataagatttcatcaattttttcaaaaagttcttcttgttcgcgtgtatacttcctttcggacatagttgtagcggagaaacgcgcaaatgcagggacttatatttgcgcacgtagggactttaggacgacgatcgcccaaggtcatgatggaacataacctgtaatgtcaatatataaatttctccgcttatatcagatgacatctaaaatgtgtcatctttactctttatccctgcatcttccctattccataatttttatttctccacttttttcacatacagcgatgatgcgtgctcttttgcttatcgcatccgcgcgagcacgctgtcatcatatcgtccaactaagattgagcgacgctttttccatagcaactaaaaaaccgcacaaattcattctgactttggttttcgttaacatctatcagaatgaacctgtgcggctcgttcttcatattttatcctatttttagcataccttaacaaaggcatgtacattttaaaaaaattttcttatccctacagataataagtctctcaaaaaaactttttaaatcatcccggtctgcttcagtatggtacgatcggacagcttactccatacctatcgtgattcgcttcacgcaactggtacagcaacttcagtaccaccggcctgtacactcgccgttatgatacctgcatccattatcctgcaatggcataattgtaatatatcacatttcatgatttttgtcaaattagctttatggtataatgaaaatgatttaagattagagaggatttaacatgacagacgcagaacagcgcgaagctgcgcgacaattcgcgaacaaatggaaggacggcggggatgaaaaacaggactgccatccgtactggattgaattattgcaggatgtgctcggtgtggcgcacgtcacgaattatattgatttcgaaaagcccgtaaagctgccggaaggcgacggcaaaatccacacgcgctacatcgacggctacatcgcggacgtgaaagttttgatcgagcagaaaggttctgttcatcaacttgacgaaaaagagccgcaatccggcggcgggatgttaacgccttacgagcaagcgaagcgctacaacgacaatctgccgtttgatgaaaaagcgcgctggatcgtgacttgcaacttcaaggaaatctggatttacgacatgaacgcccgcgtgccggagccggacaagatcgccctgccggaactgcccaacaaagtaccgatgctcaactttctcgtcaagcacgacgtgaagcagatttcgcacgaaatgcaggtgtctatcgccgccggggagcttgtcggcaaaatctacgacgctttcgcaaagcagttcggcattccggataaagtgccgaaaaacgaagcgccggaacaaaaagcccagcgcgaagccgatttaaagagcttaaacgccttgtgcgtgcgcctcgtcttttgcttttacgcagaagacgccgggattttcgagcgcgcgtcattccacgattatctcgcgagttttgagccgtcacgcctgcgcgaagcgctaaaaaacttgtttaaaatattggacacgccggtgaacgcccgcgaccgcttcctgaccgacgaccttgcggccttcccctacgtcaacggcggcctatttgcggacgaatccgtcgagatcccgccgattacagacgcgttaaaaacgctgctcgtcgtcgacgcgtcggaaaactttgactggcgcgcgatatcgccgacaattttcggcgcggtgttcgaatccacgttgaaccccgaaacgcgccgcaagggcggcatgcactacacctcgatcgaaaacatccacaaggtgatcgacccgctgttcttagacgatttaaaggcggaactcactgacatcctcgccatccccggcaaacgcaaacgcgaaaacgcgttaaaagcgtatcaagacaagcttgcgtcgctgacgtttctcgacccagcatgcggttccggcaattttttaacggaaacgtacttgagcctgcgacaattagagaaccgcgtgatcacgtcactttccggcgggcaggttgtgatgggcgaagcgtttgacccgattaaggtgaaaatcaaccagttttacggcatcgaggtcaacgattttgccgtgacggtcgcgaaaacggctctttggattgcagaaagccagatgatgcaggcgacgcaggcgattatccatcaggagctggattttttgccgttgaccaccaacgccaacatcgtcgaaggcaacgccctgagaatcgaatggcaaagcgttgtcacagcggaaaagctaaactacatcatgggcaatcctccgtttgtgggtgcacgcctcatgtcaaaagaacaaaaggctgatattgttgatattttcggaaaaatcaagaacgttggcaacttggattatgtcagtggctggtataaaaaagcaagcgacatgatgcagaacaacgccattcgtgctgcgctggtttcgaccaattctgtttcacagggcgaaacggtcgcaaatctctgggaaccgctttttgccgatggtgttcatattgattttgcttacagaacatttaggtgggacagcgaagccagtgataaagcgcatgtgcactgcgtcattatcggattcagtacggcgaaaaacgacaaaccgaaagttatttatacagacgatcagaaagaaaccgttggtcatatcaacgcttatttgattgacggtgaagatatttttgtagaaagacgaactaaaccgatttgcgatgagcctgaattattaacaggaagccaaagaatagataataatgaatatatatttaccaaagaggaaaaagaccattttatacaagatgagcctttgtcaagaaattatttccatcgttggtatggtgcagaagaatacataaacaacaaagaaagatggtgtctatggcttgggaactgtgaaccacacgaactaagaaaaatgccaaaagttcttgaattagtaaagcatgtaaaggaatatcgagaaaaaagtaaaagaacagctacaagaagagcggctgataatccaacgcattttggccttgaagttattccagattctaattttatcattattccggttgtatcatctgaaagaagaagatatatccccatgggaatcatgcaaccaaaagtaatttgcagtaatcaggtaaacttaatcccgaatgcaactatttatcattttggtattttaacatccaacgtccacatggcctgggttcgaacggtttgcggtagattaaagagcgattaccgttactcaaaaaacatcgtctataacaatttcccctggccttccccgacggatgcgcagaaagcgaaaatcgagaaaacggcgcaggcgattttagatgtgcgcgcggattttccggacagctcattagccgatttatacgatccgctgaccatgccgccaaaactcttaaaagcccaccagcaaaacgaccgcgccgtcatggccgcctacggctttaccaccaaaatgagtgaagtcgactgtgtcgccgcgctgatgaagctgtatcagggaatgacgaaaaagtaacaaaacgaatagcgtttatgttagaattcaatcatgtttaatccagacgtaaaagatttaggcacgctcaatattgaaatttaccgctgtatcactgaagaaatcgcgactgatcgtgtcattatatctgaagaacaactcacacacatggcaaaacatcatccagaagcgtacgaagaaacgctgatcgatttaaaatcaactatccaaagcccggagtacattttcaaagatgataaacatgcaaatacagggttagtcgctaaacacatcaacgcaaataacgaaagtttatatatcgtgttgcgtatttgcaccaattcaaaaggaggctctttagctaactctgttatttcaggatggaaaattagccaaaagcgccttgaaaactacttgcgccacaaaacggtgctttacaaaaatgagcaatcctgataaaataataatataaaataactgaaaaacatttgaggtggtaaatttcgttgcaaccacgcgccccttgggctaaaagagatgcaggagcggcgacgcctgccaaatgtttgattgtcagtatggcgctggccaatttggtcagcgtcttttttcgaccatttttaataggtgcaacagcttgctcctcaacttggcacctcttgtcacttgctttccctctgggctttttcattgtaccacgctgctcagccggtcaatagcaaggtcttgcgaccgattattggaaaacaaataagccatagcccattcacaccatatattcaagtgtttatgtactatggctttttgtttttgccaaaaatcgctattgacagtcttgcgctgcgtggccgctgtactttcagcccaagagggcaaattcacttaaaggagtacagcaaaatgactaaagattcaacttatcagggatggcggaattacgaaacatggtgtgcagcgttatggatgaataacgattacggcttcggcaccgaagtcaccgagtatatcagtaccatcaccaccgatggcgattacgacgatctgaccggtgaacttgcattctacctgcaaaactacgcggaagaaatcacaccagatttaggcgcttcaatggctgcagacctgctcaattacgcaatcgagcaagttgacttttacgaaatcgcggaaacctacttgatggattgaggggactcgttccccttttttggtcggtcagatgttatcgagcttttgcagttccttgttcagtttattctttgataggccgatataaatgtcaagtgtcgtttggatagacgcgtgaccaagtaattgtgacacaaccttgatgtccatatcccgttcaaaaagctgcgtcgcaaacgtcctacgcaaggtgtgtgcaccgcgtttctttggatcaatcgcgccgtttgtcgcagcaatcactcgattgtaagtttttgtcaaaaccttcggactgagcacaccgccacttttgctcgtgacaactttatcccttggtttttccgcatgattagcatcaatcaattcgagtacgcattttcgcgcaatatcatttaacggcaccgttcgattcgagccttttgttttcgtcgaattttggataactggtttcgtcttttcaaccaaatcagaatccacatcctgtacatcaatcacagtatggcgaacgtgaatagattccggctcatgcttgtcgtcaaagttaatatccccgtaaagcaaaccgcaaatttcaccaggacgcaatcccgtttggagttctaacatcaatgcccagcgatttttgccgtagcaataagtaccatttttgtacttaccaaataattcttttttaaaaacggtgatttctttgtcatcaagaaatagcaccggatgatcagtacccgtgtcatccgatggaactgggatcatatcacagggagactgcataatcagttcgcccttcgcaaaattacacatggcgcgcaccgcataataagctttacgccgggtgctgatacttttaccgtcatcctgcaactgttgcaacatatccaagatattatatttggtcaactgttgaacattaacttcgccaataatcggaatcacctgatattcgactgttttcactaagcggttaaagctgcttgttttaagtgagagtttttttgccgggagaaaatatttgcgcatataggttgtaaccgtgatggtagaatgtctggaaggcatgatcgcaatatctttgagatatgcttcatatttgcggtagacttctgctttggaatgaccgtaaaatgatttgcgttttttatcaccattcgcataagtgatcgttttagaaagttcccagcggccatcgctgcgtttccgtaaataccccataccgttaccatttttagaagtttttctcatatcaaaatacctcgatctttagatttaaagataaggtaacgcagcgttgcggacaccgtaggacacttaaatttgaccgcaattttgaccgcaataagtgcggaaaatgcaggaaaaaagcggatattgttcttaatttaatacaatatttctttttagaaaaacgcatgaaaaaaccggaaacccacataaatacaaggcttccggctacattttaaacataaaaaatggcaggggcagaaggatttgaaccctcggcacgtggttttggagaccactgctctaccaactgagctatacccctgcaaggaaatggtgatccatcggggatttgaaccccggacaccctgattaaaagtcagatgctctaccaactgagctaatggatcataatggtggggaaagatggattcgaaccatcgtagactaagtcaacggatttacagtccgccccctttagccactcgggcatttccccgaacattagaatggagctgacgggcggacttgaaccgccaacctgctgattacaaatcagctgctctgccaattgagccacgtcagcatattaaaatggcgaccaggatgaggttcgaactcacgacctccagcgtgacaggctggcattctaaccaactgaactacctggccgctaaaaaattggtgacccctgggagattcgaactcccgtagccgccgtgaaagggcggtgtcttaaccgcttgaccaaggggccttaaaatgacttaaaaaacggatatggaattgaatgaactccatatccgctaattttcaatggctccccaggtaggactcgaacctacagcctatcggttaacagccgagtgctccaccattgagctactgaggaacaataagatttcgcaacgatctatcctcccaggcagctgcccgccaagtactttcgacgtgagagagcttaacttctgtgttcgggatgggaacaggtgtgtcctctctgctataatcacgaaatcattattaactttttatatggtaacatagttcaaaataatttgcaaggattaatttgcttattaaattgaatgtctaggtcactcaaaacaacatagagttttttaagcgcttaacacgtctttggatcaagacctcggccgattagtactggtcagctgaacacattgctgtgctttcacctccagcctatcacctgatcgtctatcagtggccttactccctttaagggatgagatatcttatcttaaggggggcttcgtgcttagatgctttcagcacttatcccttccggacttggctacccggctgtgctcctggcggaacaaccggtgcaccagaggtccgtccgttccggtcctctcgtactaggaacagctcctctcaaatttctaacgcccacgacggatagggaccgaactgtctcacgacgttctgaacccagctcgcgtgcctctttaatgggcgaacagcccaacccttgggacctgcttcagccccaggatgagacgagccgacatcgaggtgccaaacctccccgtcgatgtggactcttgggggagataagcctgttatccccgaggtagcttttatccgttgagcgatggcccttccactcggtaccaccggatcactaagctcgactttcgtccctgctcgacatgtctgtctcgcagtcaatcacccttctgcctttgcactcttattgatgatttccaaccatcatgagggtaactttaggcgcctccgatacattttaggaggcgaccgccccagtcaaactgcccatctgacactgtccgaagactggtttcacagcgctttgttagaattccaatatctcaggggtggtatcccaacatcggctccagctatgctgacgcacaactttctcagcctcccacctatcctgtacatgacatatcgaaatccaatgccagactacagtaaagctctacggggtctttccgtcctgtcgcgggtaactcgcatcttcacgagtactacaatttcaccgggtgtgttgtcgagacagtgctcaaatcgttacgcctttcgtgcgggtcagaacttacctgacaaggaatttcgctaccttaggaccgttatagttacggccgccgtttactggggcttcaattcgcaccttcgcttgcgctaagtactcctcttaaccttccagcaccgggcaggcgtcagcccctatacttcatctttcgatttagcagagacctgtgtttttggtaaacagtcgcttgagcctagtcactgcgacccctttcggggcactccttctcccgaagttacggagtatttttgccgagttccttaacaacacttctcccgctcatcttagaattctcttcctgcctacctgtgtcggtttgcggtacgggtgatcccttactcaatagaagtttttcttgacagtatgagtctgcagcttccctacttatttttcgttccccatcacacctcagccttgtccaaagggatttgcctccttgaacagcctcgatgattggcccgggtcaaccaacgcccgggtctgctttcccgcctgtgtcactccatctctcaaacataagtgatcagtatcggaatttcaaccgattgtccatcgcctacgcctttcggcctgggcttaggtcccgacttaccctgagcggacgagccttcctcaggaatccttgggcttccgatggtgaagattctcacttcactttcgctactcatgccaacattctctcttctctttcgtccacgataccttacgatatcgcttcgccctacaagagattgctcccctaccactatactataaagtataatccattgcttcggtgactgatttgagccccgttcattttcggcgcaccgccactcgaccagtgagctgttacgcactctttgaatgaatggctgcttctaagccaacatcctggttgtttatgcagtggcacatcctttcccacttaatcagtacttagggaccttagcagatgatctgggctgtttcccttttgaccatgaaacttatctcccacagtctgactgctgcagatggctgtacggcattcggagtttgatatggttcagtatgcattttgcaccctacccaagtcagtgctctacctccgtcagtcttactgcaacgctagccctaaagctatttcggggagaaccagctatctccgtgttcgattggaatttcacccctatccacaggtcatccaagcctttttcaacagacactggttcgggcttccacacagctttacctgcgcttcaccctgcccatggatagatcacacggtttcgggtctacagcatacaactagacgccctattaagactcggtttcccttcggctccacacctgaagtgcttaacctcgctgcacaccgtaactcgttggcccgttctacaaaaagcacgccgtcacttgcgctccgactgcttgtaagcatcaggtttcagtttctatttcactccccttccggggttcttttcacctttccctcacggtactattcgctatcggtcaccggttagtatttagccttggagggtggtccccccatgttcccacaaagtttcacgtgttccgtggtactcatcgtaactcccacttaagttatttcgcctacaggactctaacctcctatggtcagctttcccaagctgttcggctataacctaagctttttcattactgggctgttcctcgttcgctcgccgctacttgaggaatcgcgtttgctttcttttcctccgggtacttagatgtttcagttccccgggttccctctgtgatgctatcagcaagctgtttcacatcacagtatctggcctccagccagatgggtttccccattcggatatccgcgtctcataagattttaagctcctccgcgcggcttttcgcagcttgtcacgtccttcttcggcttccggtgccaaggcatcctcctgatgctcttgttctcttgatccatttaacaagatatggttctcgtagctttcatcgttctttatgaacttgaaattgtgttaattgctttttctctatgttgttttcaatgacctttgtcatctgtaaaaaagataacatggtgggcttgggaggacttgaacctccgacctcacgcttatcaggcgtgcgctctaaaccctgagctaaagcccatgactgtaaatggtggagatgaggagattcgaactcctgactctgcttgcaaggcaggcgctctcccaactgagctacacccccattacagaatggtgtacttttgttgagcaagtcacacaaaagagaatgtaccatgactccctgttttctccctagaaaggaggtgatccagccgcaccttccgatacggctaccttgttacgacttcaccccaattaccgatcccaccttcgacagctgactccttacggttgtcacactggcttcgggtgttaccgactctcgtggtgtgacgggcggtgtgtacaagacccgggaacgcattcaccgcggcattctgatccgcgattactagcaactccatcttcatgtaggcgggttgcagcctacaatccgaactgagatctgttttgtgggattcgctccgcctcgcggtttcgctgccctctgttcagaccattgtagcacgtgtgtagcccaggccataaggggcatgatgatttgacgtcgtccccaccttcctccgtattgtctacggcagtctgtttagagtgcccaactgaatgatggcaactaatcacaggggttgcgctcgttgcgggacttaacccaacatctcacgacacgagctgacgacaaccatgcaccacctgtctctctgtccccgaagggaaaatcttatctctaagacggtcagaggatgtcaaggcctggtaaggttcttcgcgttgcttcgaattaaaccacatgctccgctgcttgtgcgggtccccgtcaattcctttgagtttcaaccttgcggtcgtactccccaggcggaatacttattgtgttaactgtggcactgacataactgccaacacctagtattcatcgtttacggcatggactaccagggtatctaatcctgttcgctccccatgctttcgcacctcagcgtcagtatctgcccagcaagccgccttcgccaccggtgttcttcctaatatctacgcatttcaccgctacactaggaattccgcttgcctcttcagtactcaagtcttacagtttcaaatgcacgtcaccggttgagccggtacctttcacatctgacttataaaaccgcctacgcgccctttacgcccagtgattccggacaacgctcgtcccttacgtattaccgcggctgctggcacgtaattagccgggacttcctcattgggtaccgtcacttcttcttccccaataacagagctttacgatccgaaaaccttcttcactcacgcggtattgctgcgtcagggttgcccccattgcgcaatattccccactgctgcctcccgtaggagtctggaccgtgtctcagttccagtgtggccgttcgccctctcagaccggctacctatcgtcgccttggtgagccgttgcctcaccaaccagctaataggacgcgggcccatctttcggcaccggagttttgattatttcttcatgcgaaaaaataatgttatgcggctttactcccggtttcccgaggctattccgctccgaaaggcaggttgcccacgcgttactcacccgttcgccactatccacttcttaaatctcccgaaggatcattaacaagcttctcgttcgacttgcatgtgttaagcataccgccagcgttcgtcctgagccaggatcaaactctcaagtaaaatttactcgaacagctttcgctgttttaagttctatctggttgctttgtttatccacagtctgctctgtgcttcgatttgaaagcagttctcactgctccggaatctaaaggttttttggtttgtgttttccaggttttatggtactattctcttttctatgacctgctgtcgcttcaagcgacaacttctttattttaccagctctcttcgttcttgtcaagaacttttttgaagttttttaaatttctttcaaaatttttaaaatccttctgccgtaaatgcgctgaaacccgcttatttacttgctttcgagctgtttaagttgtggctgtctctcgcgacaacgatatgtattatacagcattcgtgtcaaacttttttgcagatttttttaaattattttcagtttcttttgaggtcctatttcttcgtaaatcaaccggattctggagcactctccaggatccggtcttggcctctatctataatgatagaatcgtgattctcttcacaaagaattttctgcatcttgcaaaaacgtcactttccatcccgaggtggaatacgccccggccacaacgacttcgtcaaagcaggccgtgcccattgcgtcgacgcctgtcggacttccgccgctgcgtgttctacattgagacagcacgcctggtacggatcggtttctccgccggcggccttcgcgattttcgcgacaatgtgctcaatgtgctcgccggtctcatcagccaacgccgcaccgaccgcgccgcagccggtgtggccaaggatcagcaccagcgcacgccggatgatcgaccgcgtactcaatgctgcccatggttttcgcgggccgacagttgttgcccgctgttcggatacgaacaactcgccctccccgcgccaaaaaccgcttcgggcacaactcgggaatccgaaacatcagcaccaccgcgtaaggtgtctgaccgcctgagcccataacgcttgcctggcgacaaatcgccttcagccccgtttcgcgccaagccgcgttgccggcctttatttatttagcgcttctgcgcctgatatgatcgagtccatcattttctctccttttgttttatcgtttagaaagacagggggcctattccaagatagatttcatactagtggcatttgtgctgctaattctaaataaaaccatcagtcacgtttattttcaccaaaagcgttttgtcttctgcgtccgacacttttcacctgtatcaaaaaagaccaacaacagcaatgctctggtcttttagctttaaactcagtcctaaggtctttaagtttcgtcgatggacgcagcggcttcttgccggcacccatcgcgaggataaccgtctctgcgctgaaaccgcgtcccccgccgcgaaatgcccttgctggaggtcgcgccttcgtcgtctgcgacgatacatgtggcgtttgttgacttccaagccttctgtcgtcgacgagatcagcgggtttcggcgaggtgccgaggggccattgatgacggtatcgacgtcgattcgtattcgctcctgggatttccactggacggcggcggccgtattcatcagcttcgccagttccattttgataacgcggatcccttgacccatcgttttcttctacaaggatttcgacggattggctcagcgtgaactgatgccttcttctgttgttagcgttatgcacttcttcacacgagccctgcagtgtccgctcgcttctgcggttaaacgatggtgggtgtcccgcaccgaggcgcacgccgttctcgccgcatccccccccatcggacgttgccgccgccactacgacgacctgcttgcctctgtggatcggggtgtcgtagccctatgaattccttcatcagttttgttgcggtcaggtataagggggaggaggaagataagggggggaatgtttacaaacccaggaagttcaggaaggag

SEQ ID NO: 15 - DNA, 600334 bp, Unknown
  Metagenome-assembled genome
ccggaatctaaaggttttttgttttgtgttttccaggtgttaatgtactattccatgacctgctgtcgcttcaagcgacaacttctttattttaccagctctcttcgttcttgtcaagaacttttttgaagttttttaaattttcttttcaaagatttttaaaatccttctgccgtaaattgcgctgaaacccgcttatttacttgctttcgagctgttaagttgtggctgtctctcgcgacaacgatatgtattatagcaaaattgaaattgtctgtcaagaacttttttcaaattttactgctttttgatgagcgcttcatgtctcactcagaaagcttttttattttattgttttatctgtgatttgtcaagaactttttaaaaaatatttgtatttttttattttaatgctatacttgcattatatgaacacacaaacacctattaaaatcattgcaaagaaccgcaaggccagacatgattactttatagaagacacctatgaagcaggcattgtattggtcggtacggaagtcaaatcgcttcgccaaggtaaggcgagtttaaaggaaagctttgccgattttaaagatggagagctttatgtctatcagatgcatatctctccctatgaacaaggcaacatttttaatgtggatccgctcagaacgcgaaagctgcttcttcataaaagagagctgacgcgtctgtacggtttgaaacagcgtgaaggttatacacttgttcccttgtctctttattttaaaaatggtaaagtaaagctcgagctcgctttggccaaaggcaaaaagcaatacgacaaacgtgacagcattgcgaagcgtgatgctgaacggcgcatccgccgccaaatcagacggtaatgcgccgcattattagaaaggggatgtaaaggtttcgacggggataccgataagttgtaagcgggcaagtgcgccggtcactttaaaaaacaggcacttaaatttaaacgcaaaagataatcaaacaactggttatcgtatggcgttagctgcttaagcagtttaatatacgataatcaccgcagctcaatagcagctgcacgtccccttgggttcacctgctggctcaaggctgacgttcatgaaagcagggatctgtcattgggagttgttccgacccattgacaattcaggaactggccgaaggaggcggcgctgctgagcgcttccctcggtgagatcaattcagcagatacgctcgtagaaagcatcggggacgtattttcggacgtgggttcgactcccaccatctccaccatttaaaaaaataagactcagattctcatttggaatctgagtcttttattttgatctgaaagtgtttgagaaaatcctctaaatgggtgtgaaaagactgcgcggtatcagcctctgtcagcaggaattttcgggtcaccatcaaaattaatatcgcaacgacgtacaaaagcgtttgttcgccgcctgtgtgtccggcgatcatgcctcgagcaatggcgaaaattaacgcctccagcacagcctccatcgtgtgcgtgtaaatcatcttgataaattccgtgcagatgatcaggttcaggctgagctcgagaaaatgctgcagcgtcttaaacgaggtggtcagtgattcgtcgacgtgaatatgacagaacaggttgacgagattaatcgcgataaaaatcaacaggaccagggcgatccccaattccaggatttccaatgcagcctggaaaaatgccatcgcgtttttcttaaaatttttcataagattttggttctcctttccccgtattgtaaaggaggtacataaaattgtcaaatacattgatctgtgataaactttgattgatgtaatccattcacaaagattcataaaggaagctgatcacaatgaaacgaaaagattatctgaactgggaccagtatttcatgggcatcgccatgttgtccgcccagcgcagcaaagaccctcacacgcaggtgggcgcgtgcatcgtcagtcccgataaaaagatcctgtccatgggatacaacggcatgcccatcggttgtgacgacgacaagatgccgtggacaagcgacggtgatcccctcgatgccaaatacctctacgtctgccacgccgaatttaatgccattttaaacagcggcgccaaaacgttaaaggacgcgacgatttacgtcacgctgttcccctgcaacgagtgcacaaaggccatcatccagtgcggcatcaaaaaagtcgtctatctcgaagacaagtaccccgattccgacgccgtcattgcgtcaaagcgcatgatggacatgaccggtatcgaatacgttcaatatcccaagcccgagcgcgaaattaccctcaccctttaaaaaacagccgaagatctatccgtgatcttcggctgtttttctatccaaatactttttctgcgatagccacaccggacttcgcatcgcttccataataatccgcgtggattttttcagcgtactcgctgttcatgaccgcgccgccgaccatcacctgtatgctcggatccgcggccttaatcatctgaatggtcgtttccatatttttgaccgtcgtcgtcatcagcgcgcttaagcccaccagcttgacattgtttttcacggccgtctcgacgatcacttccggatccacgtccttccctaaatcgataatttcatagccgtaattttccatgaccgtctttaagatgtttttcccgatgtcgtgcacgtcgcccttgactgtcgccaaaatgaccttatccttctgcaccgacgattcggtgcccatgtgctgtttgaggatctcaaaggcgttttgcaccgtttctgccgaaaaaatcaagttgggcaggaaaacgtcgccagtttcaaataaatcgccgatttcgtccaatcctggaatcaaatcgccattgacaatgtccattgggctgcaggtctcaagtttcttcttgactgccggtacaatttcttctttcagaccgtcgacgaccatctgttttaagtctaagtgatcgtcgtctgtcggctcaggctgattttcgctctgaggttggacggcgtcctgcttttcttcccgaaccacttcaatcttttgcttgtcgtccttgtgcgccgcgacataatcgatacatcccacgtcaatgccggctaaagccttgtaggcggagatggtgttcatcatttctggatcgccgacttttagaattggggtgtcaagacccgctgccagcgccatcgtcaggaacgtcctgttgatcaagcgtctgttgggcagtccaaaggaaatgttgctgacgccgagaaccgtcggcacgccaaatttatctttgacgagggtcagggcacggatcgtttccttcacagcctgctgctgggctgaggcggtgagcaccagacagtcgatggcgacattattttgagcaatgccgtatcccgccgccgtactgatgattttgtctgcgacctctacccgcttctccgctgtcttgggcagcccactgtcgtccagtgccagtccgagcactgcggctccgtatttggcgacgattggcagaaccgcgtccaaagattcctgcttgccgttgaccgaattgatcagcaccttgcccgggtaggttttcagtaccgcttcgatgacttccggctttgtgctgtcgatctggagtggcaggtccacgacctggctgattgcgtgcaccaccttgaccatcgtttccgcttcgtcgagctcaggcagaccggcgttgacgtcgagaatatcggcaccctgccgcttttgttcaatggccagctgtttcacaaccgacaagccgccctttttcaggtcttctctgtaagcggcgttcgccgtcgggttgatgccttccccgatggtcctgatccccgtcccaagggtcacggtccgggtggtcgacgcgatgcgcatcggctgcggccgctcccagggttttataagcgggagatctctcgtcttttcaatggttttcgcgatgtactcaggcgtcgtgccgcagcagccgccgagcaccgccgcgccgatttccgcgatctgcttcataatatctgaaaaagtttcagccgacacatcgtacacggtctgcccatccacttcccgcggcagccctgcattcggttcgacgacgattggaaccgacgccgtatcgactaatttttcgacgatcggcagcatttcttccgggccagtggagcagttgatgccgatcgcgtcgacgccaaggctttccaatatggtcacaaccgtttccggatcgctgccggtcagcgtccgtccgctcgattcgtaggtcatcgacgcgacaatcggcagatcgcacgcccgtttcgcgccaatcaccgccgcgcgggcttcgacgatatcggtcatcgtctcgatgagaatcagatcggcgccggcttctgcgccggcctttgccgagcgttcaaaacaggccactgccgcttcaaaagtcatatcgccaatatcgccaatcaacgcgcccgttggcccgatgtccatcgcaacgtatcgcggatgctgcgccttcgcaattttcacggcctggccaatcacctcttcaactgaatatttagacgccgccattttgtgggcgttggcgccaaaggtattggacaccaaaatatcagctcccgcctgaacgtaggccccttggatttccccaatcagttcagggtgggtgatgttgagctcttctggaatcggtcctggatcggcaatgcgcttttgaatcatgctgcccatagccccgtccagataaagccgctgcgtcttgatttcgtctataatctgcatctgttttatccttatctcttaaaaatttaattcaaaataccataaaagcctatcaatctcaagggtaatataaaaaaaccacctgctgaaagcaagtggcttggtctaaatctcaatcttttgggtgcaactccccaaaggcttttccccagatttcctcgtagcgtctaaaagtcgtcatctggcgatagggcagcttttcaatccagccgccttcgtagatctccttcgcgctgatccgcagcacaccgggccaataaatcgaccggcgtctgtcgtggaatgaaacctggacttctctgaaaatcctcggatcccgcaggggattgatttctgggtcggtgtcaatcagcggctgcatgtcgtagcgcttgacacattgattctgaaaatggacttcgatcacatacccttccagcgggatgacctgaacgattgccggtacctgtgacatattaacctctttcgctctgtgaatgtctgatttttaagcggcgcactaagagcgccgcttaaaaaccgcttacgcgtcaactgcgatatcgtttctgtggaagcagtccttgaactgaatcttgtcaatttggctgtagaccttttggcgcgccgcctctgtcgtatcgccgagggcggttaccgccaacacacggccgccgtttgagacgattttcccgtccttaaaagctgtccccgcgtggaacaccacacagtcttcgacatcgtcgagaccggtaatttcgtagcccttggtgtagctcgacggatagccgcctgacgcgatgacgacggtcacagcgtgttccgggcgccatttgatgtcgcattccgaaagcttcccgtcgatgcaggcttccatcacgtcgaccaaatccgtctgcatccgcggcagcacgacctgtgcttccggatcgccgaaacgcacgttgaattccagcaccttcggctggccgtctttgatcatcagtccgatgaacaaaatgccgacaaaatccatctgatcggctttgaagccttcgatgatcggtgtcaaaatttcatcctgaattttacggttcaattctggatcgtcaaagagcttgttaggcgaaacgttgcccattccgccggtgttgagacctttgtcgccgtcgtaggcgcgcttgtagtctcgggcactttccatcggcacgatggtgttgccgtcgacgaagcagagaatcgacgcttcaatcccggttaagtattcttcgatcacagccgtgtcgccggcttcgccgaattttttatccgccatgatttctttcatcgcggctttggcgtcggcttccgtttcaggaatcacgacgcccttcccggcggccagcccgtcggccttgatgaccatcgggtagccaaaaatgccgagatccttcacaatatcgtcgtagctgtggtattctttgtactgtgcggtcggaatgtgatggcggatcaggaattctttcgtaaaggccttgctgccttcaaactgagcgcattttttgttcggcccaaacacacggatccctgcttcctgcatcgcgtcggccatgcccaaaaccagcggtacttccgggccaacgacgacgagatcaacgcctttttcctttgcgaattgaacgcagccgtcaatatcttcaactgaaatatcgacgcattccgccaaatcggccatgccggcgtttcccggcacgcagtaaatctgatcgaccttcggactctggctgactttccaggcaatggcgtgttctctgccgccgctgccgacaatcataaccttcatatgatgtgattctcccttcattaagcgtgcttaaagtggcgcatcccggtaaagatcatcgcaatattgttgtcgttgcagaccttgatcgagtcagcgtcgcggatggagccgccaggctgaatcactgcggtgatgccggcttttgccgccgcggtgcagacgtcatcgaacgggaagaaggcgtcggacgccatgactgcgccctgacatttttcgccgccgtgttcgatacagttttccatcggccagatacgattaacctgacccggtccattggcgacaaggcatttgtccttcgcgacagaaatcgcattggatttcgtgtgcttaaccgccttccacgcaaacagcagatcttccatttccttgtcggtcggcttccgattagtgacgacttccagcttattgtaaagcttggtgtcgcgttcggtgaccagcatgccgccgagcactttcttcagttcaaatccattgtcgctgtacaggatatcgtcaagcttaagcagccgcagattgggctttgcagacagaacttctttcgcttcgtctgtgaaatccggtgccacgaccacttcgaggaagattttaaccatctgttccgcggtatccttgtcgatcggacggttggacgcgacgattccgccgaaaatcgacgtcgggtcagcttcataagctttatgatacgcttcagcaatcgttttgtcgctggcaatgccgcaggggttggcgtgcttgaccgcaacgatcgtcggttcgtctgtgtattccttgagcatttcgatcgcgccgttggtgtcgttaatgttgttatacgacaattccttgccctggagctgttctgcgccgaccagcgtccctttgtcttcaccgatttccttgtagaaagccgcgcgctgatgcggattttccccgtagcgcagatcctgaaccttttcgtaggtgaaagtaaccgtattttgagccagcagatcttctttgttctgagtctgttcaacagactgtcttcttaagaaatcagagatcatcgtgtcgtaattggcagtcgtcgtgaagaccttcagcgccagatgataacgcgtttcgtagctggttccgccgttttgttcgatttcggtcagaacggtttcgtaatctttcggatccaccacaaccgtaacgtcgttgaaattcttcgcagccgaacgcagcatggttggtccgccgatatcgatgttttcgatgcattcctggaaggacacaccaggcttgagcatcgtctttttaaacgggtagagattgatgacgagcaggtcgatattttcaatccccagttttttacattcttcctgatgtttcggattattccgaatgttcaaaatgccgccgtgaatcagcggatgcagggttttaacccgaccgtccagacattctggaaatcctgtaatatctgatacgtccttgacatccaatccgccttcgcggagggcctttgctgtccctcctgtggaaataatatcccagccgcaggccgcgatgcgtttggcaaaatcgacaatacctgttttatccgagactgaaatcaatgctctcatcctacactcctcctctatcttttttattctttatcaatcgagacgcgccgaccgtcgacgtgtacccgtccgaggcaaatctgggtcaccacccagggcagaagcttgtgttcttcctctaataccttcttctggatatcctccggcttatcgtcatctgaaagctgtactgccttctgggcaatgatcggtccagcatccgcctgctcgttgacgaaatgaaccgtgcagcccgacaccttgcagccgtatgcgtaaatcgcttcgtgaacgtgcatgccgtagaatcctggtccacagaaagacgggatcagtgccggatggatgttcacaatccggttggggtaggcgtctacaaaatttttcgtaacgattttcaaatagccggccaagacgacgagctcgcagccgtgggccttcagcgttgccacaattttcgcgttgaaatcctctgtgtcttcacacgctttttcgtcgacaaatacagctggaatgcccgccttttcggcgcgggttaaggcgtaggcatccgccttgttggagatgacgaccgtaatctctccggtcttgccgtggacgccgtcgatcaccgactgcaggtcggtcccgctgccgctggccagcacaccgattttcatcaatggtttcatagaactattttttccgttccttctgtcacttcaccgagaatgactggtttttcacccttttctttcagagcgctcacaaagccgtccgcctgatcctgcggcagggcgcagaccagcccgatccccatattgaaggtgttgtacatatcgtgatctggcacttcgcccagctgttggaggacgtcaaaaatcggcagcggttcaatcacggaggtgtcgaccttcgcgcacaagccgtctggaatcatccgcggaatattttcgtaaaagccgccgcctgtaatgtggctcatgccccgaacgccgtaagggacaatcaaatccgacagcgcgtgaacgtagatccgcgtcggggtcagcagtgtttcgccgatggtcgcgcccagctcgtcgatgtaggaatcgaccgtcaggtcgtgatccttgaaaataagcttgcgcaccagcgaaaagccgttggagtgcacgccggacgacggcaggccgaccaagacgtcgcccttctgaatcgactgcccggtgacaatctgatccttttcgacaacgccgacagcaaaaccggccagatcgtattcatctgccccgtacatgtcgggcatttccgccgtttcgccgccgatcagcgccatatcgccctgaacgcagccttcggccaccccggatacaatctgtgcgattttttccggcgtgtttttgccgcaggcaatataatcaagaaacagcagcggctttgccccctggcagagaatatcgttgacgcacatcgccacacaatcgatcccgacggtgttgtggcggtccatcataaaggcgatcatcagctttgtgccgacgccgtctgtgcctgaaatcaggcagggctttttgtacccttccggcagttcgatcacaccgccgaacccgccaagttcagaaagaacgtattggttaaaggttctttttacatctttttgaatcagacgaaccgactcgtacccagcttcgacgtcaacgccggcttccttgtaggcattcgttttggacatgaacattcctttctttatctgtgtattattcttcgtttaaaagcgcctgaacgcgggcattctttgtcttgacttcttcgtccagttcccgcttgtacgcttttatcgcttcgcgcaatttcggatatttaaccgaaagaatctgcaccgctaaaatggccgcgttggccgccccgttgaccgccaccgtcgcaactggaatccccgtcggcatctgaacgatggagaacagcgagtccatcccgccttccagagaggtcttgattggaatcccaatgactggaagtggggtcgagcctgcgatgacccctggcagatgggctgccttgccggccgccgcgatgataacttcatagcccttttcttcagcggtctgcgcaaagatggccagttcccgcggattgcggtgtgctgaaatgacgcggacgtcaatatccacgtcaaattttttcagcatgtcgatgcattttttgacgacatcaaaatccgaatcgcttcccataataactgctacttttgccatagtatacttccttctttcttgtactatttaaaatacgccacgccggattcgaagattttctgatcctttttgcctggaatatttttatacagtccgctgccgattcgttcggagtggcccatcttgccgagaattctgccgtctgctgaggtaatgccttcaacagcgtagactgagccgttcaaattgtaggcgccgtccatcgtcgcgtgtccgtcgaaatcgacgtactgtgtcgcgatctgaccgttcgcgatcagcttctggatcacttcgtcgctggcgacgaaacgcccttcgccgtgagaaatcggcacgcggtaaatgccgcccaattccgcctgtgccagccacggcgacagattggagacgaccttggtcaacggaatcgccgaaatgtggcgtccgatggtgttgtaggtcaacgtcggcatgcccggcttaatcggttcgatcttgccgtctggcagaaggccgagtttaatcagcgcctggaatccgttgcagatgccaaggatcagcccatcccgtttgttgagcaggttcatgaccgcttctgtcatcttcggatttctgaagaccgccgcaataaacttcccagagccgtccggctgatcccctgcggagaaaccgcccggcagcatgatcatctgcgcgttgtcgatggcgtcagccatcgcgttgatggaatcttcaatatcctgcgcgttctggttcttgaagacgatcgtctgcgccaccgccccggctctttcaaaggcgcgggccgaatcgtattcgcaattgttgcccgggaagactggaatgaatacccgcggctttgtaaattcagacgcactcgcaatgaccggccctttgttgtacatgacgtcttcgactttgccttcagtttcgaccgtttccggatagacatcccacaacggcttctgataagcggtcatcagcgcgttcaaatccattttaacgtcgccgactgtaatggtctgtgccgaaaccgtttcgccgattttttcgccggcatcgatcggttgtgccgtttcgatgaccaaggtacctgggtcggcgtcaaacagcgcctgttcggtcaaatccggatttaattcgatcccgatcttgttgccaaaagccatcttcgtcagggtttccatgagcccggcttcgccgactgttctcgctgccagtaccttgccgtcgatgacaagttcgtgaaccgtgtcaaaagttttggccgccgcgtcaaaatcgatgagtcccttttcgtcgcgctgaatcgggaagcggtataaataatggcccgcaccctttaattcgttggtgacaatgttgtcgaccttttccgctgtcaccgcaaaagaaatcaatgtcggcggcaccgtcatatcttcaaaggtcccagacatcgagtctttgccgccgatcgccgcgacacccatggccttctgcgcttcaaaagcgccgagcaatgccgaaaacgggcggccccatttggccggatcctgttcgaggcgttcaaagtattcctggaaggacagacgggcttttctgaaatcgccgcccatcgcgaccagcttcgacaaggattcgatcacggcggattctgcgccgtggaacggactccattccgctaacgtcggattgtacccgtaggtcatgatcgagcaggttgtcgtcgagccgtgttcgaccggaatcttcgccgccatgccgtcctgcggcgtcgccgcgtatttcccgccgtacggcatcgtcaccgtccccgcgccaatggtcgagtcgaacatttcagacagccctttctggctggccacgttcaaatcgctcatcatggccatcgtgcggcctgcgatatcgcctgtcgcttcaaacggcttgcggtctgctggttcgctgacgtaaacatcggcgtactgggtcgcaccgttggtatttaaaaattcgcgggacaaatcgagcaccgtctgtccgcgccatttcattttcagccgtcccgtatcggtcacgtctgctacatgggtaacttccagattttcctgatggcccaattcgataaagcggtcgacattttccggtgcgaccacgacggccatacgttcctgagattcggaaatcgccagttccgttccgtcgaggccttcgtatttcttcggcactagatccaaattgatgtctaaggagtccgccaattcgccgatcgcgaccgagacgccgccggcgccaaagtcgttgcatcgggtgatcatctgagacaattccggatttctgaacaggcgctgaatcttccgttcttcgaccggattccccttctggacttccgccccgtcatcctgaatcgaatggacgttgtgcgcttttgacgagcccgtcgcgccgccgcatccgtcacggccggtccggccgccgatgagcaggatcgcatcgcccggcgccggggtttcccgacggacatttttcttcggcactgctgcgatgaccgcgccgacttccaaacgtttcgccaaaaatcctgggtcgtgcacttcgtagacctggcctgtcgccaaaccgatctggttgccgtaagaggaatagccctgagccgcttcctgagaaatctttctctggggcagcttgccttccatggtttcggacaacggcgctgtcacatcgcctgccccggtcagacgcatcgcctgatagacgtaggctctgcctgacagcgggtcgcggatcgcgccgcccagacaggtggccgcgcccccgaaaggttcgatttcagtcgggtggttgtgggtttcgtttttaaattccagaagccagtcttcatcctgtccgtcgtgatcgaccttaatattgatcgagcaggcgttgatttcgtcggatttgtcgagatccggcagaaggcctctggcctgaatatccttggccccgatggtgcctaaatccatcagcgtaatcgggcggtcggtgtcttcgccgtaaatcatgtcccgagtcgaatcgtaatcggcaaaggcctgttcgacggcgtcgttgatatcgcccttttcaaaggtgatatcgttgagattcgtcgcgaaggtcgtgtgacggcagtgatccgaccaataggtatcgatgacgcggagctcggtcaccgtcggatcccgcttttcatcatctctgaaataggcctgaaccatttcgatatccgcctggctcatcgcgaatcccatgtcctgtttaaaggccgcaagttcttccttggtttttacaataaaaccctctatcgtcgaaacaggcgcaggttccttcactacatcggtcagagtcgtacgcggtgccagatctgcctccttcgagtcaacagggttgatcatgtattgtttaattttctgaatatcttcatcggataaatcgcccttgagcacaatgcattccgcgactttaatcgtcgggcgcgtgccggagagcagctggacgcactgcacagcaaaatcagcctgctggtcgtactgtcctggcaagtattcgatggcaaaaacttgctcatcttctgaaacaggtaaatcttcgacgtaaacattgtccacattcggttctgaaaaaatcgtatcgacaacctgctgcatgacgtcctcaggcagcgcttcgatatcgtaccgattgacaatgcggagtccttccaacgctttcaaattcaatatttttctgaaagtcatttgaagggctttggattttgtattaaatcctgctttcttttcaacgtaaaatctcttgatcaatgtacaaatccgccttttcaatagatttgcatttattgtatcgctttttaattaaattttcaacgaattacattcagaacattgcaatctcaccaaggatttatagctcatttactgaaattctttgtcatttttcccgattgtgccgcaattctgatataatgtaaacaataatatttttaacaggaggattcgatgaaaattatctatctgcaccattcggggtttgtcgttgaattggacaaaaataccctgatctttgatgcgatcacctatattcagccgcaatttttaaaaaaaggcagacgcaaatatttcttcgcctctcacgcccacaccgatcatttctcgcagattatttacaattacggcacggatttcgacacgcgctacattttgagcgatgacatcacccgccgcggcggcaaaaagacgactttcatcaaaccgtacgaacatctgcactacgacgacatcaagtgcgggccagtggaaatcgacaccttcggttcgaccgatcaaggcgtttccttcctggttcaagcggaaggcaaggtcattttccacgccggcgatttaaactggtgggactggtcgccagacgcccgtccggaaatcgaccgcgccgctgaagaacgcgactacaaagcggaaatcgccaagatcaaggattttctcgaaacaaatcaccggaaaatcaacgtggccttcgttcctgttgactccagactggggcgctcggcaaccaaagctgccgaatacttcgttgacgagctgcatccgcagattctcgccccgatgcactgctgggacgaatacagcgttgtgaccgacctgcagcaggcctgctacggcaaggacgtcaagattctaacgatgtccaagcgcaacgaaatcatttatgccgactaatcactgtcatttcaaaaaggctgtttggcgcgatccgtcaaacagccttttttataaggtttctgctatcttttttatttttctaatgcggtaatacattgtcgatttctgaaggggcggtgccatcaaagcgcccaattcctgaaccgacgcatccggatgctcgagccgaagctcagccacctcgcgcaattccttcggcagcacgccgaggcctgccttttcctcaatttttcgaatcgcactgatctgatcgcccgccgccctcgcgcttttctgcaagttggccacgtcgcaattgaccttgcggttgacatcgttgcgcatgcccttgacgattttcacgttggtcatctcaagggcggcccgtgccgcaccgattaagcttaaaaagtccgcaatgctctcactgtctctaaagtccaaaacgccctgtccgccgcgggagcgcgccttgctggaaatatcgtagccctttaatatgcggctgatattttcaaaaaagtgcgtggcattcccgttgagctccagctggtatttcttcttagggtcggaaaccgagccgcaggtgatgaacagcccgcggaggtaagccttaaaataatgctgcttcgagagaaaatacggcgggatatcctcgctcactccctctttgtcgatccgcgcatccttcattaatcggcggctgaacgcctgggagtctgcgctcacgacgtacacacgctgttttctgacggtttgaatcgccactgtcaggccgctgccgtacagcattttgctgatactgcgcatacgtgccgccaaaaagggaaattccgttgtgatcgaaaaaggcccgccgccttctctgcggcggcctgccagcacgtaactgcccattaccatgccggccatttcggcgcgcatttcgttttcgctgtggcaggcgaagcggcacaattccttttttacatcgtctgaaaaactcatacggtcttcttgcggtcgcccatgtacacttcgaaaatccgcttggcgagcaggtcggcgtcgtgccgaacgtgtttgtccttttgaacgacaaaattgtccttaatgtagcggtaaggcagcagctcttgtccgattttcaccggtttagagccgatttttgcgtactgcttgagcatctcgctgctgagcgcgccgtcgttgacgacgacattgtcaaaaagcggtcctttattcttgatctgctgatgggcttccaacgcgcggatatgatcggcctgcgtgtacccgatggtttctcccggctgcatcatgatattgccgacgtaaaatttctgagcggtgctgctcttaatcgtctcttcaatgccgtcgatcaagagatggggaatcactgaggtgtacaggctccccggccccatgatgatgatgtcggccgacttgatcgcgtcaagggtttccggaagggctgcggccggcgtttttaaagaaatccttttgatgtgggtgtgtgccgcctttgcggccttcggaattttcgattcgccctctataatttcgccgttcgccaattcaccaacgagagtcatgtcgtctaaagtcactggcagcacggttccggtgatttggagcacgtcggacgtcctgcggatcgcgtcgtagaaatccgcagaaatgcccgtcatcgcggccagaaataaattgccgaaattgtggccttcgagtcggcccttgtcaaaacggtaattgaacagcgcctgcatcacgttttcgtcgtcggccagcgccaaaatacaattgcggatgtcgcccggcggcagaatgcccaggtcttctctcaattttccggagctgccgccatcgtcgccgacggtgacaatggccgtcagccgattggtatattttttaagtccgcgtaaaatgaccgataatccggtgccgccgccaaaagcgacaaccttgggattgcggacgcggacgatatctttgatcgtaaattcacggatatattctttgatttccatatctatcctccaattggcatatccattgagattttcgttattctatgctcatcgaagatctttgtcaatatcgcggtgggtcaaactcaccggaatgttttccttttgaagggcttcacttaagaggcaggcaaaggttacggagcgatgccggccgccggtgcagccgaaggcgatttccacgtactgcttattcacttcttcgtagtggggaatcgtcgtcttgactaaatccaatattttttcaaaataaacctttgactgcgggaactgcatcacgtaatcttggacggccttgtcctgtccggtcagtctgcgaaggtccgctttataataagggttgggcagaaagcgcacgtcaaaaacaaagtctgccgaaatcggcatcccgtatttaaacccgaaggacgacaccttcacgccaacctctgcattttccttttccagcgtgagcatatttaaaattaatttcttgagatctttaacggcgagactggtcgtgtcgatgatgtaatccgcgcgggtgcgcagttcttttaaaatgccgcgttccatttcaatcgcgccgactaaagtgttggcctgatccaataatggatgtttgcgcctcgaaacctgatagcggcgcaccagctcctgcgtatccgcctcgagaaaaagcacctcgacatccgacggcagctcgtcggcaaatcggttaaaaatttccgccacgtcgtggtcggttccggagccgcggatatcggccacgatggccaggcgttcgaattcagagccgccgtttcggcacagtctgataaaggtcaaaacgagatgaaccggcacattgtcgacgcagaaaaagccttcgtcttccaaaatgtcaatcgcctttgatttgcccgctccagataaacctgtaataatcaatgttttcatgctcgtttcccttactttctatcaaatgctgctgtctattacgttttcacgcgaggttgataatctgctcccgcgggatgcccgatgcctcagcccaagcgatgccctgcgcgacgtcggccacccggtcgattgaatgggcgtccgaattaatggcaaaggtgccgccgtattgcgcagcgcgtttcaattcctcggcgttcaaatgatgatgcctgggattaatttccagaatcacgtgcttttcagctgcctttttcgccacagcctccacatcgatcgggcacttgtctcccggatgggtgatcatttttaaatcgtagcggtccatcatcttcaaataagtctgcgtgttggcccgacggctcccttcttttaagaagggcagcaccttcgtcagataattgcgcagcttaaaggtgaagaaatccgaaaaccggtgtgggatatacacccagtgatagccggcgtatatccagtcgcagtactgtttttcttcttccccgatgtcgatggtgccgtcttttcccgtgatgttggattccacagacagataaatttgaatatctgagtatttctgattgagccgatcgatctcctcgcgcatcacgcggaaattctcgggcttgacgccgtaaagcggatggctgcggccgtggtcagagatcacgatcgcctctaagcccagctgtctcgcccgattgaccatttcttcgatcgagtttttgccgtggctgaaggtcgtgtgggtgtgcagatctgccttaattttcgtcacgggtgtcttctccgatcgtgatgacctcaggctctaaatcaacgccgaactgcgccttcactttgtgctgaacgtcgccgatcagctgcaagacgtcggccgccgtcgcgttgtccgcgttgatgacgaagccgctgtgcttctgactaacctctgcaccgccgacctggtagcccttaagtccggcatcctggatcaattttcctgcgaaatagccttccggccgtttaaaggtactgccggcgctcgggtaattaaggggctgtttgtcccgccggcgctggttcaattccttcattttcgcgcgtatcgcatccgcgttgcccggggtcaaggtcaattccacagccgtgacaatttcccctgcgtcccgcatgcggctctggcggtagccaaaatggcagtccgcaccatccaccgtttcgaacctgccgtcagccgtcatcaggtgcaccttcgcaaccacgtccttcatttcaccgccgtaggcaccggcgttcatgatcgccgcgccgccaatggtgccggggatgcccgacgcaaattcaaagccgcttaagctgtgggccagcgcttcctgcgccaccgcgcgcagcgacgcgccggcctgcgccgtaactcgggtgccttcggtcacgacagtgttcatctgccgcgtgttgatcatgacgcctcggaaaccgccgtcgcgaaccaacaagttgctgccgtttcccatcaaaaagacgggaatgtcattagacttacagaaggctgagatgtcagctagctgttcttcactttccggaaagacgataaaatccgccggacccccgattcgaaatgtcgtgtggtcccgcatcaaactgtcgattaacagctgatcgctgctgacaatttccagtaatttatttttaatttcatttttatctaatttatatttcataagcctgtttcagctccttaatttcttgcaatgctgtcgatgatatcacagcatcattaaaaaggtattaaatcttatgagggcacagccgcaaaggtgatgactgcgacatctgcagcgccggcttgtttcagcgccgccgcacaggcgtcaagggtcgcgccggtcgtcatcacgtcatcgacgagggcaatccgcttcccgtacacgcgctcggggtcgacaacgtcaaaggcgtttttgacatttttgagacggaatgccgccggctgtcccaattggtgcggcgtatcgacaacgcgctttaaacgctccacgtccagtgtaatctcgatacccctttcatttaagccagaggcgatgcccgccgcgagctgttcgctttgattgtagccgcgctcggacagcctgttcgggtgcagcggcaccgggatcaacgcgtcgacctctgccatccacgggcaatccgcaagatcctgcgccatctgggcgccagcccaataggccagagttttctgataattgaatttaaaccccgccgcaatttgttcagctgccctgccgtagaccagccaaacccatccgcggtcgattggccgctttgcgtcatctctgcaggcgctgcagagatcggcatcgtctgaggataagggtcttccgcatcggcggcatgtccgcgcgtcgtttttcggcagttcccgcaaacattgatcgcagagataggcctcttttttccacagtatttttttgcagaccgggcagcggtcgttgtcgatcaacagcagccggctcaaatgctcgagaagtttatttttcatagcgataaatttcgatagcgcgcgatccggaaaaccagtcctgttttccgcttgcggctgtcgtcagactggatcattcggataaaatgctcgggccgcccgacaaggatcatcatgcgcttggctcgggtgacgccggtgtacaacagctttcgatttaaaaacagcggcgaaccgccaatcagcggcatgatgaccacaggaaattccgacccttgacttttgtgaaccgtcatcgcaaaggcgtgggcgagctcgtccagctgatcgaaaccgtaaaccgcctcacggccgtctgtgaaggccactgtcagctggcgcttgtcgtcggaaatcgacttaaccgtgccgatatcgccgttgtaaacgccgtcgccttcttcaaaggtgagggcatcgcgccacttcatctggtagttattgcgaatctgcatgaccttgtcgccctcccgaaagacgacgggcccgaaggtatgttcatttttccgaggcgacgccggattgaggatattttggattttttgattcagcgcaattgtgccgacaagtccttttttgaccggtgaaatgacctgtacatcgtgcaccacgtcgatcccggcattgtccttcagccggtagcccagaagatcgaggactgtcttttcaatgccctcttgatttttttcagggatcagcacaaaatccgattggttgtcgattcgggggacactgccctcgtttatggccttggcgttgacggaaatctgactcttttccgactggcggtaaatgcgcttcagacggacgactggcgcaatgccgctttcaattaaatcgctgagcacattgcccggccccaccgacgggagctggtccgcgtcgcccactaagatcaggcgcgtgccctcttcgatggcctcgagcagacttttcatcagcacgatgtcgatcatcgacgcctcgtcgacgatcagcgcattgagctccagcggattgtcggcattgcgctcaaacgtcggcgtcagcgcgttgtcgtcgtaatgatattccagcaggcggtgcagcgtcttggcttcctcacctgtggtctcggtcatgcgcttcgccgcgcgtcccgtcggcgcggcgagctgaacggacagccgcatgctctggagaatgttcaaaatgccgttgataatcgtcgtcttgccggtgcctggcccccctgtgatgatgaccagtccctgctcgacggcggtcttgatcgcgttgcgctgctcctcgtcgagggtaatggcgatatggctctcgtagcggtcgatggcttcctctacatcaatgtcgtccgcctcaaaatggctgcccgcaagctgcgtcatcatcagcgcagtggcgtcctccgcctcgtaaagccccatcggataataaatccgtctgccgtcaatttcgtccatatgggcagcgccgctgatgatcgtatcccttatgcccatctcgacggtttccctgtcgacgccgaggagttcctgtgcccgcgcggtcaattcctcttcattcatataggtattgccctgggcgtagcactctctgagcgcctgaacgacgccggcctgaatccgcttgctgttatccctgtcgacgcccagtttttccgccagctgatccgccgctttaaaaccgacgccgcggatatcccggacgatgcgataagggtcctcgaggagaatcgctacggtttgatcgtggtaggcgttgtaaagcttcatcgccattttcgacgaaacgccgtactcctgaagctcaatcagcaccttccgaatgtcccgctgatcctgataggcacccagcatccggctcagcgtctttttgccgatgccgggaatttccaaaagccgggacggatcgtcgtctaatattcttagcgtattctggccgaaacgctcgacgatcagttcggcggttttcggaccgatgcccggcagcaggccactgctgagatactgaatcagcccgtcttctgtcgtcggcagttcgacgcggtagtgctcgaattggaactgccggccgtaaacgaggtggttggtccatttgccaaggagtgtcagatgggtgcccagctcaaccgtcaccatgtgcccaacgaccgtcaccatttcgccatcgacgtcgagatcggccacggtatagccattttcttcgttgtgaaaaacgacattttccaatgatccgctaagcttttccatcccatcctcttttctcgttttatttaacatttattatacacgacggcgctttcttcctgcaatgcttttcctattcgtcccttccttgacaccccaagaaaaaaccactataatgaataaaattttattcgcaacaagttattttattgtgatttgtcgttcgtttatttgcttttatttcataacacaaggagaactatatggcacagatttatgaagaaccttcccgtacctttaacgaatatttgcttgtcccaggctattcctcatccgaatgcatccctgacaacgtcgatttaaagacacccctcgtcaaatttaaaaagggcgaagaaccggcactgtccctgaatattccgatgacctccgccatcatgcaggcggtttccggcgaaaagatggccatcgccctcgctcaggaaggcggcctctcattcatctacggttcccagtccgtcgaagacgaagccgaaatggtcgccagagtcaaagcctacaaagcgggcttcgttccgtctgacaccaacctgtcaccggaagacacgatggcagactgcctggacatcaaacagcacaccggccactccacgatcgccatcaccagcgacggcaccgccaacggacaattcctcggcatcgtcaccagccgcgactaccgtgtcagccgaatggacccggccaccaaaatcaagaccttcatgaccccgaaggacaaagtggtttccgctccaatcggcacatccttgaaagaagcgaacaacatcatctgggatcacaaattaaataccttgccaattctgaacgaagacggcaccctggcctatttcgttttccgcaaggattactctgtccataaatccaatccgctggaactgctcgacgcgaaaaagcgctacatcgtcggcgccgggatcaacacccgcgactacgccgaacgcgttcccgctttggtcgacgccggcgcagacgtgctgtgtatcgactcgtctgaaggctattccgaatggcagaagctgaccctcgaatggatccgcgaacattacggcgattcggtcaaggtcggcgccggcaacgtcgtcgacgcagaaggcttccgtttcctcgctgactgcggcgcagacttcattaaaattgggatcggcggcggctcgatctgcatcacccgtgaacagaaggggatcggccgcggacaggcgactgctgtcatcgaagtggctaaagcccgcgacgaatactacaaagaaaccggcgtctacattccgatctgctccgacggcggtatcgtctacgatcaccacatcacactggcactggccatgggcgcggacttcgtcatgctcggccgctacttctcccgtttcgacgaaagcccgacccgcatcgtcaccatcaacggcaactacatgaaagaatactggggtgaaggcagcagccgcgcccgcaactggcagcgctacgacttgggcggcaaaaaagcgctctccttcgaagaaggggtcgactcttacgtgccttacgccggaagtcttcacgacaatgtagccggcactctctcgaaaattcgttcgaccatgtgcaactgcggttcgctgaacattccggaattccagaaaaaggccaaattaaccgtcgtgtccgcgacgagtatcaccgaaggcggtgcccacgacgtcatcctcaaggacgacagcaaggtccgctaatatcttatctgtaaatagtaaaacgctgaagactgatatttgatatgctcccttttaggtagacaagtaaaataataaaaacttgtttatctggaagggagcatttttcattgagacgaacaaaactggaaccagaaatcatcatcgcagctgtgcaggaatatttatccggtaaatcctcatacaaagcgatcgccaagcggttgtgtgttgccgaggggatgggttagaaattatacaaacttcggtattgaagccttccactcaaaaagcaatcagcattactctaaagcgcttaaagaacaagctgttcaggaatatcttacgggaaagggttctcagactgaaatctgcaagaaatataagattaaatcaactcgtcagatttatgactggataaagaagtataatggtcatgaggaattaaaagcatccggatcaggaggaaacaccatcatgaccaagggaagaaaaaccactttcgatgaaagagtcgaaatcgttcagtattgtattgcacacgatcgcgattatgcgaaaaccgctaaaaaatataaggtgtcttatcaacaggcacgcagctacaccgtcaagtacgaaactggtggaattgacgcgcttcaggataaacgcggcaggaaaaaaccgtttgaggaaatgacagaagttgaaagacttcgggcagaaaataaaattttgcgagcggaaaaggaacacgctgaaatggaggcatccttcttaaaaaaactcgaggaaatagagaggaggcgaggctgagccgagtccggcacgaagcaatctatcaagccattcaagaagaacacgaagaacatcgttatccgattcaggcgctctgcaagcttgggcatgtcagccgggcagcttactacaaatggcttcatcgagccgcgcccgcgtttgtcggataagaggcatcaaatcgacgattaagtacgctaaccacggatgcaccaggcaggcgaagaatccgcaatacatcgcagcaaatattctaaaccgagagttcactgccgatgcgcccaaccagaaatggctgacagacgttacagaattcaaatattacactggtgttgaagttcacaaaatctatctcagcgcgattctcgatttatacgatagaagaatcgtcgcttacaccatcggcgactcgaacaacaacgcactggttttcaatatgtttgatcaggctgtagccgagaaccctgacgctacgccgctgtttcattctgatcgcggctatcagtacacgagtcgaatctttcacgccaagctcgaagctgctggcatgaggcagagcatgtccagagtcgcacattgcattgataatggtccaatggaaggcttctggggtattctgaaacgggaacgttattacggcaggcgctttttagatagaacttctcttgtaaaaatgattgaagactatatctcgtattacaataacaggcgcttacagcgtaatctaggtgtgttgacacctatggaaaaacataatcaatataaaatagcggcatgaaaaatgccatcagacgtgagcctgatggcaaagaaattttatttttttgattgtctacttgacggggtgcggttcaattttcaatcttcagcgtttatttttttgctatcccaataaaatcaaaatccctattgtaataaagacaacggggatgagcacttctccccatcgcgcaaccagctgtttaaccggcgggatttggccaatgattctcccggcggcacacagcacaagagccatgatcataaacaccaccgaggaaaccgccacgcgggccgcgtcacttacggcgaacagcggaatgtaaacacttaaattgtcgccgcttccgaaaagcaccagcattgtcatcgtgcccacgccaatggcgggctgttccgtctgtgcttgtgcagccttccccttccaattctgaatgcccttcaccacgccgaaaatgatcggcgcgagtccaaaaaggtgcagatatttggtcggtacggctctaactaaaaaggccccgacgaggctgagcgccgtaatcgccgcgacgccgagacattgtcccgctgcaatgtgcatctcctcccgcttcgttttcgcgctcgcggacagcagcgccagcagcaccaagtcgtcaatattcgttcccaaaaacgccagcaccgctgtaaggatcgtctggatcatggtgtcctatttatccgaccagcttcttgagcgcctgccaaaccgcgccgaccggcagtccgacgacattggtgtagtcaccgtcgatgccgcggatataagcggaaaacgctccctggatcgcgtaaccgcccgctttgtccatcggctcggccgtactcgcgtaagcggcaatttcgtccgccgtcatcgggtagacgtgcacgtcggtcttttcggcgaaagtcaccgacgccccatcgccgtcggagagcatcagtgtcaccccggtgtaaacctgatgggtcttcccttcaatcatgcagatcatttcggccgcttcctcgtgatccttcggtttgccgagaatctggccttccgccgcgacgacggtatcggccgcgatcaccaccgcgtgagcgttgagctgcgccgcgacgtgctctgccttctgacgggacagcgccttgaccgctgcctccggatctgtcgtgtcaatcgcttcgtcgatcgacgccggcatgatcactggatcgatgccgatgcgctggagcagcgctttgcgccgcggcgactgagacgccaaaacaatcggaatatcctgactcagctgcatggtgtcctcctttacgcgtcttcgccgtttccggtgagctgaagggcttccgcatgggcctgcatgccggaaatgacaatggacgcgacgtcgcggatgtccatgccgagcatgtcacagcccttcaaaatcagcggacggtcgcagttggccgcaaaattcttgctcttccatttcttcatgaagctcttgattttcatatcggtaatgccgtggggccgcatccgggccgccgcctgcacaatgcccgtcagctcgtcgaccgtgaacaggctcttctccatcggggtttctggcttcacgtcgttgacaattccgtagccgtggcttaaaatcgcccggatgtctctttccggcacccccgcttcgcgcagcggcgcttccgtatgtgccaggtgttcttccggatacttttcgtaatcgtagtcgtgcagccagccgaccgcttcccattcttctttttcttctgcatcagcgccgaaatgttcggccatggcccccatcgctgccgacacattggccgcgtgcagaatcaggtgatcttcagtcaccatcgtcgcgttgagttttttcgcttcttctaatgtcaatctttccatttttgctcaattgtctcctttctttattttgaattgcggctatcttgattgtggccgcggttgtcaatcaaatgtctcaaatcgtgcaggcgggcgcgcagatcgtcaaccgccttgtttcttcgccaattggcacggacgcgccgcacctgttccgatacgacctcgtccaattcgccgcggtgggccttgagcatcgcgtacagctgcggatcctcctgtttcagctggtcggcaatctgtcggcgcctttcagcaaaggcctgctcaatatccgcctcatccagattgagtctttgcgccagcgctgcggtgcggtgctccagatgctcgagcagatcgtcctcacggaccccgttcagatgctgccagaccggggagtggcgcatgaaggcttccaggctgccccctgccccttcagtgtgctgccaatgggcgacaattttttcaacgtaggccgcaatttcgtcatcggccttgtcgccaaaggcccattctatatcgtgcaggagcaggtgtcggcgcgaacgattgagattcatcgaatcgttttcgccgccttccaccggatagggcggatgatagccagccgccaaaagcgcgccggtcatcgtccgcaccacgcttccctcctggatcatcgcgtcccgatccgcctcgcgcagggtctgatttacgctgctgatgtgctccgtcagatagaggcggatgccgctgtccttcagccgtttgtaaagggcgtctattttcttcgccgcggtataatcgagactcgtgatcccggacgcgtcgacgatcactgtcttcgtgtcggggcggatcgcgtctaaaatatcccgctcgaacaaatcgtaattagcgaaatacaaattggacgaaaaccggtagagcaccgcaccggcgatgggcttggccccccgcgcggtacgcagatcgtaaaaccgaagctgccccggcatcacgccgaggaaggtgcggggcggcgacatcgtccgcatcagcaccaccacaaaggacagcgccacgccgatcacgacgccgtaaatggtgccgaggagcacgacgccgcagaacgccccgacaaaaatcatgaactcccgccaatcgattttcgccaaatgcacggcctcgtcgatttccaaaatgccgagcagcgctgaaatcacgatcgccgtcagcaccggcactggcagaaacccgataaacccggtcccgaaaagcaaaattgcgatcatcgcaagaccggccacaatcccggtgagctgagaatcgctgccaaattggtcggcgatccccattcgggaaacggacccattgaccgggcagcagcccgtgaacgccgccgcgaaattgccgagggcgtaagccagaatcccctgattgggcttgagggtaacgcccttgcgctccgccatgttgctggaggaaagaagggtctccgccgtaatcaccagcgcaatcgtcatgctgtacttaatgatcgtatccatcggcagcaccccagctgccgccgcaggattgacaaaatggggcagccccggcgccacactgggcagcgccgccacaccgaagcgcgttaagtcgacccaccggttcaataacgccccggcgagcatcaccacaaccgccatcggaaatttcggcagccattttcggctgacgaggagcacagccagcgtccccgcgccaagcgcaaaggacacgccgttgaacgcgccggcactgtggacaatgtggacgatcagatccggcagctcgccgtgaccgaccggaccgccgaacagctttggcacctgcatcgtgatgatttcgacgccgatcccggtgataaaaccgcccatgaccgcctctgagatgtaacgcacaaaatgtccaaaacgcagcagcgaaaacagcagcagccagcacgctgtgcacaaggtgataagcggtacggctttaagcgccatagcggattccgccgtgatgccaagggacacgagaactgagccggtcagtgccgctggcgctgcgtcgaccccgaaaatcatgtggggcgacgtcgacatcagcgcaaaaaacaaaatcggcaagaccgatccataaagcccgtagaccgcaggaagcccggcaatctgcgcgtatcccatcgcaatcggaatggaaacagctgctgtgatcagcccggccacaatgtcatttttgacgttaattttttgtccgagaatcgtcgataaaaacttcactggcgtctcctggttacacgtgattgaccacccgcttcggccgtctgccttccacaagcgcgcggatatcctcatcggccatcgcgtagcttctgacaaagctctgcgcggtaatgccgccgacgtgcgggctgagcagcagtttcttttctatggcttctggctgattcaagagcggatgatcctttcgtaccggctcgccgtctagtgtgtccagacccgccattgcgagtttccccgacgcaagggcttcgatcaaagcctgatcgtccacgagctcgcctcgagccgtattgactaaatagctgcccggctgcatcagctcgaaaaaccggcggttcgcaaaatgggtcgtctccgcgttgaccggcagatggaggctgacgatgccgctcgcttggagcagctcatccatcggcttgtagatgacgccctgtgccttttcttcttccggactcagacggtgccgcttgttgtaataaatcgtcgagacgccgtaggcccggaccagcctcgcggtctcccgggcgatgtccccgtagccaatgaggccgatcgaaaattccgaaagctcccgcaagtcactcctgaccatgtagccttccttcatttcaatttgatggccggctcgaactgcggcatcaccctgggccacatttctgagcatgccgaccatgaggagcacggcctgttccgccacggcgaccgcattcattcctttggaattgcagacgtagacaccgcacgcgtctgccgcctccaaatcgaaactgttgtaagcaacgccttcggaatgaatgagcttcagattcggcatgctgcggatcagctcccctgtcaccggcgccatcgcgtccgcgatgataaaatccgcgtcggcgccatctttcaaatacgccgatacaggctcattcatcgggacgtccaccagcgtcatagtccgtaaaatactgctttcgtgggtaaagcgctgcagattgccccgctttccaatatgtaaaatcttcattttttcactattctttctatcaaaattacttctattttaacatggaatggattttctgcatagaaaagctctggcctgaagccagagctgaaatgaactacgcatcaaacgccaagacaagccgctgcgccgacatgtcgtgataaacggtcagcccagcctgagccgtgtcgaataggctaaccacgccctcaatatgggtcgtatcctgaatcacttcggcgatcctgttcggcagatctttgaatttttctgggtcgaatattttcgttttctcattttcgaaaaccgcggtatacaaaattttcgcttcaacgagatcctggaaaatgtggctgccgtaggaaagttccggactgtagccggcgcgggagtcggcaatttcgaacaccgcgtcgaacccgtcgatatcggaaaacgtcgtcggcacaccgagctccggcgaggatgtgccaacccgcccgggcaccatcaggattaaatgcctgccagattttttaaagtgccagttgatctggccgatggctttggcgacgcgggttttatcgacgtaaggcatttcgtaatacgcgaccggatcgacgtacgccacagcgtcgattttctgggtcaaggacagccccatcgacgcgccatcgcattcgaggacaaccttatccggtgaaaaggtctcgggcatgtcggtctcgccgtcgtctttgaaaacctgaagcggccggcactgcagcaggttgatgacgtaggtgccgtcctccgccagattgatggtgaattcgatatccaccgggtattgataaacgcgctgaatttcggccatcatccgccgcatatcctccatcatcgccttatttttgacaagcccagcgcaggagacgaacaaaatctcgcgattgcttccccgttcccgaaactgacgctccgcatcccagtcgtgttcaaagagcagcttcttcatgtacgccggcagcagcggctcaatccggttggacaaggcctgctccaccttgcgggtcttgctgctgatgtattcgacgccgcgctgggagtaacggtgcttttctgccgaactgaccgctgacacgacctctggcttgtcgagactgacgagccttggataggagccctcggttcggtcgacggctgacgtgccgagccccatcaccagtctgagcatcccggcttcgggatcgagatcctttaaaaatcggtaggggctgtaggaataaccgacaccggccgcgcagggcatgtacaccgtgtcgtaataggagccagaaacccgctgcaccaaaagcgccatctgttcgtcccgctgatccaagccgcggtccttgcggtaggtcaacgccgacaggctcattgtgctggcgtaaacctggcggacggcatcctcgaattcggcgaggcgcgtctcgagggagccggtattcgcgcagaacaccgattcgtatttgcccgcgaaggcgttgccaaagccatcctctaatatactgctggagcgcacgatgattgggtcctggccgaaatactcgaggagattcacaaattgatcttccatctctttcgtgaatctgcccgtcctaagtttttcggcaaagggctctgccagagaaaagtattcctccggccggcgctgatgaatccgcattttccagaagtgattttcgacgatgtaggaatagaacacgtcggagccgacgtagaaggaatcgtggggctccaggcgcgcggcgatatctgagcagttgcgctcgatgattttccgtgccaacagcatcccgcaggccttgccgccgatgagtccggttcccaccatccgcaggcgcacgtcgaaatagtcttcaagcttgaaatacttgcgcaccagcggccgcagccgttcatcccgggtgatcatgatccggcacatccggctcttttcctcggaaacatcttggccgttttcaaactgttccatggtccgatcaaagaaacggtcccaggcgtcgctgttctgttctctgcccggccatcgttcccgattcagcgcccggtaaaactggctggcctgcaccccatcgaggatcggacggaacgtcccgtcctttggctgatacatctggggcagaaacatcgtttcagaaaaccggcgccacaccttttccggccgcacgtaaatgttcgtgccgtcgtcgtaagcatccaggaaaacctgagccgtgtcgcggattttcgccacagcctttaaggaatgcttgccccgcatcagcgggaaatacgccacagtatccatttcaaagagaaaaggacaggtcacttggaagaaattgcccatcatcaaatccgtcgaccaggcggtctgcagctctgagaggcaatcgaagacataaaacacgtccttgccccgctgttcgatgatgttgtgaatatcgacggtgaaggtctcgaaccgatgggacaattcgacctggaccacctccacgcccgtcaagtcgtcaatcagcgaatcgtgggcggcgaagcggacgtagacgacgtgccgcccatccgcgacggcctgcctaacgtagggattgacaaaggctttgaaaacttccagatcggacacccgccagactacgttgtcgccgagccggatgttgtcgagcaccttgtccatctctggaatgccggatgggatgcggtcaaatgctgccatgttgttaccccctcatttcaaaatgattgcgttttcttttattgtatcacgtgtttaacagttcgtcgacagcttttctttttctccctgaaacccgcataaaataaggactcgaccgacagtcgagtctcctacgcttgacagccaaacgccgtcaaattatgataaggccagatcttaaaacgcagcggcgccctgctgaaacattggaggtatcctgatggaagaaaagaaaagtttaggcaagtatattcaaaacaaaagaaaaaatctgggcatgacccagaaagagctggctgcccagctcttcgtctctgaatcggcggtcagcaaatgggaacgcgggctgtcctatccggacatgaccctcgtcagccctttgtgtgaggcccttcacatttcagagcacgagctcttcactgccagcgacgattggcgtcagcgccaaatcgaggaacaagcccgacgctacaaacgcaataagacgatctggctgtgcgtcacctgtatcatttacgccgcgatgctcttcggcacattgacctgggggatcactacgggaaacggcttaactactttcgcctacacttttggtgcgtgcgccttgttgttctcgctgatcgacgtgccaatgcttgcagaaaatgacaaaggcgtcaagtgttttgccgccagcttcgcttcgcttttactgctggaaatcatcgcccgaatcgtcagccccacgaacgatccgcattggctctggatggccctgcccggaacggccctcggcctgctcagcgtattcctgccaattattctggcatacgcagattgggatttcccttttatgcgtcacaaagctgcattttgtctcggcgtcgactccgcattaatcggtctgctcgtgattttcggacagtttttttacggcgatggacaccctgccgtgccgatcgcctcaacggcctcaatgctcgcgctgatctggggcgtatttatcgtcgcgcactacacctgctggcccgttccctttaaaatcagcgccggactcaccatcggcgcggcgttttgtctttttaccgatgcactcatcgaagcgctcgagggatacggctttcgggttgtcttcaacgcaaatcgatcaaattctggcaatattgcccccgatatcggtctgattctccttgccgcagcggccgttctcgccatcattcaagtgatcatattaaagcgccgtacccgtccttaaacctgttttaattccgtctgcgcgccggccggcggatcatcagggccgtgccgattaaaatcatcgtaatgccgaagctgatcggataggccatcatcagctggcggaaggtgtgatgactcgggaagtacagaaaaatccacagcagtctgaacacgcagacgccaaaaatcgtcagcaccgccggcagcagtgaaatgccgaagcccctcaaatagcccgtcatcacctcgtacacaatcgcgaagaaataaccggaaaacaataggccgagcttcacgtagccgtaatgaatgacgcgcggatctgtattgaacaggccgagcagtggtttcgcaaaggtccagatgagtgccatgaaggcgccgcacacgataaagctttcgatcaggcacagccacatgacgcgcacacagcggtccggctttcccgcgccgtcgttctgcccgacaaaggtggttgacgcctgaccgtaagcgagaatacacgcgtaaatcagatattccagattcagcgccgcactggagcccgccatgaccgccgcacctaaggaattgacggccgactgaatgacaatattggccacacagaagacggctgactgaatgcccgcgggcaggccgatccgcaaaatccgtttaagcgttgcccaatccacgcgaagccgctgccgcgccaaatgaataaccgtctgttcccgcgtcaagcgccagaacaaaaaggccgaggaaacacaattggcgatgaccgtcgccgttgcgacaccatccacggtacgcttgaatccgatgacgaatatcagattcaacacaacgttgagcgcccctgacacgacgagggccattaacggcatctgcgtcttgccgatcgccctgaaaatggccgcctcgaaattgtaaagaaagatcaccggcagaccgaccagataaatgcgcaggtacagcacggccagcggcagcaccttttccggcacgctcatcgagcgcaggatcatcggcgcgaaaatttcgccgcaaatcgtaaccacgacaccggcgaaaaacgaaaagagtacggcggtaccaacggccttctgcaccgtgtcgtcccggccttcaccgaccgcgtgagcaataacgacgtttgcgcccagtgaaattccgagaaaaagatttaagatcaggccggtcacaggggtgttcgcgccgaccgccgccatcgagagcgtgcccatttttccagtgaaccgcccgaccactgcgagatccgccgcgttaaacagctgttccaaaatagacgtcgccgcgacaggcagcgcaaaaatcggcagcttgttccaaatcgagccgtggatcatgtcgatgctgcgcccggcgccagcccgatccttacttttcatgaacccttttcccggtgatgtgtgccgctttgatcgctaagcacaaggcccgcgcgccgtcctttttgacctcgcgcgctgcgctttcctgatccggatagtatttttccgctatttcccgggtgatatcgatggatttttcgcggtcttccaccggcgcgatggtcccgaaaacgacgacgctgttcacgtattgaaaccagccgtcttcgtccggcgtgccctggtccatgacacagaaagacaccttcggatgcttggcaatcgcgtcgattttatgaccttcgtgagccccgtgaaaataaatgacctgcgctttcgggtcgtaaacgtaattcatcggaacggtatagggatagtcgtcatccccgagcaccgcgagtacgccccgctttgcatttaataaaatggcttcgcacgcttcagcagtcaatgcctgcttaaatcttctcatttttcgtatcatgattttcttctttcttttgtgtgatgagattccgtccgcatgatcaataatcttcgtcccaggcgttgatgaccaccggttccttttctaacatcttcagctgatctggcgtgaaatgttttttgtcaatgacggcttcgtagacgtaatctctaaaatatttttcagagcagacaaagtatcctttgtcgcccacgtcgtcgccccaggaattttcaattttccaacggtcgggcttcccgtccgcgtcgaagtgcacgccggtcagcagcatcgcgtgggtcgccgagctggcgttgtagtccaggcgcttgcccttcgggaaatccacagagaagccaccgagcagggcttcgatttttgagctgtccgggtcccaaatgccttccttgcgcataccgaaggcgccggcatcgcacgcgaaccaaaccggttcgccgccctgaagctgtttgacgcacagggcttccatcgcgtcagccgagaggttcagcgcctccatgtcccgcccgatcatgttttcaatcgcgtgaaaacggacgggcgtgtccattttcttatcggccgtcggctcattgatcacggctgccaattcccgcagcggcagtcccacgtatttgtgataaaatgcctggggcgtcaagccgcggtcgatgtagtaattgtcgtccttgtctttatattcgaaatcaaagacggtgaccggctgaccgaaggcgatacattccgcgcggtaaacttccagcagcatttcctgttttctgggataagggtccttcccagcctggaccagctcgcgcagctctgccgcgtcctttctcagcaagcggttcagcgtcgagacaaactgcgccgtgtggttcgactggtaggtttccggctggaccgccttcggcacgacgccgtacttttcaaccagatccgccgcttcgcaccagtagccgccatcggtcatgccgcggagcacgtactgcatcagctgacccttaattggttcgtcggcgtggtcgatgaccatctgaaggaaattattggccttttccaatttatcgtaaaaggataaataattttgagacagttcaaaattttcaagctggcatttttcggccacctgttccctgaggatgttcagcgccgcaaacagccagcaccgccccgaccgttcctgagacgtcacgccgcgggttttgacttctaccgaaaaggcgcccttgagcttggccgccgcggtcggcacgtacgccagctgttccaaatccgttcggctcagcgcggcgttcagcgtctgtgccgtttcgtcctggcggtaattgtcgccaaactgcttcaatactgcttctgtaatttctttttccatatttttacctctacgcttcttttttcagtcgatacgcccgcttcgcgatttcgacaaccgtctcgcacgccttttttaacgacgcagtcggcaggtattcaaatcggccgtgaaagttcgccccacctgtaaacaaattgggacagggcagcccgcggaaggacagctgagcgccgtcggtgccgccgcggatcggactgacgaccggcgtgacgcccaccgctttcatcgcggtctttgccaaatccactacgtccatgtggccgtccgcgattttttcgaacatgttgaaatacacgtcgtgatgggtaaccgtgacggtgcccgcgccgtatttctggttcagaaaggcggccatctggtcgagcagcgccttgcgcgcgtcaaaccgcgcccgatcgtgatcgcggaccagcatgtgcatcgtgcatttttcgacgtcaccctcaattttgtagacgtggaaaaagccctcacgcccttcggtgtattccggcttttcgccagccggcagcatctgctgccactccgaggccaccgacagcgcgttgatcattttccctttggcgtcgccagtgtgcacgcttctcccgcaaaaggtcaccaccggattttcggcgttgaaattttcgtattccagtccgcccagctcgccgccatccacggtgaaagcaaaatcggcgccaaaacgatcgacgtcaaagcggagggggctccgacccgtttcctcatccggtgtaaaggccacgcggatttttccgtgttttatttccggatgctgaatcagctcttccatcgcgctgacaatcgccgtcacgccagctttatcgtcggcgccgaggagcgtcgtgccgtcagtaaagatcacgtcctgccccgcgtattgggtcacttcaggaaaagccgccgtcgaaaacacgatgttcttttcgacattcagcaccacgtcaccgccgtcgtaatttcggacaatctgcgggtgcacgtcttttccaggcgcgtccggagacgtgtccatatgagcgatcaagccgacgaccggcccgtcctcagccacatttgccggcagtgtcgccatgatgtagccgttggcgtccagctcaacctcctgcatgccgatgcgtgttaactcttgggctaaggcctgtgcgaagaccagctgtcccggtgtgctcggacagacctgatcgttctcttcatccgactgcgtgtcgaacgacacgtagcgcaaaaagcgctcaatcaatttcgttgtgtccattgttcaggcatcctttctacattgcattcattttaaattaattttagtttatcacacgaaagaaacccctgccacggcaaatgcgcggtaaacatttgcacgtaaacaaaaaaacaccggccgaagccggtgtatagtattttcttatttttcgctgaaatccgtcacgatggtgccgtccgcatggtagcgctgattgccgaaatacttgttgtgcgcgtattcgatgccgttccaattcagcggcgtgtagacttccgcaatttccggaaggtggacgtctttcagcgcccatttcaggaattcctcggtgccggtgcggtcgacgatatagccgatgtgttccttgccgcccggtgaatcagggttgatataatgtgcggtgtagtcgtagacgtttttgataatctgaatgatgctgtcttcgtccgcccatttgataaaatcgacacccattctcggattcttcttcccggttcggccgaggagcgtcacgcggtaatactttttctgactccgcgtccaggccagattcgggcaggcgttgatgcattcgccgcagccaatgcatttgtaggcgtcgcgctgcgggcggaaacgcaccttttccagcgcgtcgacagatttggaacggcaggctttgatgcaggcgccgcagctgatgcagcgttccggatcgaggtgaggctcggtcatgcccatgatgccgatgtcggccattctgactttttgacagtcgttggggcagccggttaaaacgattttgacgtggaggtcattcgggaaaatgaccttttcaatgcgctgggcaaaggccgtcgtgtcgtagcaggcgtaggggcagacgcggttgccgacgcaggctgagacgttgcgcgtcccggatgccgggtagccttctccccgttccttacctgtctggttgatgccggtaccgtcgatgatgtcctggagggcggcgttgacttcgtcgattttttcaaaggggatccccggaatttcgaacccctggcgggcggtcagattgacgtggccgttgccgtatttttccgcgatttcctggattttcccgaggtattcagctttgagaaagccgccgggcacacggattctggaggacgtgacgcctctgttcttcgttacgcgaaacgcgtttttcttgagttgtttggtgttgatatccatcgtcatcctccttaatcgaccatcgtcttgctcttcagatacgggaaaaccggaccgtcgatgcagacgtaggtgttgccgattttgcagtgaccgcatttgccgagaccgcagcacattttccgttcctgagacagccagatattttcttctggaatccccagctcgatcagtcctgcgatggtaaagcgcatcatcggaggcggcccgacgacaatcgccttcgtgttcgccaaatttttcggcgtcagttccggcacaaccgctgtgacaaatccttcgcggtagcctggctggcccttcgcgctgtccacggtcattctcaaatcgatgtgtgcgtcccaatatttcaaatcgtcgcggaacagcatatcgtccggtgatttaaacccaacaatagccgtcataccgtctacagcttcaggatgatgggcgtaatggtcgatgacgccgcgaaccggtgaaaccccagtcccgccggcgaccacgatcagttcggagccgtcgtaatcggcaaagtcgaagccgttgccgtagggcccgcggatcaacaggctctggccttcgtagtgttcgaaaacttcgttggtcacgacgccgacgcggcggatcgtgaaatcgatggtgtcgtcgccgatcccgctgactgaaattggcgcttcgccgtatttcggcatggagatttcaaaaaactgaccgggtttaaccttttccttcgccccgtcaaaatgcatccggaaggtgtattccgtctgggtgtgacggatgactttttcaatttttgaagcaaatggaatgtattgattcttagtcattgccgcgcacctccttcatgccgtcttccaggtggttgatgatgtttgaaaatgaaatgtattccggacagatgtcatcgcatcggccgcagcctacgcacatctgatagccaaagcgttctttgaaatccaacactttgtgcagggttttaaagcgcatccgctggccgtttttctgacggtagctcccaccgccggccacatccgtgtagccgtcgaccatgcaggaggcctgaacccggcgccgttcgccgatcttgccgttgtcgtcgtaatacacatcctgcatcgtaaagcaggtgcaggtcgggcacacgaaattacagcggccgcaattgatgcagcggctgtcgtactggtcccacatcgaactcatgccgaccttgtagctcaagtcttctgggatgttcaccttcaccttattttcagtgacccgctgaggcgccacgtccgcggataccgcgccggccgtcttcaaccattcgttccattcgtcctttttacaatccagacgatatcggccgtctaccaaatcgacactgaagtcgtagttgtcggccatattggactgcatcgagacgcagaatccgttttcgcaggattcagaacagccgattaaggcaaaggccatatccctgcgtcttctttcatagtaatagtccggatcgccattttccatgtaaatttgatccatccgtttcaccgcggccagatcacagcttctcagaaataccagttttttcttggctggcccttctgtttcgccggcgtgattttccgcgaaataaaacagcgtttccgatggcggcagtaccgcctctttccacgaatacgcggacttttcgttcaactcaatttcgtccggcgattcgatgacagcgtagcggaccgcatccgtgtcggaaaagcgtcccccgcccttaaacttcttcggtgcccagatttcgtactcttctttcagcttgctgatgaaatctgaaaattgctcccgatcggcaatataacccataaatcctccttctgtattagcataattttattatgcaaaccatttctgtattaattttagcattttttattgtttttgtcagttgtttttacaacgatatggtcattaattgtttaattcgtgtaaattttatcaattatttttgaaaattttcaaataattttacaatccgctttacaaaacgacagggccgtgataaaatgcaaagcaaattcaatatcggtgaaattggaaacgcacactcctgaagtgataacgaacaacacggtgatcacgagaggagtttttttatgcctaaaaacaaatttgaaaactttatttttaccgtcatcatggctttcatcatggtttacgcgatgatctgctacaacatttcgctgaacattggcggcatgaccaatcaggtcttcctgatggccttctctgagctgagaatcatgtggccggtggccatcgtgctggaaatgttcgtgatggaaaaaccggtcatctacctgacaaaccgcgtcgtcacaaaagacatgccgttcatttggatcctgttaatccgctgctcgctgaccgtctgcctgatgtgcccgtcgatgagcttcgtcgcgacactgctcttcaaaaacttcgcgcaatccggttttgtcggcatgtggcttcagactacggccatgaatttcccgatggcgctggcctggcagatctttttcggcggcccccttggacgcctgtgcttccgcctgattttcagaaggcaaaagggtcaggctcccgctgccgctgaaagcctttcagaataatcgctgtcttttcgatgaattgggtgcgcccgccttcttgttgacatggatgttacacttaaatcaaaaacaaaggaggtggaccgatgattttatattccagcatgcgcacggacattccggcgttttacagcgattggttttacaatcggattgccgacggtcgagtcctggtccgcaatccttattatccccagcacgtgtcgcaatatcggctcacgcccgatgttgtcgacattttttactttttgacgaaaaatcccgaaccgatgctgagccgcctcgaccggcttaaggccttccgcaccttctggcacatcaccctcacgccctatcaacgggatatcgagccgaacgtcccggacaagcgggacatcgtccgcgccttcaaagcgctgtcccgccgcgtcggggcagaccgcgtcgagtggcggtacgatccaattttcgtaaccggccaatacagtgtcgcctaccacatcgacgccttcgaaaaactcgcgtcggcgctggagggcgccacacaccgctgcgtcatcaattttatcgatctgtatcaaaaggttcgtaaaaattttcctgaggtcaccccgattacggcgtcgcagcgccaggccatcagcgcggccattgtcaaaagctgccgcgcccacggcatgatcccctgcgcctgtgcgtccaacggcgatctcgccgctgtcggattcgactgctccggatgtatgacaaaggaaaaggtcgagcgcctctaccacgaagcgatcgacccaccggcctctcggattggcgccggcaccggcgccctggccggctgtccctgcatcaccggctacgacataggcgcctacaacacctgcccccacggctgcaggtactgctacgccaattacgatttagaaaccgttcgaaccaattaccgtaaacacgaccccgccgcaccgtttttaatcggcggctcgctgccggacgatatcctgcacgacgcccaccatacctcctggatgaccggtcagctcaccttattctaaattttttagccttttaccagcagtgatttaacgatcactgcttttttatttcgtcaacgccttagcgcaccagatgtaccccgccgcgcagcgtttttcattatccttgaagtggttgcccggatgccatgccagcgtgcagctttcaaccgacgcattttgtttgagcacgtcgtattggtggcggatgttgtcgccgacctgcgccataacctgattgcgtgtcttttcctctttatcgccaaggcttaaataaatcgccggcaccttgggcgcgtgggcgtcgctgtaatcccgccatccgggaaaccagactgaaggtgacgctgccatgaccgccgcgaaggcgtctgtttgataagcacaccaaagggcaaacagcccggccagagagtagccgccgacgacaatcggcgttgtttcggaaagcttcgcccgcgcgcgcacttctgggatgaacatctcactgacgaaagccaaggtgtctgccgcgccgtgaccaaaaccttcctttccgaaaaccggcggcgcgtcccacggtgtcagatcggcgttccaatcgccgacgtaaaaatcggcaaaaacaaagggctgttcgatttgttgattcatgatctccagcatcgcgggaaagccctcagcgtcgtgatcgtctaccgcctgaatgaagatcagttctgcttcccggccgtcaccgtccggcgtgtacagctcgcaggcttttcccgccagttcaaaggctgccttttccattgattttcctcctgtggttattttatgtcattatagcacagcgaaatgtcttcagatatattttcccgtcatgctttctgcacaatttttaacagcttccaccgtcccggccgcgacgatgcgcccgccttcttcgccgccgcccggccccatatcgacgaggtaatcggcgttgtgaatcacgtcgagatcgtgttcgatgaccacaatcgtcgcgccaaaatcaatcagcgtctggaagaccgtcagcagtgttttcacgtcgaggggatgcaggccgatggtcggttcgtcgaagacgaacagcgcgtccttttgagggcgccccatctcgctcgccagcttgagccgctgggcctcgccgccggagagccctggggtcgcctcgcccaaggtcagataccccaggccgagatcgtgaagcacctgaaggcgcctgcacaccgccggcaggccctgacaggcgtcaagcgcttcgtcgacgctcatcgccatcagctgcggcagcgtcaatgctttttttgctttgttgtgccaatggatgtggtccgcctccgcgctgtagcgcctgccgccgcagtccgggcaggtgatttccacatcgggtaaaaactgtacgtccaaactaatcgtgcccgtcccctcacagatcggacatttgagcgcgccggtattgtaggaaaaggcaccgggcttaaagccagccgccttcgcttcgtctgtctgcgcgaaaatcttgcgcagcctgtcgtgaacgcccgcgtacgtcgccaccgtcgaacggacgttgatgccaatgggcgtcgcgtcgatcagcttgacctgctcaatccccgacgcctcaattcctttgacgtgcgccggaagtggccgcccctcgatttgcgccgttagtcctggaatgaggctctccaaaatcatcgtcgtcttgccggagccggaaaccccggtgaccacggaaagccgccctttcgggaaggtgacgtctaatggcttcaccgtgtgaatcggtccggtttgcatgcgaacggctccgttgtcaaacagctccgattccgggcagcgctttcgaacctggacggtatctccagaaagatagggcccaataatcgacgccgaatccttttccattttttcaactgctccctgggcgatgacctgtccaccgtcggcgccggccttcggtcccatttcaatgagccagtccgcctgtctcaaaacctgcgtgtcgtgatccaccaacaccaccgaattgccgtcgtcaatcaaatcgcccatcaccccggtgagcccttcgatattggccgggtgcagcccaatcgacggctcgtccaatacgtagagtacaccggtcgtccgattgcgcacggcccgggccaactgcatccgctgacgctcgccagtcgacagcgtcgacgcggcgcggtccaatgtgatgtagcccagccccagatccaaaaggcgcttcgcggtgccttcaaaagacgcacagatgctcgccgccatcggccgcatctcgtccggcatcgtccccggcacgcctttgacccacccgcaaagggcggtaagcgtcatttggcaggcctgatccagcgtaatccctctgagcttcggcgcccgtgccgcttcggaaagccgagtcccgccgcagtccgggcagactgccgtctttaaaaatttttcgacccgtttcatgcccttctcgtccttgacgtgggacagcgcgttttccacagtgtatttagcgttgaaataggtgaaatccatgtcgccggacgcgccgctggttttgttctgatagatgatgttctttttgacggctgggccgttaaacacgatgtcccgctctttgggcgtcaaatccttgaaaggcacgtcggtgcgcacgcccatttctctggcgatgtccttcatcaaagaccacatcagcgtctgccatgggcgcacagcgccctcgtcgatggacagggtttcatctggcacaagggtcgcctcgtcgacagtacgcaccagccccgtgccttcgcaggtcgggcaggcgccgcggctgttaaaggccagatcttccgcgcctggcccgtaaaactgcgcgccgcacgtcggacaagtaatggccttcatcgccgccacattgagcgacggcggcacgtaatgaccgttggggcagcggtggctgcccaatcgggaaaatatcaggcgcaggctgttcaaaagctcggtcgctgtgccaaaggtgctgcgcacccctggcacccccgggcgctgccgcagggccagcgctgctggaatatagcggaccgcctccacctctgccttttccgcctgggtcatgcgcctgcgcgtgtatgcggaaagcgcctccaaataacggcgggagccctcagcgtaaaggacccccagcgccagagacgacttgcccgatcccgagacgccggcgatgccgaccacttgattgagcggaatgtcgacatcgatgtgcttgagattgtggacgtccgcaccccgcacttcgattctatttggcactttttcgtgattctgccccatcagcctgcctcctgcattgctacaatattttatttattgtaccattacttgaactggacgctttaatgattacgcaataaaattatttgacaaaaatttttctgtcatttaagataatattaaagtcttttcaagcgacacatgatgtcctttgtaacggcttttttcttttgacacagtttgtgtcccattttcacaactaaataaaagacagctcaaagcagaaccctttcggaactgttgtctggcgtttgttcggccagtcctacgtctaaaagatgtcgcgacctgtcacaggaaaggagttttttatgaacaatccaaaacccgtgaaacacgcggcagctgtcttaacggccattgcacttggcgcttttctggcgacatttaacgaaacctttttaaacgtcgccttgacgccgatcatgcacacctttcacatcaattccggtcaagttcaatgggtctccactgcctacatgctggtggcagccgtcaccgtaccgatggtcagctttctgttccgcagtgtgcctacccgccgcttaaccacggtggcctttatctttctgctggcaggctctttaattggcgctttctcaacagcttttcccgttttgattgtcggccgctgtgtccaggccgtgggcactggcatgatcgtccaaatcggcatgaacctgacactgctcatcgcacccaaggggcgcctcggcacctatatgggcgtcgtcagcgcggtgacgctgctgggtccggcattcggccccatcgctggcggcctgttattgtccgtctctgactggcatctcttatttttcgttttttccgcgctgacggccgcggctttggtcgtgaatctggttttcatcgacgattacgccgtcctcagccaccctaatctcgatgtgccctcggtgatgctggtctctctgacgctacttgggatcatgtacggcatttcgaccatcttctcgcaaagcgtcatcgtcgcgattctggcttttgtcatcgggatcgttagcgcggggctgtttgtccagcgccagcatcaattggccgaaccccttttggacctgcgtccttttcaagatgcgtccttcgtcaaaggggttgccgttgtcttcatcgccttcatgtcggtattcgcgatgaacattctgctgccgctttacatgcagaacgctctcggcttctcagccctcgatgcggcactgactttattggtgccctgcttatcctgcgtcgtctttgccccgctggctggcagtctttacgatcgatacggctttaaacattccctgccgatttcccttttggtgatggctgcctttctgctcctcatgtcgacggtgaccggcacccacaccgcaggtgtgcagattgctctcatttacctgccgattctcgccggctgcaacttcagtatcggcccaactcaaagctatgtgttggacaacttgtctgaagatctgcatccccacggcgtcacgatctgctacaccgcgatccaaacggctggatgctttggttcatccctttacgtcggcatcctcagcgccgtcgaacagggtcggctcgccgccggttttaaaagcgcgctggccgtcactggcggctttcacgtcagctgcgccactgccgcggctgtcgcgctcgtcggattcgtcgtcgcattgtcattaacctggcatccctttgccgctgctccgaaacaaagcagcgaacagctgtcataatccgcttcagctcatctttaaaaaggtcatcttattatccagatggcctttttgcttgcggtacgattgtgatgagatgcgccgcctgcaaatcgccatgttttcttaagaagaaatgcgctaaaatagaatcaaaattgtttatctgttgattattaatagaaaaaggagaatgctatgccttgtactacgcttttagtcggtaaacgcgcgtcctacgacggttcaacgatgatcgcccgaaatgacgactcgggcgccggtcactacacgccgaaaaaatttgccgtcgtcacgcccgacgcacagccgcgccactaccgttcggtcttaagccacgtcgaaattgatttgccgtacaacccgatgcgctacacctgcgtgcccaacgcgctggcgggtgaaggtatctgggccgcggccggcgtcaatgccgccaacgtcgcgatgaccgcgaccgaaaccatcacctccaacgaacgggtgctcggcgcagatccgctggtccattatctgtcggctgacgcgtcaccggacggtatcgaaaaacccggcggcatcggcgaagaggatttcgtcaccctggtcctcccctacatcacaagcgcgcgggaaggcgtgatgcgcctcggcgcgctgctcgaacaattcggcacctacgaaatgaacggcgtggccttttccgacgctgatgaaatctggtggatggaaacgatcggcggtcaccattggatcgcgcgccgcgtgccggacgaccgctacgtcgtgatgcccaatcagctcgggatcgaccaatttgatctcgaggatgctttcggcgaacagcgcgatttcctctgttcctctgatctgaggacctttatcgccgatcatcacttaaacctgtcttttgacgacagccttaatccccgggaggccttcggcagccacgacgacgcggatcacgtctacaacacgccgcgggcctggttcatcgggcggtatttcaacccgaccacgtatatctgggacggcccagacgccgacttcacccctgaagccgacgacattccttggagctttgtgcccgaacggaaaatcacgccggaggatgtgaaatacgtcctctcctctcactatcagggcaccccctacgatccctacggcagctatggcgaagataaccgccgcggcgcttaccgctccattggcgtcaaccgcaacgattttctcgccatgctccagatccgcccggacatgccggcacacgctcgggctttgcaatggctgtgcttcgcgtctaatccgttcaacgcctggattccgctgtacacccaaattgacaccgtgcccgcttttcttgccacgacaggcgaacacacttcaaccgacagcttctactggtgcagccgtctaatcgctgccttggccgacgccggctatcaaaactgcctgaatcacatcgagcattaccaacaggccgtccagtcaaagggacaggccatgctcgcccattacgatccgctgttgaagcaatctgaccccagcgaagctcaggccctttgcgaagaggccaatgccgccgtcaccgatgcgctggaaaagctgtgtcacaacacgctggatctcgtcctctttgaaaccagcaatttgatgaaaaacgcctacgcgcggtcggatgcgtaggtgtgacgcctttcaccggctctaaaattttaagcctgcggtgaaaccttatacgtaaatctgttttcgttaaatttgaaggctatgatatactttaattaatcatcatagaaaattaatatggaggtatgctatggagaaatccaaggtttatttcaccgattttagaacacggcttggtgtcccgctcacgacaaagctgcagaaactgatcaaaaaagcgggaatcggcgatatcgacatgcagggcaagttcgtcgccatcaaaatgcacttcggcgaactcggcaatctcgcctacctgcggccgaactacgccaaggcggtcgccgacattgtcaaggaacagggcggtctaccgtttttgaccgactgcaataccctctaccctggcagccgcaagcacgcgctggaacatttggactgcgccaatctcaacggcttcaatccaacgacgacaggctgtcaaatcatcatcggcgacgggctccgcggcacagatgacatcgaagtgccggtccacaacggagaatactgcaaaaccgcaatgatcggccgtgcggtaatggacgcggatatcgtcatcagcctgacccacttcaaggggcacgaacaggccggcttcggcggctgtatcaagaacatcggcatgggctgcggctcccgcgccggcaagatgctccagcaccagagcggccacccccacgtgatcgaagacgcctgccggggctgtcagcgctgcgcgacagaatgcggttctgacgcaatcacgtatcttgaaaaagaaattgacggcaaaaaagtcaagaaggcgtatatcgatccggaaatctgcaagggctgcggccgctgcatcggcgcctgcgccttcgacgccattgaaaatgataactgggatgcgccggcactgctcggctgccggatggccgaatacacgcaagccgtctgctacggcagaccgaccttccacatcagcctcattaccgacgtgtcgccgaactgcgactgccacggcgaaaacgacgcgccgattcttcccgatatcggaatgctcgcttccttcgatccagtcgcactcgaccaagcctgcgttgacttgtgtgaaaaggcgtcgccgattcagaattctcagctcggggacaacatggcctcaccagattttcacgatcacggtgatgtctggctcaacagcaacccgaacgtcgcgtggaaagaaaccctcgaacacggtgaaaaaatcggactgggttcgagagattacgaacttgtcacaatgaaataattttaaatttgccgctccggcatcggttttgcgccgatgtcggagtttttgcgttgatctctaaaaatttttattgttattttgcaagcttaggaaaatgctcaaacacaatgtcattcagctgtttcctaattattgaaaaatcttgattcaaatcgagcgttcgaacgctgattttgttgccactcatatgataaacatgattcggttgaatgacttcatccgtttttgcatacagcagcatgccagatactttgtgtttctgatctgtcatctccgcttctttattttttacataggtaaaaatttgatacaaatttcccgagtgaatcgttcgtttattgaagtgctgctgcgttgtatgtgcgtagtacttcgcgtcgataatcaaaatgttgcctcggtgagacaacataatatccgactgcatcatcggaagcatcgcatcttcattgtcatcaagctgccacggaatctgcgatgcactggcatgaagatctggaaactcctttttgtagtactctaaaataaacttttcatagaggtgatacatgtgcgcttcatcaaaaaaatccataagttttgttcgccccgaggctgtcgtctggattaatcctttaatgattaaattacaaatcgctatcagcatccgatatgtggcattacatcgattgaattgcagccgccagtttatgcgatggggatccaaagattctacatttccgaaataaacaagtagttttcttaacgattttttccgctttttcgatagatccgaacgaagcaaaagtgccattgttgttttaatgattctgttcatatagttgttctctgaaaaatcatcgaaagagcagatcatctgtttattcaacatactttgttctttgatcgattcagacaaattgatctttccgcgcacagctgaaaaggcgccctttctttcaatgtattcacgtcccagtccgcgttttaattgaaccgacaccccttttgttaaaatcgctgaacacaattctatcgcattatcaaacgactctgttgccacctccctataaccttgcgcgtttagcacctgaaacacataggcaagcatataataaacattctggaccggaatcactgaatcgcactcctaagattatcgctccattctttgacttttgaagcttcatcgaaccagtattccttcaaaagcggaataagttcgtattccacgatgctgaataaggccttatcattgaccatctctggcttaagacaaaaatagctatgaccgatacaaaagccttttcccagggaatcgtcatcagcgatgacctcattcaaatcgacgacgcatgcaatcaaccgatcgaatttttcgttgtttagactttcctgatacgttttaaagccttctgtattaaatcccggctcgatttcgataaaagcaaatcgccggcgcagcgcgtagtccagcatcgcaaggctgcggtcagccgtgttcatcgtcccgatgatatggacccgtttcggaatggcaaacttttcatccgagtagagcatctgaatcttgtgctcccgcttgtcattttcaatcagcatgaacagctcgccaaatattttgctgagattgccgcggttgatttcatcgatgatgaagaaataatcgttgtcgctgtcgatttcagctttcttgcaaaaattgtaaaacacgcctttcttcagctcaaagccgccctctgtcggtcgaaagcccataatgaaatcttcgtaggtgtagctctggtgaaactgaaccatcaacacacggtcgacgtccttcacgcccatcatcgaataagccagccgtttggcaataaaggttttaccaacaccgggcgcgccttcgagaatgatgtttttcttatagcggagcaaacggacaatgttctggtacttttcctcagacatatagacctcgcttaaaaaatcatcttctgtatacaatggataattgacggcttgatcatcgtcctcgtcgagcgcatcactttcgaatatttcctttaattgctgaacaaaaccgttataaggcgtgatgtcggtcaaagttttcatcgcggtgcgctcctgaagcatccagcttccgcggtcggtccaattaacgtggcgcaggtgattgaaatgatcggtccggtccgcgtcgtattcgtaatccgatgtcacgatgccccgtccgatgatttcgctcatgccgttcttgacgaaaatgacgtcaccgggtttcatttctcgagcaaactgccacgtcgcgtgggcagagtttttgtaagaggtgtcttcttgatagatctcctgcatctgtttacgcatagccgatttggatgtaaatgcgttcaggtcgccgatctcgccccaaccgagaagcatgatgcccttttgataacattcgtcccacttttccgctttttgacccggtgcgtaagtccaataatgaacggttggaatctcgtcgtcattttccggcttgccctgtgtctcaacccaagcggcgttagacagttctgggaaggttgtgtacggatattgcccgctttcaaagacggccttgcaggcatcaatgatgttaaggtagtgttcagccgacggcaccttggcgtatgtcttgatataaggctgataacgcgcgacaaaatccgccggcatgtgttcgatattgtagaggaattttcgatttcgggaatcgagatttacgtaaaaatacggtctgatccaatagagtcccatcgtgatgttccacttaatataccgctgggaaagcgccgtattgaacgcttcacaaaaagcttttcggtgatcatcgctggcattttccgccaattttaaagcactttcaaataattgccaaagatgatcgatgtcattcgcttctctgtcccctgcaaatccatagaaagcagcattcatatgattgaggactggaatgcccgataaagactgcggcacttccgccgagatatcaaaggcttccgcgatgcctttcatgatatgaatacgattttcatctttgatacctttgttaaacagtccaaaaaccgtaaagggatcgatgtcaatcggtatgccgcccttttccaattttggcagcttcatcttgatcttttcgaaaatccggcaaatcctttgaaccagctccgcacggtctgatttgaaatttaatagtttatcggccaactctgcataaaaagccgtccattcataatggcctgcttccatatccattcctcctcacgcatttgattaaacaaattatgccattaataaatgaaatcgacaagcctgtccatcgattccttacagatcaaaatgaggcgcatgacgacgaaataaccgcctataaaccgcaaaaagggagacattctgtctcccttttcagactgtcgacaaagtctagagggaaacgctctaggctttgtttttttatagcagtcagtcatttttcacctgtcgcaatacaaacgtggtaaaatagcaataatagaaacaggccatgcattgcattcagtaaaaggaggaaaaaggaaagaaaaaagatgctgacaaaaaacggtgaaaagaaacgagatcaaattcaaatattttgtatggacgacttagttccaaaagatcatcttcttgaatgatcgatgaggccattgactggtcatttatctatgaactggttgaggaaaagtattcggcagatcagggccgtccaagcatcgatccagttgtgttgattaaaattccatttatccaatacctttacggcaacaaaagcatgcgtcagaccatcaagaaatcgaggtcaattgcctatcgttggtttcggatgagtatgcacgataaagttcgcgcattttccacctttggcaagaactacacgcgccgatttaaagataccgatcttttcgaagaaatcttcgcacatatcctctcagaagctacaaacacaagttgatcgatccagagaaatcttcgttgatgccacacatgtaaaggcaagagccataataaaaagaaacaaaagaaaattgccagaaatgaagcgatgttttatgaaacgcagttaaaccaagagattcaaagagaccgggaagcccacacaaaaaaccgttgaaagataaagacgatcaagaagacgatgaacatcacccaggctcaaaaagaaacgggaaatcaaagtagtacaaccgacccggaagcggctggtttcacaaagggaacataaacaagtcttcgcctacgcggttcaaacggcctgcgaccgaaacggatggatcatcggctatgacgtcaacgcaggaaatctacgacacagccgaacctttaaaggcctttatgacaagataagagagcataatccggaaatgatagttgcagatgcaggttataaaacccctgccattgctaagctgctcatagacgacggtatcaaacccgttttcccgtataacgaccaatgacgaaaaagggattttcaaaaaatatgagtacgtctacgatgaagcttttgactgttacatctgtccccataatcaaattttaaaatattcaaccaccaaccgcgaaggtttcgggaatacaaaagccgttctgaaatatgtaagactgtccttatcttaaccagtgcacccatagtaaaaatcatgtcaaagtggtcagccgacaccctatgggcacactacctggaaatctgcgaggacatccgacacacaaacggaatgaagcaatttataatcgcagaaaagaaaccatcgagagaatttttggaactgcgaaagaagcgcatggattccgctacaccaaatgtatggtaaagcccgatgagaatgaaagtcgggcttactttcgcatgcatgaatctaaaaaaactagcaaaaatattatttagaaacaaaaacacccgggaccgaatcgtcctatatttcgatttcaatttataaatctacaaattgcagcttgatattaaatcaaatgaggctctgagtattttctcagagcctcgtttgtctacagtctgaagggagacattctgtctccctttttttatcaccccagcacaaagccggtcatggcgatggcgccgaggttgcagacgtcgttgaagacgcgggccttttcatcctttgcggcgcccaaacacaaaatcagcggcaggaaatggtccggcgtcggcacggcgtaatcggcgtagggatgggcttcccagtggatcaccgcgtcgtcgtcccgggccatcaccgcctggatgatctcggcgttgaaagcttcggtggcgtcggagccgccggggctatcccattccacctgccttaaattgtgcacgacattgccgctgccgaggatgagcacgccttcgtcccgcaggggcctaagcttttcggccatggcgtagagcgccgccggggcggctgtgccgtcgatcgacagctgcaccaccgggatgtccgcgtccgggaacatgtggaccagcaccgtccaggcgccgtgatcgatgccccagtcgttattgaccgcgacgtcgtccccgagcagcgcacagacgcggtcggccaaagcggggctgccggccgccgggtatttcacctcgtagagcgcttccgggaagccgtacatgtcgtaaatctggcggggggtctcggtttgctgtacgaacgtcccccgggtgaaccaatgggctgagagcatcaaaatcgccttgggcttgccgtagtcagcgcgcacttcctggccgattttgcttaaggtctgggtgagggcgtcatcgtccagggccagcatcgggctgccgtggccggtgaagatgacgggcatgcgttggtttgttttcatttgatttctcctttttttacatactttaattttctgacttgcctgtattatataaagctggtatactcaagtcaatccggattttttccttaagttagtatctttatcttgaccattaggaggtttccaatgaaaaaacaggattgcgaaaaggcgggcgtcttcggcatgtgccccttcgttaccgcccagcatctcctttccggcaaatgggccattctcattttgcaaaaacttgccgacgggcccaagcgcttcggcgcccttcagcgccagatcgacatcacccaggcgaccctgtccaaccagctcaagcacctggagggcgaggggctcatccaccgcgaggtcttcgccgaggtgccgccccgggtggagtattccttaacgcccatcggcgaggccttccgccccgtgctcgacagcatcgagacctggggcaacgcctacatcgcctatctaaaagaaaagaccgcgcactgagaaggcccgcccgaaaaaaattctataaatcatcaaaatttaacttacacagaagaaaattttatgatagcatagtcgacgttgatcaaaggcggtcgtcagacaaccgtctatttctatgatctcaatggaaacgcacactgtctcagtgataacgaacaaccagtagaaaataatcttattttctccggcgttcgcgctggggcagttttttatgtgtaaaaaaaggaggacaaatgaatttatcaaagaacaagaagaaaaatccctggctgatcgtaggtgtactggtgttcagtgcttttatcgctttatttaacgaaacgatcctgaacgttgcactcatcaccatcagcaaagacctgcgcgtctctgtcagcgctgtccaatggctgatcactggctacatgctggtgacgtccgtcatggtgccgatcacggcatttttatacgaatccatccccacaaagcggttgttccagattgccatgggcatcgtcctggtgggcacactgggctgcttcttcgcgggcagctttccggttctgctcggtttccggatgtttcaggccatcggcacaggcatgatgatcccgatcatgatgagcacaaccctgattgtcgcaccgagagaaaagctgggcgctgccatggccatgtgcgtcatgggcatcacccttggacccgccttcggcccgaccctgtccggcatcatgatgcagctttttagctggagagcaaccttcgccctcatcgcagccttctcagctgtgatgttcatcgccggctccctcgtcatcgataatgtggcagaactccgttacccaaaactggacatcctgtctgtcgtcctgtctgtagccggcctggcagtcttcctctacggcatcagcatcgtggcttcccagccgctgaacggcctggccttcatcgccgccggcgctgtcgtgatcgctttcttcgtccgcagacagggcaggctggccgaaccgatgctcagcttcgccccgtttaaaaacagaatcttcgttctcggtcttatcatggtcaccatcgccatgctgatcaacttctccatgaacgtcctcatgccgtccttccttcaggaagcttacggcgtgtccagcagcatttccgccatcgtgctcctgcctggcatcctgctcaacgccgtctccacgggcatcagtggcaagatcctcgacaagggcggcgccggtcggatgattccccttggcttcctgactgcgaccgtcttcctggccgtccttgcggccttcagcgcccattctgccctgccggtcgtcatcctgactcacattctgctctatcaggggctggccttctccatgtctccggctcagacctccgcgctggcggttctcccgaaggaactcaacccccatggcgtctcgctggtcaacaccttcatgcagatcgcagcaagcctgggctcctctctcttcggcggcatctccgcgacggtccaggcttccgcagctgctggcggggcatcttcggcgtcggctgccaccagcggctttacggctgccatcttcgtggctgcgggcatcgcctgcaccggtctcattttggccctgatcttctccagatcctgcgcccagggcgcggccgctccgtctgatgcaactgctcaggaaaactaaaacaaaacaagaacaattaatcgtcacccacagttacagcgggtccggatcagtccgggcccgctgttttttgatgtgcttttcgtcccgaaattaaaacgtcatcatttatttatgcttcttttcatgttatgataataagaaaaaaacagaagatttataatcggttaaattttgaacacaaaacgctgtgaggaggaataatatgacagatcagacccttaccctgactaccgctcagatgaagcagatcgccagatacaagctcaccttcaaggatattctggagggcgccagctttgaagaaggccgcatcgtctgtccggaggtctattccttcacccttgacgatttgtaccacgccatccaaaacatgaaagccgccgacccgactgttcgtgaattcggtgatgactggttctatccgatttcacagctttcagaggcctttgatctggatcgtgcgcagggctttagcgacgatgtggatgagtatgattccataaagggatatcccggacttaatctctctgacagcagctggttttacatactttggataaagctcgaaggctgctggttagacattgatgacgaaatcaaactttctgagtttctcaattacgatgagatcctctccgatcttgaccgctatttttccaataagggcaaacctcttgaggcatggtccttctccaaaaatgaaatgatagattacatcggcttttttgacgatgatcagttcgtaaaggaagccgatgagacggagctcgcccttgcgcggaaattcaccgatcagctttgtgacgaagacagctgccttgcgctccgcgtcaagggttatgcctgctatggcgggaaccggctgtatccctgtgactggcatacttcccgggactgcatgatccgcctctttgagagaacggatgatccccagtatgccgacacccttggctatatctactactacgggcgctgcaatggcggggtgccagaatacgaaaaggcctttcattatttcggcatcgccgccgccaacggtctgtacgaaggcatgtacaaacttgccgacatgtactgccatggctatgcgtgcaaaaagagtccgcgcacggcccgctccctttacaaaatcgtctacgaagacagcctccaaaatttcctgaaaggccgtggagcgaacttcgccgatgcggccctgcgcatgggcaacgtgtatgccaaaggaatcgatgaagaagcagatccgatcgcagcctatcgctactacgtgcaggcggagtatgccgcgaaaatccgcgcccaggaaaatgatttcttcggcaatacaaccgtcgtgatcaatgtccagaaagccctggaagaaacccgcgggaagctgcccaaggattatctgaaagcgcatatggcctatgactttccctggcttttcagacagcttgcggaagacaacaatcgctgtgagcttcgcaaggtcaccaacaataaaggccatacagaactgaccgccaaaaggctccctacccgctcggtgccggagcctgactgcattctggtcacgattcctgaactttctttctgcacgaggacggcggaagtgtcctataccatcggtgacaccgcggaaatctggttcgttgacggttcagatgatggggatcgaacccgcttcgacttctgtgattggaatcctgtggaatgccgttatgaattttattatgataacgaacttgtcgcctggtcaaagtccgaaaagtaccgcttctacggtccctctgcctgagcgccttcctcgcgaatgcgcgcctgcaggttttgcttacgggccgcgctccatttcgcgcattctctgaccttcggcaggccgttgggctcggccaattcttcgataatggccataatctcatccgttgacaccgggtccggcccgctgatgaggtccgagacgtccagggccacatcctcccgcacggattcgcggtagtcgagataataccccttgtcctggtaaatcagcgtcaaaagcgcgagataggtcaatgccgccgcaggcccgtggtgcgcccgcggcgctctgagcttgcggtccgtgagcaggcccacctcgaagggaaaccaatccagccccgttttgcaggggcgtcctcttttgtttgccattttttcctccttatcatttcatctctcttatataatgcgtaaatttgccaaagggttgacaaaaatttttgcccacaggcaaaaaaattttgttcacgcgtagaatgggtccattttgcaaagacttttatgacataaaaagataaaaaaaattgtcttcccctttaaacaagaggaagaccaaaacaaaccggggcctcctttaccgggcggcggtaagctcccggcagatggcttcaatttggcccgaatagacgctgcccttttcccagatgaagtcgaaggggtgggtcatgtgaaaatcgttaagggggatctcccgcagggtgccgcaggccagctccggtgccaccgcaatgcggtagagaaaggaaatcccgcagtcgtttttgagcagggcgatgatagtgtgcatgttgcccacctcgaccgacgccttgaaatccgacaggcggatgcccttggccgaaaggcttcgcgccaggatgtcccgggtgccggagccgggctcccgcaggatgatgcgctccgccggcaggtcccccagggccttcacctggcccacggcgaagcggtggctcgccgcgcagacggcgacaaagggctggtggctgaaggtcaggtgggcgaagtcgtctttgggataatagccctccaccagcgcgaaatcgatggcccccgattgaagcaggcccagcagcttctgggtattgccgaaaaccacgtgaatgctccagtcgggatgattttttaacagcgcggtcagcgggccggcgatggcgtactccccgacggtcatggtcacgccgatggcgatggaccatttcccggagcggacggcctgcatctccttgtggatgcgggcgtcgtcatttttctgcaccagcagccgcgcccggagaattttcccctggggggtgagggtcagggtcttcttctcgtaatgaaagagcttgacgccgtaatgatcctccagaaaatgaatgtgctgggagacggcgggctgagtaatgtgcaatatctcagccgccttggtgtaattcaatgtccggcagaccgctaaaaaggtttgaacgcgaaaatcaagcatgccattcctctcatcaataattttttcttattgttttataaaaattcatcattttacattttggttatgtttctttatactagcacatgcctttaggaaattcaaaacttgttgcgtttagggaggataatcatgaaatcatatttgaaaaattttggtccgggactgggcgtttgcttcgccatcgccattccagcctggctgctcgggaaggttttccctgtcgtcggcggcgccgtcattgccattctggccggtatggtcatcaccttgttctggaatgacaagggcgtctgtgatccgggcgttcactggacctcgaaatacattcttcaggcggccgtcgtcctcctcggattcgggatggatttaggcgtcattctgcagaccggccgtcagtcgctgccgatcatcgtctgcacgatttccacctcgctgattctcgcctggcttttgcaaaaagccctgcacataccgggaaagacgtccatcttgatcggcgtcggcagctcgatctgcggcggctcggccattgccgcaaccgcacctgtgatccacgccgatgacaacgaggtcgctcagtccatttcggtcatctttttctttaacgtcctggcggccattttctttctgatgcttggccacgccctgggcttctccaccaccagcggcggtcccttcggcattttcgccggcaccgctgtcaacgacacctcatcagtcacagcggcggcggcgacctgggacagcatgtggcacctcggcacgcagaccctcgacaaggccgtgacggttaagctgacccggaccctcgccatcattccgatcaccctggtcctcgccatggtgcaggcccgggctgaaaagaacgaccgcggggaaagcggcgggttcagcttccgccgggccttcccgatgttcatcctttattttgtcctcgccgctgtcatcaccaccgtctgcatccatttcggcgtccctgccgcagccttcgcgccgctgaaggaactgtcgaagttcatgatcattgtggccatggctgccatcggcctcaacagtaacgtcgtcaaactcatcaaatccggcggcaggcccatcgttctgggcgcctgctgctgggccggcatcaccgttgtcagcctgctgatgcagcacgtcatgcacatctggtaaggcgcctgtctctcaacaatcgccgccctcacgtgtcttggggggcggcggttttgctgtctgagatttacatggcgcacaaaaaaagactgcccgaaggcagccccgcatcattctggattattttttccgcatgacttcgatctggtagccgtccggatcggtcaggaaataataatccttcgtcgcgccgagccccttgagcggaccaaccttgtagcccttcgcctgatgttcggcgtgggccgcttccagattgtcgacctccaccgcaatgtggccgtagccggtgccgagatcgtagggctgtgccggatcgtaattgtacgtcaattccagctcgaaatccgactgaccatccgacagataaaccaaagtgaattttccttccggcttatctttgcggcggacttccttcattccgagggcatcatcgtaaaatttaagtgaacgatctaaatcgtaaacgcggatcatttcgtgaatcattctgcatgctggcatgtttatcccacctttcgtgatttgtttaattgtattttatttgaatcacaccgataaatcaactcaaaatatcgtggacgcgctgctgaagtgccggcaccacctgttcctcaaaccacggatttttgcgctgccatctgaaattcagcggactcggatgcacaattgggaaatattccggcagatatgccttgtaagccgcgacggtttctgtcagatttcttttcttcttccctttaagataataatccaccgcgtacttgccgatcaaaatggtcatctcgacgtccggcatcatacgcagaatctgaggatgataggtctgcgcgataaatttccgaggcggcagatcgccggacttgcccttgcccggatagtaaaaatccatcggcataatcgcaattttcgaggagtagaacgtctcccggtcgatacccatccagcggatcagcttttcgccagacttgtcgttaaacggaattctggtttcctcgacctttcttcccggcgcctgcccgatgagcagaatcttggcgtttgagctgatttgaaataccggcggcacgccccgcttggtgtaggcttgatttctttcatctgccttcagtttttccacgatttcctctactgtcattgtattcccttctttcgcgctggtgttccgttaattttttcgaacgattaaaattaattcagcacacgctgactataaattaagcttatcatattttgcctgcgcggtacgttgttagggcaacacgttttaatttttcaaaattaatgcatgatttgatttttaaattcttccttttccttagatgacagttcattataaagcagcataaccatatcgattcgatcattgtgtaccgcttctttttcgccatgtttcgacataaaaaaagaagtgattgcactggtcagactactgatcaagccgatccccacgatcatcaatagcgctgcaatcactctacccgctgttgtgaccggtgaaagatccccatatcccacagtcgttgccgtgacaaaagaccaccagagtgcatctagaaatgacatcttttcaaaatacatcattccaatcgacgcaccaccaatggatgcaagggctaaaaaaatcatatactttaatccattggtatcgacaaattcttttaagtgttcaatcccacgggcgcctctcgctgataatgatgtgaatcggaccactttaaccgctttcgacatttttgcaagacgtgccaatctggctattttcaaaatacgaaaaacacggaacaatgaattaaagggaaatatagcaatcaaatcgaaaatatttgacttaaaaactgtctcttatccttcgccactgcgatgcggactacgtaatctacgacaaaaatcagataaatgatgaggtcacatattttagccgcaggtggcagccctctccacagatcatctatcgctaatgcgactgatacaatcgccaataaacaaatgaccgcgttataaattttttctcttttattcattcgatcgacattgccgcctctctaaatttattcaacgattctatgaatagaaataacacagatgcaagccacacagctgactttttataatcccaacaattgcttcttttttgcgtcgtattcttcttgtgtaatggcaccgtcgtcgagtaacgctttgaatttcgcgatttcatccgcgactgaataattctgtgatgatagctctggtgtatcggaaagcgctggctcttctggtttcgtcacaataccgttgcttaaaatgatttcattacaaatctcctgtattcttttggctatttggtaacttaaacgatagattgtcgaaccaagttttgttttcgtttcaatgagtctaatttgttgatattcaggagttgatttaaatcgaagcctaaccatcagactttgacaaaaatcttttcctttcttccccatcatcccgccaacgatagcgccagcaggtccaaaaagtatggctccagctgcggcctttccagcgcttacaggcgagccatcctccttgatgtctctttcgaatactttgcattctaacaaatcactggtttggcggagttcatatttagagatccccgtcttaattcgcatatacccatgaattgaatcgatctgcaaatatgatcccgcctttttgttttgatccggttcaaaattttgaccatttggaagaatctctccctttctctccaacttctgcttgttctttgcagccttcttctctaatttagcttgttttttggcttcctttctttgttcctttattttgtgcgcttcagctttttgcacatttttttcgtgtgctttttgcgcttttaactcttttctcgtcgctttctgattgcgtttgacttctcttttttcttcttttccttttccaaacatagcgtagcctcctaaccattctttaaattaatgatattatatttttgaaaacctttcaatattttcaaagatttttcacccgctgagtacaccaaaaaaagcgcattagattttcatcgcatcaaaacgctgcaagtctttgcagttacacgatgattttgatccaatgcacttttttgatttgctgctcgcaaaaattggcatcactttgagtattttgttcccctgcccctgcctgaaatggtcacataatgcttagatgcaagatccttcagcagctttgtcgttttggaccgcccaaagggcagcgcgtctgtgatttcgccgatcgatttcggcaaattctggctgaggacacccagcaccatcaactcatcatcggttaaatcctggcggtcgacaatggggagcgtgacctttatcgaattttcgaaaatttcaaaagccggctttttgtcgctgccgcgatacgcttctttgattctgagcacgcctgttcccaaaatttcaacgatatgcagccggtaaaatacattgccgataattggattgcgcagcacggagacactgccgttcagatactcttcctcagatatgccgctcggcagcccgccgggtgaagtcacttcgatcctgtcatcgtacatcatcacgcggatttgcgcgtcaacatcccaagtgcggtgaatcaacgcgttcgcgatggtttcccgaaaggcttcctccggaattctctcaattacctttcgttccatcccctggatggcttcataccggtaaaaatcccggaatatttttaccgtttcatccaattctgtcaaaatcgaacggttttcaatcatttcccgtttcaatatgatgctgatcgattcgccgaaacgcgcgatatcgataccggggaatccgttcacatccgccagcagctccgccgcgtgattgtatccctctgtgtcgctataaagattcaatgtttttagaatgtcttggttgatttccgcgatgccgatttcccggaccgcggccatttgcagcacgttaaaggttaaatcctgccgatttgccggcaattgttcaaagtgcatgtgccttccttttaagatcaaccgcgtcagctcaagggcgtcaacctcaatcgtcgccaaatcatttctgcggtacgctttccccttgtaaagataaggagggctgatgcccggttctacagaaagcgtcaccgttctttcattcggctgtacactgagtgcatacgtcggctgagggtgaatcgtatcgttgatcttattttcaatatccaggcatgcctgctccggattattaagaccgcaaacggtcccgtcatcattgacgccgaaaattacgcttccgccgccgtaattggcaaaagcgctgattgtttttaaaaatgtattggaaatacgcgatttaaactccaatgttttcgattcccgcatggcccctcctcatatcgcatctttttcgattattataatgaataagcaattaaaaaacaatcacaaaaatttgcgattgctttacgactgtttttcggttgtattttcgcttttacgattgcatcgatgatgatgattaacttccccttgacatcctttgcctgccgtcgtatattaatcgcaacagcatacgacgacaggcataatacgtcagaccatgtatcttgacgcaacatgagaaaggcgggtcgccgtccgaaaactgctcgaatccatttttaacgcgaaaggagaaccgcaatgaaaaacaagcgcagcctctgcctgattctgattgccgccgtcgccttggccgtcatcgcctttggcgccgggcaacatctgggggccgggcatctgtcccccgactcggacgaggacaatttcgccttcccttggactaaagcccaccagaccaccgtccgcaaaaagctcgacacctttgaccgcgccgatatccacctcgacaacacggacatcaccctccaagacggcgacggctttgccatggtctaccgcgggccaaagggcacctgccccaccctcaccgtcacagacggaaagctcactgccaaagcggcgaagaccgccgtcggcgcccatcaagacgccgagctgacgctcacgattccgagggggcgcgctgaactcaaaaccctcaccctggccgctgataacggcgacatcaccgtcgagcccgcccaaaccttcaggaccctgaccctcgagagccaaaacggcgatatcgacctcgacgcctgtgacgggaccaccctgaaggccacgacttcaaacggggatatcgacctcgaaagtacggcctttaccaccgctgagctgaccgccgacaacggcgacatctcggccgccccggccgacagcctcgcccgctacaccatctccgccaaaaccgacaccggcgacatcgatatcggcgagcgcgaatacaacgccggcaccatccgcgtcggcagcggtgacaagaccatcaccgcccacaccaacaccggcgacatcgacatcgaaaacgactgatgttgatgaattaaaaaatccctgccgtcttgaatgtcaagacgaacagggatttatttttattccaactcgttgccgaaaaccacaacttaacgctttttgtttataaattgtgtgatgtggttttcatattattctgataatccatattatactgcctgtacgacgagaatttatcaatatcttatcagatgtgataaaaccgatggttgcgaagaaagaataactgccaccggattgtttttgtcaaatgtatttcttaaattacaattctcttattttttcgctgttaaaaacaatctgcgaaacccgaataaaatattaccatcaaattggatgggatattgttcttttacccttttcaatatttcttcttcaagttcttttcccatttcttctcccaaaaaatcaagatacgggcgaagttttgcacttcttacccattcaacaagggccatatgatcaggcatactgtggtagtacttcgtttcccatacatcgaaagaggatgaacattctgaaagtatttcataatattctttagcatcaagtgttatattattttcgagttttgcacaatcaaatccccatttaggttctgataccacttcgtttataatacggtatagcggttcatcattgttatatggcatttgcactgccagacaaccgtttggatttactttttccatcaacgcgggcaaaaaagtcttatgattcggtatccaatgaaaacaagcattggaataaataacatcaaactttccttcaattgataatgcattacaaacgcaaaagtcaatgtcgggattatcttctttagctttagcaatcatattaggggaagtatcgataccaagaagctttgaggttgggaatatttcttttaatatttttgtactatttccaggaccacaaccaatatctatcacagttttaggtaaataatgagcaattcgcatagctaaatcttttgctggctgagaacgctgttttataaatttttcatattgtaccgaattccaatctgccatatttttcactccagaaaaatcatatttatatttttatgatattataaaaatatgaatatttcaatgaatttgctgaaaataactctaccagaaagaaagtgtatactctttgacactacttatgatttatatacaaataaaatttttattcacaacctccattgctctattacgaatattattcatcttctgcacccacagcatttgcttttcagctttgagcttttccgttacattttctttttccgccagttgttttaccagccgggaaaacatttcctctgcctgctcgtcaatatccgcaagataactgttcaacttgccgcttgtgagcagattggtgtaaagtatcttgcggtgctgtttgaggtaacgcaaatgcctttgtccccaaatgcccactggcttctgttcttcttcgggcagtgagaggcaagggagataataatctccctgccgtacataagtcccgctctgccaaaaccaacaccggcgacatcgatatcggcgagcgcgaatacaacgccggcaccatccgcgtcggcagcggtgacaagaccatcaccgcccacaccaacaccggcgacatcgacatcgaaaacgactgatgtgaaccttgatgaattaaaaaatccctgccgtcttgacattcaagacgaacagggatttatttttattccaactcgacttttcctaactgattttgtttagaaattattctctgccgagtatgtaaatcctttgattatttgatatatccatattatcctgcctatataagctaatgttatcattttgttatcggtattgataacacttgctcagtagctgtggataatagttatatgctatggcttaaattataagcgagttttttttgttttttaaattctataccgaccagtacaacagatagcacaaacgctgaaaaatcagcaacaggccccgctagcaatactcccataattccgaaacgaagcgggagcagcagggtaagcggaatcaagaaaaaggtctgccttgttaatgccaacagagcacctcttaacgattttcctattgcggtaaaaaagctggaagaaagcaactgcacaccatttaccaacaccatgaaaagataggtacgcatgaacaaaacagcaaattcaaaatacagctcgtccccgtctccgaatagcgaaatgatagattgcgggaaaaattgaaatgcgatgaaagcaatagtggaaacaacaaggttccattttaccgcaagcaggtaagcctcccgtacacgatggtattgccttgccccatagttgaagccgataatcggctgcatcccttgcgagattcctacaacaatcgcaaggattatggcatttgttttcataacgattccgcaagcagctaagggaatatctgttccatattttgttaatgcgccgtaataagtcaacgaattgtactgaatgatttgaatcacggtaactgcaatctggtttgagctgctgctgattcccatgttgcaaattttcatgctttctttgatgtccaataaaaacgactctttttcaaaatggattgtttggaaacgccatagataacggagtgcgagtatgaaggaaaaaatttgtccaataactgttgcccaagctgcgccggcaattccccaatcgcaaacaaaaataaaaatggggtcaagaatggtattgataatagctcccacaaccatgcagaccattgaatactttggttttccatctgctcgaatcaaattgctcataccattcgttacaatgagaaacggcattccaatcaatgttatgctggcatactgctttgcatatggaaatacatctgtcgttgccccaaatgcctttaggagcaaagacagaaaagtttctccaaccagcaaataaataattccgaaaattcccatcagaacaataccatttcccgctgctttggcggcagctttcggctctttgcgtccaagacagagggaaacaagggaagcactgccaattccgaccagtagtgcaatggcaaggcagatggtagaaaacgggtaggcaacattggttgctgcatttcccaaataaccgaccccttgaccaataaaaatctgatccacaatattgtagattgagccgacaagagacgccacaatactgggaacagcaaaatttttcaacagctttgaaattttttcatagcccagaggattttcagtcattgaactcctccccctttctctctatatggagttccgatgtgatatttctgcccgcctgtattaagaaatccataaaaaggttctgctcggattcgctcataccctgcaataaaagagcttctgtcttttcgcatatcatctgtatctcgtcaataatagacaatgctctttctgtaggatacaatttatatgtccgcttatccttatcattgggagaacgtgtaatcattccctgcttttccaatgtcgcaactgtccgtacaatattgcttggatgaacatagaacatattcaacaaagaatcttgtagaataccgggcgaacgacagattttgattaagaacatatattgactgttgttgattccataaggggcaagttgcttgtccaaatagattttgtaaaatcggtctgttacggaaagccattttaatagttgcatagatatatacctccaatcagaacgtattatacatcaatatgcgtgcgcacgcaactacttttaacattatatctgccgctttgtcctcctaaacacaaatcaattctacatctataatctctactgctctgctacgaatattattcattttcccgacccattcaagctgattttctgcctttagctgttctgtcacaccctcacattctgccatctgttttaccagccgagaaaacatttcctctgcctgtcggtcaatatcagcaaggtaactgttcagttttccgcttgtcaacaaattagaataaaacagccgtttatgctctttcaagtagcgtttatgccgctgtccccatatgccgatagattgtgtttctgtttcgggtagtttcaaatcggggagaaaataatctccaacccgtatataagtgccgcccatttcttcaaaaatcgtctttgtcattgtgtatccctacctttcattttgattatctctaaagcgtttatcatgctgtttagactgtttggcttgctctaaaagtccatcaatttgcttgctgccgaataccttacggagtagtttataatccctgttttgctccttcagttcagcattttcagcgttaagactgctgttttttctgctcaacacttggttttcacgatacagacttgcgtttgttgcgttcagcctgtgataactgtcccacgcttcaaaacatcgggcaaatacggttttaataagcgattttaacctcttgataagcggctcggcgaactttgttttataggttttggctgtcattaaccccgatggttcgggtagattatattcaggtgcagtatctaagctatcgcttattgcctgcaatcgctcaataccgtcatcaaaattctgcactcggtctgaaagagatttcaccacatcggttttctcggcaatctgactgtcaagagccgatatttctttttcccgttcctgctttttgtaatcaagaacggacaaatgcttatcgtgtgtgcctttctgctcccactcaattccgtaccgttccataacggcggcaagctgttctttttcagaaagtacccattgcgaccattccgtatcgccacgagtaccgcccttaaatccctgcgccacaagagcctgttttagcgacactcttgtatctaaacctcgcttgctacctgttgtaaacggtacaaagtcaatgtgaatatgcggtgttgcttcatccatatgcagatgaacagagaacacatataagtttggatttctctctcgaaaacccttgtaatactcatccaaaatctgctttgcaagctgtccgttttcgctttctgcactcatattatctttatcgccaatctgtaaaatcagttcgtgaaacggcttttcctgtttgcctgtacggattttgtcgtaatagttttctatctttcggtctgcccttgtctgcttatcattgtatcgtttcagagcttcatcaaatagtttgtgatatactttttcgatgttctcattgcaataatctatattcaagtgggtgcgctctggagcaatattctctgctgtaaactttcggctgttgtgattgatcgagccctttccgaccattgcactaattgttctttgcattttatcacgccctttcttttcggttagtggttctgttactcttgccaagagtaacgcaaaagcacttttgtcagcttcgccaacaaaaatgcaacctgcaagcaggttttgcgctctccgagaggtaagggctgtcctttgaaaaggacacccttacaaccccgtctaaacttttgtgacggtgtgtgacgatggtgacggtatttttgataccgcacccgcccctaaaatcatcgtcacaccgtcacatatcgtcacgcctgctccaatcgggatagctttacttttcgctcacttcgactgcggctgttctcatagaaaatcttatactcatttagcaaacgccccgcattgatattcagctttcgtgtgagagcgttaggctgaatatcaagctgaagaatagagcaaagctccgtaggcgtccccgtccattcattactgcccgaagaaagcaattgcgctatcttttcaagcaaaggttcgggcggttctttccaaagctccgtttctgtccgttccagctcccacagcaaagtttcggtattgcgattgaggtacagcttttggtcttgctgatctctgcccgatacttcaagcgtggcggcgttgcttgtgcgtttctctttttgcagaagaaacgccccctccgccgcaccgagcaagcctgtcgttcccgaaatcatattaaatttatcatccgctgtttgcttcctcgtgtgatgaacaagcagaatacaaatgccgtacttatcggcaaactgtttcagccgtgtgatgatttcataatcgtttgcgtagctgtaattatccccgccgacttctctgaccttttggagcgtgtcaatgataatcaggcttgtatcggtgtgttcctgcataaaccgctgtaactgagcgtccaatccattaccgagactgtcggctgaaacagagaagaaaagattgtctgtgctgtctgttccgaacattcggtatagccgttcctgcaagcgtcggtaatcatcttcaagagcaagatacagcaccgttccttttcggacggtataatcccatagcggtgtgcctgtgctgatatgataggcaagctgcgccatcaggtaacttttgccgagcttcggcgcaccgacaaagagataagtgccagtatagagcaagccgtcaatcagcggcggcttgcttggatatacggtgtcgtaaagctctgtcatagaaattgtttcaaggtcgttgatttttcctgctttttcggatatactattgtcagtacattttgaaattggctgctccgtatctgttgccgcagatacatcaagggcagtcatttcttttttattctccattcccatcttctcctttcagcccgccgagaataacggcaatcaattcgattgtgtcaagcaattcatcatcaataccgtttcctgcttcaatcctctgtaattccgcaaggacggcagcaagctcattacggagtgccttatacactctcggattgccctgcacaaccacatcttggcataagagccgtcttgtgatatagtcctgcttggtaagccccgaaagtcgtactgccctgtctatctgctcgctttcttcgggcgatacccgaaaccctaccgtgatatttctccaacggtttttgttgtccctgtttttcgctgacatattaaaaatctcctttccctaaatcgtctaatcgctctgccatttccgtctgtttagacgggaacaggtgggcgtactgataagtgatttcaatactttcatgtcctacacggtctgcaatcgccaccgccgaaaatcccatatcaatcagtaaactgatatggctgtgtctcaagtcgtgaatgcggatacgcttcacgcctgcggctttcgcccctctgtccatctcgtgatgaagatagctttttgttaccgtgaaaatgcggtctttctttttcagaccgtaaagcataccgatatattcctgtatttcctcacagagaaactgcggcattttgattattcggttgctcttttttgttttcggtgtagtaatcacatcttctccgtgtaaacgctgataggatttactaatcgttaccgttcccttgtcaaaatcaaaatcggaggcggtcaaggctaataattcgccttcacggataccgcaccaatacagcatttcaaaggcgtaaaaggaaactggcttatccatcatctcatcggcaaatttcttatattcttctctcgtccagaacagcatttccttgtgttcctcgcttcccatatttcccacctttgccgcaggatttgaccgcaattcataatagcgtacagcgtgattgaatatggctgacaactgattgtgcagcgttttcagataggtttgtgaatacggttttttcttctcgtcacggtaagcaagcatttcattctgccaagtgataatctcttttgtggaaatctcgctgattttcagtttgccaaagtagggcagtatcttcgtgcgaatgatatgctcctttgtcagccaagtattttccttcagacggtttttcacatcgttaatatacagttccgtaaaggcttcaaaactcatatcaaggtcagacgagttttgtaactgaaacattcgttcccattcctgcgcttctttctttgtggcgaaaccccgcttgcatttctgcttgcgttcgcctttccagttcacatatctcgccattacataccaagtgccgttgtcctcatttttgaatactggcattatttactctcctttcctgctccgtacaattcctaaacttatatgctatactacttgcagatacataaggcaaggagtgaaacactatggctattggcgaaagaatacatttttttaggcttctgcgtggtatgacgcagaaatatctcggtacggctgtcggttttcccgaaaagtccgctgatgtgcgtttggctcagtacgaaacaggcacacgcacaccgaaagcagacttaacggcggcattggcgcaggtgcttgatgtttccccacaggctctctctgttcccgacattgacagctacatcggacttatgcacaccttatttacccttgaagatatttacggtctgaccgtcagcgaagcagacggagaggtctgcttaaaagtcaacaaggacaaaggcaaggacgccgccgagctactgaaaatgctctgtgcttggaaagaacaggcggacaagttatcttccgaggaaatcagcagagaagaatatgaccgatggcgttattactacccgaaatatgacaccacgcaactttgggcgaaagttccctcgcaggaacttagcgacgctcttgttgacgctttcaaagaccacctccaatccgacaaataaagataaagacagtcgcgaccacccgtaaaacgggtggctcgctctaaggctataagcctttaataccagccggcgtctcaaggcgctggctggctttctcttcgttcaagccactattgcttttgttactttgacattaaccccattctggggttctcctatttaaacgggtcttcatactctttgacactcaaacgatctgcagcaagatcggctttttcttgatctctgatatatttccgtattgttgattcattcaatcccactgtgctgacataatatcctactgaccaaaaatgtcgattcccaaatttatacttcatatttgcatgtcgatcaaacatcatcaaggcgctttttcccttcaaatatcccataaacgatgacacactcatcttgggcggaatacttacaagaatatgtacatgatcaggcattagatggccctcaataatctccacgcctttatatttacacaatgtttttattatttcttttaaatcttttcgatattaattgtaaatagcttttcgtctatactttggggtgaatacgatgtgatacttacataaccacttcgtatgcgctaggctattatatctattagccattttattcatctccttcgttattttgtgacttgaacaatctcattatacgaaggagatgattttttgtataacattttttctccacccgcatagcgggtgatttattgttaagtatgcttttgcatacttaacgaagctcattactccataaaaaaatccctgtaagccttggccatttaagacttacagggatttgtgttttgattcgaattcgaaaatgaaatactgattttcacccgttcgaattaaactctatgataggatttgattctgtttgatttcagctaccctgtttctacagggtatacgaactgatgttatcaacgccactgcttcgttattttaccagccgcttattcaagacacatttataccgaatctgttcaaacaggcttctttgctgattccaaaaaatgttttattccttcttcaaaggcttctgccgggattaaagcgatcccgatctcatcactgacaataatcaaccgctgtcctccggtcaagccaaatttttctctcgccgcttttggaataacgatctgtcctcgatcagagatcgtaacagagccccaaatgtttttcccttttggcgcgggagggatcgatacacccagtccctcgggttcttcgttgcaaaccagactatctatagacaccccataaatgtctgccagaagcctgcatttctcaatgtccggcatcgtgatgccactttcccatttggcataggcctgacgggaaattccaattttctcagacagtgcctcctgcgaatacccatgcattttccgaagcaaaacaagattatctttcagcatgacttatctcctcacagatctattttttcgaaactacggcaggcatatcgatatgacaccattgtaaatactagatagctcaaagcgccaatgattaacaatccgagctgaaggctgagatgtgcgaagccaaatgcattcactgcgcctaatcccggcacataatgcacagcttcaaaaaaaataaccgctgcgaaggccgcgacgatatatctgataaaagagacaaacttatacgctgttcggaaaaagccgcccaaaaaaatcagattgaacagcccaaagagaaacagccccgccccaagtgcgaacaaattcgcattcatcagggcattctctcggtataccgcaaggtccttcaacaccgtcattctcaacaaaactacagctgacataactgcaaaactgaccagttcaatcatgcaggtaaaaagatactttccctttacaacatcttttttcgcaatgggaagcagcgcagagaacactaaatcatttgcctccctcgcattctgaaaagtcttgaagatgccaagcgtcacaaaaaatacgctgcacagtacaggataacccggaaggaaaaacatcagtccgaatacaataaagaaatacgtcaccggtgatgcgctgagtgtcatctcttttctaagaatatcacgcatgagctgcccccttttccattctcaaaatggtgtcttccaatgtctcacctgcttgggaatatgcatcgcggaaggcctgttttagctttgccgctacaatgcttccatgggaaatgtaaaggatgtcatctgcacatttttcaaggtccgacacaatatgtgtggaaaagaaaacagctgtaccactgtcccgaagcatggtaaatatttcaagaagttcttcccttgagaacggatcgagtccactcgtcggctcatcaaggatcaggatttctgctttatgagacaacgccagaaccagagtgaatttaactttcattccttcggaaagctccagcggtgtcttccgctcatccaagccaaactgcttcatataatgctgataaacatcgtcatcccaattcaggtagaagcgtttggaaactgctgctatggtgctgagctttttacggggataccagctgacacttccagtggaataaccgatgcgctgcttgatctctgcttcatgcccggcaagcggcatgccaaagtaacgaatttctcctgtatccggatgaaccagattcagcatcgatttaatagtggtcgttttccctgcgccattacggccgataaatcctgtaattctgccttttttcagcgcaaatgacacgtcgcttaaacgaaatgtcgggtattccttcgtgaggtttttaatttctgcgatatccatagatacctccggttatttcgttcacaatttcttatttatctgtatattgtaatgtacagttgccctagcgtctaccaactttaaataacatacttctgtgttttatgtattctttgattgcatttcccgccgatttcctttagcatccacattttctgattgaatgaacgaaaaaggatctgacacaatcgcatcaactctctttctcactaaaaatcataaccaccggctcagccggtggtttgtgttagccctataagggcctgttaccgaccaacatcttaagatgttcgaaatagttctccgctccacttctttcttctgtaactcttttccgactaaccctaaagggttactttattttcttcccactaaatggatctatatattcttttatatttatttgatcctctgctatatcctcttccaattgtgtccgtatatactctgctattttctttgtattctttccaactgtatccacatagtatccgcgacaccagaaatgcctatttccatatttgtatttcagattcgcatatttatcaaagatcatcaacgcacttttcccttttaaatatccgactatctgcgatactgaatattttggtggtatgtgaactaacatatggatgtgatctggacaacattctgcttctattatttctattcctttcctttggcataacagcctgagaatctttcctatatctctttttatttttccgtagattactcttcgtctatatttcggtgcaaacactatatgatacttacaattccattttgtatgtgctaaactatctttatcatttttcataatgatttaacctcctttatgaaatgttgcggttggcgaaccggcatcattttagcataggaggtttttgcttgaagctgaagctttagtaaactcaccggcctagccggtggttcttcgattctcctcgtttctctcgtcgaatccttcgctaaagctaaacaataaaaaatcttccctgaaatgatcggtgtgatgcatttcagagaagatgaaatccttaataaacgatgaccggcgtcccctgagagacgttgtcccagacgagggcgacttgagccggcggggtgttgacacagccgtgggagccgttgccgcggtaaatcgtaccgccgtaggcaccgcgccaataggaatcgtgaatcccctgaccgccgttaaagggcatccagtaagaaaccggtgtcgagtagccttcgcccttcagcgtcgcgtggcgttccttgtaggcgatgtaataggcacccggcgtcgtgccgttgcccttggtgacgtcgccggtgacgaccgccgtgtcgacaaccttcttgccgtccttgtacacccacatgtgctgatcgctgatggagacttcgacgtaggaatcgccgatgtcgtcgtaggtgctgttgcggaccttccccttcttggaatattccggatcgcgggtgatgaccttgcccgcttcgatttcctgggttagattcttggcttcggcatcgcggtcgatgcgccagccgtagttgccgccgttcacggtaatggtgctgccgccggtggtcttgaaggtgtgcttgccgtaataggtgttggttttgtaggccaaatcgtagagatactgcttgagctgggtctgatcgactgtgacgttcatgttgtcgtccacggtcagccacggcccgaacacgctcttgtcgatgacgactttgtcgctgccgaaggtgtaggtgatttcggccttgatcattttgcgcatcttggccgctgcctgcttgacctttttggagctcgacgtgtatttcggctggacgtagcagtcttcttttttcaagttgatggtgctgtcgccggcggcgatcgcgttgatcagcagcttcttgagcttggtctgatcgacggtgctgccggaaatctgatcttcgatcacgattttgccgtctttgtaaacgggctgggcgttgcgcgccgcttcaacctggctgccagacacctggaacaaattgcggaccaggtaatcgatcttgtccttgtcgtaggaaatcgcggagtagctcttcgttcccgagaacaagtgcgctggccaggcaaagccgttttgattcgacaggatctgctggacgcgcttcttaccctgatatttgaggcccagcgcggtcgccgtgatcttttcggtttctcctttgcgccccttaagctcgacgctgtaggtgtcggcgcggttttcaacggagctgctgatggctgagacggttttaccggaggcggcgaggccgttaatggccgtattcgggaagaaatgataattgaaataaaccgcaaaggctgcgtagataatggcaatggctgcgatggcgatcccgacgattttgactttcggcgcggctttccgctgacgtgacttcggctgctgctttgattttttggctttgggttcagccttttcttcggcgtcagccgcagattcagcggcttctgcggctgcggcttcaacagtttcggcttgtggtgccgctgcgtctgcttcttctgttttgtcagacgacgcttcatctgctttgtcagcttcagcttccggcgcttcagtcgtttcatcagctggtttgacatcggcttcgaccggttctgattcagacgcttcggccgtttcatcagcctgttcttcgtccgattcgacttcggcttcaggcgtttcggtcgtttcgtcagccgatgcttcagctgcttcagtgtcttcagcttcggacttagccgcaaagacttcgtcgatttcagctgcgagcttggattcagccgacccgtccgcttttttcccttcgtcggtttccgcttcttccggttcagcggcctcggtttcggccgcgtcagccgcgtcttcagatgtttcttttgatgcttcttcggatgctgcttcaggttcggaggcggcgtccgccgctttttctgaggcctctacttcagcggccatcgcgtcgatggcgtccgccgcggtttcgaccgtctttttcggcgctgcttccggcgtttcatccgccttagacgctgcgtccgcttcgtcgtcttcactttcggcgatttcaaaactgcgttcccgcagccgttcgttgacgacttctgtcgggtcctttgcttcacccgcatcttctgtggctgcttcagccggcgctttagaagtgacgccatcgtctgttgtcacatcgtcctgccggacgtcttcgtcgaaagccggcttgactttcggcgagtcctcacggtctgtcctttcgaacagacctccttttttttcattttcttgagacatagttttccttatttcttattgattttttagttcagatcaaatgccgcctgaatcgccgtcactgcgcgcttgacgtcgtcatttttgacgacgcaggacatcgcaatttccgacgtggtgatcatcagaatctgaatgtcattttccgcgaagacccgcaggtatttggccgcgaccccggactgggtgcgcatgccgatgccgtggagattcagccgcgtaatgtttttgtttacggtgatgcccacttccgggaaatcgtcgcccaggttgttggcgatgtcccgaaccttggccagatcccgttccggcacgatgagggatacgtcgtaggtctcgcccaccggcgccgttctcgagatgacgctgacgttgaccgacgccgcggccaaatcgtcgaggagacgggtcatcacgtattcgccgaagggcacgttatgcatcgtgatcattaagctttcgcagtcgatggacagcgaatctactggatgttcttcaatattaatcatttcgcacctctttacaattcaaagccatcggctaccgccatgaccacccgttccttcgcttccttcgggatcatgcaggagatccggatgtcggaggtcgtcaccatcaaaatcgggaactgctgttcgcagagcagcgcgaagaatcggctcgcgacgccgctgtgaagcttcatgccgctgccgacgaccgacagcttgacggtatcgtcccgaatggtcacttccgtgccttcgtatttcgcctggaattccggcaggacgcggtcgagcaaatcccggtcttccttcgagagcgagaacgagatgtgcatcttgtcgttgactggcttcgtctggctgatcatatcgacgttgatgcccgcttcggctaaatcggcaaaaagctgtgccgcgacatcggagcggtagggcacgtccttgatcgacaccatcatttcgtcgtcgtagaccgcgagaccggtgatgtccttgacctgctgatcgatattggacgtgattaacgtccccggcaccttgttgatgctggaggcgacgaggatatctgcgttgtacttgcggcccagttcgatggctctcgggttcatgacgccggcgccaaggctggccatttcgagcatttcgtcgtagctgaccacgtcgagcttctttgctggcgggtacagccgcgggtcgacgccgtaaatcccgtcgacgtcggtgtaaatttcacaggggcagccgagcacgacggacagcgcgaccgccgaggtatcggagccgccgcggcctagagtcgtgatgtcgtcgttttcgttgacgccctggaagccggcgacgatgacaattttgtcctcatccagcgcttcgacgattttcgtcttgtccacgtccatgattctggcgcggccgtggagcccttcggttttaatgccgacctgcgggccggtaaaggagatggccttgtagcccatttcgtcgagggccatcgagagcatcgaaatggaaacctgttcccctgtggctaacagcatgtccatttcccgctttggcggcttgtcgttgaccgcgtaggccatttcgacaaggtggtcggtgctcttccccatcgcagaaacgacgacgaccatccgattgccctgttcctttttcgcgataatccgtttcgcgacattctggatccgggcaatcgtccccatcgacgttccgccgtatttttgaacgatcgtattcatagatgattccttattccttttatagattttcgattgttttttctattttatagataaagaagcggactgtcaattaaacagttcgcttctttataatgtaaatgacttctatatttgatcttttttattaattggttactgggcgtggatcacgtcgctcatatcgaacaggccgttcggctgtttgatcaagaaacgagcggccttcagggcgccgttgccgaaaatcttccgcgaaagggcggtgtgcttgatttcaacgagctcgtcgtcgccggcgtacaacgccaggtgaacgcctgagatggtgccgccgcgaatggcggaaatccccatttcgtcttcggtgcgcttgcagtcacggccgtggcgaccgtaggtgtagcgcttcttcggcaggccggcttcttcgaggccttcgttgacggcgtcggctaaaagcagcgccgtgccgcttggggcgtcgactttgcggttgtggtgggcttcgaccagttcgatgtcgtaatcggcaagcacgccggaaattttctttaagacgtcggccatcacgttgatgcccagggacatgttcgcagatttgaagatcgggaagcgcttggatttttcagcgatggccttttcgtcgtcttcgctcagacctgtcgtcgcgacgaccagcggcagatggcgtttttccgcaaaggcgagcacctttgggaaagctgaaaaatgggagaagtcgatgatgacatccgcctcttcggtgcactgatcgaagtcaccgtaaatcgggaaagccccggttgtgtcggtgacctgatcgaggccggcgacgatcgtgaaatcgtcggccgccgccgcgcagtcagcgaccacgtggcccatgtgtccggcagcgccggatagaatcatcttaatcatcgagcagtcctccgtaggccttcatcacttcgaccattctcgcctgcgcaccttcgctcatcgggaccatcggcagacgcatcgccccggtgtccagacccatcagtttcatcgcggccttgaccggaatcgggttgttttcgtagaacatcgcgcggttcagcggattgatcgcgcggaagagcttccgggcttcgtccatccggtcttcgacgcaggccatggccatgtcgtgcacagccttcggcgcgatattggcggtaaccgaaatgacgcccttgccgcccaatgcgatgatcggcagcgtctgatcgtcgttgccgctgtacacgtcaaaatcgtcgtcctgggtcagttcgatgacttccgcgatctggctcaaatcgccactggcttccttgaccgcctgaaccgtcggcagcttggccaaacgggcgatggtcgccggcaggatgttggagccggtgcggctcggcacgttgtagacgatcagcggaatgttcgtgttgtccgcgacagccttgatgtgctggtaaatcccttcctgggtggttttgttgtagtacggattgatgaccagcgccgcgtccgcaccgatggattctgcaaattgggtcagcgacaccgcgtagctggtgtcgttgctgccagtgccggcgataaagggcacccggccgtcgatgtattcggcagaagctttgagcacgctgcggtgttcttcgtcgctgagggtcgccccttcgcccgtggtcgcgcagattaaaagcgcgtcggtgccttctgcgacgtgccgatcgatgttcgccttcaggccgtcgtaatcgacagagccatcttccttaaacggcgtgatcatcgcgacacatgagccggtaaagattgtagacatagtgtttcctcctaaaagcttaaatcgtgccaatcagccctgatactgatcgtggaccagatcctgttcgatcagggattccgcgatctggatcgcgttggaagcggcgccctttctgatgttgtcgccgacacaccagaagttaaagccgttttcgatggagaagtcgcggcggatgcggccgacgtaaacttcatcgtggccttccgcttcgatcggcatcgggtaaatgttgtgttcaggatcgtcgcgcagaatgacattctggaagctgcccatgcagtcctggagttccttgactgagccgaagggcttcttcagttcgacgttgatgctttcgctgtgaccgtagaacaccggcacacgggctgtggtcgcggtgatgcggatgttgtcgtcgtgcaggattttgtgggtttcattgaccattttcatttcttctttggtatagccgttttcgaggaaatcgtcaatatgcggcaggatgttgaacgcgatcgggtacgggaatttcttcggcggcacgccttcgacgccgtccttcagatcacggtagccctgaaccccagcgccggaaacggcctgataggtggagtagacgatgcgttcgatgccgtatttgtcgtagactgccttcagcggcagcatcgcctgaatcgtcgagcagttcggattcgcgatgatgttgtgatgccacttcagatcttccggattgacttctggcacgaccaatggcacgtctgggtccatccgccagcaggacgagttgtcgacgacgatgacgccgcgcttcgccgcttctggtgcgaattttttgctggtaccggcgccggctgaaaagatcgccaggtcaatatccttgtcaaaggattccggtgtggtttcttcgacggtgtaggtcttgccggcgaattcgatggcttttcccgctgagcgtgaagacgccatcggatagaaatgattcactgggaaatttctttcttcgagcacgcggcacatcatctggccaacgaggcctgtagccccaacaacagcaacattatactttttcacaatgatcctccttcagatccttttgtcataaaaaaagccagtatagagataccggcatcacaaaggttcgaaatcaacattgattcccaaacatttgacagcgctccgccgaccggcgacagtcctgacgatattttcggcaggcccagaaccgttatcagcagggacagcggctcttcggcgttttttccttttcccgccgttcccttcgccctgatgcgatcccgacgggtactgataaaagacgcacctctatctttgttttttttatataaaatttgctggtttttattgtatcaaaaagcgcatggtttgaaaagggaaaagtcaaataaaaaagcagcggttcaccaggccgctgcttcaaagagatggttccattccttttgtgtgtaagcaaatggaaagaggaatgaattaatgaaggttaaatagaaaggatccattcgtcaaaccgacctctttatgtgtctgctttaacgttgttgcgttccgatgccacaaatcgaagacatccgaaccaatcactgtgccggtcttctgacttcgcgatatcatctgcgctcccttcccacctttcggcagtggctatgagcgcgcatttcgcgttacagctgcgattcacagtacaggttttccacctgtttccctttacccacaggatcttttttatttaactattctcattatagaataatccctcaaaaacgtcaattcatttgaggaaaggtctcaaatttacatattttcgactgcttcggccatgaccttggcaatgtcgtcgcggatgaccagctctgctctggagtctgccgaggtggccgatttgttgatttcgacgaggtgcttccctctgaaataattgatcaggccggccgccgggtaaacgatcagcgaggtgccgccgacgatcagggtgtcggcctttgaaatggcgtctaccgcgccgttgatctgcgccggatccagggcttcttcataaagcacaacgtcgggcttgacgatcgcgccgcatttttcgcatttcggcacgcccagctgcgccatcacccattcgtcgtcgtaaaacgcaccgcatttcgtgcagtagttgcgcttgaccgagccatggagttcaaagacgatttcgctgcccgccttttggtgcaggccgtcgatgttctgggtgaccacagccttgaccttgcccattttttcgagcttggtcagcgcgatgtgacagccgttgggttcggccttgggatagaccatcttgtcgcggtaaaatttatagaattcttcggtgtggttgacgaaaaagctgtgggacaccatttcctccggcgtgaaggtggcgttgagcttctggctgtaaatgccgcccgccgatctgaaatccggaatgccggaagccgtcgaaacgccggcgccgccaaagaagacgatgttgtcgctttccctcaaaatttccgttagcttcgaaatgtcagatgccattgcaataaccccctttttatttttattatacgcctgttctgggggaaatgccaaccacaaaaaaacgccgccccaaaaaggagcagcgtcgtgatcgtgccaaaacggcttatttgttgccaccgccgcggcgcgcacgtcttctgtccagttcagacaaaatcttcttgcgcaggcggatgctctgcggtgtgacttccaccaattcgtcgtcttcgataaattcgagggcttcttcgagggaaaagaccttcggatcgatgagcttcagggcttcgtcggagccggacgcacgggtgttggtcagcttcttgttcttaatcgggttgacgaccatgtcgtcgctgcggttgttgatcccgatgatcatgccttcgtagaccttagtccccggatcgacgagcagggtcccgcggtcgctcaagttgaacagcgagtaagccatggtttcgccgttgacgccggagacgagcacgccgttctgacggccaggaatgtcgcccttgtagcgttcgaagtggtcgaagcggcggaccagcgtcccttcgccgtgggtgtcgttgatgaattcgctctgatagccgaggagcccgcgggtcgggacttcgaaggtcatgtcggtccagccttcttcggagctcatttcagtcatcatccctttgcgctggttcagcttggcgatgacggtcccggagtattcgtccggcacattggcgacgacttcttcgatcggttcggtccggtggccggattcgtcggttctgaaaatgacttccggcttggagacggccagctcgtagccttcgcggcgcatgttttcgatcagaatggacaggtgcagttcgccgcggcctgaaaccttgaagccttcagtggtgtccggcaggggttcgacttcgagcccaacgttgacttccaattccttttcgaggcgggccttcagatggcgggtcgtaatgaattccccttcctggccggcaaaaggcgaggtgttgacgaagaagttcatcgacagcgtcggcttttcgatttcgatcatttccatcggctggacctggtccacttcgccgatggtttcgccgatggagatgtccggaatcccggagaccacggcgatgtcgccagccggcgcggatttaaccggcactctggacaatcccttgtagacgaagacctgattgaccttgaccttttcgaagctgccatcgcgcttggccacttcgagctggtccccttcgtggatcgtcccggtggagacgcggccgatgccgaggcggccgatgtagtcatcgtaggccagggatgaaatctgcatctgcagcggttcgaggctcaggtcttcctgaatgccgacgtgcttgatgatcgtgtcaaacagcggagtcaaatccgtgctgtcgtcgtccatttcgtatttggcgatcccttccttggcgattccgtagagaatcgggaagtcgagctgttcgtcgttggcgtggagttcgacgaagaggtcgaagacttcgtcgacgacttcttcggcgcgctgatccttcttgtcgatcttattgatgaacagaatcgggcgcagtccctgttcgagggatttgttcaaaacgaagcgggtctgaggcatcgggccttcgctcgcgtcgacgagcaggatgacggtatcgacggttttgaggatccgttcgacttcagacgagaaatcggcgtggccaggggtgtcgacgatgttgatcttaatgccgtcgtgcatgactgagcagttcttcgagtaaatggtgatcccgcgttcccgttccaaatcgttggagtccatcacgcagtcgacgaccttctggttgtcgcggaagacgtggctctgattgaggaaagcgtcgaccagcgtggacttgcctgcgtcgacgtgtgcaatcacggcaatattaataattggattttcttgtttcattcatttctcctgtttacgaattgtagtgccgataatggtcaaaatttatttcatttattttcaatcggcccgccgatttgacgggttttcatttgtgtgaaaatttcgcttacaagactatatcacacttttcattttctttcaatttttacttgattttttaaaaaatgtcacaaaaaaaagactttgccaatagacggcaaagtctgatataaaataaattaacgttttgagaactgcggtgcgcggcgcgcttttttaagaccgtatttcttacgttcgaccattctgtcgtcacgggttaagaagccagccttcttcagttcaggacgcaggttgacgtctgcttcgaccaatgcgcgggcgatgccgtgacggatcgcgccggcctgaccgttgaatccgccgccataaacgttgacgacaacgtcaaagctgtctgcggtgttggttaatgccaacggctgacgtgcgatcattttcagtgtttccagtccgaaataatcgtcgatgtcgcgaccgttgattgtaaatttaccatcgcccggcaacagacgcacgcgcgcgacggatacttttcttctgcctgttccaaaatattgtacttttgccatgttctatacctctctcagattacagtgccatttcttcaggctgttgtgctgcatgcggatgatccggaccagcgtaaacgcgaagtttcttcatcacctgatcgccgagcttgttgtgcggcaccataccacggactgccttgtaaacgagctgagccggtttttcttccaggaagtgacgataagcgatttccttcagtccgcctggatgaccggaataggtcttgtaaagcttctgatcgagtttattgccggttaatctgatcttgtcagcgttgacaataataacaaaatcaccgcaatctgcgttaggggtaaagcacggtttgttcttccctctcaacacgtttgcgacttctgcagccagacgacccagcaccttgtctgtagcgtcgaccacataccatttgcgatctatatcctgagatttagccatttttgtggcgtatgctttcatctcatatcctccttgattgtaagttgtttttttcgataaaagtgggaaattatcgaaagcgaaatgaccggctgattggttggctcagccgttatatcattttgtacctaggggcagaggtacatgaaagcctgacacatattatattatatgcctcttttgactgtcaattctttttcccatttttgtcaaattattttgtgtagtaaacgcgggtcagctccagccccttcgccggggccgtcacgcctgccgcgtttcggtccttcgccgcgataatgcccgccatcgcgtccggcgcaaatttgcctgagccgatggcgacgagggtgccggtcaaaatccggaccatgttgtagagaaaaccggtgccgatgtagcggatgatgagcatcggcccgtcctcggcaaagtcgatgcggtctacccgcctgaccgaggtcttggccgaggagcccgccgcctgaaagctcttgaaatcgtgggtgccgacggcgtccgccgcggcggcacgcatcttgtccacgtcgagagaataggacacctgccagctgaaatccgcggtcaagggatcggcgatgggtccgcggtaaatgcggtaggtgtagcatttgcccttcgcgtcgtaccggctgtgaaaagccacaggcacctcaaagctctgcatgacccggacggcctccggcagatgggcgttgagggcgtaggcgaagcggtcagggggaatgcgggaagcggttttgaaattggcccgctgtccccgggcgtgcacgccggcgtcggtgcgcccggcgccgtaaatcgtcaccctttcaccggtcaccgcctcgactgcctgcttcaaatcgccctcgacggtttcggcgtttttctgaatctgccagccggcaaaggcgtcaccccgataggccacgaccaatccaatgtttttcatcggcttatccaaaggggaagggccacgggtattggatgaaccgggagccgatcatcgctgccgtcatcgcggcgagcacgatgtaggcaatggcgtcccgcttcgcgtaggcgagcacgtacatccgagtccggccgctcccgccgcggtagcaccgggcttccatggccgttgccagttcgtcggcccgtctgaaggccgagacgaacagcggcacgagaatcggaatcaatgctttggcccggtcgatgatgttgccggtttcaaaatcggcaccgcgcgccttctgggccttcatgatcttgtccgtttcttccatcaacgtcgggatgaagcgcagcgcgatggacatcatcatcgccaggtcgtgggccacgcgcttgagccccggaatcaccgacataccggcttccatcccgtcagtcaaatccatcggggaggtcgccagcgtcatgatcgacgtccccgccacgagcagcgtcagcctaagggccatgaagatcgagagtttcagcccttcccgggtgatgtgcagcgccttccactgccagagcacctgccccggcgtcatgaacatgttgaggataaaggtcagcacgatgatgaagatcagcggcttcaggcctctggcgatatagacaaagggaattttcgacagcgcgatcaccagcgccagaatcccaatcgcgatcagatagccgaccggattgttcacgacgaaaagcagcacgatgtacacaagggtaaaattgatcttcgtccgtgggtcgagctggtgaatcaccgagccggtcgggtaatattggccgagggtaatgtccttaaacatcgcgttcacctccaaacacccgttcgatctccgccttggcagcttcgaccgtgaagatatcgtcgtcgatttccgggtaccgtttcttcagcgcccgcatcaggtacttgacctcgggcaccgccaagcccattttttcgagctcatccacgtggcggaaaaccacggtcggcgtgtcgtagtacacggccttccctttgtacatgacgaggatgcggtctgcgtagcgcccgacgtcttccatgctgtgggagaccagaatgaccgtattgcccgtcgctttgtggagcttttcaatctggccgaggatggtgtcccgcccgtgggggtcgaggcccgccgtcggctcgtcgagaattaacacctcgggtttcatcgccagcaccccggcgatggccacccggcgcatctgtccgccggagagttcaaagggcgagacgtccttcattttttcgtagtctaagccgaccatttcgatggcccatttcacccgctcctgaatttcttcctctgaaagcttcagattcttcgggccaaaggccacgtccttggcgaccgtttcttcgaagagctggtgttccgggtactggaagaccagccccaccgaaaaccgggttttgaccaaatcttcttttgactgattgaaaatatcgacgccgtttaaataaaccgtgccggaagtcggctcgatcagcccgtttaaatgctgaatcagcgtagatttgccggagccggtgtggccgatcagcgcgatgaagtggccgttttccagctcgacgttcacgtcgtcgagggccttgaactcaaagggcgagttctgcgcgtacacgtgatccaagtgttctattttaagtgacataacgcctccaccatttccggaatttcgaggacatccttcgggatgtcatagccgtcctgattcaaaaggtaggccagctcggtcatctgcggcacgtcgaggccgatttctcttaacatcgccacctgggagaagatttcccggggcgtgcctgtcgcgacaacccggccgccgtccatcacgacgattcggtccgcgccgacgagctcggtcatgtagtgggtgatgtgcagcaccgtcatcccgtgctcgcggttcaaattggtgatggtcttcatgacctcagcccggccgttggggtcgagcatcgcggtcggctcatcgaaaatgatgcagtccggctgcatcgcgagaatgccggcgatggcgatccgctgtttctggccgcccgaaagctggtgcggtctggccttgcggtagtcggacatcccgacgatgtcgaggacctctgtcactttttctttaatctgttctgagggcacgccgaggttttccatgccgaaggccacgtcggtttccaccaccgaggacaccagctggttgtccgggttctggaagaccatgccggccgtcttccggatctgccagatcttttccggatccttcgtgttcattccttcgatccaggcgtcgcccgaatccggtgaaaggatcccgttcaggattttcgacagcgtcgacttgcccgagccgttatgcccgatgatgccgacaaactcgccgcgcgccaccgttaaattgacatcgctcagtgcctgcttaggctggtcactgtcttccaccggataggcgtagctgagattttcaacccggataatcggctggctctgtgcgtcctggccgttctgaccgtgtgttacaaatgcagtttgctcattcatatccttatcctttgtatttcgtcaatctgacgattagttccgcatgccattataatacaaaacccaaaacttgcaaaataaaaaagaccaaagtccgaagacttcagtcttgattcttaagctcacgccaatggcttagaccatttcgatgatggccacttctgcagcgtcgccgcggcgcggtcccatcttgtaaatgcgtgtgtagccgccgttgcggtctgcgtatttcggtgcgatttcttcgaagagctgggtgaccacatcttcacttgtgatgtaggccagagcctgtcttcttgcgtgtaaatcgccgcgttttcctaatgtcaccattttttcagccattcttctgacttcttttgcgcggtgcagcgtcgtctggatgcgaccctgttccagaagtgcagtggttaaatttctgagcatggcttttctttgggcggatgttcttcccagttttctgtaaccagccattctattactccttcgttttatcttcctgactcagagacaggcccatttcagcaagcttacgtttgatttcgttcaaggacttgcggccaaggttgcggaccttcatcatgtcttcttctgttttctgagtcaatttttcaactgtatcgatatttgcccgtctcaggcagttgctcgaacggacggaaagttccaattcttcgatggacatttccttgatccgttctttttcattttcttcgcgttcgaccatggtttcgacgtgttccgcttcttctgtcaggtcgatgaaaagcttcaggtggtcattcatgaccttcgccgaaagggacagtgcttcttccggcgtcatcgtcccgtctgtccagatttcaagcgtcagcttgtcgaagtctgtaacctgaccgacacgcgtatcttcaacccggaaaatcactttccggatcggtgagaaaattgaatccatcggcagtgtgccaatgggcatcccgtcgtacttgttcttttctgacggtctgtagccccggcctttttccagtttcatttccatattgaggacggcgtcgttggccatcgtacaaatatgcatgtctggattgatgatttccacttccgggccacagatgatatccccagcggtgatttcgccttcaccttgagcttcaatgcggatgatctgcggttcgtcggtgtacatcttggcgcacaggcctttaagattcagcagaatttcaataacatcttctctaatgccttcaatcgtcgaaaattcgtgacgaacatcattaatcttgacagatgtaatggcaacgccaggaagagaggaaagcatgattcgtctcaggctgttgccgagcgtggtgccgtatccacgttcaagaggttcgactgtgtatttgccgtaagtgttatcttcggatctatcaacattcttaatgattggcttttcgaattcgatcatataatcgataccctcctaaaatataaacaagactccaaaacacgagggttccaatacggccctagattacttggaatacaattcgacgatgagatgttctgcaatttcaatatcgatatcttcacgggtcggtgcactgacaactttacctgccagtttgtcgtaatcgaccgtcaaccattgaacaattgctctgttttctgtcgcttcgatgatgtccttgaattttgtggatttcttgctgccgtctgcaactgcgatttcgtcgccgaccttgatttgataggatggcacgttgacgcgcttgccgttgacagtgaaatgtccgtggagaaccagctgtcttgcttccttgcgggaggttgccagtcccagacgataaacgacgttgtccagtctttcttcgagtaagaataacaggttgtcccctgtgatcccctgctgtttttcagcgacgtcgaaatagtgtctgaactgtttttccagaacgccgtaaattctcttaaccttctgtttttcacgaagctgcatgccgtattcggaaagcttcgcgcggcgtttgcctgcaccacctggcggtgtcgggcgcttgtcaaaagcacatttgtcttttgaatagcatctttcgccttttaaatataatttcatgccttcgcgtctgcattgacggcatgaagcttctgtatatctcgccatactctatatacctccaatcagactcttctgcgtttcggtggacggcagccgttgtgcggaatcggcgtgacgtcgcggattactgtgatttcgagaccggcagcctgaagtgcacgaatcgctgcttcacgaccggagcctggtcctttaacattaacttcaacgcttctcaggccgtgttccatcgctaattttgcggcttgttcgctggccatctgtgcggcaaatggggtgctctttttggagcctctgaagcccatttccccagcggaagcccatgaaagcgcgttgcctgcgttgtctgtgattgttacgattgtattgttaaaagaagattgaatgtgtacttgaccgcgttcaacattctttttgatctttctctttttagatctaacagccttagccaattttcaacctcctattatgcgtctttcttagaacggccaacagttttcttcggtcccttgcgggttctcgcgttggttttggaacgctgtccgcggaccggcaggccgcgacgatgtctcataccgcggtatgatccgatttcgatcagtcgtttgatgttcaagttcacttctcggcgaaggtcaccttcaacggtgtatttttcatcgagaatattacggagagcgccgacttcagcttcggtcaaatccttgactcttgtgttcgggtcaatgttgacttcctgaagaatctgctttgaagttgctcttccaatgccatagatgtaagtcaagccgacttcaacacgcttatcgcgcggtaagtcaactccggcaattcttgccataagtagtttacctcctgaatcatgtgtaaatatgatctgagctgcgaagtgacaataacagcccatgtccgtcggatctgattcccttattcaggcaatacggtgatggatccgaacctcatctatcaaaaatgtgttgacagccgcttccacattaatgatcaaaaaataatgttggcttcgattagccttgtctttgtttgtgcttcgggttttcgcaaatcaccatgactttgccatgacgtttgatgactttgcatttttcgcacatcggttttacagatggtctgactttcatgatattctccttatttaaattattatgaccggccttttccgcgccacacaatgcggccacggtctaaatcgtacggagaaagttccagagtaacttcatcccccggcaaaatgcggatgtaattcatacgcaatttcccagaaatatgtgctgtgaccatatgtccgttttccaattccactttgaacaccgtgttcggcagcgcttcaacaactctgcctttcaattcgatcacattctttttcgacaaagtatatcctccttcatttctgtgtcgcgtttagattttgctggccatcctgcggataagctgaaagtgcttttcgtatctcactattctgcactttttgacctgataacagcctatcttttatatgatacaggactttgttcgtttttgcaagatgttttatttttttctttttcggcgatgcaatcttgcgcaaatcgccgtcgcacaacgcaacatgatcgccatcgagtatcccaacgacgatcatgtatctgcctttatctctgcctgctttcgatcggacgatctgtccgatctcaatttctttactcataaaataatttcgattaatcttcgaccagtgtcagaatttctggcgcgccttctccggtgatccagatcgtgttttcgtaatgagcggcgagcttgccgtcattggtcacgactgtccagtcgttgtccagcgtgtggacttcgtaggtgccgacgtcgaccatcggttcgacagccaaggtcatattcttgagcagtctcggaccgtggcccggtttgccgtaattcggaatcggcggatcttcgtgcatttcccggccgatgccgtgtccgacgtaatctctgacgacggagaagccagcggcttccgccacctgctgaacggcgtggccgatatcggaaaggcggttgcctacgtgcgcctgttcgattcccttgaagaaggagtcgcgggtcacatcgatgagcttctgggcttcatctgaaattttcccgacaccccaggttctcgccgcatcgccgacgtatccgtccagcgtcgcgccgaggtcgatggagatgatgtccccttctttaagaactcggtctgacggaaagccatggacgacttcttcgttaaccgacgcgcaaattgaatacgggaatccgccgtaccccaaaaacgtgggatatgcgccgtgatctctgaaatatttttccgcgacgtcgttgagttccatcgttgtgatgccgggcttaatcatatctctgagcagattgtggcattcaccgaccagacggccggctgccttcatcttttcaatttccttgtcattttttatcgtaatcattgtgtctcacactttcctgtctatttgattctgttcctgaaggtgcctcaattaattgagcgccttgaaaatatcggcggtgaccacatccacatcctgatcgccgttgacagtgacaagaatgtccttgcagcggtagtagtcgatcagcggtgcggtttccttgttgtagacgtcgaggcggttcttaacggtcgcttcggtgtcgtccttgcgctgagtcagtgtgccgccgcagcggtcgcagacgccgtcttttttcggcggattaaaggtgacgtggtaggatgcgccgcagttggggcagacccgtctgccgacgatccggtcaatcaatttgtcttcaggcacttcaattgagagtgcaaaatcaaggggcttgccggtcttttctgtgtaatcagacaaagcagaagcctgcgctactgtccgcgggaacccgtcgagcaggtaaccgttctggcagtcatccttcgcaatacggtcttcaaccaacgcgatgaccaattcatcaggcaccagattgcccgcgtccatataagccttggctttctttcccaaaggtgtctgatttttgatgttgtctctgaacagatccccggtggaaatatgaacaatgccgtattgatcggcgatttttttcgcctgtgttcctttacctgcgcccggagggcccaataacacgattctcatttgattttcactccccatatgtttttaaagaatcttttatttcaaaaatccctgataattgcgcatcgtcagctgagattcaagctgcttcaccgtttccagcgcaactccgacgatgatcaaaagactggtcccgccgaactgcatgttgacgccgctgatgaagtggccgacgataatcgggatgaccgcgatgatcgcgaggaaaatcccgccaaagagcgtcaagcggttcatgaccttcgtgaagtattccactgttggcttgcctggacgaatgcccggcacgtagccgccctgctttttgatgttgtccgcaatatcgtaaggattgaaggtgactgcggtgtagaaatacgtaaaggccaccgtcagcacgacgtaaagaattgtcgtcagcggtgtgccccatgcgaagtatttcgcgagccactgtgtaaatcctgaattcgggaaaaactgtcccaacgtcgccggcagaagcgtcagcgatgaagcaaagatgatcgggatgacaccggccatgttgacccgcagcggaatgtgggtattctggccgccgtacatttttctgccgaccacgcgttttgcgtactgaatcggaatcttgcgctgtccttctgtcaccgctacgaccgcaacagtcgccgcaatgatgaagataatgagcagaatcaaggtgataatattcatcgtcccgacctgcatgtactggtagatgttctgaatcgccgtaggaatgcgggatacgatactgatgaagatgatcaatgaaatcccgttgccgatgccgatttctgtgattttatccccaatgtacatcaaaagcacagtgccggctgtaacgattaaaataaccgtaaagactgtgaagaatgttctttcaactaacagctgtctgtatgaaagtgtcatgccgagggcctgaataacagcaaggacgatcgttaaataacgtgtgtactgagcgatttttttgcgtccttcttcgccttccttctgaaggttttcgagggccggaatggcaaacaccagcagattcataatgatttccgcgttgatatacggcgtaatccccattgcgaaaatggtgaagttttcaaagttcccaccggaaatgatattgaaaagtccaaagaagttattgccgctgaccagcgaagcgagctgctggctgtcaatgtacggaaccggtatgaatgagcctaaccgatatactaaaagtaggagcagcgtcataataattttacgacgcagctccggtacgctccatgcttttttcagggtcgcaagcattaaatcacctcgaccttccctccggaggccttgattttttcttctgctgttttgctgactttattcacttttacagttaaaggcttgatgagttcgccttcgcctaaaaccttgacacctgctaataattttctgacgaagccgtattcgagcaacagttccggtgtcacaactgtattggcttcaaaggcattgagttcgccgacgttgacgatggcgtactgctttttgaaatgataattagaaaaaccgcgctttggaaggcgtcttgccagaggcatctgacccccttcaaaacccagacggacgctgccgcctgaacgggatttctgaccgtcctgacctctgccgccggttttaccctggccggtcgcggtcccgcggccttttctcttcgtgtttcttgtagaaccttctgcaggtcttaatgtacttaacttcattcagagaccctcctacgcttcttcttctacatcgagcatgaaatcaattttgtgaatcatgccgcgaatctgaggtgtatcatcatgggtcactgtctgaccgatcttgcgcagacccagagctttaacagttgcgcgctgtctctggttgcggccgatcatgctctttttcaacgtaatgtttaatttcgccatgatagtcctcctagccgagaatttcttctggtttcttgccgcgttttgccgcaacctgttcaacggtcgtcagtcttgacagaccttccatagttgcgatgacaacattgtgcggattgtgtgtgccgaggcacttggtacgaatatccttgatgccagctaattcgcatacggcacggacaggaccgccggcgataacaccagtaccggctgcagcaggtttcagcagcacgctgccggcgcccttctgaccgagcacctgatgcggaatcgtggtgccgaccaatggaaccttgatcaaattcttcttcgctgcgtcaacacccttgcggatggcgtctggaatttcaacagctttaccggtgccgacaccaaccaggccattgccgtcgccgacaacaactaagcagctgaaacgcatattgcgaccgcccttgacggttttgctgacacggttgatttcaacgactctgtcctgaagttcgataccagatgcgtcaataagttttcttttcattaacagaccctcttctttagaatttcaagccagcttcgcgggcagcttcagccaattccttgacacggccagtgtagatgtagcctcctctgtcaaagacgacgtttgtgataccagcatcgagtgcttttttcgcgacagcttctccgactgcttttgcagcatttttgtctccgccgtgttcgacggcgttcttgatgtcagcttcgacagtggaagcggcaaccagtgttttgccttcaacatcgtcaatgacctgagcgtagatgtgcttattgcttctgaatacgcagaggcgcggacgttctgcagttccggagatttttcggcgtacgcgcaggtgtctgttctggcgtaccttattcttatcttttttcttaatcatttgtgatcctttctcttaccctgtggagatagtctcaatcgatcagccgatcaattagccggtcttcccgaccttacgtctgatgtgttcatcagcgtacttgataccatgccccttgtaaggttcaggcggtctcttggagcggaccagtgcagcgtaagcgccgaccgcttccttgtcgattccggatacgatgacggtgtttggaccgtcggttttggtttcgattccttccggatcttccatttcaacaggatgggagtagcctaagttcatgacaagcttattgcccttcttctgtgctctccaaccaaccccgctgatttccattttcttttcaaatccttggctgacgccgacgaccatgttgtggatcagcgctctggtggtgccgtggattgctttatggaatttgtcgtcagatggtctggtgacaatgatttctttatcttcctgtttagctgtaatgtctgggtgtaattcgcgggttaaagtgccctttggtcctttaacggtaatgacgtgaccgtcgattttgatgtcgacaccgtctggaattacaaccggtgcattcccgattcttgacataatttcctcctcagatacgcttaccagacgtagcagacaacttcgccgccgacgcctgcttttctggcttccttatccgtgatcacgcctttggatgtcgacatgatggcaacacccaagccatttaataccttcggcacatcttctttaccgacatagacacgcagacccggcttggaaatgcgcttcagtcctgcgataacacggctcttgtcttcgccgtatttcagtgtgactttgatattcccctgattgccattatcaattgtttcgtacttttcgatatagccttcatcgaggagaattttaagaatagcttttttttctttagatgccgggatttcgacagacgcatggcctgcggtattggcatttctgattctcgtgagcatatctgcgattggatcagtcattgacatgcttgttcctccttgttcctaaatccgtattaccagctggctttgcgaacgcctggaatttctcccttgtaggctaattctctgaagcagattctgcaaatcccgtattttctcaaataaccgtgcggtcttccgcaaatacggcagcgattgtattctcttgtggaatacttctgcttgcgctgctgtttcaccttcattgatgtttttgccatgaatgattctcctatctttcaaaaggcaagccaagctgtgccaacaattcgtgtgcttcttcgtcagtctgagccgttgtgacgaacatgatgtccatcccgcggacggcttcaaccttgtcgtattcgatttccgggaagatcagctgttcgcggatcccgaaagcgtagttgccgcggccatcgaatgagtggttgttcaagccgtggaagtcgcggacacgcgggagggcgacgttgaagagcttatcgcagaattcgtacattctgtctgcacgcagagtcacctttgcgccgacgctctgtccttcacgaaccttgaagttagcaacggattttttagccttggttacgattggatgctggccgctgatgatgctcagatcattgaccgctgcttcgagcagcttggagttgtctttgcaatcgccgagacccatgttgatcacgactttaaccagttttggaacctgcatcgggtttttgtagccgaatttttccttcagtgcaggaacggcttcattcacatatttatctttcagtcttgtcattgtgtactcctctattaatcaagttccgtgccgcatttcttacatacacggactttggagccatcttcgttgactttgatcccagtgcgcacgcctttaccgcatttgtcgcagaaaagtaaaacgttggaagcgtcgatgaagccttcctgttttacaatgctgccctgctgcatcgcctgattggctttcttgtgcttggtctgaatgttgacaccttcgacctttacgcgggcgttttcgaaatcaactgcaatgactttgcctgttttgccaaggtctttaccggaaataacctgaacgttatcccctgtctttacatgtaattttcttgtcatctggaaacctccttaaattacttcaggagccaaagacacgattctcatgtatttcttatcgcgtaattctctggcaacaggcccgaaaatacgggttccgcgcgggttcttgtcgtcgttgatcagaacggctgcgttctggtcgaatttgatgtaagaaccgtcgttgcggcggacaccgcgttttgaacgaacaaccacagccttgaccacgtcgccttttttgacgtcgccgcctggggttgcgcttttaactgaagcgacaatgacatctccgatattggcatagcgtctgccagaaccaccgagtacacggatgcagagcagttcctttgcacctgtgttatcagcgaccttcaatcttgtttcttgttgaatcatctctgatacctccgtagtaattataatgccttttcgacaatttcaacgactcgccagtttttgtccttgctgagctttctggtttccatgcatttaacggtatcaccgacatggcattcgttgttttcgtcgtgagctttaaatttaactgtatcttttacgcgtttcttgtagagcggatgctttttaaaagtttcgatggcgacaacaactgttttgtccatcttgtcgctgacaactttaccgattcgcgtttttctttcattacgttccatcagctatccttccttcttatgcctggttaatccccattttgcgttctgtcaaaatggtttgaatacgggcgtaagtcttcttgacttcccgaatccgcatcggattttcgagctgacccgttacactttgaaaacgcaaattgaacagttcttctttcagatctgctaatttcgcattcaattctgtatcgttaagacttcttaattctttaatctgcttgctcatgcgttttcacctgctgcttccttgtcaacctttttgatgacctttgttttaattggcagtttgtgctgcgccaagcgcagagcttcctttgcctgtgcttccggaatgccgccaatttcgaacatcacgcggccgggtttgacaacagctacccagtattccggtgaacctttccctttacccatacgtgtttcagccggctgagctgtaacaggcttgtccgggaaaatcttgatccaaactttaccaccgcggcgggtgtatctggtcatggcgacacgggctgcttcaatctgatttgaagtgatccatgccggttccagagcctggatgccaaaatcgccgtatgaaacggtgttgccgcgcatggccttgcccttcatgcggcctctatgttgttttctgcgttttacacgcttaggcattaacatctcaacatcctcctttacgcatcagtgcggggtgctgccttgcggcggttattgttctttcttcccccgcgtttgtcgtcagctttctgagcttcggccagaatatcttcacggccggttaaaatttcgcccttattgatccagactttgacgccgatttttccgtaagtggtatctgcttctgcaaaaccgtaggaaatgtcagcacgaagggtctgcagcggcacattgccctgtgcgtagccttcttttctcgccatttctgcaccgttcaaacggccggaaaccaatgtcttgattccctttgcgccggcgcgcatggttctctggatacattgtttcatcgcacgtctgaaagaaattcttctttcgagctggccggcgatgttttcagcgacgagctgcgcatccatgtcgatgttcttgacttcgacgatattgatgtaaaccgtcttcttgatcatcttttcgagttcgaggcggagggcttcgatgcctgcgccgccgcggccgatgatcatccccggtttagcggtgtaaatgtgaattctgactttgtttccgaatctttcgatgacaatgttggaaacaccagcctggaactggcttttcttaatgtatttgcgaagcttgttgtcttcgatcaggttgtcagcgaaatctctatcattcgcataccatttggcattccagtctttgatgacgcctacgcgaaaaccaaatgcgtttactttttgacccaaattgatttaccccctaattattcattagaatctgcttcttttaaaacggcagtgatgatggacgttctctttttgatcgggaatgcgcggccctggggacctgccttccagcgtttcaaagttgggccctggtttgccgaaatctgagcgatatacagggtgtctgtattcatgttgtgattgttttccgcgtttgcgtaagcagaaagtacgaccttttcgatgattctagcggccttgtttggcgctaactgtaagatcgaaagtgcttctccgacgctcttgcctctgatggcatcagcgacgagcttggcctttctggatgaaacacggacgttttttgcggttgctctagcttccattgatttcctcctttaaggcttattgcgcagcggtcttctttgcgccagcgtgacctctgaatgtacgggtcggtgcaaattctcccaatttgtggccaaccatatcttctgtgcagtaaaccggcacgtgtttacggccgtcgtgaactgcgatggtgtgtccgacaaactgagggaaaatagtggatgaacgggaccaagtcttgacgactttcttttcacccttttcgttcatttcttcaattctttttaaaagtctttcttcgacgaaaggccctttctttaatgatcgactcattctattcctcctcgttacttggcattgcggcgtctgacaatcagcttatcagattgctttctcttcttgcgggtcttgtaacccaatgccggtttaccccaaggggtaacaggtcctggacgaccaactggtgcgcggccttccccaccaccatgcgggtggtcgttcgggttcataacagaaccgcggaccgttgggcggatacccatgtgacgtttacggcctgctttaccgattcggacattctgatgatcgaggttgccgacaataccgattgtggcgtggcattccaaacggaccattctcatttcgcctgacggaagtctcagggtcgcatagtcgttttccttcgccatcagctgtgcgctggagcctgcggagcgggccatctggccgcctttgcccggcttgaattcgatgttgtgtacgtaggtaccaactggaatgttagccagcggcaggcagttgccgaccttgatgtctgcatcatcagatgagagaacggtcatacccggctgtaagcgcagcggagcgaggatgtagcgtttttcgccgtctgcgtactggatcagcgcgatgttcgcggtacggttcggatcgtattcgatgccgacaaccttacccggtacaccgtatttatcgcgtttgaagtcgataatacggtatttgcgctttgcgccgccgcccttgtgacggacagtgattctgccgtagacgttgcggccgccgtttttcttaaccttcgtcagtaaggttttttctggttcactctttgtgatttcgtcataggtgttgacgctcatgttgcgtcggcctggtgacgtcggtttgtattttttaattcccattattcgcaaatctcctttaatatcttttgcttatcgggtaaagggattagaccccttcgaagaattcgatggtcttgctgtcatctgtcaatttgacgatggcttttttccagtccggtttcttgccgacggtgtaaccgcggcggactcttttgcccttcatgttcatggtgaacaccttctggaccttgacatcgaaaatttcttcgactgcgttgcggatttcgatcttgttggcgtccttcgcaaccttgaatgaatatttcttttcttcggtttgatccatgctcttttcagagatgatcggactgatgataatatcgcgaggatctttcattatgcatatacctcctcaatcttagcgagcgcatcttttgtgaggacaagcacatcgtatttgagcatgtcgtaaacattgagttcagaaacagttgtggcctgaacctttatgatgttgcgggctgacagatagacagtcgcgtccttttccggagtgacgatcagtgcgtttttcgcattgagggcatccagtgcggcgaccatatcctttgtcttcggtgctgcaaaatcgaaagcgtcaacaactctgagttcctgatctgctgtctttgcggaaaagacggaacgcatagccaggttcttgactttcttgttgacctttttgctgtagtcgcggctcttcggtgcaaagatcacgcccccgccgatccacaatggtgaacggctggaacccgcacgtgcgcggcctgtgcccttctgacgccatggttttctgccgcctccgcggacttctgaacgggttttactgccctttgtaccctggcgtttattggctaactgtgccacaacaacctggtgaacaaccggttcattcggttcgatgccgaagacgcgttcgctcagttcggtattgccgacaacatttccttttgtatctaaaatatcgatttttggcatttgatttcctcctgtcgttattcagcaaccttgacgctgctctttacggaaaccacagaacccttcgagccaggaatagcgcccttaatcaataacagattgttttctgcgtcgacagacaccacttcaaggttcaatgttgtgacatttttattccccatctggccggccatgtgtttatccttcggaacgcgtgacgggtaggcagaagcacccatagaacccgctgaacggtggtatttagaaccgtgagccattggccctctctgctgtccccagcgcttgatcgcgccagcgtatcctttaccttttgaacggcctgaaacatcaacatgatcgccgacttcaaaaacgtcagccttgagttcctgacccggttcaagtgcgctgcagtcgtccagtctgaattcgcgaaggacgcgcgcgtattttacgccgtacttgtcgaagtgacctttaactggcttggtgacattcttttctttgatgtcgccaaatgcgagctgaactgcatcgtagccgtcggtttctacggtcttcttctgtacgactgtacagggaccagcttcgacaactgtcaccggaacaacggttccgtcttctttaaaaatctgcgtcatgccgatttttttaccgataatcgcttttttcatatttcctcctgatcattggatcgctttcacgatcataattcttggttcgctataaaagcttctttatagtttgatttcgatatcaacgccggaaggaaggttaaggcgcatcagcgcgtcaacagttttcggtgttgggttaacgatatcgatcagacgcttgtgtgttctgatttcaaactgttctcttgaatccttgtacttgtgtacagctctcaagatggtcacaatctgcttttctgtcggcagcggcaccgggccggaaacagctgcgcctgtgcggttcgccgtttcgacgatgcgtttcgctgactgatcaagcaaaacgtgatcaaaagcctttaaacgaattctaattttttggttgctcatacctgaaacaatcctccttaaataataaagtgtttaggtgttgctgtatcatcacccacccgtccgggtgtttaaagtcactgtcttaaaaaaagcgagcgaatttgctcatctttttgacggtgatgatcgtcgcccgattcatagatcgtgacatactccccaagaatgacctgaattagtaacagcaatatcttggttcatcgcagacagccaactttgactagtataatgcattccccgaatgttggcaagatttttttttgtaattctcattttttttgaaagtggttgaaaattaaagtttttgttaagtttattttcaaattagctgaaataattaaccgtaaaaaaagcccgtgccatacgacacgagcttttatttcaattgctttgtttttgaagattagtcgatgatcttcgcaacagcgccggaaccaacagtgtggccgccttcgcggatagcgaatcttaaaccttcttcaatagcgattggcgtgatcagcgtgacttccatttcgatatggtcgccaggcataaccatttctacgccttccggcagtttgatgtcgccggtaacgtcggttgttctgaagtagaactgcggacggtatccgtcaaagaacggtgtgtggcggccgccttcttctttcgtcagaacgtaaacctgtgcggtgaagtgggtgtgcgggtgaatggtgcccggctgtgccagaacctgacctctttcgatctgggttctgtcgatcccacggagcagtgccccgatgttgtcccctgaacggccttcgtccagtgatttacggaacatttcgataccggtaacagtggtctttctcggttctttgatcccgacaatgtcgacttcgtcgccgatgtggacaacccctctttcaacacggcctgttgcaactgtaccacggccggtgatggagaagacgtcttcgactggcatcaggaatggtttgtctaagtctctcttcggttctgggatgtagctgtcgacagcttccatcagttcgacaatcttgtcgccgtctgggcccattggatcttccagggctttcagtgcggagccgacaatgattggtgtgtcgtcgcctgggaagtcgtattcgttgagcaggtcgcgaacttccatttcgacgagttcgatcagttctgggtcatcgacctggtctgctttgttcaagaagacgacgatgtacggtacgccgacctgacgtgcgagcaggatgtgttcacgggtctgcggcattggaccgtcagctgctgaaacgaccagaatggcgccgtccatctgtgcagcaccggtgatcatgttcttgacgtagtcagcgtggcccgggcagtcaacgtgtgcgtagtggcggttcggggtttcgtattcaacgtgtgccgttgaaatggtgatcccacgttctctttcttctggtgctttgtcgatgttttcgaatgcgacttcttcaccagagccatatctcgcgtgcagcactttggtgatggctgccgttaatgtggttttgccgtggtcaacgtgaccgattgtcccgatgtttacatgcggtttcgatctatcaaatttttcttttgccattttaaattcctttctatactaaatctactcaaacgaatgattgaaggcaattattctttgccttcaacgattttttcagcgattgatttcggaacagcttcgtaatgtgagaactgcatggtcgaaatcccgcggccctgtgtcttacttctcagtgaagtggcgtagccgaacatttcagccaacggcacaacgccggtaatctgctgggttccgttttgacgagcttccatcccttcgacacggccgcgtcttgagttgatatcgcccatgacatcgcccatgtattcttccggacagacaacggtcaatttttccatcggttccatcaaaactggtgcggccttgcgcatcccatttttgaacgccatcgaccctgcgaccttgaaggccatttctgaggagtcgacttcgtgataagaaccgtcgtaaactgttgctttaacgtcgataaccggatagccggcgacaacgccgttctgcatcgcttctttgatcccctgttcgattggtccgataaattctttcggaatggcaccaccgacgactttattttcaaagataaagccttcgccagcttccaacggttccagagtgatcaagcagtgaccgtactgaccacggccccctgactgacgagcgaacttgccttctgcgtcgaccttcttggtgatcgtttctttgtaagcaacctgcggtttaccgatattggcttcgaccttgaattcacgcagcatacggtcgatgatgatatccaggtggagttcgcccatcccagaaatgatcgtctgaccagtttcttcgtctgtgtgcgtcttgaaggtcgggtcttcttctgcgagcttcatcagggcaacggtcatcttttcctgaccagcctttgtcttcggttcgacagcaacggaaataaccggatccgggaattccatgctttcgaggacgatcggatgatccggatcgcagagggtatcccctgtaccggtgtccttcagaccaacagccgcgacgatgtcgccggtgtaaacttcagacaattcctgacggtgattggcgtgcatcaagaggatacggcccaatctttcgcgcttgtccttcgatgagttgtagacgtaggagcctgcttcagccttcccagagtagacacgcataaaggccaattttccgacgtacgggtcggtcatgatcttgaatgcgagtgctgagaatttttcatcgtcggatgcttcacgtgtgacttcttcgtctgtattcgggtcaacccctttgacagccggaacgtccagcggtgacggcagataatcgacgatggcgtcgcacagcatctggacccctttgttcttgtatgaggagccgcaggtaaccgcgacgagcttcagttcgacagtccctttacggatggcgcgtttgatttcttcttcagaaatttcctgaccgtccagatatttttccattaagtcgtcatcgacttcggccaagccttcgagcatcttatcgcgatattcttcggccttgtccttcatatcatccggaatgtcagtgatttcgatctgttcgcccaattcgtctttgtagatttcagccttcatcttgatcaggtcgatgatcccgatgaattcatgttcagcgccgattggcagctggatacaaatcggattggcattcaaacggtcaaccagggtgtcgactgacatgtagaagtcagccccggtaacgtccatcttgttgatgtaaaccaaacgcggaacgtcgtattcgtcagcctggcgccaaaccgtttcagactgcggttcaacccctgctttggcgtcgaaaacagcgacggcaccatccaggactctcaaagaacgttcaacttcaacggtaaagtcgacgtgccccggggtatcgatgatgttgattcgattccccttccaatgacaagtcgtagccgcagaagtgatggtgatccctctttcctgttcctgagccatccagtccatctgtgaagccccatcgtgggtttcgccgattttatggatttttccggaatagtaaaggatacgttctgtggtcgtggtcttacccgcatcgatgtgggccatgatcccgatattccgcgtattttccaaactatattctctagccacaatttctccttgttctggttattttgatctaacctaaaacgcttaccatctgaagtgagcaaaggctttgttggcttctgccatggcgtgcatggtttccttacgtttgacagcgccgcctgaattgttgcaggcatccatgatttcgcctgcgaggcgttcgaccatcgtacgttcagaacgctgacgtgcaaaaccgacgagccatctcaatgccaacgcctgttttctgtctgcgcgaatttctactgggacttgataggttgccccgccaacacgtcttgctttaacttccaataccggtgtgatattggcgattgcttcttgaaatgcttcaagcgcatcttttcctgttttttctgctaccagatcaaaggcaccgtaaacgatacgctgtgcgacgccctttttgccgtctaacatcacgttgttgatcaatttggtcacaatcgtgttcttatagattggatccggcagtacttttctcttaggaactggtccttttctaggcacttgcttccctccttaacaattttggattttcatcggtactcgacatccaaatgtcgtcgtgcgcttaacccgaaataatttcgcgttaatggccaatccacatcaaaagattctattctaatgacgcggctctgactgcactacttactttttaggctttttagccccgtatttggatcgagcttgcttgcggtcttctacgccagcggcatcgagcgcgccacgaataatcttataacgaaccccaggtaaatccctaacacggccgcctttaacaagaacgattgagtgttcctgcaggttgtgaccgattcctggaatataagccgtaacttccatgccattgacaagtttaactctggcaattttacgaagcgctgagttcggcttcttcggtgtcgctgtacgaacagcggtgcacacgccgcgtttctgcgggttgctcttcaaagccggcgtctttgtcttcagaactgccgattttcttccttgtttaacaagctgattaatggtaggcattcagtgctgcacctcctcatttaaaatttttattaaaaccggcacattcttcgcttaaaagaaggtgccggagataaccatgcctatgcttgatcgtttttcactcatccagaaagccgatgacggccgcgggcctgtcgatttcacaggctttgccgatctcagcctttgtgccggcgacgatgcagtggacctgatgggttttgcaggcctctttaacggtctcggcaatatgcgcgtcgcagtcctctgcgagcacgacgaaacgaatttcgtccttccgcatctttttcatcgtctggttcagtccgatgactttgggtgagcttttaaaagtctctacatctattttcataagactcccatttggcattaatgcacgctcaaaaaagcatgcgtgattattttacctttctgccgattcagtgtcaaggtcttttttatctgatcagccgagaatatcgccggatccgccgtcatccgaattggtatcgtcggaatcgttgtccttgtccggcttcttgtccgcgtcggcgtcgtcatcgctcaagaaatccatatcgaacatgtcaaaggcctttgagagctcggcgttcttttcgatgctgtcgtcaatggacttccgttcttcctcgacgcgttttgcgagaatgttgtcgtcgtcgatgaccacgtccaggccgtcggtttcgccgtctgcgatgtcgtcgatcagatcgtcgctgtcggccaaatcttctgtcgcgtcgatgtcgtcgtcgagggcattttcatcgtattccaaatccacatcttcgtattcgcggatgcccgtcccagctgggataagctggccgatgatgacattttccttcaagcccatcagcggatcgaccttgcctttgaccgccgcatccgtcaggacacgggtggtttcctggaaggaggctgccgacaggaaggagtcggttgccagcgcagcctttgtaatcccgaggagatcgcgggagtaagtacacggttccagaccgtgatccagcgccttgttgttggcttcgcgggcatcgaaaatatcgacgactgtaccggtgatcatgtcggtgtcgcccgaatcttcgatcttgacctttcttaacatctggcgaatgatgacttcgatatgtttgtcggagatgtgaaccccctgcagacggtaaaccttctgaacttctgtcagcaggtaagcctgaaccgcttcgacaccttgaattcttaagatgtcgttcgggttgatggacccttcagtcaacggctggcccgcttcgaccgaatcgccggtggcgaccttcagtctggccccgtaaggaatgacgtagctcttcgagctgccgtccggcgcggagacaatcgcttcgacgcgcttgccttcctgaatatcgaccaccccggcgatttccgtgacaatggcctggccctttggctttctggcttcgaacaattcttcgacacgcgggagcccttgggtgatgtcgtcgcccgacgcaaccccgccggcgtggaaggttctcatggtgagctgtgtcccaggttcaccgatggactgtgccgcgatggtcccgaccgcttcgccgatattgaccggcttccacgttgttaagtcaaccccgtagcacttgcggcagaccccatgtttcgcttcgcagttgaagacggcacggatgctgaccgattcgatgcccagttcgtcgatcttgtccgccatttcgcgggtgatgacttcgtctttagcgaccagcacttcgcccgtgttcgggtcgacaatatcttcgtgcgcgtagcgcccggcaatacgttcgcccaggctttcgatgacttcgttgttttccttcagcgcgtggacttcgtagccgtgttcggtgccgcagtcttcttcacggacgatcacgtcctgagagacgtcgacgagacgacgggtcaggtaacctgagtcggccgttctcagcgcggtatcggtcaggccctttctggccccgtgggagctcgagaagaattccaagatgttgagcccttcacggaagttggagcggattggcaattcgacgatgtccccgtcggtcttcgccatcaagccgcgcatcccggcgagctgacggatctgattgtcagaaccacgggccccggaatcggccatcatgtgaatcgggttcaagcggcccagattgtcgagcagggagcgggtaacttcgtctgtcgccgcgttccagatgtcacggatgttgttgtggcgttcatcccaagaaatgagccccatttcgtaattggcctggttttcgtcgatcttttcgtcggccgcggccaggatttcttccttgttcccaggcacctgcatgtcggcgaccccgacggtaatcccggacagcgtcgaatgcttgtagccgaggcgtttgatttcgtcgagcacttccgaggtgacggtcgggccgtgctttctgaagcacttgtcgacgattttgctcagcacgccttttttgacgacctggtcgatttcaagcttgaagtaggtttccggtctttccggatctctttcgacaaagcctaaatcctgcggaatcacctgattgtagatgaaacggccgactgtcgattcgatgaaaccgacgtgatcgacgccgttgattttgcggtgttcccggactttgacccgtttgtggagaccgacggcgtgattggccagtgccatttccatttccgcttcgtcgcagaagaccggcatttcgtcagaaaccaccggttcgtaatccgccggcgcgaagctgccgtgggtggcttcttcttcgtcgttcatttccagcgtgatgtagtaagcgccgaggatcatatcctgggtcggcacgacaaccggcgtcccatcctgcggcttcaggatattgttgcaggccatcatcaggaaacgcgcttcagcctgtgcttcgacggacagcggcacgtggatggccatctggtcgccgtcgaagtcggcgttgtacggcgtacaggccagcggatggagcttcatcgcgcggccttcaacgaggaccggttcgaaagcctgaatcccgagacggtgaagtgtcggtgcgcggttgagcagaaccggatgttcgtgaatgacgtcttccagcacgtcccaaacgattggatccatcttttcgacggtcttcttcgcgtttttaatgttctggctgatgccgcggtccaccaattcgtgcatgacgaagggcttaaacaattcgatggccatttccttcggcagcccgcactggtacattttcagttccggaccgacgacgataaccgaacggccggagtagtcgactcgcttgccgaggaggttctggcggaaacgtccctgcttccctttgagcatgtcgctcaaggatttgtacgggcggttgccagggccggtgatcgcgcggccgcggcggccgttgtcgatcagggcgtcgaccgcttcctggagcatgcgtttttcgttttggataatgatgtccggcgcatcgagttccaacagcttcttcaagcggttgtttctgttgatgacgcggcggtacagatcgttcaagtcagaggtggcgaaacggccgccatccagctgaaccatcgggcgcagttccggcggaatgaccgggatgcagtcgaggatcatccattccggcttgttgttggattgtctgaacgcttcgaccgcttcaagatgacgcgcgaccttgacgcgcttctggccggtggcggttttcagttcttccttcagaaccgcttcgtcctggtccaggtcgaccatctgcagcagttccttgatggcttccgcgccgatgccggctctgaagcttctgccatactgctgtctggcttcccggtattcggtgtcggaaaggagttgtttgtaggccagcgggctgtcgcctggatcggtgacgatgtaggacgcgaaatagatgacgcgttccaattccttcggcgacatttcgagaatcaggcccatccggctcggaatgcccttgaaataccagatatgggaaaccggagaagccagttcgatgtggcccatgcgttcgcggcggaccttcgcccgggtgacttcaacgccgcagttttcacagacgacgcccttgtggcggatgcgcttgtatttgccgcagttacattcccagtccttggtcggtccgaaaatcttttcgcagaacaagccgtccttttccggttttaatgtgcgatagttgatcgtttcaggttttttgacttcaccgcgggaccactggcggatcttttccggtgatgccagactgatctggatcgattcaaattttaactcctgtggattgatcatcttttactcctcattatcgttcaaatccgcatcgatatcctggccgttgataatgccgaacatatcttcgtcggaataatcgtcttccgtcgccatctgatcgtcggaggcgcctgacaaatcgtcgaacagcgactgtgccgcctgttcttcgtcgtgttcttcgccttctccttcgtcgtcgtgatgttcgtgcggcttcttctgatcgaattcgccgttatcgtaagcttcctgagccaagtcaatatccaagacgtcgaggtgttcgccgtctgcggtgttgaccgtcacgtcgagggccagggcctggagttccttgatcaaaaccttgaaggcttcaggcaggccaggttccggaatattttcgcccttgacgatggcttcgtaagccttcacacggccgacgacgtcatcggacttgatcgtctgaatttctcggagggtgtgggctgcgccgtaagcttcgagagcccagacttccatttcaccaaaacgctgtccgccgaactgcgccttgccgccgagcggctgctgggtgaccaatgagtacgggccggttgaacgggcgtgcatcttgtcgtcaaccaggtggtgcagcttcaagtaatacataaccccaacggtgacgcgcccgtcgaaaggttcgccggtacggccgtcgtaaagctgaaccttgccgtcttccggcaggccggcttcaactaagaggtcgcggatgtcgttttcgttggcggcatcgaaaaccggtgtcgcgatgtgcagaccgagggatctcaatgccatcccgaggtgcacttcgaggacttgcccgatgttcatacgagacggcacgcccaacgggttcaggcagatgtccagcggtgtaccgtccgggaggaatggcatatcttcctgcgggagaatgcgggagataacccctttgttcccgtggcggccggccattttatccccgacggagatcttgcgcttcgtcgcgatgtaaacgcggaccatcgtgttgacgcccggtttcaaatcttcgtccttgttggctctcgagaagaccttgacgtcgacgacaatcccctgttcaccgtgaggcaccttcaaggaggtgtcgcggatttcgcgggctttttcgccgaaaatcgcgcggagcagtttttcttccggtgacaggtcggtttcgcccttcggcgtgaccttcccgaccaggatgtcttcggatttgacttctgccccgatgtagatgatcccgttttcgtcgagcttcttcagtgcgtcttccccgacgtttggaatgtcgcgggtgatttcttccggtcccagcttcgtttcccgggcttcgcattcgaattcagcgatgtgaatcgaggtgtagcggtcttccttcagcaggttttcgttgagcaggaccgcgtcttcgtagttgtagccttcccaggtcatgaagccgatcagggcattgcggccgagggccagttcgccttgttcggtggccatcccgtcggaaatgatttctccggcgtcgacgtgctgattgtgataaaccagcgggcgctgattcatgcagttcccctggttggttctttcgtatttctggaggtgatagacgtccatgccttcgccttcgtccggacggatgcggatcgtgtccgcagagacgtaggcgacagtgccggcgcgtctggcgatctggcagtctccggagtcgtgggccgccttggcttccatcccggtcccgaccaacggcgcttccggcttgagcaatggcacagcctgacgctgcatgttggcgcccatcagtgcgcggttggcatcgtcgttttcgaggaatggaatcagcgcggctgcgacagagacaacctgttttggcgacacatccatgaagtcgacttcttcgcggtggatggtcgtgaagtcacggtttttgccgacacggccggtgacctgttcgttgacgaaacggttgttttcgtccagcggttcgttggcctgggcgatcgcgtattccccttcttcgtcggcagccaggtaaacgacttcgtcagtggcgaccccgtcgacgacacggcggtatggcgattcgataaagccgtattcgttgatgcgggcgtaaatcgccagcgacccgatcagcccgatgttcggaccttcaggggtttcaattgggcacattctgccgtagtgggagtcgtgaacgtctcgcacttcaaagccggcacgttctctggacaaaccgcccggccccaatgccgacagacggcgcttgtgggtcaattccgacagcgggttgttctggtccatgaactgcgacagctgggaggaaccgaagaattccttgagggccgcgttgatcggacgggtgttgatgaggctctgaggcgtcagaatttcgtcatcctgcacgctcatgcgttcgcgcaccacccgctccattctggataggccgattctgaactgattctggagcagttccccgacagagcgcagacgacggttgcccaagtggtcgatgtcgtcggtttcgccaataccgtattccaagcccataaaataggaaacagtcgcgtacaaatcagagtggagcaggtgcttcggcaccagttcacggtgacgacgcttgatttcgtcgtgtttttcttcgtcgctaaggccttcgtcgttcatgatttcgtcgagcaccggtttgtagacgaattccttgatgccgaggtccgccgtgtcgaaaggcagatcctgtttggtcagatcgacgaagtcgttgccgatgacgttgaacggtgcctcttcaccgtcaatggtgacggccacgcggacggtgttgatgcctgcgttctggatggcccaggctgtcgccttatcgaatttctggcccttttcgatcaaaatttcgccggtttcttcgtcaatgacgtcgtcgtaagcgatttgaccgatcaaacgggctgccagcgccagcttcttgttgtacttgtaacggccgaccttcgccaaatcgtagcggcggtcgtcgaagaacatcgaggtcagaagggattctgccgattccactgttggcggttcgcccgggcgcagacggcggtaaatttccaaaagcccgctgatgcggttgttgacttccccggccgcgtccttcttcatggtttcgatcaaacgcgggtcttcgccgaagacaccgatgatgtcgctgtcgtcgccgaggccgaaggctctgagcatcagcgtcagagaaatcttacgggttcggtcgatcttgacccagagcagattgttggcgtcggattcgtattcgagccaggccccgcggttcgggatgatctgggactgatacagcggaatacggtttttcttgtccatttctgaggtgaagtacgaccccggcgaacggaccagctggctgacgatgacacgttcggccccgttgacgatgaaggtgccggttggcgtcattttgtgaagatcggccagataaaccttctgttccttgacttcgttcttttccttattaatcaagcgcacgcgaactttcagcggctgataataggtttgatctctttccttgcattcttcgatcgaatacttcgttttgtcttccagatcgtaatcgacgaactgcagcacgagatttccggtgtagtccgtgatttcgcgcatgtcgtcgaaaacttcctgcaggcccttttccaggaaccacttgtaggaatccagctgaacctccagcagattcggcatctcgagaacttcttcaattttcgagaagctttgtctgatacgaagtccagatcgaacaggatgtacttgtaccattagcgtttgtctccttcgaatccaataaaaacacactcagacagcaaaaaagaaaaggtatcgatgaaatttccaacctttgatcagttgaaaaaacgaatccggaaaaatgaaaattccttcaaaccgcctttgatcagcggtttcacgcccatccatgcctttttgcattcacaatttataaagtttttttgagaaacacaaaaatttttttgaattttttttaaaattacgtataaatttttgcacttaagttcaattgagcatgttatcatgccgttttaagattgtcaagcctttcgtttgacaattcctccgaatttttttataatacatcttgcaaaacaaataaagccgtacggctcattttttatcgaccattttattttttcgccgttcggcttaatttttaattaaatgggggaattacatttatgaaaattaatgacacctcagaatttggtgccgccctgcgcaaccgcagaaagcagctgcattacacacaggcttttctctctgaatttaccggcttcagtatcagttttatttccgacctcgaacggggcaagcccaccgccgagctcggcaaagccctctacctggccaacctgctcggcctcgacacgacgctcaacgccagaggctccaacgcgtgaacgcgttaaatgtcatgattgaaatctgcgggcagcccgtgttagtcggcaccctatcggacgcctactcgccgctgccccagtttcaatacgcgccggattatctctcccgagaaaatgccaggcccatttccctccatctaccccttcaaaaggaccctttttcacctgaaagcacccgaaactatttcgaggggctgctgcccgagggcttcacgcgccgttccgtcgctgcctggatgcacatcgacgccgacgattacctcaccctgctcaaaatgctgggccgggaatgtctcggcgcggttacgatctgcgatcccaacgagcctgcgccgcgcccgtcttacgagaagctttcgatggaacaagtccgcgacctcgccaacgaaggtgtaaccgtctccacccagctcgtcaccaaagcgcatctgtcgctgaccggcgcctccggcaaggtcggtctctaccacaatcccaataccggcgagtggtttctgcccaagggcaacgcgccgagcacccacatcgtcaagcaaagccacgtccgcctcgacaacatcgtcaccaacgagcagctgaccctgacgacggccgatcgcctcggcatttcggtgccgcagagttttatcgtcaacgtcggcctcggccgggaccaggacgtgctcctcgcgacgcgccgctacgacaggagcttctcgcgctcgacgccgacggccaaaggcacgccaatgccccaacgcctccaccaggaggatttcgctcaggccctcggcattccctcagcgaataaatacgaggggccgaacgaccattatctgccgaaaatgttcgacctgctgcggcgctattcggccaacccgattgtcgaccagctgaagctgtgggatctggtgattttcaattttttgatcggcaacaccgacaatcatttgaaaaatttttcgctgctttacgacgaaacgctgacgtcgattcggctggcgccggcttacgatctgatctcgacctctatttacccgagttcaacccgcaacatggcctttaaaatcggcgatcacctgtctctcgacgacatcacgccggaggattttgcccgcgcggccaagacgtgcggtctcggcgccaaaatcgccgcccagcatttaagccgcctcagcgctgcctttgtgccagccctgaaggccgccacttcgtccttagtcgagcagggatttgtcaacgcgaagcacctcgccaaccggattctcaaaaccggcggctgtgagcaggtcgcttgattacgataataaaaaatcgagatcctattcaatcggatctcgattttttgttcgattatttaattcgctttggtttccttcgcgctcttaaccttccagtcgccgccgtccttttcaaaggttaacttccaagtataatccttggttgaagcggtatcgatcatctgcgattttgccttctcaattgcttccggcatgatgccgttgaaaagcgcaacatttaatcccttttcgccgccggaactgtacgcgctcatcaattcgctctgatgctgcgcaaagtagttctgactcaaggtagaaactgagttcgtaaaagttgaactattcatactgttcggatcaagaatagatactttaaccgacagcgatttgtcgttgtcatcataatcgtcgttaatcgtgtaagatttaatcaaattctttttgtaatatttcatcagatcattgactgaatcctgagcagactgagataaatcagattctgaaattcccatactggaaaaacttgagtaaaaaccttttttgaacgtatcttccatgttttcgtcgatatcgagagaagtcgacgcggaacttgagcacatcttctgcgctgaagtaaaatcgccatcgtcgcaatacgtcataaaggtcttcgctgccgattccacttcctttttgtcactgccacaggccgtcaaaccgagggccagcgccgccacacacaccacagccataagccggctcagcattttctttttcataatcttacacctccttagttttttcttgttgtaatattatgacttcgatttcattttatcatgattatgcgctgaatacaatatatttatccaaaaatatctttttgtttgaattaatatccttaattgaaaaaaagagcaagtgaatcgtcctcttcgtatcaaaaatagataccattatttattcaaaatttactgcacttcttttcgcagcggtaatggatttgtactataataattttgtaatcgatataattcggagggtaattaatttatcactcattttctctaaggaaagaaggcgtatgattttgattaaaaagagaaaagttgccatcatcggtctgggccacgtcggcgcccactgcgcgtattcccttgcgctccaaggcatcgtcgacgagctgtatctggtcgacacgaatcacgacaaggtcgtcagcgaatgccaggaccttcgtgacgcggtggccaactgcccgcacaccgtggaaattaacgtagcggattacggcgatctcggcgacgtggacattatcgtcaatgccattggcaacgtcgccattctcgcggcgtcgaacaacgaccgcctcaaggaattggatttcacgattcctcaggtaaccgactttattcctaaggtgatggccagcggctttgacggtatcatcgtcaacatcaccaacccttgcgatatcgtcacctatcaaatcgcgaagctgtccgggctgccaagagggcgcgtcttcagcaccggcaccggtctcgactccgcgcggctgaaaaacgtgctctaccggagaaccggaatcgcgcaccactcgatttacggctgcatgatgggcgaacacggcaacgccatcatggtcccctggtcgcagattactttcggcggcaagaaattgactgaactcgcaaagcgcgacccccgttttcaatttgaacacgaagacatccgcaagcaggtcgtccaaaacgcctgggtaacggtcagcggcaagggctgcaccgaatacggcatctgcagcactttggcccgcatcgtccacgtcatctatcacgacgaaaaggcgattctgccagtgagcaccgagctttgcggcgaatacggcgaatccgggctgttcatcggcgtcccggcgatcgtcggctctgacgggatcatcgaaatcgtcgaatattccctgcctgacgatgaaaaagccgcgttccacgcctgctgcgaaagcgtgcgccacaatctcacattaaacccgctgattgtccactaattgtcgacacaaaaaaacgagatccgcaagggtctcgtttttttaattgattcaaaggaataaacgctacagcaaatttctatccggcgcgtacccaattattatcggaggatgatacccggccgcgttacaaattatggtaaaataataatatcgtaaacctttaaaatgaaatgattttagaaacatgaaaaggagggatgctgatgtcaaacgacgccatcactgtattaaagaccgaagcccaaattgacgcgtacctcaaggatcgcggaatcttttccagaacctgccgtctcattgtcgaggacctgcgcaaggtcaaggaaagcgccgagggctttgtcaatctgatctaccgcgtgcgcggcagcgacggccgttcagtggtcatcaagcagattctcgatgtccccgtcagccgtcagcagcgcaagagccccgacgcctacgtctccaactggcagctcgaccaaagccggatgcagtacgaaatcgccgcgttgattttctggaatcaaatccgtccgggcatctgccctgaaatctacctgctcgaccgccccaacggcgtcattgtcatggaagacttgtctgatctgagcctgctgcgctacgaatttacgcggttcaaaaaatacccgcgcctcgggcgtcagctcggcgcttttctcgccgacaatttattttattcgtcggctctgaacatgaccgcctaccgcagacagaccctgctcaagtatttcgacaacccggaagtgaccgcgctctacacctttttattcaaatcctgcgtgatcgtctcgccggaacgcgcgatgcccgaggctgtcgccccgctgcggcagaacatcatccacgacgaggccgtccagacggaaattacgcggctgagcaagctgttcaccgacgacaaggaatgtctgattcacacggacctgcacgcgtccaacattatgatcgacgacgaccacctgaaaatcatcgacggcgaattcgccgggtttggtccaatcgcccaggatttcggccgtctctgcggttcctttgtgctcgactactgttcgctgttcggcgagggctgccattcgaaggctaagcggaaagactatcagggctacctgctcgatatgctggccgatttgttcacagtctttgaaaaggaattcaaaaagctgatccgcgaaaacatcccgcacaattacaacctgcgaaagctcaacgtcgacgcttatctccgccagcatttcgccgacgctctctcctttaccgcgctcaacgccgcctcccggctcagcgactgggggctcgtccacgatttcaagattcttccgattgaggaacggatttacccggaaaagctcgtgctggtctcgagtcaagatattttaagcggccgaatcaagcttaaaagccccgacgagtggatcgcctacctcaaggatctgccgaaccgctacccaaaagactgcctgtaagctttctctattctcaatcatttttctaagcattaaaaaaagctcgtgccgtacgacacgagcttttatttgattgctttgtttttgaagattagtcgatgatcttcgcaacagcgccggaaccaaccgtgtggccgccttcgcggatagcgaatcttaaaccttcttcaatagcgattggcgtgatcagggtgacttccatttcgatgtggtcgccaggcatgaccatttctacgccttccggcagtttgatgtcgccggtgacgtcggttgttctgaagtagaactgcggacggtatccgtcaaagaacggggtgtggcggccgccttcttctttggtcagaacgtaaacctgtgcagtgaagtgggtgtgcgggtgaatggtgcccggctgtgccagaacctgacctctttcgatctgtgtacgatcgatcccacgaagcagtgccccgatgttgtcacctgaacggccttcgtccagtgatttacggaacatttcgataccggtaacagtggtctttctcggttctttgatcccgacaatgtcgacttcgtcgccgatgtggacaacccctctttcaacacggccggttgcaactgtaccacggccggtgatggagaagacgtcttcgactggcatcaggaatggtttgtctaagtctctcttcggttctgggatgtagctgtcgacagcttccatcagttcgatgatcttgtcgccgtctgggcccattggatcttccagtgccttcagtgcggaaccgacaatgattggggtgtcgtcgcctgggaagtcgtattcgttgagcaggtcgcgaacttccatttcgacgagttcgatcagttctgggtcatcgacctggtctgctttgttcaagaagacaacgatgtacggcacaccgacctgacgagcgagcaggatgtgttcacgggtctgcggcattggaccatcagctgctgaaacgaccagaatggcgccgtccatctgagcagccccagtgatcatgttcttaacgtagtcagcgtggcccgggcagtcgacgtgtgcgtagtgacggttcggggtttcgtattcaacgtgtgcggttgaaatggtgatcccacgttctctttcttctggtgctttgtcgatgttttcgaatgcgacttcttcaccagagccatatctcgcgtgcagcactttggtgatggctgcggttaatgtggttttgccgtggtcaacgtgaccgattgtcccgatgtttacatgcggtttcgatctatcaaatttttcttttgccattggtcatatctccttatttaaaattaaaataaattaaaggcgtcgttaaaaaacgttccataacattatatataatatgattgacaacttcaagccattttcgcatttttaagccgtctttaataggcgcgtgcgaaataagccatcttgtcggcgtgcttgccgcagcagacgcaggagccgtctccgatgacttcctgttcgtcgtcaaaggggatgcagcggcaggaggcgccggtttcttcgtgaatcttgtcttcgcaggccggattgccgcaccaattggctttgataaagcccggattttcagcgaggcgctgcttgaattcgtccatgttttcggctgtggacgtcttttcttcacgggccttcagcgctttgtcgtacaggttctgctgaatggtttcaagcagatcgccgatcgtgtcttcgatgccgtcgagagacgccggtaccttttcgccgttgtcgcggcgcgccaggacacactggttcttttcgaggtctctcggtccgagttcgacgcggatcggcacacccttcatttcccactgattgaatttccatcccggcgaattgtccgaatcgtcgagggtaaccttgaatcggccttcgaggcgttttttcagatcctgcgctgcgtcaagcacacccggcttgtgcgccgcgatcgggatgatcgccacctgaatcggcgcgatgtgcggcggcagcaccagcccgttgtcgtcgccgtggaccatgatgagcccgccgatgagccgtgtagacacgccccaggacgtgtggtacgggtactgctgttcgttgttgcggtcgaggtaagtgatgtcgaacgccttggtgaaatgctggcccagattgtgggaggtgcctgactggagcgcctggccgtcgtgcatcagggcttccatcgtgtaggtcgccgctgcgccggcgaatttttcgctttcgctcttgcgccccaccaccatcggaatcgccagatccttttcggcgacttctcggtaaatgccgagcatgcgcatcgtttcttcctgcgcttcttcagcggtttcatggagggtgtggccttcctgccacaagaattcagaggtgcgcaggaacggacgcgtcgtcttttcccagcgcacgacgttggcccactggttgtacaaaaacggcagctgacggtaggaatgcagccacttgctgtacatcgagcagatgatcgtttccgacgtcggccgaatggccaggcgttcgtttaactttttgccgccgccttctgtgacccaggcgacttccggcgcaaagccttcgacgtgttccgcttccttctggagcatgctttccggaatcaaaagtggaaaatacatgttctgatggcctgtcgccttgaattttgcgtcgtacagcttctggatattttcccagatcgcgtagccgtacgggcgaatgaccataaatcctttaaccggcgcgtagtcgaccatttccgttttggagatgacatccgtgtaccaccgcgcaaaatcgacgtcccgcggtgtaatggcttctacttttttgcccttatttttccccataacaatcctttcgcataaataaattttctttttaaacggcctatattatagcacaaaataaaaggctgtgccgaaaagcaacagcctttttatttttatttcccgcgaatgcgcttacgcttattgtgcgtccgccgccacttcgtccgcttcgtcgttcagatgcagggtgtcgtttaaatattcgaccacctgatcgccgtcgaggccgtgaaccatagacgcatcgccgatggattccattgcggcagccgggcagctgatgcagcccatgccgatcatcatcaatgcgcgggccgcttcgggatatttagcgacaacgtcgccggttaacatgtcttttgtaattttcatcggagtcctcctcatttcgtcttcattttgtgcctattaatataacacagaataaaatgaaatcaagactttttttgtctaatttaagtttaacccctggaaaacaccgccatggcccgctcgacgtcggcctgcatcgcgtcctgagccgcctgagccatttgatcgaagcgcaggccagccgggtcgtcggcaccgtcgattagcgcccggacgccggcgccgccggcgagtgacatgtacgtaaaataattgattttgcagatgccgtttgcgatggccttctgcatttcgtcatcagtgacgccggaaccgccgtgcatgaccagcggcagctgcaccgcctcccgcacctcggcaacccggttcacgtcgagcaccggcttggacgtgtagaccccgtgggccgtgccgaaggcgatagccaggcagtcgacgcccgtcgcgtcgacaaaggctttggccgctgccggatcggtgtaggccgcgtctggcggcagattgtcgggatcgtcggtaccgccgccggaggccgggcggataacccggccgagctccgcttcaacgtccgcgtcgtaggccttggccatctcgaccgctgccttcgtgaccgccacattgtcctcgtaaggttgggctgaggcgtcgatcatgatcgatgtgaagcccagctccagcgcccgctttaaataatccagatcttcaccgtgatcgaggtgcacggcgaccggcaccgacgcacgtttcgccgcatcgagcatcaccggcgcgatcacgtccatcggcatcagggattcgtgaagctgagcgtgctggagaatgacgccctcgccccgcgcctcagcggccgcgaccgtcgcacgcaccgcctctaaattcggtgtgttgaaggcgccgacgccgacgtgcttgtcgtaagcttctttcagaagcgcactcattttgactagcatcgcgtccgcctacatcctgacggttttggccgcgacgatgtcgacgccggtccccgccacattggcgatcagcgactcgcccattttaacggcgtgatgcagatgcttcgcctgaatggcctgcatcgcgtccttcatcacagccttcggaatcggcttggccgaacgcaccggcacgagcactgccttggcgccagtgtcgaggatcatcgtcgatgtcagagtccgcactgggcagcgccattcgctctctgcaaaatcgacgccccgtttgcacaaattgccttctaccgcgaccacctggtcgtcttcaatcgtcgctaaaagctcacagctgttcgggcaggtcgtacagctcatttttacttttttcattctggcctcctcattatgcctgggtttcaactgtcacggtcagcggttccgcacagcctgcgagggcatcgcatttgaccgtgtgaatttccatattgctcggcaggaaacgatgggccttcttttcccggtaaatttcctgcccacctgagcggatgaccgtcacaccgcttgcaatcggcgcgccgactctgaatttaatctgcttgtctgcgccgtccgccggatcgacaaagcccggcaccgtgtagcgcaccgcgccctcggctttcacggcgagctgctgttctgaatgttgcagcgcgtttctggcgtaaagggccgctttttcgccagcttcctgggcttccgccgtcacgtagtcgacgacgtcgtgcacgtgcaggacgttgccgcaggcaaaaatccccggcactgcggtttcgagattttcgtcgacaatcgggcccttcgtcaccgggtcgaggggcacgcccgccttccggctcagctcgttttcggggatcagcccgaccgaaagcagcaccgtatcgcaggggatttcccgttcggttcccggaatcgggttgcggtgttcgtccacctgtgcgacctctaccgaatggacgcggtccttgccgttgatccgcgtgatcgttgtggacaaatgcagcggaatgtcaaaatcgtccaggcagttgatgatgttgcggtacagcccgttgggatagggcataatttcgtaaaccccttcgacttcaatgccctcgagggttagccgtctggccatgatcaggccgatgtcccctgatccgagaatgaccgcgcggtttccaggcttcatgttttcaaggttgatgtagcgctgggcgattccggcggtgaacacgccggcgccgcgatcccctgggatgcggatggcgccccgggtccgttccctacagcccatcgcgaggatcacagcccccgcttcaaaatgaagcaccccttcgccgcagatcgccgagacgtggcggtccttggtaatgtccagcaccatcgtgttcaaaaacacgtcgatgtcctgatccacaacctggtcgatgaaccgttcggcgtattccgggccggtcagctcttccttgaagacgtggaggccgaatccggcgtgaatgcactgctcgagaatgccgccgagctccgcgttgcgttcgagaatcgccacgctggcgccctgctttttggccgagagggccgccgccagaccggccggcccgccgccgaccactaccacatcgtattgataagtcttcactctgattctcctttatttcttcactggcccgaacaaaaccggcgaatggtcttcttcgaacttcacttcttcttccggaatgcccaattcccgtgccagaatcttcatgaccttgaactgacagaagccgctctggcagcggcccatgcccgcgcgggtgcggcgtttgacgccttcgacggtccgcgcgccgagggtctggtgaatcgccgcaacgatttccccttccgtaaccgtttcacagcggcagacaatctggccgtagcgcgggtcctgcgcgatgatttggtccttttcctcgtcggtgcattcgctgaaatccaccggcgccttgcggtacttgttgtagcccggtcggggtttcagatcgagccctgcgtccgccaacaaatcgcggacgtattcggcgatccccggcgaagaggccgcccccggcgactgaatgcctgccgcgtggatgaagtgcggcacggtttccgattcgcagatccaaaagtcgttatcgttgtttaacgccaccggccgctgcccggcaaaggtgcggatgactgacccgtcgtcaaatcccggaatcaagtgatgggcgccgttgagcagatcctgaatgcccttcgcgtcgttgctcgtgtcttccttgtcggtgcgcatcgtcgcagtggagccgatgatgtaattgccgtggggcatcgggatcaacgcgatgcccttggtgtccggactcgggcacgggaacatgaccgtgtgaatcggcgtcggcaggtttttgtcgacgacacagagattgccgtggcgcccctgaattttgtactcgtgaatgccggccatcgcggcgacgtcatcggcgtagatgcccgccgcatcgacgatgtagcgcgtccgataagtgtcgtggttcgtctgcacggtgaaattgccgtccgcgtctttcgaaatgccagtcacttcagattccaggaagatatcagtgccgttcaccttcgcgttttcggcaaaggccaccgccacctcaaagggatcgatcatcgtcgtcgtgtgggccaaaagcgcgccgagggcctttttgttgatattgggctcccgattctgcagctgggccgcgtcgatgcgttccacctgttcgacgccgttgatccgcgcgttgtcgcagagctcatcgaccttcttcaaatcctgttcagaataagcgacgacgagggtacccgtgtgacggatattgaaatcgagatccttcgcgagctgcgggtacatccgcgcgccccggggattcagcttcgccttgagcgtcccgggatgaggatcgtagccggggtgcaccaccccgccgttgcccttcgtcgcgcccatgccgatgtcgtttttgcgctctaaaagcgccacatcgatgtcgtatttcgccagctcgtgaatgatcccggtgccggtgatcccgccgccgatgacgatcacgtcgtatagtttctgattttcagctttcaaattttacgcctcccttttgttccaatttaccgcatcagcatgccgccggtgaggtcgaccgtcgcgccggtcatatagcccgccggttctgaagccagaaagacgatgacgtccgcgacctcctcgggctttgcgacgtgaccgattggaatccggctttcgtaatagcccggatgctcggccatgctcttcgcaatcatgtccgtttcgacgatgcccagcgccaccgcgttgaccgtgatgcccttcggcgaaagctctctcgccatcgaaatggtcatcgccgccatgccggccttagacgccgcgtaatgaacgtggccggtggtcgagccgtgaaaagccgcctgagagttgacgttgatgattttaccgccccgcccggcgtcgagattcgccttcgcgaaatactgagacgtcagaaaagacgccgtcaaattgacgttgaaggtccgctgccagtcctcgaggctgatatcctgacaccagccctgaaggaaaatccctgcgtcgttgatcaggatatccatctcgccgagggcagcctccgccttcgccatcatcgccgtgacctgggccggatcggcgaaatccgcagccaaagccgtcgcctgcacgccgagggctctcgccgcctcagctgttttttccgcgccttctatatgtccggccgtcacgacaagattgaccccttctctcgccagcccgagggccacggcgcggccgacgccccgcgaggcgccggtgacaattgcatttttaccttttaattttaaatccatataatccttcgatttctttacgcttacacgcgctgtttcattcgttccaatcgtcccagacgccgtcgagagcgccgatgaccttcagataccgcctgtatttcctgtcgtagacgtccttcttcgacaaatccggctgggccgtgtacatgacgtcgaccatctgctccgacgcttccttaaaggacgggaagaccccgacggccacgccggcgttgatcgccgagccgagggcgccgagctcctggctgcgggccacttcgatcggcacctgcaggatgtccgcgaacatctgcacccagatcttcgatttggcgacaccgccggccattcggatcaaatccggggcatcccggtatttgagcagcttttcaatgtggtatttgtggctgaagacgataccttcatacaccgcacggagcatgtcgtcccgggtgtgccaggactgcagcccgatgaaggcacccttggcgttcatgttgacgttgctgccgaacaaaaacggcaggaagaccaatcctttgtcgtcgtccccggcccgggccaccgcctcgttggcgtagtcgtaaatgccccggtcgtggaggtcgacgcctttgagcacctccgtcaagaaccattcctgattggaggccgaggtggggctgccttcgagaatcatccaatagcccgggatcgtatcgatcgacgtcatgaacaaatccttgtccaccaccggctttttgctgatgtactcgttgatgctccaggttccggcgaccacgcacatcgccgattcgtcggtgacaccgacggccatcgccgacgcgtgaatgtccatcgagccgccggccaccggcgtgccggccttcagcccggtcaaccccgccgcttcttcggtcacgtagccgcagatttcgccggagtagcgcagcggcggcagcttgtcgtaaatgcactcgaggcccatttccgcgaggaggtccttgtcgtagcagacatcccggacgttcatcagcgacgacccggaataatcggtgatttccccgtaggcctcgccagtgagcttaaaccggatgaaatccttgcacatgaagacccagcgggtccgttcgattacctccggctggtactttaaaaaccacttgatgatcgtcgtcggctggccgccccagcaggactgcatggtcttcggcagaattttttcaaaggtgccatcctgctgccactgggccgcgaattcgttgcctctggaatctgtcgaaatgatgccgttgtaggccggcgagccgtcggcctgggtcaggtagacgccgttgccgtggcccgtcgccgcgacgccgacgatctgcccgctgtcgatgccggcctgagcgatcaccgcgcggatcgcgccgacgttggccgcccacatttcgttgctgtcccgttcggtgaagcccggctgaggctgaatcagctcagttttccggctggacaccgcgatttcatgcccctctaaatcgtacagggccgccttggacatggtcccgccgttgtcgagccccaacagatatttttccattttcacacacctctctattgtgatctgaactttcgttcatcctcatccaatctaaaacaaatgcctttcactggtggtggcgccgtcgaatccggcccgctccaccgcctcaatctcttctggagtctgaatgaagccgccggcccagagcgggatagctgtcaccttgcgaagctcgggcagcacgtctaccgcgaccttcgccggcagaatttcagccgcctgcgctcgggtagatttcaaaatccgaagggtcgtgtccagcgccttggaatcagagatcagaaagcgctgaatcgtgtacaggccgatgttgcgcgccatcccgaggcgcatccggtcggtggacatgacgccgtcgaccttgaagtaatgcttgagcagcttgatcccgacctcgtctcgtccgaatccgccgagaagctccatattgatgagcacccgtttcccggcgtcgtggaccttttgggcgagcagcggcagactggcgatgtctgcccccgtgagcagaatcgtctgccgttcgctctttagcgcccactccaaatcgccgaggcggcggatcgacgggatcacctgaaaggctgacggctgatgcccgccgcgctttgcgccgctcattcgcgcgcccagttcgaagagcgcttcacggcttcgcgccattgttcgtagagcgcttcccgttccgtatcgcccatgcgcggttcaaacaccttgtccgcttcccacaagtccttgagctcgctttgatccttccagacgccgcagcccagccccgcaagataacaggcgcccttggccgtggtttcaatatccttcggacggatgacgcggcagttgaggatgtccgcctggaactgcatcaggaagtcgttctgggacgccccgccgtccaccttgagttccttgagggcgatgcctgaatgttcggccatgtcttcgagcaaatcccgcgtctggtacgccatggattcgagggccgcccgggtgatttgttcctgggtcgtgtccgcggtgatgccgatgatcatccctctggccttcggatcgtagaacggcgcaccgaggccggtaaaggccggtacaaagaagatgcccccgttattggggatgctggccgccatggcttccgattcgccggatttttcgaagaactgcatcttgtctctaagccactgcaccacctggccggcaatcagaatggacgcgcccatcgaataggacaggtggccgtcgatcccccaggccaaagtcatcagccccgtttcggtccgcggcgccttgtcgccggtgaacatcagcggcacagcggaggtgccgtaggtgtttttcgcgctgccctcttcgaagcaggcctggccgaagagcgcagccgactggtcgccagcgatgccggtgattggaatttccgcgccgaaccatttgggatcagctgtgccgaaatagcccaccgaatccttgacctccggcaggatttccgccggcacgtccagcgcctcaattaaggcattgtcccatttgccttcgtaaggattgaacagcagcgtccgcgccgcgttggagcagtccgtcgcgtgcacccggccgcaggtgagattccaaaggagccagcagtcgatgttcccgaatttgagcctgccctgttttgccttttccgccgcttccggcacgttgtcgaggatccatctgatcttcgttccggaataagtcgggtcgagcaccagccctgtcttgtgattgaacatcgcgttgtagccttcctgacggaggcgttcgacgatcggtgccgtccggcggcagccccagacgatgtcgtgatagaccggctctccggtttcgctgtcccacatgacggtggtttcccgctgattggtgatgccgatggccttgatgtcctggccggtgataccggccttggcgatcgcgttctgcgaggttttcaaagtgacctgccagacgtcgttggcgtcctgttcccaccagccggactgggggtaatactgcttgtattccgcgtaatcgatggcgacgacattgccagtttcgtcgtagacgacgccgcgcgagccggttgtgccctgatccataaccaaaatatactgtttcattttcatcctccccgatgaattcaatccttgaaaatacaaaaagccctgtttaataaactgcgcaatctcgtacacgacttcagatctcgcaatccattaaacaggactctgcatttccatcccattctccaactctccaaattttgaatcaaatcggaaatattttgttttgcaggtttatcttaacacggttagaaaacgatgtcaagatgaatttgaccggcggcttctgcactgtaagttttataccgaaaaaatagcttatcggtgtgtattctgtgatatgattatctttatgagatacgaaaaaatagacgcgatttttaaccaattccacatcagtcattaccgcagccaggtcgagcagattttggatctcgaatccatttatcacaagctcgccaacccggagtttctgacgatcacagcggcgctgaagcagaagctgcgcgacggcgcggcggaagaagatatcaagattcacgccttcgccctgatccgcgaggcggcctgccgggtgctcggcatgcggccctttccggtgcaggtcctcggcggcctggtactcaacgacgggtgtgtcgctgagatgaaaaccggcgaaggcaagacgctggtggcgatcatgccggcgtatttgaacgcgctctcgggcaagggcgtcttcgtcgtcacggtcaacgattatctggcgaagcgcgatgccgagcagatgggccgagtcttcgccttcgccgggctcacgaccggcctggtgacaagcggcatgtcgacggctgagcgcaaggccgcctaccaatgcgacatcacctacgggacgagcagcgagttcggcttcgactacctccgggacaacatcgccgccgatttggacgaccaggtgcagccccgccgccatttcgcgatcatcgacgaggcggactcgatcctaatcgacgaggcccgcacgccgctgatcatctccggcgatcagacccgagacgccggcgaatacgagcgggcggatcggttcatcaaatcgctgacccccgccgattacgaaaaagaggaaaaggaaaaggtcatcaccctgaccgaatccggcattgccaaggccgaggctttttaccacctcgacaatttggccgccgctgaaaacacgaccgtggtgcacgacatcgaaaaggccctctacgccaacggcatgatggataacggcgtggactacatcgtccaggacgggaaggtcgtcatcgtcgatcaatacaccggccgggtgatgccctcgaggcagttttccgacgggctgcaccaagcgattgaagccaaggaaggcgtcacgatcaacagcgaaaccaagaccctcgcgacgatcacgattcagaattattttaggcattttgacaaaatcgccggtatgaccggcacggcccagacggtagccgacgaattccgcactgtctaccacatggacgtcgtctcgattccgacgaatgtgccggtgcagcgcgtcgacaagccagaccaaatttatacaaccgagtcggccaagctgcgcgccgttacagcccacgtgaaagcctgcctgaaaaaaggacagccggtgctcatcggtacggcgtcggtcaacgcgtctgaaaagctcagcgcggccctgacgcgcgcgggcattccccacactgtgctcaacgcgaaacaccttgaacaggaagcggcgatcatcgccaaggccggacagcggggcgccgtgaccatttcgacgaacatggccgggcggggcaccgacatcaaactggggcccggcgtgcgggaggccggcggtctctgcgtgatcggcacggagcgccatgaatcggaacgggtcgacaatcagctccgcggccgcgccggccgtcagggcgatccgggggtctcgcaattttacctttccctcgaagacaatctgctcaaaatttttggcgggccgagggccgaaaaactaattgccaaatacgccgactatcctaaagataaaccgattgtcggcggggccgcggagcgggcggtcaaggcggcgcaggatctgatcgaggccaaaaacgccgaccagcgcaagaacgtgctcaagtacgacgacatcatcagccgtcagcgggatttgatttacaaggaacgccaggcggtgttggaaagcggcagcctcgccggtcagatcgacgcgatggccgacgacgcggccgatgcaattatcgacgaatgcgtcaccgacgactataaggtcgacacccagcagtttatccaaaagctcaaggcctacaacatcgcgattccacagaacgaactcgtccaaatccgcgatctcgacacgctgaagcaggcgcttgtggccaaatttaaagcccttcacgcggatcacgtcgctgaattcggcgaaaccctcgcgaacaatatggaacgtttagtcctgcttcgacaggtcgacgcggcgtggatcgatcatttgactgcgacgtcgcagctgcgccagggcatcggcctgcgcgcctacgggcagaacgacccggtcgtcgagtacagccgggaatcaggagaattattcgatgcgatgaaccgccgcatcgtgctggagaccgttaaagccctcgccaatttgaccaattattgattctttctttttaaaaaacatatccgcagcttgtcttttcaggctgcggattttttgcgcaaaaccgcacgtaaaaacccctccttacggatgcctatccataaagaggggttgaatttttatttgatttcgcgctgattcgcgctattccattttaattaacgtttccgtgcttacgcgtcttcttcgctttcgcggcggcgtctgcgcgcaaagcccaaacctgcgatcgcagcgaggatggcggcggcttctgcaccagctgcggtgttgtcaccggtcttcggcgaaccggacacggtgctgttggcggtcttggcggttactgctgcggcattgccgttggtgcccgcgatattcgcagcgttcgcagctttcatcgcggcgaggagtctggccaaatcgccttcaggcagcatcgccttcgcgctgtctgaaagggcctgataacggcggtagacgttcatgatcccatcgcggtccttggcgctcggatgtttcggcagcgcattgatcatcgtatcgactttcttcgcggcatcactgtcggccttttcaatggcgagacgctgattcgctttgtcaagagtaactttagcatcgttcgcaatacttcttgctttttcagcggccttttggtctgcatcgacttgtatctgcatatcagctgctttttctgcaagtttcttagcgtcttcaaggcgtctcgcatagtcattaacactagctttaatatccatattggttgtatcgtaagccttaagccaatcaatgacaggatcaactgtgtcaggttttgcaaggaaatcctgatctgatggcagattgttcatttcatctgcaataactttgagtgcgtcagcctttgtttttgctttaatagcttcattgttaagacattgctgcttttcatcaagtgtttttgctctctgctcagccgcatcagctttattttgtgcgtcagaagcaatctttgcagcatcgatcgcagctttctgagctttattataaacatcacgagcatcagttactgcctttaattctttagcctttttatcggcttcattttttgcaacattagcattagctttagctgtgttcgctgtttctgtggcttcattaagagctctttttgtttcagttacgtcttgatctgcttttgctttcttatcttgtgcaattttgagattgctttccgctatttcaagattttttttcgcatttttaagtgcagtttctgcctgcccctgatcgtttgcagcctcttcggctgctttctttgctgcatttgctttactctgtgcatcattagcattagcttgagcagtatcggcttctgcttttgccgcgttataagtattgcttgcatcttcttctgcttttttagccgtattatatgcagactgagcattattcattgctatagcagcattggatgcagcttttttagcctctgttaatttattttcacagttcgtaacttccgtcttggcctcttctaatttctctgttgcagtattgaaagctgttactgcgttgttataagcaacttgagcatcttcggcagcattttttagtgctgttttttgtaacgttgtatcagttttagcttcttccgcaagatctctgaagtcttttgttgttccattaacaccattttgaggtttatctgttgaaaaaccagctgttgcagtatttggatatgtattctgttgcccttctcctgagctaaatcccattccgacgtattcgggatctaaactgactaaactgagccaatggccatatacatgattttttgtgttgatgctgtcctgatatttgtaagcaaaaggaacaacagatttttcgctattccaatctacgttcttaaaatcagttttatacgtttcggttgtatccttatcattgaaataatcttgagcatcacttttaaatgtgttacgttcgtcaagccaatttgcgattggatcttctgcataccatgaaatatccttttcattagtttcgccaaagaatactgtatgataatgaatatcatcatatccatcgacaagatcacattcgagcatttgactagccatatggctgccactgacaatataatcaggaagtccatttttttcacgatatttattcaaagcatctatacaatcaagtgctttcataaaattgtcatacgtcatatcagagtcattggcttttgttgtctttgtcccaaagatctgtctataaacgccatcatttttttcgccacctttggtagcccattcagtatatttgttatttgaaatggaatccaaaaactgggctacagtcatagctttatgaccatctggagcgtcattgtatttcttgtttgcttcatcgagagcttgttttgcattatctacagcatctttatcactctttaatatagattcaagatttgttacattagtcttcgcagtattaacagcttccgttgccctcttctcctcggaatcggcatcatttttcgcagatgatgctttatctagtttatctttagcattttgtgtattagctgtggcgcgatcaagattttcttttttcccatcagcaactttatttttattcgcagcttctttttttgcggcgtcagcagtatcttgtgcagccttggcttcagtagcagcttttttcggattgatagcgttatctacagctttttgagcagaactaacagcttgttttgcattagttaccacattatttgccgtatcgacattttcttttgcaatagcgtcagctttttcagctttactttcgtcttcttgagcaacatctttcgcattatcggcagttttagacgcttgttcagcttttgacgcttcagtattagctttatctgatgcatcttttgtgttcttaatagattcatccgatggatttgttactgtctttgctgtatttgcagctgcttttgcgtcagactgtgcttttcttgctgcattctgagcctccgctgcagctttatttgcgtcagttgaagcttgtttgtttgcttctgcttctttttcagaggtattggcaacattttgagcactatttgctgctgttttagcttcattagcaacattatttttttccgtagtagccttattctgtgtagctatctgagatgcttttgatgcagaagcagttgcctcagcatcttttgctacctgattagcattgtcataatttttttgtgcctgtttttgtgactgttcagccgtatcattagtttgtattgattcagttgttgaattagtatttattgtctgttcaaccgtattcgactgcgcgttgaccacgacatgtccaccagctaaagtcgccgctgcgaatgccaaactaacggcggtgcgtttaacggtctgttttttcatttttccttctgttttcacttctgttttcctttctttttacccttacttgtacgcctctcttttcccaaaagccgcgtaactgctgtgtactaaataaaaataaatgtcacttttcctttaagtaacctttaatttaattatagaaccctctagttgttctttcaagttatttattcaatatctaggttaatttcatcaaaaataagttacttatgaataaaaaaattacaccaaccctttcggattgatgttggaattatgaatgtaaaaagacgcgctgcttcaatctcgtcagattaaagaaacacgtctttctatttacttttcgattctatttatccgcttatttctgcaaagccttcttatctttttttatcttgagcaagccaagaccagtcataccaccaattcctgcgatcatcgtcaaaacttctgctaaagcatcagttgtgtcaccggtttttggcgaagcgcttgtaagcgttgagccagcttttacagttccaaagctattgtttccaaagctcatgttggctatagcagcgttattatttgaaatgccttgatttttcgttgcttgtcctggtttttgtcctttatcgttaaatttaaagaaatctcttgattcaaatttaattgcaagatccaccaattcatcagcttttccgtttgtctgctgattgagataagctaattgttttggagtcagctcgtcaatctgatctactaaatcaaacaactgattaatgtttgctggcgtaatcttagtgtcaaaggcgctgagctgcttgatgattggcttcatcgcttctttctgcgcatctgtaagattctgatctttatctgaatcctttgtatcgtcgcccttttgactcttctgtgctttagcgactgcagcgtcaagtccgaaatactcataagccccttctaatttttccttaacgtagttttgatcatcctttgataggttaagatattcctttgccagccgatcaagatcctctgaattcgcatagagagctctatcatgaaaatccttcaagaaatttttcaccgagtttgatttgttattattctgcgcatctatacctgcttcgtaaataatttcactagcatagctatcgactagtcctgaagagtacccttttacgacaaccttcttattattcgataatttattgtacaacttgataaaatctttcaattcaagtggatatcctgcattgttgagtttctcaataagtggcttgacttcaggatccttcatgaggatatcactataataatagccatcttcattgttgccaagtgaaggatttctaacagttaaagacataatataatcttgagcctgtggagttaattgacaaaaatcactataaaatttatcaagattttctgacttgttaaaatcaagcgtagttagctctttagaaacatctgccgcagatttttttatcacttcaatgcgtttagcagctgcttcactttttttctgtgcagcagcaaaagccttttcatctacaccttctggtttttttactcccgcatatgatgcaagataatctaagtcagcatatgcacctttatcaagatcatcaatcatatcagcagttgagatataatcattaatttcgtcagcgctgattgtcgattcattattggtgttgtcttctgatgatgccgctgtgttttcgctcttctgatcttctgtttgattttctgtctgaacttttgttgcattgtctacacttgctttatctgtcgcagctgaagctttttctgtagtttcggtcttcgcttcactgctggtgtcttcgctctttaccgtatcttgtttggtttctgttttagcttcagctttggtttctgctaacgcctgatccgtcgttttaacatcactggtcgtcgcagttgtttctgtatttgtgttttctgctttttcagttgtaactggcgatgcaaaagcggtcattggcgcaccaatggtgcctactgctgcaacacccgtcaaaatctttaataatttcgaatccataatttctctccttatgataaaaatactttctgatacgagctctttaaagcttcctttagttgtattatagaaccataagttactcaagtcaataatgagttaccatttcatttatgctctgacgcttctacataaaaatagacgcgctgcttcaatctaatttgattaaagaaacacgtcttatgttttacttcttgatcttatttagtacatacgatcacttatctccgcaaagctctcttttcttttctcgtcttaaagatgccgactcccgctgcgccgccgatgccagcaatcagggcgagaatttcgggcaaagcgtccgtcgtatcgccggttttgggcgccgcactcgtcaccgtagccgtcttcgcgttgccgagaaccgctgtcagtttcttcgccaccgtcgaacccttttgcgcggtattatccttaccgttttccttctgatcgctcttctgcgctttcgcgaccgcgtcgtcaaggccgaaatagtcgtaggcccctttcagatgactctggacgtaggcttgatcggccttcgacaggctgaggtattccttcgccagctgatccatactctgagaggtcggattggccgccgcttcggcaaaatcggcgaggaaattcttcagcgcatccgactgcttgctcttgttagcatcgtcgatcgatttttcgatcaatgacttcgcaccggatttgatcttgtccggatccaagttgttgacaatggcctttttctccggcgataattggttgtactgcttgaaaaaagcattccaatccggatcagcatcgctatcgagaatgtcaagcacgggtttgatttgggcgtcgctttcgatcacttcctgaatcaacaggttttgatctggatcggtgtacatccacatatactcttgaagtctcgggctgagctgactgtaggccttcagcgctgcctctgccccttccggtgtggaggtatcgatggtcttcatcttattgcggaaagcgacgcattctggactattaaacatgttgtcaaagtaagcttcgaccgctttcgtcactttatttgcctggttgagtcgatcggtataaccatgatttttaatgaagtcctcgctgatcttcgaaaggtccggagaataaccctcggtgcgatcgtataaatcaaataaattgtactgtgataaattatttaaatcgatctctgttgtcccctgaatataatcgtctagggtcttaacataacccttttcggtttcagagagctggctggacgcattggttttcccttggtcgccagcagtttcgttcttcgcgtcggtgtttgtattgtccgcctgattatcgctggtgctgtctttggttgtcttttcgtctgatgtattcgaatccttattagtggtatcgttcttcgtttcgccgctagttgtttcggattttgtggtatcttgtttagcttcttttttagtatcttctaacgccttgtccgtcgttttgacatcgctggccgtatcggtcgtttcggtgtttgtattttctgcttctgtcgccttaaccggggaggcaaatgcggtaactggcgcaccaactgcgcttgccgcgacaacgcctgttaagatttttaataatttcgatttcataatgtctccttacagaaagtaaccctatattttaatttacaggttattagttagttctattataaagcaataagttacgcaagtcaatctgaagttatccctttgacagcccctatgccgatcagtacaaaaaagacccgctcaaattgagcaggtcggttttgaaaatttaagatgattttcgcttatttcagcaattccaccaagcgtctggccgcttccttcgtgtcatccggatcgccgaacatcgagaaacggaaatagccttcgccgcagtcaccgaagccttcgcctggtgtgccaacgatctgtgcttcgttgagcagcttgtcgaagaacgtccagctgtccatgccgtccgggcaggccatccagatgtacggcgagttcttgccgccgcagtaccacagacctaattcgtcgagggccgccatcacgactttcgcgttgttgcggtagacgtcgatgttttcctgaatctgtttctggccttccggcgtaaagaccgctgctgcacccttctgaatgatgtaggagaccccgttggaacgtgtggtccggttgcgcacccacatcgcgttcaggttcatgccttcccgttcgagctctttgccgatcaccgtgtagccgcagcgcgtcccggtgaagcccgccgtcttcgagaacgagcaaatttcaatggcgcaggtccgcgcacccggaatttcgaaaatgctgtggggcagttccggatcggcgataaagcattcataagccgcgtcgaaaatgatcaccgaattgtgggcgttcgcgtaatcgacccacgctttgagctgttctttgttgaacaccgcaccggtcgggttgttcggtgagcagatgtagatcagatccgcgttgagatcgtccgtcggcatcggcaggaagccgttgtcccgtgaagaaggcaggtggatgatttcgcggccttccatgacgttggcatcaacgtacgccgggtacgccggttccatgacgagggccgaattcttcttgtcgaacaggttcaggatgtggctgagttcgtcgctggcaccgctggacacgaaaatttcgctgacgtccagatcgacgccccgttccttgtagtggccctgaatcgcttctcttaagaaatccgcgccgacttccggcaggtagccgtggaacgtttctttcttggactgatcatcgaccccttcgtgaagcgccttgatgaccacatctgccagtggcagggtgacgtcgccgatgcccattttgtagagcttcgcgtccgggtgatcctttgtgtacgcgctgaccttctggtcgatgttgtagaacagataggacgagacgagctcgtcgtaatggtgatttggaatcataatgttacctctcctttgtaaactgttgtcgccgggccagtcatgatcgccgccccgtcgtctgtgattttgatgtgcaggtcgccgccgtcgagggtgaccgtgacgtcttcattcttcgggcagaagccttcggcaactgcagccgccgtcgacgcgcaggcgccggtgccgcaggccagcgtgacaccgctgccccgttcccaaacgcgcattcttaagtgatgatcgtcaatcacctgaacgaattcggtgttgacaccgcccgggaaagcctggtgtttttcaaccttcggccctaacgtcgtcagcggcgccttttcgccgtcttcgacgaaaatcaccgcgtgggggttgcccactgaaacgggccggcaggtcaccgattcgccgtccacgtccagtgtcttcggatcggacacgtcgacgtggcccatgttgaccgttgcgccgacagccacgccgtctttgacaatcaaatccaatttcttgatgccggacaaggtgtcgatcaaaaggtgggtcttgtcggtgtagccgtgatcgtacacgtatttgccgacgcagcggatcccgttgccgcacattttcgcttcactgccgtccgcgttgaaaatccgcatcttaaaatccgcctgttccgacggcgtaatccagatcatcccgtcagagcccgcgccgaaatggcgttcagacagccggattgacagcgccggcgcgtcgaaatgatccgggtcgtcgtagacgtaaagatagtcgttgccaagaccttccatttttgtaaatgtaaataacatactgtactcctgattattgtttactctttttcttgcgctgggacaacggcgtcgagaatcggtccttccggtaatgcgccgaaacctcagtcgcgtagtgcccgtcgaagcagccggcgcaatagccgagcttcggtgagaggactttcaaatcctcgatcggcaggtagcccagggaatccgcgccgatcagctcgcagatttcatcgacgctgtggtgcgccgcgatcaaattgtcttcgctgtcaatgtccacgccgtaatagcacgggtgcaggaacggcggtgccgaaatgcgcatgtgcacctcggtcgcgccggcgtcccgcatcatcgtcaccagccgtctagacgtcgtcccgcggacgatggagtcgtcgaccagcaccacgcgcttgcccttgacgatcgacgagatcgggttcagcttgatgtggacctgattgtcccgttcccgctgacccggcgagatgaaggtgcgggcgatgtatttattcttgatcatcccgatgctgtaggggatccccgattcctgagcgaagccaatggccgcgttgagcccggaatcaggcacgccgatgaccgcgtccgcgtcaaccggatgcgccttggccagggcccgccccgcgcggacccgcgcttcgtgaatcggaatgccgtcgatgacggaatccgggcgggcgaagtaaatctgttcgaaaatgcagctctggcggggcaccttgccgcagtgttcccggcgggacacgatttcgccgtcggtgttgaacacgagcatttcacccggttccagatcgcggatgaattcggcacccaccgcctgcagcgcgcagctttccgaggccacgatgtacgtgccgtccttcgttttcccgtagcacagcggccggtagccgtaggggtcgcgcaccgccatcagcttcgcggccgacatgacgacgagggaataggcaccctcgatttcgtccatcgcctgactgacggcgtcttcgatggaaccacagtgcagccgcttgccggtgatgatgtaggcaatggtttcggtgtcgctggtggtgtggaaaatcgccccgttcagctccagacgatcccgcagcttgtcggaattggtcaaattgccgttgtgagccagcgcgagcttgcccttttggtggttgacctcaatgggctgacaattcgcccgggtcttttccccggtcgtcgagtaccggacgtgtcccaccgccatcgtgctctccggcagccgatcgagatcctccttggaaaaaacgtcgccgacgagcccgagatccttatgggaatagaacaggccgtcgtcgtcgacgacaatgccgcagctttcctgaccccgatgctgaagggcatacaatccgtaatacgtgagccgcgccaagtccctccgttcacggctgatcgcgccaaacacaccacattcttcgtgaatagacattcttacctcacaatgctttagttaattctgcaaatattctattaaacgatcgttttctctcatcataaccttgtagacagaaaaaagcaatgcgcagggaaaaaacatccaaaaacgccattgcttttgccggctttatcttacttcacgaccttcctttttgtcaatccttttttaagggacgggcccgcgcacggttaaataatgctttcatttgtaggaattcacttttttatttttattttatttattttattgtaaaatatttctattatctaaaaataatgaaaggaaatcacatttatgatctacgatcgatattcagctgaagaagtccgtcaatttgtcgaagaagatgacgtcaaattcatccgcctcgcctacaccgacatcttcggccgccaaaagaatatctcgctgatgccctcccagctcgagcacgccttcaaggacggcatcgcgatcgacgcttccgccatcgaaggctttgaccgggacgtccactcggatctcttccttgtccccgacccgtctacgctgatgctctttccctggcgccccgaacacggccgcgtcgtgcggatgttctgccagattcggaaccccgacggaacggttttcgaacacgatacccgcagcctgctgattaaggccgtcgaagacgcccgggccgccgggctggaattttacttcggcaccgaaaaagaattctacctgttccgtctcgacgaaaacggcgatccgactcacaccccgatcgaccaggccacctacatggatatcgctccgctggaccgcggcgtcaacatccgccgagaaatctgcctgaccctcgaagaaatgggcatcagcccgaccggctctcaccacgaaggcggccctggccagaacgaagtcgactttaattttgcggacgccctgaccgccgcggacaatgccatcgctttcaccaccgccgtccaggccgtcgccgtacagaacggcctctacgccgattttgggccgaagccactgagtaacgaagacggctcgagccagcacatcaacatctcggtgcgcgccgctgacggacgggactgcctcgaaagcatgaccgctggcattctcgatcacatcctcgatatgaccgcctttctgaatccgaccgaagcctcttatcacagactgggccaccggaaagcgccgaaatacatttcctgggattatcagaaccgctctcagctgatccgcgtcccggccacgaccaacgaacgctaccgccgcgtcgagctgcgctcgccggacaacggcgccaacccttacctggcgctgaccctgttaatctacgctggcatcgacggcgtcgtccgcggtctgaagctgcctgacccggtcaacgcgaacctgttcaccgctgaacccgaaattctcgatcagctgcagaccctgccggcctcccgctcagaagcgactggcatcgcccgccattcatcattcattcaagctcacctgccctcttcattaatcaccaaattctgtcatcgttaggaggcggtctatgcgcatcacgcaagcatctctgaacaatcaacgcgtctaccgcgtgctgctgatttcctcagcggagcgctttaacactgcccttcaggccctgctgcccgaacggcgctacagcccggtaaccatcgtcactaacgccgcagccgggcgccgagcgctcaacgaccagccctacgatttcgtcatgatcaatacgccccttcccgacgaattcggctcagagctggccatccacctctcgcagaaccgcgccgtcgtgccgctgctctttgtgggccgcgaccatatggacgacattcacaaccaagtggcggaatacggcgtcctcacgctgcccaagccggccaccggcgaaaacgtgcgcctcgggctcagatggatggccgcctaccgggagcggctccgccgactggagaaaaaatccgtttccctcgaagataaaatgaaggaaatccggctggtcaacaaggcgaaatggctgctcatcgatcaaaaaaacatgaacgaaatggacgcccaccattttatcgaaaagcaggccatgaaccacagcgtctccaagggcactatcgccgaggccattttgaaaaatctatcggtctaaaacgcgatttattttaattacgtgccattataaaatcatattaaaaactttccgcatcaaaaaaagaggtccaacgcaaggttagacctcctttttttgtttacgtttccggctcgacctctacgtcctcgtccaaatggggactcagcggcatctgccactgatggtggtcggtatggaggtagcgctccgctttttctgaaaggggctcgcccaaaaagtcgcggtacagccgttgaatctccggattttcgtgggagaaacggatgttggccatccggtctaaattgtggaggcgccgtccgcgcagcgccgccagttcttcgccgtcgtgaatcggctgaccgccgccgcccacacagccgcccggacaggccatcacctcgacaaaatcgtaatggacctcgccccgcctgagggcccgaatcaacttccgggtattggccaacccgctgaccactgcggtgcgcaccggaatgccggcgaaatcgtaggctgcttcgctccaggggtgtgtcccggtgttgagcacagtcttgaaagcgtccgggttcgggttttcccccgccgccagataatagcctgtgcgcagcgccgcttccatgaccccgccggtggtcccgaagatgacgcccgcgccggtgctgacgcccaaaggcgaatcgaagggctcttccggcaggttgtcgacatccagattctgggcacggatcatcgcgatcatttcccgggttgtcagcgagacgtccaaatccttgccagcgccggcgtcgttgaggctcgggatctcgatttccgcttttttcgccaaacaaggcataatcgaaatggaaaagatcttgtcagccggcacccctattttttctgcgaaataggttttggtcattgtcgcctgcatgccctgaggggatttggaggtcgacaactcgtcgaccatgtccggatattgggatttcataaaccgcacccaccccgggcagcaggacgtgaacatcgggtagcggtgctttttcccgtcggtcatccgcttcaaaaactcggaggcttcttccatgacggtcaggtctgcgccgaagttggtgtcgaagacgaagttaaagccgcagcggcgcagcgcagccgcgagccggcccggtgtggcccgttctcgcgaaaggttcagcccttctccccaggcggcccgcacggccggcgccacctgcacgacggtgacggtttcgggattgttgatggccttttcccaagggtagacccgtttgcggtcttgtctgccgtgaagggcaccggtcgggcagtgggtcacgcattggccgcagacggtgcagtcggcgttttcaatgtggcgcccgccggatacgctgacggtcgtgcgcccgccggaacgcaccagatcccagacgccgaggctctgcaccttatcgcagatctgcacgcatcgcagacatttgatacatttggattcctcccggatcagcggaaacttctgaggccacctgttttccggcacttcctttttgtacaggctttcctcaatgcccaaatcgaagcaggcccgctgcagcgcgcagtttccatttctcgagcaggtagtgcagtggctgtcgtgctgggacaggatcagctgcaggttgatccgtctggcctcctgcacccggggcgaattcgtgtagataaccatcccggggtacaccttgttgttgcaagctgtgatcagccgctcttccccttcgacctcgacgacgcagacccggcaggcgccgatttcgttgatgtcctttaaaaagcacaggtggggcagcggccagccggttctttcgcaggcttccatgatggtgatgtccgaagggatatgatagacgaagccgttgattgtcacgcgcattaccattgtttattcctccctcctcgcagggtgctgatgccgaagtgatcgcagcgcaggcaccgcgccgattcctgatcggcttcctgacacgtcatgcccgtttccaccggatcgaagtccaggcgccggctgttggcgttcctaaaccgcaggttgacgcggccgcaggccggatggtcgatcagcgccggttcggggatatccatatcgacggagatgacgtgattaaagcccaggtaattgtcgatattcgccgcggcgaccttgccggcgccgaccgccttgatcacggtcgccggcccggtgacgcagtccccgccggcgaaaaccccgggaacggctttgaccttgccactgccgccggtcacaacacggccgcgatggacggggatgccgtgatgttcgaggtgctctgaatcgatctgctgaccgatggcgacaatgaccatgtcgcagggaatggccacgtcggcgccgtccgccgcttccggcctggggcggccgccgctgtcaattttcccgatgatcttcggttcggtgagaaaggccgtgacctggccgtctttgtctctgagaacggccttcggtgcgtgcagctcgaggatctggatcccttcagcttcggcgccttcgatttcctcggacaaggcggtcatgtctgccttgcgcctgcggtacacaacgctgacctctgacgcgccaaggcggatggccgtccggctgacgtccatcgcgacgttgccgccgcccacgacgaccaccttgcggccggttaaatcgtggggatgcccttcgccgatgtcccgaagcagcttgaccgccgagacgacccccgggccgtcctcgccgtcgataccgattttccgatcttcgtgggcgccgatcgcgatgtacaccgcgtcgtaatcacgctgaagggtctcaatgctcacgtcccctccgccgtcgccgatgccggtggagagcttcacgtcgatgccagtggacaggatcatctcaagatccttctccagcgcttcttcagacagccggaatcggggaatcccgaaacggagcatcccgcccagtttgctgcgcttttcgtagacggtcacgctgtggcccatgagccttaggaagtaagccgcggtcattccgctggggccgccgccgacaatggccacccgcttgccggtgtcgggctgaaccgccggcgccggcacgacgccggcctgttcgtcggcgaagcgcttgaggccgcggatgttgatggattggtcgatcatgttgcggcggcaccgcgcttcacacgggtgttcgcagacaatgccgcaggtcgaacagaacgggttgtccttgcgcaccaggcgcacggcgtccgcgtagcggcccgcgtgcaccagcgcgatgtagcccggaatgtcgacgcccgccgggcagagggccacgcagggcactggctgatccagctgttcgatacagcggtcccatttgacatggccttcgaaatcgtcccggaagctgtcgagacagcgaaggatcatgtgggccgcctcgtagccgatcgcgcagtcggcggtttcgtaaaccacgcgggccgtctgttccaagacttcgacgctttccatgctccccttaccgtcgaggatgtcgtccatgatgtgcaccatctgcccgatgccgatccggcagggcacgcacttgccgcaggtttgagcgtggcacatcctcaaaaaggccgccgaaatatccaccgggcagagccccggcgggctggcgacaatccgctgctctaaattgctgtacaagtgctcgacaacctgctgggcgcggctctgagtcggtgttctgagtcttgacatttttgtttcctctccttcttttatatatttttgtttctcgttttctttcgatgtgaaaaaaagagtccgcaagactttcttacggactccattattcgcgattggagcgggtaaagagaatcgaactctcgcgactggcttgggaagccagggctctaccactgagctatacccgctttcggattaacaacgttattttagcaaaaagcccggcgtttgtaaaggcttatttttcgtacgtttggttgaaacacgctgtcacgcgttctgcgcgtcgacccaatcgacgatttcgtctgcgcggtccacgatgaccgacgcgccctgcgcctttaaaaattcgacggaacggaacccccagctcacggcgatgcagggcagttctgaattgcgcgccgtcgccaaatcgacctcagagtcgccaacgtaaaccgcgtttgccttcgagaccttcaaatctttcatggccttcaccgtcatgtccggagcgggctttctgcgcacgccggtctgttccccgacggctaaatcgaagcagcccgggaagatttccttagccagggtctgcaccgcgaaatccggcttgttggacacgactgcggtcaaaatgccccgatctctcaacgcggcgatgcattcggggatgccggcgtaggggccggtgtggtcgttgcagtgttcagcgtagtgaggcgcaaacaccttgcggatgcgttcgacttcggggtcgtcctccggcacgtcggggcggccttcttccgccaaagcccggctgatcgcgacgcggacgccgctgccgaagaaatgctttacctccgctgcgacgaaatcgtggcggtggcccgtctgtgccagtgcgtaattcaaggaaccggtcaaatcgtccagcgtgtttaaaattgtgccgtccatgtcaaaaatcacggcttgtattttgttctgcatgtgctctccttttgatctagaatttgtataataaataattaataaataaatgcttgcgtgaatcgagcggctctattatactacttttttcggttgttgaacaattctttacaggatgattgggcgccgatgtgataaactgtttttaataatggaggcattttatgcgtaaaatggttatgatgggccgttcggaatgtggcaagaccacattgaagcaggcccttaaaggaaaaaagttacaatacgaaaagacccaggcggtcaattatttcgacattatcatcgacacccccggcgaatacgctcagtgcaccgatttggcccgtgccctggcgctgtacgcctacgaagcggactacgtcgccctgctgatggcggccgacgagccctactccttgtacccgccgagctgcgcgggcgtcagctcccgtccggtcatcgggatcatcacccagatcgacaagccgaacgcggacatcgaccgtgcccaatattggctgcgcctcgccggcgccaatccgattttcccggtctcgtcctaccagggcaccggcctttgggatctgctcaccttcttaaaggacccggacgatcatttcccattcacgaaggaagagctggaaacgccgcgtgaagtcctgacgaccaaatacgaagcggtggaaatcggcacccagatcgaagatatgggccacaccgacttcctcgacatcaacgacaatttgatcgtttcggccaacaaggcgggctccttgaagaacaacgtcaacaacatgcacaatcaggcgcggtaaatttttcggcacgcaaaaagacagatgagcttttccgctcacctgtcttatttttgtgcgcattattcgtttgtcacaagggtgccagccaaatggtcgatgaactgctgggctgttctgccggagaagccgccgtgctgcatttcccagacccgcgcctggtttaacagctcgtcgcggtccaaggtaatgcctgggcagcgcttcgccaattcctcgacgatggtctgatattccttctgagacggtctgaaatagccgatgcgcacgccgaagcgattggccagcgacagtttttcctgcaccgtgtcgttgcggtgaatgtcctcgctgtcctgatcggcccggtcggaccaggtttcgcggatcagatgtctgcggttggaggtcgcgtaaatcagcacgttgtctggacgcggctccagtcccccttcaataacggcttttaaatatttgtattccgtttcgaattcttcgaaggacaaatcgtccatgtagatgataaagcggtaattgcggtttttcacggccgcgatgatctgggacagcttcttgaactggtgcttgtaaatttcgatcatccgcaggcctgcgtcgtaatactggttcaaaatggccttgatgctcgtggatttgccggtgccggcgtcgccgtagagcagcacgttgttggccgggcgcccagcgacaaaggcttcggtgttttcgaccagctcctgcttctggatttcgtagccgaccaaatcgtccagcaccacatcgctcgtgttggtgatcgggatcagcagctcgccttcatcgtcgtcgttgacgcggaaggccttgttgagcccgagtttgccgacgccgtaagcacagtaaaattcggcgaccacctgggtgatgccatcaacttggtctgccgcttcgatttgatgagaaagtgcctgcaccttttcgctgacgctctggttgtagagccgttcctgcttgaccaccgcctgataatgggtgatcgtcgtgaagcaggtcaaattcaaatcggcttcgattttcgagaaatcaaaatcgaacagctgcttgaaaatggcgaagtcattctgagcgaactggttgaccgagccgtcgagcacgccgaccttttcggacacgagggtgaagggcgtttccgtcgtcgccagcagatacgcgaggtagttgtgccacaggttgtcgttaaagccgtacttcgtcgccaaatcgaggaggcggtgaatctgcgtcaagatgtcagccgtcagctcctcgggcgacgattcgtcgtgttcccagcggcggaaaatgtcggacagctgcatcaaaatgctgtcctgatcgatgttgcggtaaataatgagttgggatgttaatcggtacatatatatctccaaagataatcgtaaattttgacccattatatcacacaaatgggcacgaaaaaaagacctgagacgtctcagatcttttgctgctgtttttgatttgttatttaaccttcatgcgcttgaatttcaagccgacgaagaagtcgatcgcgccttgaatttcggccgcgtctggatggcctttgcccgtgccgccgaagagcttgaaggggccaaaggtgttgtgccccttgcagccgtattccccggtgtaaatgcatcgagattcctcgacgatgctcttgatttcgttggtgtagcccgcgcgcggcatgccgtaggtgtagagcacgaagacgcgctggccttcacacaaatgggttttgacgtagttgaccagcggctttccgaaatgcccggcgtaaataccggacgcaatgccgacgaccgcatactgcgacaaatcctcaggcttttccttcgtgatgtcgaagacatcgatgtcgtcctgtcccatcgcgatcgcatccacgagcttgcgcgtgttaccgtgatgcgtcgaataaactaagattgctatatttttcatcgtgaacctttcattctgtatttcaatgtacaagatagtatagcacaaaataaaagggtgaacaaaatcggtaagttgttaaatcaaatgtgccaatcctgcgaaggcgctcaaaacgcagccagtcgcaatcaattgaaaataagcttcttttgtctttttccgaatcatacgtttcattgtgagcctccttttttgttttaaatgtctaactctagattagcacgttttgtttgttctgtcaaacaaaaaggcggtctgcccaacggcagatcgcctttaatataaagatttgctatcaaattttatcgataagaattgccgccgcagttccaaacgccgtaggagctgccggaacggaaggactgatacggatgattacgcttgccattctgcatacagtcaatgacggcctgtttgacgtaacccggatacttcccaccgagatagcgcttgtacggcccgtcgagataagcggcaaactgacccggcgccttcagcactgacacggcgtcgtggccgccccatttgccggaatcgacccggttcatcacgcaggagatcacagccagcgcaccgtcgtagctcgcgttgcattctgccgcgacgaccgcgcagatgaagtccagctgatccccaggatctgccgtgctgccattggtggtggacgccgccgtcgacgacgaggtttgggccgcgtactgctgcagctgcttctgttcttcttcgagctttttgttgtacgtcgcctgctgtgcctgaacctgttccttctgctgcttcagctctttctgctggttctgcaggttctgctgagtctgttcgacctgggtctgcaggttttcgacgtcttccactgtcttctggtcggcgctgttgatcgtgcgcacgctttcgattcgagacagggtttccgtcaggctgttcgacgtgaacagcgcgctcataatgccgtcgttgccaaacatgtacataacccgcgcccgctggcccatgtttttcttcgcagtcgccagatcggccttggtctgttcgagcttctgcgtgttgtcggcaatctgctgattgatttgattgatctggctgttgagcttgttcatctgatcgcccgcctccgtcaattgtttattgagtgcgttgatcgacgccgtcagctcggacgcgctggccgcgtgaacggccgccgccggcgcgaggctcgcaaagcccaaagtcagcatcagcgcaaaagctgcaatccgtgccgtcatccttctcatttttcgggataaaataatgattcacctcgttattcttcaaaatttctacacttcacgtatttgtaataagtataacaggttacgcggtgcatctcaaatttatctaaaaaacaccttaacgccggacgatgagccggccttaaggtgttgatccgtacacgtttatcgataagagttgccgccgcagttccagacgccgtaggagctgccggagcggaaggactgataggggtggctgcgcacgccgccgaccatgcaatcgatgacggccttcttgacgtaatccgggtacttgccgccgaggtagcgcttgtacggcccgtcgaggtaagcggcgaattggcccggcgcggtcagcaccgacacggcgtcggacccgccccatttgccggaatccacgcgattcatcacgcaggagatgaccgcgagagagccctcatagctggaattgcattccgccgcgacgaccgcgcagatgaaatccagctggtcccctggattttcagttttgttgttggccgcgtattcctgcagcttcttctgttcttcttcgagctttttattcagctcgttctgctgagccgtcagttcccgctgtttcttctgaaccgctttctgatcggccttcgcgcgcgctgcggtctcgatgtagcccgtcagcatatccgtgtcggcgcggaccacgctgcgcatgttgtccaaattggaaaaggtctcgccgatgttgtcgcttccgaacagaaactgcatgtagccgtcgttgcccatcatgtacatcgcgcgcatccgttggcccatggcttgttttttggctttcagctgcgacttcgcctggaggtagtcagcggtcttgtcggccagctcctgattggtggcgttcagctgcgtcccgagggcgccgatttcgtcgttgagtttggtaatggattcggtcagcgcgaccaaatccacatcggcgtggacaggcaccgccgaaatggcaaacaccaggacggcggccatcaggcaggcgccccagcggaaaatattgtggtgtttcaaaatgttctcctgaaattatttcggtataaatggtaaaaaatctcgggatcacctcgagatttgtgtaagttgttcttattaaaatgttggttttattttatcatgaatccccgatcttggcaaatttgaaggctgcggctcaattttttcattttccccatcattttttcagcacagctttcattttatgataagatagcactaaatctttaatcacaatccaattggaggcattcatcatgaccaaaccccttaccattgaagctttcgaagaagcgagcgaacgcgtcaaggacgtcaccctgcccacagagctcgtttattctgattattacagccaggcgaatcacgccaaggtttacttaaagcctgaaaacatgcagcgcaccggcgcttacaaggtgcgcggcgcttattacaaggtctcgaccatggcaccgaaggaccgcgaaaagggcctgatcaccgcgtccgccggcaaccatgcccagggcgtcgcttacgcggcgaagaagtacggcgtcaaggccgtcatcgtgatgccgacgacgaccccgctgatcaaggtcaaccgcacgaaagccctcggcgctgaagtcgtgcttcacggcgacgtctacgacgaagcctgcgatcacgcgctcaagctcgccgacgaaaagggctacacttttatccacccctttgacgatccgacggtcgccaccggacagggcaccatcgcgatggaaatcatcaaggatctccctctcgtcgacctgatcctcgtacctgtgggcggcggcggactggccactggcgtctcgacgctgacgaagctgttgaacccgaaggtcaaggtcatcggcgtcgaaccggaaggggctgcctgcctgaccgcgtcctttaaaaatcacaaggtcaccacagtcgaacacatcaacaccatcgccgacgggaccgcagttcagacaccgggcaaggtcattttcccatatctggaaaaatacctcgacgacgtcatcaccgtccctgacgcggaactcgtcgaagccttcctcgatatggttgaaaatcacaaaatggtcgtcgaaaactcagggctgttgtccgtcgctgctctcagccatctggacctcaagggcaagcgggtcgcctgcgtgctctcgggcggcaacatggacgtcatcaccatgtcgtcggttgtccgtcagggcttaatcctgcgcgaccgcatcttcactgtctccgtcttgcttccggaccgtccgggcgaactgacccgcgtctcctccgtcatcgccgaaaccggcggcaacgtcgtccgcctcgaacacaaccagttcgtgtcgatcaaccgtcaggccgccgtcgagctcaagatcacgatggaagcctttggcaccgaccacaagcacgaaatcttaaataagctgacccagaccggattcaatccgaaagttgtcccaaccctcttgtcttaaaagtctaatccccgctgcgtgaccgcagcggggattttttcgacttccatcttttcgcttatatttattatttcagcgcataaaaaatccgactgagcgcaacaccccgtcggatttgaatcattttaatcttctttctaatatttgggaacgccgtacccaaagatcgagctggctcttgcattaatgtagcggctcttcacttgatctttgtaatttccttctacagtggtgatcctgccattctgataattgacaaccaaaccgacgtgatcgactaagccatcatattgccaatcgtaataaactaaatcacctgctcttggcacgtattgatccttccactgccaggcattgtgattttgataccactgcacaccagtaggtgtgtaagcgtgataataataaacgctggaaggcacacctgcctgagcgccgcaccaggatacaaacatcgcacaccacggcccgtgttcaaaggatttattattgactaatccagcgtaccagactccgtatttcgtataattgttggccccttcgtgcgtgccgagttgactttcagcgatatccacaacgagcttacgttctgtccatttgaacttgcccgcatcgaccttttcaattttgaaaagctgagcatccgtcccgttggccgtgtacaaatcgaggttggtattttcctctgaagaatttccgtaaacatcgagaacccgcgtcgatgaattttcaggcatcagcgtgtacgtcccatccccttgttttttaattacaaatttttgtgcagccgaacggttttttgtataaatctggacattggtgccatctgcgtcggcgccaccggcaatatccagcgcacaatctggattagacaaagggcttaaggtgtaagagtggtcgatattgcgtacaaaggtccaagcacgcgtctgcgtgtaatttggcacccatattgcagcattgccattcgaaaccgccacgacttttccattaacgtttttaatcatagcggtaaagctgtcaccaagattatcactatctgtcaccgtgcgatctttaaatgcagtacgccaagactgtgcagccgttccgttttgattgtaaacttgaacattagcgccgctggcgctgctgcctcctgcgacgtcgagcatcaatcccgacccgcggtttttaaaactgaactcatcgccattttgggtaataatccacttttgagcatcagtgtcattaggcgcatataaccaaacgttggccccactttgtgtactgccgccacaaacatcaatagcctttttatttatactgttaataatcgaataactgccatcgtcattttgcttgatattaaatttctgagcgccagtttcgttgaattgatagctttgaatattagcgccattctgactgctgccgcccgaaacatccatcaccgtattgtcggtataagatgggcagagcatcacttcggatgctctgaaatttggaatttgtccttttgaggttaaaatccatttctgcgcttttgtcccgttatttttgtaaatctgaacgtttgtgccattttgactgctgccgcccgcaacatccagagcactggctttcgcaacagccggtaccaaggttaccgttccgtcatcattatttgtaattcgccaacgttgtgctaccgtgcagttaggatcgtactgccacacatttgtactatccttcgcatttcctcccgctacgtccaatactcgacaagcgaccgccgtgtaaattgaataagtgccatcgctgtttttgacaaaacggaagcgctgtgcctcggtattatttgcagaataaatctgcaggttggcaccactcgcaacactgcctgccgaaatatcaagcactttatgattgtccacagcagattgaatttcgtaatattgtgtcgtatcaacatccgtgtctttattttgctgatcggatgtaccttggttctgctgcgcatcttgtacagcagtattctgattttctgtcgaatttgtctgcgtctgagacgtttcgttctgcattgctgtactgccgctattctctgctggtgccgcgcacacacagggggttaacgcgagcaaagcagccaacacacaagatgtcacccagtgctttttcttctcattttgcttttttgagataatcttgatcattccttccttaaattttcttaagtttgaacgggattattatagcatggcttattgatataataaagtaactttttttgaaccatttgaaaatgaattggctattacttgtgtttttaattaccatctaatcgataagtgtcatgatctcgtaatgatttatgcttcaatccaatccaataagattttaaaatcgtttcacgtatacctaatgttttcaagcatgaaaaaagtccgaaacatttcgcttcggactgtatttgcaatggtgatccctactgggcttgaaccagcgacctctaccgtgtgaaggtagcgctcttccagctgagctaagggatcaacttaaacaagcataacgattttagctgaaattgtcaagccaattttatattttattgaaaatgccgcttacgatttagcggccgcatctccctttttctcggcgtcgccgctgaacggcacagcgatattttgaattccgagcatcagcacgttgccgatcacctcgaccatttcctctggggtcttgtccgggtcctccgacagccacttgcgcagcatccccatacaccctgatactacaaaggcgtagccgtaatcgaaaatcttttccgtcgtgttgttgtcagcaacccgcgggtcaaaacggatcaaatcgttgatgcagcgcagccgcagcatttcctgaatgctctgcacaaatttcgggtcgccgttggggccaagcagcgccagcgtcaggtcggcgttctggcggagcagcgtgaaaatatccaccagccgtattttaatgtcctctgccgttttcggggcctcacgcgcgtcgatggtctggcggaattcgtcgtaaagctcctcttccagatgatcgcgcatgtcgtaaagatcgcggtaatactgataaaaggtgccgcggttgatgtggatgcgctccgaaagctccttgacgcggatttcccggagcggtttttcgttcaaaagctcggtaaacgcctggcgcatcgccgccttggtcttgaccacgcggcgatccagcttgtcttgatttttgttgattcttctgtttttgccgtaatgcgaacccatttcatctgctccattaatataatataaagataatgtacattttcttaatatttgtttattgattttttcgacaataacagtataataggattgtaaaaattagtcaacacttgtatggttatctttcaaatgttgacccgcacttattccattttcattaattcgacaatagaaaggaaagcattcatggaagcatttggcaaaaaagtggtccaattccgcttcgtgatcctggctgttgcccttttgcttttgattccctcgatcatcggatacaacaacatgcgtatcaactacgacgtgctgacttatctgcccgattcgatcgatacgatcaaaggtcaaaacatcctcaaggatgaattcggcaccggcggcttttccctcgtcattttcgagggcatgagcgaccaggacatcgcgaagaccgaagcgaaatttaagcagatcgaccacgtcaaatctgtaatctggtacgacgatgtcgcggatttgaccattccgaaggaaatgatcccgaacgacatctacaaagcctttaacagcggcgacgcgacgctgatggccgtctttttcgacacctcaacctcgtcggacgaaacgatgaacgccatcacgcagatgcgcaaggtcgccaaaaagcagtgctacgtctccggcatgtccgccatggtcaccgatttgaaaaatctgaccgaacaggaagaaccgatttacgtcgggctggccgtgctgctgtcctgcatcgcaatgatgatctttatggactcctacgtcgtgccgctgatcttcctcgcgaacatcggcatcgccatcatctggaacctcggcagcaacttcttcttcggcgagatctcgtttattacccaagctctcgccgccgtgctgcagctcgccgtcacaatggactattcgatcttcctctggcacagcttcgaggagcagatctccctcaaccccaatgacccgaaagccgcgatggccagggccattgccgcgacgatcacgtcggtgaccggctcgtccatcacgacggttgccgggttcatcgcgatgtgcttcatgaccttccgcctcggcctcgacctgggcatcgtcatggccaagggcgtcatcctcggcgtcatctcctgtgtcacggtgctgccggcgctgattttgatcttccggaagctcatcgaaaagacgcgccaccgcaacgtcctgcccgatatgcacagcctggctcacaaaatcatcgaccaccgcgcggtgttcatcattatcttcatcgtggtctggttcccggccagctacggctacaaccacattcagacctattacgatatgggctcaaggctgccgaagaccctggattattccatcgcccgtgacaagatggacaaggacttcaagaccggcgcgacccatatgatcctcgcaaaaaaggatctctcgacccgggacgcgcacgacatgattgacggcattaaagacgtcaagggcgtgaaaaacgtcatcgcgatggattccttcgtcggcgcgatggtgccgaaacagatgattccggacagcatcaagagccagcttgaaagcggtaaataccagctgatgatcatcaactcccagtatcaaaccgggacgccgaaggtcaacaaacagatcacccagattaacaaggtcatgaagcggtacgacaagaccgcgatgctcatcggcgaagcgccgtgtaccaaggatttgatcaccatcgccaaccacgacttcaacgtggtcaacgccgtgtctatcgcgatgatcttcgtcatcatcgccctggtgctgcagtcgatcacactgccgatcatcctcgtcgcggtcatcgaattcgcgatcttcatcaatttagggattccgttctacactcacacgacgctggtcttcatcgcctcgatctgtatctcgacgattcagctgggcgccaccgtcgactacgcgatcctgatgacgacgcgttacaaaaccgagcgctatggcggcaagaacaagcacgacgccatcgaaacggcgctggccttcgccatcccgtcggtcatcgtctcggcggccagcttcttcgcggccaccttcggcgtcgccgtgtactcgaacatcgatatcatctcctcgctgtgtaccctcctggcccgcggcgcgatcatttcgatgctttcggttatcttcatcctgccttcgcttttgatgattttcgacggcgtcatcattaaaacgtccagaggcttcatcaacaaggaaaaggtcggcctcgggatgcgcaaagcagacgacggccacgaaactcaggtgttctccgaaatcgaaaccctgccgtcgcaccccttcgatcaggacgtcaccaacccaaccccaacggatccagagccagacgattcgtccggcggtccccacgaccccgacgacgacacgcggatttttatccccggctcatctaaataattaaacagaaaggactacaatcatgcacacgatcaaaacgatgatgaaacagcacaaggttgtactcgtcgccatcgtcctggctgctgccatcgctctgactgccttcgcctccgcccagaccgcgcgggcgaagtcgtcgagcgcgtctaccgcctcgaacaagacgctgacagccaaggctgaactggcttcaggcgccaaggcgcagacctctaaaaagggcgacgccatcagcaaggccgaaacggtttacgtgaaagccgatgcgacgggcacccgcaccgccacctacgtctccgactggctgcagaacgccggcaacgacaccgcgttaactgacgtgtccaatctttcgaatattcaaaacgtcaagggacacgaaaaatacacgaagaacggcaataccctgacctggaaaaccaaaggcaaggacatttattaccgcggcgaaaccgacgcggctctgcctgtgaacgtgcaggtcagctacgaattgaacggcgaaagcgttacgccgaaggaattggccggtaagagcggcgatgtcaagatcaccttcacttacaacaacgaaagcgaaaccgacggcatcactaccccatttacctgcgcgaccgcgctcgacctgccgacgtcccgctttacggatatcaaagtaaccaacggcgcagtcctcagcgacggcaacaacaatatcgtcgtcgggatcggcttccctggcctgaaacaggatctcgggctggaaaacgtcgaccaggtgaagattccggaatccttcacggttgaagcgacggtgaagaacttcaagatgggcaacaccctgacctcgatctcgacggatgtgctcaaccgcgccgggctcaaggatatcaagagcttcaaggatttggacaacgcgattaatcagctcgaaaacgccagcggcaagctcgtcgccggctccctcgccgcacgaaatggctccgccgcgctccagaccggcgcagcgtccctcaacaccggcatcggcagtctgcagagcgggctgaaccaatacaccgccggtgtggctactgcggcaaacggcggcaccacactcgccaacaacacgcttttgctccacaacgggatcaacgatctctacaagcaagtgccagaattgactgacggcatttctcaggcttatcaagggagccaacaattggctgaacatttcggtgacccaaatgatagtaacaaatatggagacattctgaaaggttctagttctttggctagcggcgccgctcaactcaacgccggcatcaacggcgtcaacggcagcacgaccaacgtcggtcttgtcaagacgatcaagggcatgaatcagcagcttcaggctgtcgacgcgtcgaaggtcaacaccgtgctgaccaattatcaggccaatcttaaacaagaaggcgaatcggctaaaaatttagccgccgtcgcacaaagtcttgcagcaaagggcgatgcagaaaacgctcagaaagttggcactgaagccaagaccctcggtgccaaagctcagactgacgccgccgctctgcaggacgcacagtcttcgctaaaggtgctgcagaacctcggcacgatgcagacacagctcgctgaagcctgcaaagatggcggcaccctcgatcagctggccgctggctcttctcagttagccactggctccgccagcctgaacgaagcgctcacaaaggtcgctcagggcacaaaggatctcaacgacggcttaaaacagctcaatgacagcaccggctcgttaacagacggcgtcgatcagctcaacagcggcagcaaaaagctcgctgacggctccaaggaactcagcgacgggctcaacacgcttaaggctaataacaacacgttgaattccggtgcggctcagctcgcaggcggttccagccagctttacgccggcacggtctcgctgacaagcggcctcaataccctgtattacggtatgaatcaattcaagaccgtcggcatcgacaagatcgccagcgtctacaacaacaacttcaaggatctggccaacaagctcaacaccatcaagaaagcctcagccgattacagcaacttctccggcatcgcatccggcatgggcggctcggtcaacttcgtcattgaaacagacagcatctctaaataatcgagattttctcctttctacacacagcctggcactcacgccgggctgtgtttttttgtaaaatcaagcaatgaatgttcttttattgtctaaaatttatatttcttttgctttgtaattgttttataataaaaacagtttaataaatgacaatttcaggtgcccttgacgatacgccaagggagaatagggaatcaggtgcaaatcctgaacgaacccatcactgtaagccgcgaacaccgcaacaagtcactgtcgccaacatatcgacgatgggaaggcgcggaacccgctttcgagcgcgcggcaagtcaggagacctgcccgaaatacacccgctgatggatgacggtaaagtccgcggccgatttattcctgtatttcggctgtggatttttttattgccaaaaagccgaacgtaatgaagatcagcatttttgagagaaaaggagaattatgatgaccatactcgaagcggctcgcgccggccagatcacagacgcgatgcgcatctgtgcagaacgagaagatgtcgacgcggaattcatccgtcaaggcatcgttgacggcagcatcgtcgtcctcgacagttcacgagacaatatccgtcccgtcgccgtcggtaaaggcttaaaaacgaaagtttctgcctctgtcggcatgtacgaagaaaaagacaccatcgacggtgaaatggaaaagattcaggccgctgtcaaggccggcaccgacaccattatggatttgtccgtccgcggccccatcgaagagatgcgcgaaaaggtgctgtccaccgtcgaccgcccagtcggcaccctgcccatgtacgaaaccttggccaaggccgccgctgaacacggcacggcaatggacatgaccgaagacgacatcttcgatatgattgaacatcaggccgcccagggcgtgtccttcctcgccatgcacccggccaccacgctggaagtcgtccgccacgccaaggaagaacaccgcatcgatccgctcgtctcctacggcggcagccatttaatcggctggatgctctaccacaaaaaggaaaacccgatgtacacccaatttgatcgtgtcatcgacatctgccacaaatacgacaccgtcttgagcttcgccgacggcatgcgcccaggctgcgtcgacgattccctcgacgccccgcaggtcgaagagctggtcttaatcggcaccctcgcccgccgcgccagagaagccggcgtccaggtcatggtcaagggaccgggccacgtcgccctcgacgaaattcaaacgactgttcaattagaaaagaagctctgccacggcgccccttacttcattttcgggatgctcccgaccgacaccggcgccggcatggaccacatcacctcagccatcggcggcgcaatcgccgcgtactatggcgcggacttcctctgctacgtcaccccggctgaacacatcggcatgccgtctaaagacgacgtgtaccagggcgtcatcgcctcccgcattgccggccacgccgccgacgtcgccaaaggcctgccttccgccattcaatgggataaggaaatgtccgaagcccgggtcaaaatgaacttcccagctcagtttaagctggccatcgatccggaaaccgccgaaagaatgtggcgggaacgctcagacgatttctccagcgaatgtaccatgtgcggcaaattctgcgccgcccgcatcgtcgaaaaggtattgaacggccaggaagcgccgactagaacagaagaggtgatcaaataatgactacgcaaatgctcgaagcccgcaagggtcatattacagaagaaatggaaattgtggcgaaaaaggaaggggtcagcccggaatacatccgcgatcaagtcgcggtcagccacatcgtcatcccgaagaacatccaccgcgaccgcaccaatatctgcggcatcggcgccggtctggacgtcaaggtcaactccctgatggggacctcttctgaccgcaacgacaaggagatggaaaagcgcaaactccgcctgatcgaagaagccggcgcggacgctttcatggatctgtccaccggcgacgacatcgacggcatgcgcgctcagtccatcgcccactccaacatcgcggccggctgcgtgccgatttaccaggctgccgctgaatccatcgaaaagcacggctctatcgtcggcatgaccgcgaaagaaatgctcgacaccatcgaaaagcagtgccaggacggcatggacttcatggctattcactcggcctacaacttctgggtcctcgacaccttaaaacagagcggccgcctcaccaacgtcgtctcccgcggcggctccttcttaaccgcctggatgcactacaaccagaaggacaacccgctgttcaccgaatttgacaagattctggaaatcctcaaatcgaccgacacggtgctgtccatcggcgacgccatccgtcctggctgtaactgggattccctcgacgcgccgcaggtcgccggcctgatggtcgcaggcgatttggccaaacgcgccattgaagccggcgttcaggtcatgatcgaagggccgggccacgtgccgctgaaccacatcgcgaccacaatgcagctgcagaaacagctctgccacggcgtcccttactacatcttaggcttcctcgccaccgacgtcgcgccgggctacgacaacatcaccggggccatcggcggcaccttcgccggcatgtacggcgccgatttcctctgcaacttgacgccggctgaacacctcggcctgccgactgaagaagacgtcgtcaccggcgtgcgcaccgcccgcctcgctgcggactgcgtcaacatgctccgccgcgacagcaagagctacaagcgttcgctgaacatggcgaaggcccgcgtcgccgacgacccgcaggcgcagatcgacaacgcactgttcccggaactggtcaaggaacggatgtccacagaaccggcccacgatcactgcgcggcctgcagcgaaggcctctgcccggcggactacgcctaccaatatttcttcggcgactgattttaaacctttaaggagtacaacatggcaaacctcacccttgacactgttttaaacggcattgaaccggctgacaaagcctgggaagaaaaggcgaaggcccgcgtggaagccctcgcggtgccgccctggtccctcggccgcctgtcccgcttaggcgtccgcctggcgggcatgcagcggactgttcaccccgacgtgacccgcaaaatgatcatcacctgcggcgccgacgaaggggtcgcggaagaaggcgtttcggcctttcctcaggaagtcacgcaggaaatgctgcgcaacatcgcctgcggcggcgcgtcgatcaacgtgctgtccaaggcggccggcgctcaggtgcgcctggtagactgcggcgtcaagggtgattttccggagctgatcgaaaagggcgtcctcgtcgataaaaaggtcgcctacggctcacagaacatgcgcaaggggccggccatgacgaaggcgcaggcggtagcctctctcgaagcgggcatcgacgtcgcctccgacgccattgaaaaggacggcatccagctcctcggcaccggcgacctcggcatcggcaacacgacgccgtccgccgcgatcctcgccgtcatcggccaccactcggtggaagacgccaccggccggggcaccggcctcgacgacaaaggcctggcgaacaaaattcaggtgatcaaggacgcgatcgccctgaatcagccggacccgaccgacggcctcgacgtgctggccaaggtcggaggcttcgacatcggcggcatcgccggcacgatcctcggcgcggcctaccaccgcacgccgattttaatcgacggcttcatctctaccgccggcgcgctgatcgccaaaaccctatgcccgacctcagccgactacatgatcgctgcccacaaatcccaggaaccgggccacacgctgatgtggcagaccctcggccaaaagccgattctggatctggatatgcgcctcggcgaaggtaccggcgccgccgtcgcgatgcacatcgtcgaatgcgcggcccgcacgatgaacgacatcctgaccttcgaagaagcggccgtcactaataaaaattaaagccatgaaatacgatcctcacaaaagcggtgcccagtatttagaagatctggctacctcatattggtacgcaagtgccctctttacagccctggactcagggctttttgaggtcttaagggaaaataatcagctcggcgccgaagctgcggccggtatcctcggctggcagcctggcccgaccgaacggttcctgcgcctgctcaaggaaatgggtctcgtcgacgtgtacgaaggcaattggtacctcaccggactcaccgccgaccacctcgtcgacggcgcgccccacgatcagcgcgcgaacatccgctggcgccgggatctccgcgccgaatgggacaccctgcccgacgtcctcgccgccggcacccgcacactgttcccatcagacgacgtctccgaggccgacatgcacgcccgccgcgtcgactacctgaaggcgatggacgcggtcatcgacgggaaaatcgcggaaatgctgccgatgtttacccgcgcgctgcctgaaaacgcggccgtgctcgacgtaggatgcggcagcggcaaattcgcgatgtcggtgctcgacgcctgccccagcgccaccgctgacctgatggacattcgacaaatgacgcccatcaccagaaccttcgccgatgcctggcccgaagcggtagcgagccgcgcccaaacaatcgatcagaacatcttagagcggccgtggcaggtgcgtcggccatacgacctgatcattttgtccaatatcgttcacgccacggcagaagcggaatcggcatcggtacttgaagaagccgccacccatttggcgccggacggcattctgctcgtgcacgatttcttcacggaacacgatccggtcaagtcgcgcctgtccgacatcaacatgatggtcaacacctacaacggccgggcctactcggcgaaatggacggctgacacactgaaggccgccggctgcggcgcgtcggctttcctgccgctgtccaccgacaccggcgtgctcttcgcctgccaaaatgaagcccgcctcggcgatctggccctcgacccggtcgcccagctgatcccgaaaatcgaagcgctgggtttcgccgacgcgatccccttcccggcgggcgacgtcgtcttcgcgcccttcgcccgaaacaaatgcgagtacggctgccgctccgcctacgataagacctgcgtctccaatcgggacatgagctacgacgacacccggaccctcgtcggggactaccaccacgcgctgctgctgtgctcagagccgcccaccggcgatttccagagacgatgcttggcggcggaggcggaagcctttaaatcgggcttctacaaggccttcgtgttttgggccggcccctgcagcatctgcgcggtctgcgatccggaaacgccctgtgccaacccggcccaccatcgtccgtcgatggagggctgcggcatcgacgtctacgcaaccgtcgccaaggccggcgagaccctgcacccgctgcgccgccggggcgaaaccgtgaaatactacgggctgcttctcctcgactaacccattttaaaaaaagaaaagagcgtttatgaaatcaaaaattttactggttcaggccatttcgatggagggcctcgacatcgaacgggtctaccccatcggcatcgtcaccctcggcacgatcttaaagcgcagcggccgctacgacgtaacgattttcgacatgaacatggccggcaacccctacgcggagctgaaaaccaaaatcgcggaaaccgagccggacgtgatcggcatctctctgcgcaacctcgacccgctgggcaaccgcaccacttcgctgatcgtccccttcacgatgacagtccgcttcattcaccagttcgcgccggatacgccgctgatggccggcggcacggccttcacgctgtttccggaacggctgatgcgcgacttcccagaaatcacctgcggcatcgtcggcgaagcggaaaacaacgccgtacccctcgtcgacgcgctgacggatcacgaagtcctgcccgatctgccggggatcatccgccgggacggcgaagggatccggctcaccccgccggacggcagcttcgacatggggaactaccggatgatcgaccgcgacctgctctcgccggtcgattacctgaaggtgaacaaatacgtcgaaagcatcggcgtcgaaacgaagcgcggctgctgcttccaatgcggctactgcgaataccctaagatttccggccggtgtatgcggctgcgggatcccctcgccgtcgtcgacgaaattgcgtatctgaaagaaaaatacggcgtcacccgcatccatttgacggattccatcgtcaattacccgacgaatcacctcgacaccatctgcgaagaacttttaagacggggcctcgacatccattggagcggctttttccgggaagacgccctgactcgggagaacaccaagctctacgccgaatcgggctgcgagtccttctccctctcgcccgacggcctgtgccaaaagcatctggatatgctggacaagcatttgaccgtcgaccagattctcgaggcggcccgggtattggccgacaccggcgtcatcgccgtctaccatttcctcgtcaacgtgcctggggaaacccgggaaaccgtcgaggaagccaaaaaactcatcgacgccatttacggcattcacgccgggacgaaaagcctcggcaccatcgtgctcaacctgattcggatcatgcccggtacgaaaatcgagcgcctttccctcgaagacggcgtcatcacgccggaaaccgacctgctctacccggtctaccacgatccgccggccatgcgcacctcccgctacgagctggaggtgtaccaccagacgcgcaacatcgcgatgtggaatggcttcgacctgccgaaaccgatgaaataaatcaaaagatcaaggaaaaatccaaggaaaaaatcaatgaaaatcttattactcgaacaccccagaaagcccgcggaagaccgtcagaacgacatcgccaacacgacgctggcctcctgcttgacctccggctacctcgccgccaatctgctcaaggcggggcactgcgtcgatttgatcgaaggctacatggaacacctgtcctacgacgccatcgaaagggaagtcgccgccttcaggccgacgctgctggccgtccacctcgtctacaattgggaggacaaccacgttctcttcgacttcctgacccggctgaaggccgactacggcatccagcacctgtcggtctacggctattacccgaccttcgcctacaaggaagtgctcgaccgctgcccggccatcgattcggcgatgctcggtgaaaacgagctgaccgtcgtcgatctcgccgaccatctcgaccactggcaggacgtgaagggcctggccttccgcacggctgacggcgtccaggcgtccttcggcaccctggtcgaagatctcgacaccctgcctttcccgatccgcaaggcgacctcctaccctggcggcgaggtcaacatcctcggcagccggggctgctacaacacctgcaccttctgctacatcaacccgttcttcggcgaccataccggctgtccgcggtggcgcacccgcacaccggaaaacatcctcgccgaaatcgaccaggtcatcgcccagaccgaccatcggtatttctatttcgatgacccgaatttcttcggccccggcaaggccggccgtgaccgggtgctcaagctcgcggcgctgctcaagacccgcccgatcaccttcggcatcgaagcccgggcgaacgacatcgacgaggccaccacaaaggcattggtcgacgccggcatgaccgacatcctcgtcggcctcgaaagcggcagacaggaagtcctcgaccgcctcgacaagcacacgaccgtcgcccagaatgaggaggcgctgcgcatcctgcgggcgaacggcatcgagcccaacgtcggcttcatcatgttcgagcccgattcctccttcgacgacctgcgcaccaatttcgattttctgatgcgcaacgatctgctgaaacggctggaaatttccgtcaacgtcctctatcatcaccagatcatcctcgccggcagcgaaagctacaagcagcttcagcgcgaggggcggctgcacatttcagatcactccgtctacgaggcgacgaccgattacctgaatccggacattgcggccttcgcgcggttcatgcgccagctgaccaaccacattttcgactggtccgccggcacctggcaggcagccgctgacggcgaacccgaagcccgcgccgccttcgaccgggtgaacaccgtcctcgtcggctggttcaaggctattttggatcagccggacaagcttcacgatttcgacgcgctggtggctgaagccaaatctgacgtcgaccgcgccatcgccggttaacgcttctgttaaaaaaacaagccttcgcaaaggacatttgtccgatacgaaggcttttattctgtctacccttccaaatcgaaatattcccggggcacccccagcggcgcgagcacctgggcgagctgctcgagggcggccatgatcgcgctggcgtgaggattggtcatccggtcccgcttgtagcagctcaaattcgtcgtgccgatttcgttacgcgcggtgccgtcgtaaaaggccatctcctgggtgtagccgtcgagaatcatcgtgcaggcctcgtcgtaaaggtcctcgtagccgtacaaatccgggttgctgacgatccgcttgacctgggccatcgtcccgtcgtcgatgtcaatataggtatacgtcttcggcttataatcatcgggcatgccgtagccgacgcggcagccgtcgccgtcctcgacgatttcgacgccggaaatcggaatgccccaggcgtcactgagctcgtacgcaaaccaaagtgtctgatcttgatccattgtgccctccctatttttttcgttcaatttatactttacatcattatatcacacccgctctaacgcgctgatggtttgaaaaaaatacgcattctggcgcgttttttgccctttttgagtgattttgaatcattctatgatataatttaactgaaatttaattttatattaagaaaggagtctccttcattggcaacttctccaaaatcaaagcagcctaagcacaagctttccctgctccccaaacttctcatcggcatcggcgtcggtatgctcatcggcagtttcggcagctggtttcacatcgcccacacgccgggatacgtcggattaatccgcgccatcgcaaccttcgtttcgctgttcggtgaatttttaaacttcaccattccgctgctcattctggcctttgtcgccgtcggcctggccgaactcggcaaaaaggcgaacaagctcttcggcatcaccctggcattggcctacgggtcgaccatcatcgccggctttgctgcgtatttcctcggcagtaccctgctgccccgcctgatgcacgccatcggcagcaaggcgattgaaggcaagagcttcgagccgatcttcaccatcacgatgaagccggtcttcccgatcatgacttccttagtcctggcctttgtcctcggtttgtccatggcgaatctcaagacgccgacgctcatgaacgcgatgcaggatctcaagcagatcatcgtcctcgtgctggaaaaggtcatcatcccgctgattccgttctacatcgcaggcaccttcgccaaaatcgcggcgtccggcgaattgatcccgacgattacgattttcgcgaaattgtacgtctgcatcctctgtctccagtgggtctacattttgttccagttcacggtggccagcggctggcgcaaggaaaaccgctggaaggatctcaaaaacatcctgcccgcctatttcaccgcgctggggacccagtcttcggccgcgacgattccggtgtcccttcagtccgctgaaaacaacggcatcgccccagacgtccgcaatttcgttgtgccgctctgcgccacgattcacttggccggcgacacgatctgtctgacgctggggtccatgggcatcatgatggcctgcggccttcacccgactttgaacctgtacgtaccgttcatcttcatgctcgggattacgatggtcgccgcacctggcgtgcctggcggcggcgtcatggcggccctcggtatcatcaaatcgatgctcgggtttaacgcgtcgatgtgcgagctcatcatcgccctgcacctgtctcaggacagcttcggcacagcctgcaacatcaccggcgaccaggcggtcgcagccatcgtcgattacatcgacaacaaagaccgccacgacgatccgagaattcctgaaacgtccacggattcggccgattctgtcacagctgaataacacaacaaaaataatcctcagagcccaaatgactctgaggattatttttgttgatcggctttttacgcctgtatctttttcttaatgacaaccgctgccgtacccacaagggccgccagcacgagccaatcggcgtatttggtccaattggaatcgtcgccggtgagcactgcggtcatgctcttgccttctattttctgctgagccggtgctgtctgtgtggttggcttcgacgtcgttttcgttgttgagttactcgaattttctgtcgttggtttgctcggatcagtcggcttgttattctccggatccttcggatctgtggtcgtgctttcttctggtttggccgtgctgttaaaggcttttgcggttgagatcgtcttagtacctatgacgacgccgaccatatgctggaattcttcactgtcaatcgggctgtacatcttcatcgacttcagccagaccatgctgtcggccgtcgcggtgactttgccggtggtctgtttgtcagaaaccagcctgaaggtttcgccagccttaaccgtcgtgccgccgcttgccgtttcgacctgaacgccgtctcccgtgacgcttaaggtatagataccgtgataattgtcgggttcggttacgcttaactcaccgctgacccatttcttttcgcttttgtcgtaggtcaacgtcgtgtcgcccgaaatgctgactttgtctgaggacggttcactgcgcaaaatctcatcatttgcgtccgagacatcatacaaaactttagccagaggattattcttataatagtcacttgtatcagtaatattattattaggaatgctgtactcagtcatcaggcgccaaacggccgcttgcgttgcctcgtatgcttgtgactttgtcacataataggaatccgggtaattctgcgcatataactgaattggggtttgactagaacttgcactaaccatacaaaaagcagctttataaaaaggcagactggatatatcttgataggaaagccccgacgtcgttttttcagacgtgaatgacatcatcagaacttttgaatagaattgactgagtttatttagattttctgtgttgttattggtgtagtcgctgtaagtaaactgggtatcgcccagaatatccttaaaatctgagcggacgtcctccggcgcaactaacaactcattgaattccgcttcactgatttcttttggattatcgacaatttgatacagcccaaaaccgttgtaggggtagcccgcgtacaagatcgtctgaagcctgctcataaattcgttgtacttgctcgtgctttcgaaatctttttccgtcagatatccttctgaataattaggaatcgtgggatgagctgtggtcgtatgcggccacgccagacgattattcatgcaataaatcaggaagcgcccgtcggcgttttcctgtttggcgatctccgccggaatgtaatgcatcgctgtgctggtgtcgtattcgatcttaaaggaagtgttcgaattcccatccgctgcaaagacggagaccccaaacgccagcgtcagcactgcagtcagaactgctgtcacaatttttttcatacgttttcctcttctttagattttttctaaagtataacaaaaataggcatgccttacaaagtgtttttgcgttccttaaatctctttaagtgttcttttttaagaacaatatcggcgtctaacataaaaaaagccctgaatcactcagagctttgtgtgcgtttgtacctgcggcgagcttatgaccgatgggacgccatgttggcggcgttgaaaatcttgacctgataaaccgtgctgcctattgtgatggtgtcgtcgtcgaagagctgaaaactgcggttgaggggcagggtttcgccgtccagcatggtgctgccctcgaaggcttcaatgacgattcgggcaccggcggttttgaacgcgcattgcctcgacgcaactccgggatcattgatcacggtgtcgcaggtgggatcgctgcccaccgtgtgcggaaaacggatgatccagaggcgttttgggccgatgagcatgagcccagggacgtaagccgtcggccggccggactggctggccggacgcgccccgccagccggctgctgatgcggcattgggcggacacgctggaccggcgccccttcgcccttcaccaatgcccaaagggtggtgccgggatttgccgacgcccgcgcggcaatcgtgaagatgataactcccaccgagccgacaagcatcagccaggcccccgggccgattttaaacatgcttttcaacaggctgtcgactgtggagccatagttcgaacttaacccgtagtcgtagcttgacgcgctgttgagttcctgctgaatcgccgagtgaacggccgcgagcagcgccgcgcggagcacgatcagaatcagcgcgctgacagcgcagacggccagcgccacgatcgaccaggtcacaaaccgatcctcattgtccgccgcaaagcggagaatcaccgcgacgaggatcatcgcgagcatcgcgtaccacgtccaggtgtaaacctgaaaaacctgcagcacttcggtgaggtcgctgtccgaactcgacgccacgctctgcatcatctgattgatgctgctcgacatatctgaaatcttaaagggccagaccgcagccgaatggctgaaggaaatgcccagcaccggcacctgaatcgtaaaccagggcaggaaaagaaaaataacgagcagcacggcgagacaggataagtaaaaaatcgtgcgcttggtccatagcttttggttgttcatcgttgttctccctaagggctgaatgcgctcactgaacgtggcgtggggctgaagcggacggctgtcggtgcacagccgcaattgaagtcaaatgtgaactgatttcattatttgtattatatcatattttgacgtcaaaaaggcctgccccgcctaatttccctcaatctttctcggcaagtgcttacaaaaaaatctcccggatcaactccaggagataaattagcgatgcgctttattttttcatgtttttctggccgtaatcgtcgcggaaccggaccatcatccgttccatttcgtcttcgtcgaggagcaccggcttgccgatcgcgcgggccagcacgtagaccttggcgcactgctcgatttggtcggcgatgttgaaagcgccggcgatggtctttgctccggcgaccatgccgtggttagccatcagcgcggcctggcggtccttcatcgcttcaaaggtcgctttggcgagctccggcgtgccgtaggaggcgtatgcgccgcagcggatttccggcccggcaaaggcgatcaggtaattggacgccggcaggggttctctcagcgtggcgatgaccgtgcagtaggtggaatgggtgtggacgatcgcgtccaaatcgtcgcggtccgtgtaaaagatccggtgcagcgcgtgttcgctcgagggcttgcgtttgccgtcgacgacgttgccgtccaaatccatgacgaccacgtcctccggctgggtttcaaaataatccatccccgacggactcatcgcgtaaagccccttttcgcggttcaggatgctgatgttgccgccggtgccggtggtcagccccgcagtgatcagctttttgcagtaattgacaacgtcaatgcgttcttgttcaagtaacataggcgctcctttattcgtccaataaaccgcgtgccttcaatatctcggccacggcctcgaccgcttcgaacaccatcccgtcgcagtgcacctttttcggcgtgccggtcttggcgttggcggctaacagatgcgcgcagtcaatgacgccgtcgtgtccggccttcatccggcgcagaaaggcgtgggcgtcgtcggcttcccccgcgccgctgatgcctagggccatcagcccgccggttacggcgccgcaggtcagccccgagcgcatcccgctgccaaaatgagcggcaagggcgtaagcctgttcggccgaaagtcctgcccgttcggcgaacgggatcagcaccgcctgagcgcagttgtagtgcacgttcgggtcggccctgagtgcctttgcgcgttctaatactgtttgcatatgattgctccttccctttgcgtatagtcgttagtgataggtttattatagcacagcaggcggtatcatgagatgactccctttagaattaagaattgaggtgcggcgcgccagcgcctgaaatgccgcgaagcggcatgaccgtatcttctctcatctcatcttcaatcctatcctcttctctcttctcgtctcctctcctatacgaatttttcgaccgataaattgattttctcggccgattattttctaaaacatatttttattcgtagttatctcggcaataaaaaaccgccaatcggcggttcgttgcgttaaatagtaggttccacttaataatgatagcggcacgaaatgatgctgacggatgtatcactggccacataaaccagtctgttcgtgtcgtcaatacgccggctgaaaaagccctgcagatcgtactgcagcggctcaggttttccgatgccgtgcatattgccatttctcgcgatatcatcaatcaatttgttaatgcgcttcagcgtttttctgtcctggccctgccaatacagataatcctgccacgcttcttcagtccagatgatcttcattcgtcttctgcatcgatcagcgcgtgttcggcggtctgaccgtccttcagctgctgaatggatttcatcaaatgatcgtagttgtgtcggttattggtcaaatagaccgtttccatcaggctgtcgtaggtactttgtgacatgatcacaacattttcgtccttgcgggtcacaatcatcgtatccttgtcttccgaaaccttatcaaagtaagctttcatgtgattgcgcaatgtcgaataattgatggcaaacatggaatcacccctctaatctatttttacatcattataacgtacaattaattgtacgtcaataaggattggataccgccatgctgattcttaaatattaatgtctccgaacagtcattttcacatgctgaatcatgtccgcgttacgggtattattcggctcactgcgctttttctgaacggtgatggcgccattttgcgcctttcccgtgtcgaccgtcccggaataaacgacattgctgccccagtaaagggtgccttccaccttcacggtatattgtccctgtgggagcgctttgcccttgctgtccgtcagatcccagacgaaggaatgatggccgtcctggagcgtcgcactgctgaccgcgtccagcgcgtcatccgacatcgcacccgggtctgccgccgcgaccccgtggggcagcgcgtgcccgatagcctcgccgggctccggtaaaatcagacacgtataggtttttcacgacgtgtccggacgcattctcgacccgaaccgcgacctgatttgacgcctgtgtcgacatccacgtgtaatcaaactgaacggttacgctggaagccgcggcttgactctgactggtgttttttgttttctgatttgatgaatcttgcggcgcagccgtccgcccgcaggcccccgcaagcagcatgccgcccacaaccaggacaatcaacgcgatgcgtttcataaaaaaatatacctccattctgttttgcctttagcatacaaaatggatttgctgaaaacaatcgcttatcttaaaaaatcacgtggtgaattttcataatatttaatactatttatcgccaaaatacaccaaacgttttataataaatttacaaaaaggagaagtataggagaaaaataacaaaattcgtgtgcgtcacaaaaaattgaatctaacaaattattatattgatattattatgtatatataataatattgagaaaggacagtgaatgaaaaaatccggatttattttagacattcagatattattgtcttcatatgacataaaatttcacaaggaccttttagtagatatcaataatatgcttaacaaaagcggaaatgaaaagaaatttatcagtctgctgaccgcaagaatttctatgctggatcaagcgggacaaaatgtcatttatagtgctgacagaaattttgaatctttgaaaaacgaaacagaattatactcaatgcacctcaccattaaaaggaacgcatatcgaatattgttttcattcttagacgatggctctgttcttctatgcggctttaccgaaaagcaaggaaaaagaaaaacggattataccgcttctaaacagatcgcaaggagacgtttgcacgagattcaggaggggaaaaatgaagaaatcgattcgagaaatcttaaataatctaagcgacgacgcaccaaagtctgaaatatacgccgctcattatttagggaaaatatctggacaaatattaaatttacggatgcaatctggattatctcaggaagaatttgctaaaaaattaggaattaatcaaagcatgctctcaaaatacgaaagcggcgaatacaactttaccgtaaaaaaactggccgatatctgctgcaaattagatattgatttaactctcaatctcaattcgcatggtgttcatgaagaatctttacgtaagaattgggagtatcctgtttataatcaaaaaagaaaaatgattaaatacaatgtatttgaggtgcaaaatgagtgatcaaataaaaccactggacaattttttccttctcaattactccatagtcaaatttgatttcagcagcgacttcgcagaatataaggcagaagacccagaaataacaagaaaatttaacgtaaataatgaaattgttgatgtcagtaaaaaagaggacggcttctacgcgacaatcatcgtcaatatgaacttatctatacaatcagatcaccaaaatttatttttaaattcgtcaatcatcggcagcttttattctgatcaaatggaacaagaagaatttgaacatacctttaagacatttggatgctcttccctatacgaattgttaaaatcaacaacacacaactttttatctcaagctgttccaggcgatcgcattattttaccttttattaaatttcaagaatagaaaacaaaactctcaaaaaccgatagatttgctaaaaaagaaacataaaaactcgtaaaatgtgaagaaatgacaaaatcaaaaaaatgcaaagattaaaaaaaccgctatctctagcggttccttgcgtttaaaatggtgggccatcagggactcgaaccctggacaccctgattaagagtcaggtgctctagccaactgagctaatggccctctgcaaattacttggttattatagcaattccacctgcgctttgcaaggggttttttaaaaaaattttcgcccgactgaaatttcggccgggcgatgctgtttacagcttaattttctgactgattgcccgtccggtttccgtcccggccaagccgccgatacccgtttccttgatatccggatccattttccggccgatggtgcgcatcgcgtcgatgacttcgtccggcgggatctggctcttgactccagctaaggtcatatccgctgaaatcaccgcgttgaccgcgccgagggcgttgcgcttgacgcaggggacctccaccagcccggcgaccgggtcgcaagacagcccgagcagccctttgagggccagcgccgccgcgtttgcgatggccgccgcgtcgccgccgtgcagcccggtcaatgcgccggccgccatcgccgaggccgcgccgatttccgcctgacagccgccggccgctcccgccaaaaaggcccgttcgccgataacgccgccgatacccccagcgacgtataacgccttgacgagctcgtcctcagtaaagccttccttttcagataccgcgatgagcaccgccggcaccacgccgcaggatcccgccgtcggcgccgcgacaattcggcgcatgcaggcgttggattcgccgaccttcagcgcgatttccatcacccggcccaccaaatcgccgcagatgagcttgcctgcttttcggcgcgcttcgatttttgcgccctcgccgccgaccaagccgctggcggacgtccgccccgcgtcataatcggccaccgaatcgatcatggctttgagggtctggcgcatggcctcaaaggatacctctggatcaatggcgctttcgttgcagctgtcctcctggacgatctgccaaaagggcttgcccgtctctttttccgtgtcgataatctgcttcagcgcatcaatcatggctgtctccttttctgtcaatccggtcgtccgcaatatcctctaaaaggcttaaatacgtcacctttaaaaccccttcgagctttttgagccagttgagcgcctccgccggcacctcctggtcgcattccagcaccatgaccgcgtagccgccgcggccggagcggtaaagctgcatcgttgcgatattcaccgtcttgtgggccagcatcgacgtgacctccgagacgtgacctggctggtccaaattgtggacgatgagggtcggataatccccagagaaattggccgtcagatgatccagctcctgaatcacgatccggccgccgccgatggacgacgcgacgatttccagctccttgccgttgacgccggtcagctccagcttcgccgaattggggtgggcgtcttccccgagatccacgtcgtaaaaatcaaatgtcatgccgatcgaccgcgcgatgtcgaaggcgtccggaatcgccatatcgtccacatccatgccgagaagcccggcgatgatcgccttgtcggtcccgtggccccggcccgtcgccaaaaacgagccgtaaagcccgatgtgcgcggccgccacgttctcgccgagcagcctcctgctgaccttgccgatgcgcaccgcgccggccgtatgggagctcgacggcccgaccatcaccggcccaatcacatccattacgttcatgctatttcccttctaaatctcacacctgccatcgcaaaagccgtaaaaaaacgcgcacctgtcagccatttcgagaaacctgcccgctatggcaacctgtgcgcgttctgcttttttgatgtttcactttgtaccgtccaatcaataagactttttgactctgtctatcaattttcctttatgatttactatcttacagttcccatctctaaatgtcaagaaaccgattttttcgaggcctctaacaaaaaatcaaataaggtattgacaaataccctgtgacggtatatagtgggaccatcaaacaccccttaggggtatctaaatcaccatcaaatgacaatgtccatccagaaaggaagatgattatggcagaacaatacgatgtcaccggcatgtcctgtgccgcgtgccaagcccgcgtcgaaaaagtcgtcgcccaagtgcccggcgtcgacagcgtcgcggtcagcctgctgaccaactcgatgcgcgtcgagggccatgccgacgaaacggccatcgtcaaggccgtcgaggatgcagggtacggcgcaaaacgccgggattatgcccagaatgcccagggtatcagcgccagcgcgaagctcgccgccgaaaaggaagccctcgaggacaagaccaccccaaagatgatccgccggctggtcgcgtcggtagcggtgcttctcgtgctgatgtatttctcaatgggggctcacatgtggcattggccggtgccgccgttcatggtcggcaaccacgtcgcgatgggcctgatgcagatgctgttgaccatcgtcgtgatgatcatcaaccgcaaattcttcatctccggctttaagagcctgttccacggcgcgcccaatatggattcactgatcgccatcggctccggcacggccttcggctactccactgtcatgctcttctacatgaccttcgtccaggttcaccagggcagcgccgctgcgatggccgtcatgaacgatttctatttcgaatccgccgcaatgatcctgaccctgatcaccatcggcaaaaccctggaatcctattccaagggccgcaccactgacgcgctgaaaagcctgatgaagctcgcgccgaaaacggccaacgtcatccgaaacggcgaagaaattaccgtcggcattgacgacgtcaaaagcggcgacatcttcgtcgtccgcccaggcgaaaacatcccggtcgacggcgtcgtcgtcgaaggagcgagcgccgtcaacgaatcggcgctgactggcgaaagcatccccgtcgacaaggcggaaggcgacacggttacctccgcgacgctgaaccaaagcggctttctcaaatgccgggcgacccgggtcggcgaagacacaacccttgcccagctgatcaacatggtcagcgacgccgcctctaccaaagcgccggtcgccaaactggccgacaccatctccggcgtattcgtgccggtagtcatcgccattgccgccgccgtcaccgtcatctggctgatcctcagcggcggtgacatcggcctgtccctccagagaggcatctctgtgctggtggtctcctgcccctgcgccctcggcctcgccacgccggtagccatcatggtcggaaacggcatcggcgcgaaaaacggcatcctgttcaaaaccgccgaatccctccaggaaacggggacggtgcagatcgtggccttggataaaaccggaaccatcaccaacggcgaaccgaccgtcaccgacatcctccctgctgacggcacaacccctgaagccttaatcgcaaaggccgccgccctcgaacagaaaagcgaacacccgctggccaaggcggtgttaacctacgcggaagaccagcagactgaaatcgcagacgtcaccaatttcacagccctgccaggcaacggactgaccgccgtcttaaacgggaataccctttccggaggcaaccggacgtttatcgcgtcggtggccaacctcgacgatcaaaccgcagccaccgcggaaaaactggccgaacagggcaaaacgccgctgttcttcgctgaagacggcaaacttctcggcatcatcgccgtggccgacacgatcaaggcggattccgccgaagcgatccgtcagatgcagcagatgggcatccacgtggtcatgctcaccggcgacaatcagcgcacggccgaagccatcggcacccaggctggcgtcgacgaagtcgtggccggtgtcctgccggaaggcaaggaagccatcgtccgccagctgcagcagcacggcaaggtcgcgatggtcggcgacggcatcaacgacgccccggccctgacccgggccaacatcggcatcgccatcggcgccggcaccgacgtcgccatcgacgcggcggacgtcgtcctgatgaagtcccgtttgaccgacgcggctgctgccatccgcctgtcccgccagacctaccgagatatcgtcgaaaacctgttctgggcgctgatttacaacgtccttttaattccgctggccgccggggcctacagccactggggcctggcgatgagcccgatgtggggcgccgccgcgatgagctgctccagcgtcttcgtctgcttgaacgccctgcggctgaacctcttcaaggtctttgacacgaagcacgacaagccgaagaaaaacgcgctgccggccgacgccgtcttgatcgaaccgtcggaagcgccggaagccgcgccgaaagcacaggccttcgccaaggaaacggtccacatcgaagggatgatgtgcgggcactgcgaagcgaccgtcaagaaagccctcgaagccctgccccaggtcgacgacgccgtcgtcagccacgaaaagggcacagccgaaatcgcgctgaacgcgccagtcgatgaatcggttttaaaggacaccattgaagacaaggattatacctttgttagcgtcgagtccaacgcctgacggtgcatctctccattttctatattcaaatattaaccgctgaagcaccaaagctttagcggttttttgttgaattctgatataataaaaccgaagtgaaatcaaaaaagaaaggacagatggtcatggcactttacgcgattggcgatctccatctcgcctaccagagcgaagtcaaggcgccgatgcagcgcagcggacggatttggcaaaatcacgaggccaaattaaaaaaatattgtgaagcgtacatgaagctggaggataccctcgtcctcgtcggcgatcacagttggggcaaaaagctcgcccaatgcgaaaaggacttggcctacatcgaggcgctgcccggccggaaaatcctgacccgcggcaaccacgacatgttctggaacgccaagaaaacaaagcggctcaacgccctctaccgcggccggctgcattttctgcagaacaacttctattcctatcacgactacgccctcgtcggcaccaaaggcgtcaccttcgaggggcccttttacttaaaccgccgcggtcagatccttggatgggacgaaaaggccgaagcccacgctgaaaaactgctccgccgcgaaaccgcgagacttcgggcttctttcgaggcggcccgggccgcgggctacaaaaaatttatcgtctttctccactacccgccgaccaatatcctcgagacggagagcgccttcacccgcatcgccgaggcctacaacgccgagcaggtgatctacgctcactgccacggtgaagcgcggttcaacgacagccttcacggcgagttccacggcattggctatcacttagtctccggcgattatttgaaatggcggcccaaacgcattttataaaataaatcaagcgcaaaaatccggcaggatgcttcctgccggatttttatgtatggattattttttgattgaaaaacatcagtcgaaatttttctcaaaggccggtttttcttcctccggcacaagggtcaaatgccccgaacgggccaccgcctgcacccgggtttccacgtagcgccagcgccagccgattttctgctggatgtccttgtcagtgacgtcggtgtggatagtctccggcccttggctttcggcctgcttctgggcgattttgccggcttccgccttggcgtaggccaccgcctcgtccttatcttcgaagaagaccgattggccgccgacatgggcgacgaagccctcggtcgcctcgtcgggacggaccagcgcgtccacccgttcctcaatggccgccgtcgccgccccgacggcgttggccacctcaaaatgttcggggacgaggatatcgcggtgcacgtccgcctcatttttgaccagggtgtaccaggttttggccggcgcgccgatcgcgatgaccggcagctctgcgtccgcgccttcactgtaggccggttcgctgaagaccttggccacgatgcggtccacgacgagggccttcgcctggttcagataatccttttcgtccagcccagcccgccggctctggaaggccagcgcgtactgggacgccgccgtatcccaacgggtcagtctgccttcggcgcaaagcagatcggtcggcgtcaagtcttccttctcgccgccgcggcaggccggcggcacccggtgggtcgtcagcaccggcgcgccagcgcttacgtccggataaatttccgtgtcgccgccgagaccaaaggtcgcgagcttcgccgaatccacctgagtctgccactggccgaccttcgcgcccaccggcgacagggtcaggctgtggtggcgcaccacgccggtatccgtcgtcgtgccgcccatgtcggcgacaataccgctgtcagttttcgcgaggaccatcgcgccgaggatgctcgccgccggcccggacaaaatcgtctcgatcggcttgctcgcgatcgtctcgaggctcgcgagggcgccgtcgcctttgaccagataaaccggcgcggtgatgccccgttcggccatggtttcgcgcaccgcctgcacaaagccctcgatgatcggaatcaggctcgcgttgagcaccgtcgttacggtccggtcgtggtagccgagctttgaggacagctcgtggccgcagaccaccggcattttcgaatggcagcggatgaccttcttgaccgcgagctcgtgggcgttgttgcgcacactcatcatgccagaaaccgcaatggcttcaaccttcggcagcatctgcgtgacggctgcctcaatttcgtccgggtccactggctccgtttcccgccccttgatgttgatctttccggtgatctgcacgacctcttcggtcggcagctcgcccttgggccttgaaccgatgagaatcagcccggtcgggcggccctggccctcgacgatggcgttggtcgccagggtcgtagagagcacgaccttttcgatttgaacgtcagacaggtccgccccgtttaccgggcgcaggctgtcgatgctgtggtgaatgccgtttttaagatcctgccgcgtcgtcggcgccatgcccttggcgaccacgctttcggtcagcggatcgtagagcaccgcgtccgtcgtcgtgccgccggtgtcgatgccgagcacacaggctgtaagctttgttgtgtttgtcatattgtcctttctgtgcatgcgccgttacggtttgcagatcccgcagggcgaatacccttgattgatcaaatcggagcgcttggcgttgacggtctgcttgttggcttccgacatatgggccacgccggagcagtccggtttgtgaaatttcttgttccgtttgttgatgacgtaggtctggacggtttcgtcttggctgctcgacgacgcggtggaggcggcgctgctcgacgaactggagctggtcgtacctccggtaccgtcggcgcgggtgtagccggtcgcgtaatcgatggtcacgccgggctccacgttgtagcagtagacgttgaacagcacgccgtcgcccttgtcctcgacggattcgccttccatctggacaccccgggccacgagctcattgccctgaaaaatcggcgtcacgcggtaaatcacgtggttgccagtttctttgatgtagtcagcgaccatattttcaaaggggagcatgccgtcgacgttcatcgaccgcgtgccggtgatcaggttcttttcgttggcgttttcatccgtcagctcgtgggcgatcaaatggcagcggttgtacaccattttgccgtcgacaaaatcgtagcgcgcgttgtgccagcccgtcggcttgacttcgctgatactgccacgcttttcgccgctcttgggcatcgtgtccttgccgatgcaagccatcgccgtgccgcatcggccgagactgtcgagatcgctgtagtgctcgtaggatttggtcgtcaagtcactgtctgagaaattcggcttgttgccgttcaatgcgacgtaaggatctcccgaataagtgggaatctggctcaaatcggatgccgtcttcgtatcgacgacggtcgtgctgtcagtgaccggattgtccgcgctggacgaggacgagctcgtcgtgccgccgcatccggacaacaccagcaccgcgctgagcacaatgccgatcaaaagccggctcatggaacggattgtcatttttttcatcgcgtgtacacttcttctgtgatctcatcgtgggaggtgccgatgaagacgtgctgcccgctcaggttccatcccttcggcgccaatggataggtgaagaccagatcagccggataaaccttgtcccagcggtaaaggatcagcttctcgatatgggcgtcggccgccatgatcgcctcagacgaggcaaactccgccacggcaatctcacccggtccggccttctcgaggaagtcagcatcggtcacaaatttgacgcccgtctgaccgtcaaacagcgcctcggttttcgccgcgccccagaaacatttcccgggaaataactggaccaaacggtcgatgaccgcgcggtcccgcgtctgccgcctgtggttgaaggccatgccgttcttcgggtcgagaaacatcacgaggatcacaaaaattcccttctttctttaatatttcttgatcacactataccacaacgtcaaaaaaaagccaacgacttaacccgccgttggctcgcggtaaaattgaccgatctatctgtcttattccaaattgagatggcggtctaggatccagctcgtcgcgatgaaccaaatcgcgcccagcaccagcgtgatcgccagcgcgatcagcccgaactgattgaacgccccgaccaatttgccgaagttggctgccgccacgacgctgttcatattgtcggacatcacgtatatcattctaaccgacagaatctgttcgacgacggcgatgccaatccacatgactactgacagcaggatccggtgccgatggaccagctggccgaccgccatcgcgaaatagacggttagaatggtttccgccagactcgcggccgtcagcacgacgacgagccagaaagacgcccagagatggtattgggcgatactcacgttgagctgctgaaagttccaggcaatcccctgtctcgcgacttcttcgtacccgccggaaacgacaaacaaaagcgccgtgctgaggcatacgacggcaacgtaagccaaaatccaaacgatattgacgatcagcttcgcgccgacctgttcggccgcactcgctggcagcgccatcgtcatatacccctggtctgacaataggttgtcgtaaaaccgcttgacggtccagacaatcacgagcacccccgccacaacgacgagcagaccaaagatcaccgacatcaaattggcgaaggcttcgacgcgggcaccgacacgcatcgcgatcccgtcgatgagggccaccgccaacatcaacccgaacacaatcaccattggctgccagctctctttaaattcatatttgatcaatttgcctaacatgagaacacctcccgaaagatttcatccactgatttttcccgttctgctcgtaacccgtcgacgtcctgatgcaaaacgatgtgcccctgtttcaaaaagacgacgtcgtcaagcaccggctcgacgtccgcaatcaaatgggtggcgatcacgactgtcgcttcgggattgtaattgttgatgatcgtcttgatgatgagctcccgagccgccggatcgacgccgccgatgggttcgtcaagcagataaagggccgctttccggctcatcgccaaaacgatctgcaccttgtcgatcgtccccttggacaattccttgaaccgcttattcaaatcgatgtccatctccgaaaacagccgaagggcctgttcccgatcgaaatcgtcgtaaaaatccgctaatttgcaaaccagatcgttcacgcgcatggatttgctgaataccgggcggtccggcaggtaggaaacgatgcgcttcgtgtttttccccggcgcttcgtcgtcgatcgtcacactgccttcgctctgggagagcagccccgcggcgatttttaataatgtggttttgccgctgccgttgggccccagcaggccgacgatccgtccccgttcgaggctcaaatcgatgtggtccagcgcacattggccgccgtaccgcttggtcagctgttcagcctttaaaatttcactcattgtggttctccttttcttccttttcgttttccgccgcgtagctgcggatcaattcggccgcttcttcagccgaaacgcccatttcctgcatccgccgcaaaaaatcttcgatcatgcctttcgccattttctgtttcagcgatgcaatcagcgccgcatcttccgtaacgaaccggccaagggtccgcttggcgtggaccaagccgacttgttccaactgacccagagcccgctgcatcgtattcggattcaccgaagcgtccgctgccaattcccgaaccggcggcagtttctcgcccggcgcgtactcgccggacagaatcgcccgttcaatttgacggatcagctgcagataaatcggctgcttcgcgtcaatgtgccatttcatcgcaatctcctttctctgtatttgtgtattaattacttaatacaataataaaggcatacaaactttttgtcaatacatttttatattttttgcaaaaaaagaacagcctttcgactgtcctatcacgctgcgccagatgacgctggcgtcttgtattttacgcgttcgcgttttctgaatctggcattttcgggaatcggatcgtgaaggtcgaacccttgccaagtgcggagtccaaatcgatcgtcgcgtggtgcatcatcgcgccgagcttgacaatggagaggcccagcccggtgccgccggtggccttgctgtggctcgggtcagcccggaaaaaacgctcgtaaatccgcggctggtcctccagcgcgatgccgatgccggtgtcggacactgccacccgcgtttccgacgcgtcctctgatattttcactttgacgctgccgtccttgcgattgtaggcgaccgcattgtccacgaggttgtagatcatttcgtacagcgtcgtcgccatcccctgaatcggcgctgcttccccttcgaccgaaagggtcacgttgttctgctgcgccttcgcgctcaaatcgtggacgacctgcttcgagacgccgacgagatctacggattccgtcttttcgtccgtcgccatttcgtcgagctgagagagcctgagaatatctgaaatcagcttgagcagccgccgcgattccttaatgattttgttggagagttcgggaatgtcgttttggtcggcaatgccgttgccgatgatttccgcatagcccagaatcgacgtcaacggcgtcttcagctcgtgggacacgttggcggtaaattctcggcgcagccgttcagccgactggcggtccgtttcgtcgatgatgaagagcaccgcgccgtaaatgccgccgtcggtttcgccgggaccggcgatcagctgatagtagcggccgtcccgtttgcagttcatttccgacgactgccccgccatcgcgttctggatgagcttgagaaaatcgatgttatgatccagatggagataggtgatgctgcccggatcctggtaaagtctgaagaactgacgcgccgcgtcgttgacgctcagcacctttcccgtatggctgatgatgaccagaccgtcgcgcatggaagacgtgatcgcttccaattcattctgctgttttttgagcatctcaaactgctgttcgatgtgggtgcgctgaaggttgagacgctggaggagcggcgaaagctcgtcataggtgtcgttttccaacggctcctctaaatttaaattgataatcgggtcgacgatcgctttcgtctggtgaccggccagcaaaaaggcgacggcgatcaccgcgaaaatcaaaaaggcgatgatcgacagcgaccggccaaagaccccaaaggtcgacagccgcgtctgcgccagccggatcacgctgccgtccttcaggcgcatcgcgcagtaatctgtcgattccgaaagagttttcgaaaacctggaggacgtgcccttcccaaacttcatcgctgcccgcacttccgggcggttcttgtggttttccatcgtcgacacgtcagcttcgttgtcgtagagcactttgccgcttttcgcaatccaagtcatcctgagtttcgacgttttgcccgcttttttcagataatccatccgatcggtcggattttcgttcagcgcccggcgcacgatagccgttgtctcgttcaggtaatcccgtctggatgtcgtaaaactgtgagacaatgtcggaatcagaatcgccagtgtggccgctaaaattaaaatggctgtccacgccatcgttcggaacagccggctggacagacttttttcatttttcatcttggttttctttcggtttatttttggaaattcgcttctttccgcatccggtagccgacgccgcggaccgtttcgatcagcttgcgggcgcttcccagcttctggcgcagcgtcctgacgtgcacgtcgactgtccgggtttctccgtcaaagtcgtaaccccaaatatcggtcaacagcgcgtcccgggtcatcacgttgcccgcgtggctcatgagcacagagagcaggtcgtattccttgagcgtgagctggatgtactggccgttgacctgaaccgtgtgcgccttcgggtggatgacaatcgggccgtcgacgagcgcttcgtcgccgtcgtccgccttgtggtcgaccccggcgcgccgggccacggccttgatgcgcgcgagcagttccatcatgccgaagggcttcgcgacgtaatcgtcggctcccgcgtcgaggcccatgaccttgtcgacttcttcgcccttggctgtcagcatgatcaccggcacatccgccgtctgcgtctgcgccttgagctgtttcaaaatggacaggccgtcttgtccgggaagcataatatcgaggagaatcaaatccggggccgacgtattcgcatcggccatcgcttgccaaaaaggctcagcgctttcaaagccctgagcctcatatcctgaatggttgagtgtatacacgaccaattcacgaatactgttgtcatcttccacacaaaaaatcctcatacttatgccttatctgttttaattctttggatgttcgccggtaatcgaaaattcgacccattcgccgatgttgacggcgtggtcaccgatgcgttccagatatttggcgatcatcaggacttcgacggctttggccccttcgatttccttgttttcgatgcggtgaatgatgtgggcggaaatcttgtcaaacagctgatcgacgatgtcgtcctgcttgtagacgctgtggaccgtgtccaaatccttctgaacgtaggcgtccaccgccgcgttgaccattttgctggccaccttcgccattgtgtcgagttctaaattgtggaactctgcggttaaatccgccgtcacggcgatttccgcgatatccgtcgcctgatcgccgatgcgttccatgtcggtgatcatcttcagcgcggctgagacgttgcgcaggtctctcgcgaccggctgctgggacagaagcatcacgtagcactgctgttcaatgtcccgttccatttcatcgatgttcgcatcatcttccatcgcttccttagcgaggtccgtgtcgttgtcggccagtgccttcagcgccttgtcgatagccgcttcacagaggctgcccatttcgatcatgctgtcgttcagccgtaccagttctttatcaaatcgatttcgcatattatccgaacctcccggttacgtatcgctctgttctttcatcctttggattcgagaaaatctgttccgtgtcaccaaattctaccatatcgccgagcaaaaagaaagccgtcttgtccgagatacgggttgcctgctgcatgctgtgggtcacgatgatgatcgtgtatttttccttgagatctaaggccaggtcttcgattttcccggtcgagatcgggtcgagggccgaggtcgcttcgtccatcaacaggacttccggttcaacggccagagctctggcgatgcagagacgctgctgctgcccgccggagaggccaagggcattcttcttcagacggtccttgagttcgtcccaaatcgccgcctttttcagtgaatcttcgacgatgtcgtcgagctgtgccttgttcttgatcccgtgggttctcgggccgtaggcgatgttgtcgtaaatgctcatcggaaacggatttggatgctggaacaccatgccgacgcgcttgcgcagaatgttgacatcgatgtccttgtagatttcagtgccgtccaatgtgattgacccggtgattttgcagccttcaacgaggtcgttcatccggttaagggatttcaaaaatgttgatttgccgcacccggagggtccgatcagcgcagtgatctcgtgttccgggaaatttaaagtgatgtcctttaaggcgtggaaatcgccgtaatagacattcatatccttagaagccatcttgattttcgtcgaagctggctttttaactttgtagttttccatttaagtccaaatactcctcgtttattcgttcactttgttgacgcgttttgcaatcgcatcagaaatgaaattcaggataatgacgacgacaagcaggatgacagccgtcgcgtaggactggtcgacgttcatcccttctgtccacagactgtacatgtgcacggccagcgtacggccagagcccatgatgttcttcgggatctgcgccaccgtcccagcggtgtaaatcaatgccgcggtttcaccgacgacacgcccgattccgaggataaccccggcgagaatcccaggtgctgccgacggcaggacgactttgaaaatcgtacgcagcttgccggcaccgaggccaaagctgccttcgcggtagctgtctggcacagcgtgcagcgcttcttctgtggcccgcatgatgaccggcaggatcatcagcgccagcgtcagtgcaccggcgagcaaggagtagcccatgtgcagggcgtcgacgaacatcagcatcccgaaaatcccgaagatgatcgacggaatcccggtcagggtttcggatgttaagcggatgaatgcgacgaacttgctgccgcgcttcgcgtattcagccagataaacagctgagaaaatgccgatcgggccggcgaacagaagcgacaggccgaccatcgtcagcgtgttgatcatcgctgggaacagcgacacgttctgactgttgtagtgaatcgagaacaggcttggcttgaggtgcggcagcccgttgatcaaaatgtacagcacgagaaagatcaaaatcgccatcgtggcgatgccggcaatccagacgattgccttcaaagcagcggcctcgcctctgccgtgaagcttttctgttgaattttttgtgtaatccttcactgcttatctcctttgtttttcacgatcgagaagcaaatgttgataatcaggatgaagacgaacagcacaacagccgtcgcaatcagcgcctgacggtgcaggtcggtcgcgtagcccatttcgaggacgatgttggcggtcatggtccgcacgccagcgaagaggctgtgcggcatcacagcttggttgccggcgatcatgatgacggccatcgtttccccgatggcacggccaacgccaaggatgatcccggcgaaaatcccagatttcgccgccggcacgacgacgcggaagaccgagcgttcgtgggtcgaaccgagcccgagggccccttcgtagtagctcgtcggcactgctctcaacgcggtttcactcatcgtgataatggtcggcaggatcatgatcccgaggatgatgcacgcggcgagcatggataagcctgcgccgccggcggagttgcggatcatcggcacgatgacctgcagaccgaagaagccataaacaaccgacggaatacccgccaagaggttgatcccaggcttgagcaccttatacaagggttccgggcagaaaaacgcgagaaaaatcgcggtgagcacgccgatgacaattccgatgatgagggcgccaattgtcacttcgatactggcgacgatcatcggcaggatgccgtacaaattgttggccggacgccaaatcgtcccagttaagaattttccgaatccgatcttcgccattcccggaagaccattggcaaacaagaaaatacagatgaggaaaacggcgatgattgcaatgcaagcgcaggccgcaaaaacgacctgcattgctttttcttttgcctgacccggatgcttcgatttgttcaagacgaagtctcctttcagtttaaagattgtgattaaattgtgtgtgttttgattaagtcttatttgacgtctgaccaagaagtggtcttgccagtgtagatgttcttgatctgtttaagtgtcaggttgtcaaccttattgtccttgttgacgatgatggcgatcccgtctttagcgattctcgtgaccttcaggccttcgctcgtttcagaaccttggagttctcttgaagccatcccgatatccagtgtgccttttgctgcgttggagacgccggttgtcgagtcagattcctgaacttcgatggtggcattcgggttaaccttttcgtaagcttctttcagtttttccataactggtgtgactgaggaagaaccgccgacggtgattttgcctgatggttttgtgccgctgtaagcgccgttggtagaaactttgacgtagccgttcttttcgatgacgttctgtccgtcagaagacatgatgtagttgatgaagtcctgagctacgccggaagcttcgccctttgtcatgatgttgaacggacgctgaattttgtagctgccgtcggtgacagtcttgactgacggtgcaacgccttcaaccttgacggccttgacatccttgctcaaagaaccgagggaaacgtagccgatggcgttggtatcgcctttaacggtggacatgaccacttctgtcgagttggagatggtcgctttgtctgtcgtcttgtcgaccttctggccgttcttttcttcctgaacccctgtcagttcgatgaacgcgccgcgggtcccggaaccatcttcacgagacacgacattgattgtgccgccgccggatgagccgcagcctgcgaatgtgaccgctgcaacaaaggcagctaagaccatgagaatcttctttttcattttgaactccttcattaaaatcaaaatcctgtttggtgaatgctctttccaaacttcgatttcaattttacaaaggctttgttaaatctgaaagacggcttatgtaaagtccatgtaaagtgtaaaatttattaacttaacttcttttaacaaaaaaagcccgcacaaagcgggctgcaaaaagctgattaatacgcgatttcgttgggattgttttcgccgcgaagccaggccatcaaaccgttaagggagacagtgaccatgtctttggacgactgatcggtgtaaaatgccgcgtggggcgagacgacgacattagggtaggctttcagggcgagcaggctgcggttgtggatcaaactgctttcgtggtcgatctggatcacgttttcttcgtgttcgaaggagtcgatgcccacagcgctgaccttgccgctttccacggcgtcgatgagatcccaggtgttgatgaggccgccccgggccgtgttgatgatcaccaccccgtccttcatttgggcaatgacgtctttgtcgatcatgtggtaattgtcttgagtcagtggtgtgtgcagggtgatgatgtctgcttctttgagcagggtttctttcgagacggctttggccagagcgtcggtttccgctgtcggatgcggcgtgtaggaaatgaggcggcagccgaaccccgacaaacatttggccacggttttgccgatatggcccatgccgacgatgccgacggtcatgttgtgcagctcccggccctgcatgcccgccagggaataatccatgaccgctgatcgggcgatgatgtgaataaacttgcgcagacaggtcagcatgagcatcacggtgtactcggcgacgctgtaaggcgaataatgcacgttggcgcagtgaatctggtattttttcgccgccgcgagatccaagcggttgtagccggcggtgcgggtcgaaaaataatgaatgccgtacccggcgagggccttaaaaatcgcggcgtccgactggctcagcccttcgatggacacgccgtcaaaaccttcggcgaggtaaacattgtcggtgcttaaatgtgcctggacgatcttcagttctaaatcttcccggttttgaaaggcttttaaagttggcatttcatcgtcccggcagccgtaggcgatgagtttgactggtttttgattttgcatttttcttcccctctttgtatcaatttcctcacgcagtgtatcacgcttttgcttcaaatacaaacccaataatttattactttatataattaaaataatttttttacataaaatcttaaataatgctaaaataataatattaagtcttatcaatttgtattgaattgaatacagaaaggaatggatagaacgatgaacgaaacagtcaatgcgtggctcgatgcccatctgccggatatgatcgccgacatcaaggcgctgtgtgccatcaattctgtcgaaggcgaacccgaagacggcaagcctttcggcgacggcccttaccagagcttgaataaagccctggaactggcgaagaattacggcttcgccgtcaccaactacgacaattacgtcggcactgccgattatgaccaagatctgccgagaaccctcgacattttgtgccacaccgacgtcgtgcccgccggcgaaggctggacggtcaccgacccctttaacgtcatcgaaaaagatggccgcctctacggccgcggcgtcagtgatgacaaggggccccttgtcgccgctttgtacgcgatgcgcgccctcaaagaaaacggcgtaaagctcaagaaaggggtgcgcttcatcatgggcgccaacgaagaaaccggctcccacgacatcgcccattactacgcgacggaacctgaagcagaaatgaccttctctccggatgccaacttcccgatcatcaacatcgaaaagggacagttcaagggcatcctctccaaagactgtgctgaagacaaaaccctgccccgggttttgagcctcgacgccgggatcgcctttaacgccgtcccccagaaagcggtgattcgctttgaaggcctggatatcgatgccaatcaaaacattctcgacgatgttgccgcccagtgcgaagtgaaaattgaaaagaccggcgatgacgaactcaccatcatcggccactccgcccacgcctcgacgccggaagacggccgcaacgccggcctggccgcgatgattttgatttcaaagctgccgctctatccttccgaaatgcagaagaccgtgagccagattccgaagctcttcccctacggggtcaccgacggctccggcatcggcatcaagatggcggatgaagactctcacgacctgacgtgcaccctcgacctgtatcacgtcgacccgacccacgcggaattcacctttgacgcccgcacgcccgtcatggcgaccaaagaaaactgcgaagctgtcgcagcaaagactgttcaggacgccggcttcgactggtcgactccggggatgattccgccccacgttgtgccaaaggattctgactttgtgcagaagcttctggcctcttacgaagcggtcaccggcaaaaaaggcgaatgcatcgccatcggcggcggcacctacgtccatgaactgaaaaacggcgtggccttcggcgcagttttcaacggcgtcgatacccgcatgcacggcgcagacgaattcttcgatctggacaatctgctcaccgcagcgaaaatttacgccgatgcgattgtccgtttgtgcgcctaaagattttatgatttttatagaagggataattttatcaaatgaacgagaacaattctggttttaaaccgtacattccggcggaaaaaatcgtgccggaaatgacggtgttttcagtggtcatgggggctgtcctggccgtcgtctttggcgcagccaacgcctacctgggcctgcgtgtcgggatgacggtttccgcctctattccggcggcggtcatttccatggggatcatccgcatggtgctgcaccgcgattctattctggaaaacaacatcgtccagactgtcgggtctgccggggaatccttagctgcaggggcgatcttcaccctgccggcgatgtttttgtgggccaaggaaggggttatgggcaaaccgggcctcatcgaaatcatgatcatctgcatgatcggcgggctcctcggggtcttcttcatggtgcccctgcgcaacgccctcattgtcaaggaacacggggtgctcccttatcctgaaggcacagcctgcgcagaagtgctcctcgccggtgaaaaaggcggcagcgccgcttcgactgtttttgccggtctcggcattgcctcaggatttaaattcttaattgacggtctgaaactcgttccgagcgaaatgaacaccccaagcaaggggatcggcggctacgccggccagatcggcacacagatttatccggcggtcttctccgtgggctatatctgcggaccgaagatttcttcctacatgttctgcggcggcgtcatttcctggatgttcatcattcccttgatcgtcctgttcggcggcaagaccgtcatgtatccgggcacgaccactatcgcaaagatgtttgccgcagggggcgtcagccagatctggagctcctacgtccgctacatcggcgccggagctctggctgccggcggggtcatctccctgattaaagccctgccgatgatcgtcaccaccttcagagattcgatgaaagacctcgctcagggtcagggttccagcatgctgcggaccaaccagaacctgagcatgaagacggttatcacttggatcatcatcctcatcgtcctgaccgcggtgctgccccagattcccgtgggcatcggcggcgcggtcctcatcgtcgtcttcggcttcttcttcgccgccgtctcttcccgcatggtcgggatcgtcggctcgtccaacaacccggtttccgggatggccatcgcgaccctgttgttttcaaccattatcttaaaagcgaccggcaccaccggcgcagcgggcatgaaggcggccatcgccatcggcaccgtcatctgcgtcatcgcggccatcgctggagatacttctcaggatttgaagaccggctatctcgtcggcgctacgccgaagaaacagcagatcggcgaaatcatcggtgtcatcgtctcggccatcgccatcggcggcgtcctctatctgctaaacgcggcctggggcttcggcaccaaagaactcgcggcgccgcaggccgtgctcatgaaaatgatcatcgaaggggtcatgggcggccagctgccttggggtctcgtgatctccggcgcggcctttgcggttgtcgtcgaaattctcggcattccggtgctgcctttcgctatcgggatgtacctgccggtgcagctcaacgcgtgcatcatggtcggcggactggtgcgcctcttcttcgaccgcaaaaaatacaaggatgaagaagacaagaaaaccaccatcaaccgcggcatcctgtactgctcgggcatgatcgctggggaaggcatcgtgggcatcctcctggccgtactcgcggttctcggcgttgccgacaagatcgatttgtccggggttctgaacttaagtccggcggccggctttgccggttccctgatcttcttcgcagccatgatcgcgctgaccgtgaagttcaccaagggcaaaaaagaagcagcgcctgaaaaggcagaataaaaattgaaaaaacgaccaaaacaaaagctcagccgggatgaaatcattcgtacctacaaagtttacatcccggtggtcacagaaaaaattgtgaaaacagaaatggctgacgacggcaaagtcaccctctttgtcgaaaacaaaggggtgatgaaccgcatttttcagaaaattgcccacaagccgaaatattcgcagattcacctcgacgaaatgggcagcttcatatggcccttgtgcgacggcaagacgaacatcaagaccatcgccaagaaagtccgcgcccggttcgggaaaaaggccgagcctctgtacgaccggctgctgaagttttttgaaatcgtcgaaagctacgaattcatgcgctttatgaaacccgcagactaaaaaacaggctgatagattgaactatcagcctgtttcagactgtagacaaacgaggctctgagaaaatactcagagcctcatttgatttaatatcaagctgcaatttgtagatttataaattgaaatcgaaatataggacgattcggtcccgggtgtttttttttctaaatatattttgctatttttttagattcatgcatgcgaaagtaagcccgactttcattctcatgcgggctttaccatacatttgtgtgtagcggaatccatgcgcttctttcgcagttccgaaaatctctcgatggtttcttttctgcgattataaattgctttcattccgtttgtgtgtcggatgtcctcgcagatttccatgtagtgtgcccataggtgtcgcgagccactttgacatgatttttacatgggtgcactggttaagataaggacagtctttacatatttcagaacggcttttgtattccctgaaaccttcgcggttgtggttgaatattttaaatttgattatggacagataacagtcaaaagcttcatcgtagacgtctcatattttttgaaaaatccctttttcgtcattggtcgtttatacgggaaaacgggtttgataccgtcgtcttgagcagcttagcaatggcagggttttataacctgcatctgcactatcatttccggatttgctctcttacttgtcataaaggcctttaaaggttcgctgtcgtgcagatttcctgcgttacgtcatagcgatgatccatccgtttcggtcgcaggccgtttgaaccgcgtaggcgaagacttgttatgttcgcctttgtgaaaccagccgctctccgggtcggttgtacttactttgatttcccgtgtcttttggagcctgggtgatgttcatcgtcttctgatcgtcttatctttcaacggttttttgtggtggcttcccggtctctttgaatctcttggtttaactgcgtttcataaaacatcgcttcatttctggcaattttcttttgtttcttttattattggctcttgcctttacatgtgtcatctacgagatttctctgggatcgatctttgtttttgtagcattcggagaggatatgtgcgaattttcttcgaaaagatcggtatctttaatcggcgcgtgtagttcttgccaaggtggaaaaatgcggaacttttcgtgcatacttaatccaagaaaccacgataggcaacattgacctcgatttctttgatggtcgacgcatgcttttgatgccgtaaaggtattggataaatggaattttaatcaacacaactggatcgatgcttggacggccctgatctgccgaatacttttcctcaaccagttcatagataaatgaccagtcatggcctcatcgatcattcgaagaagatgatcttttggaactagtcgtccataacatatttgaatttgatctcgtttcttttcaccgttttgtgtcagcatcttttttctcctgcttactgagatgcctggccttttctcattattgctattttaccacgtttgtattgcgacaggtgaaaaatgactgactgctataaaaaaacaaagcctagagcgtttccctctagactttgtcgacagtctgaaacaggctgatagattgaactatcagcctgttttttgatgatgaatataaaaattaaagaaacgaaaaatccatttccggatgggtcggttccagcatgatccggtaataatcgctgtggaacatgatgtggtgattgaccccttcgcgggtgaagacgccgtcgctgaacgcgaggagccgcgttttcggcacttccttccagtcaccttcgagataaggattggtcgcgaataaaagggcttcgtcgccgggggtcgtgtcctcgaggtagtagagcatcgccggcgcgttgttggcgtggacgtaaaactgttccccgtcgtagagaaaaaggttcagcttattgcggtccgccatcgaggcgagcatgctctgaatgacgtcgaagcgttcgtccttgttcagcggatggccgacccggcgcgtcttttcgtcgatcaaatccattaaatagagcagcagccgttcggagtccgtttccccctcctgctgtttgtagtagcggatcaacgccgcgctgttaaagaccgtgccgttgtgaatcagcgtccattcccggccggtgccgtcgtaggccacaaaggggtggcagttgttgacattgatgctgccgacggtggccagacggatatgcccgaggacgcgcttgcgcggaatgccctcgccgattaaacggggcaggacgatcgaatcgaccgcacgttcaggacccttgtgcatacacatccggccctcgtcgtcgtattcagccagtccccaaccgttgggttggtcaacgcttctggcgtaaaaacgggtcaatgcatcggttaaatctttgggctttttggaagaaaatgcaaacaattcgcacatgccccatcactcctttctcaaaattacttattgctttggtattgttttctattataaccgaactgcgccgtgggaaaagccttttattaaaaaaatcccggaaattccgggattataaatcatcgcccatcaataggacgtgtaaaggctcttgtacgggttgtccgcattcgggaagatatggtaatagggtttatcccgcaggatatcttccttgatgtcgaagtattcgcagaactggtcgatcaacggctgaatggccgccatgtccttggagttgcagagctcaatggagacctgcggcggcaggaattccggcttcactgcgcttctgatatacatgttgccgccatgcatccctgtgccgcagtaattgccgatcggcgagctgtcctggctgccgatgcccagcaccaaaatggtcccaccggcctggtattcgccgaggaaggagccgacgcacccgccgacgacaatgaccggctgtttgtccttgtaagccttcatgtgaatgccgacgcgatagcccgcatcgcccttgacgtaaatgctgccgccgcgcatcgcgtagcccagcgtgtcgccggctttaccgtgaatgacgatgtggccgtcgttcatcgtgtcgccaaccgcgtcctgggcgttgccaaagacttcgatgtcgatgttgtcgaggtacgcgcccatcgcgttgcccggcgtgccgtacaccgtcatctttttgtccttgacgccggtgccgatatagcgctgcccgagcacattcttcaccgtgacgtcgtgggcctgggtgtgcttgatttcctcattcagctgtttgtagtatttgttcgttgcatctatgatcatcgttaacctcgcttatcagtgtgcctgagccaaatccgcttttctcacggacacatcaaaggccgcgagcttcggcgctttagcgaggctgtcccaatccactgtcgacaatctggtctgctgtcgaatcaaatcggtgtaaatccccgcgcgctggcattcgcctaaaatcatgtagcccttgagggtatcccccgcaatatagaatttgcggatgccgtccggcgtcttgacaatctggggctggccttcggtactgcccgctgtgagcatatagaagcccttgacgcccatcgagttaatcgggaaggccttatcaaagaccgcttcgccaccggccatgttgatgcctgcggtttcaccctgcataaacgcgttgggcagaatcgcgatgttgcggttcacgtcggcgctgatgtcgtggctctgggtgcagtcgccggcggcgtaaatgtcggcggcagaggtcagctggcttgtattggtcagaatgccccgttcgcatgcgatgccggccgtttcagccagcgcctgattcgggcgggtcccaacggcaaagatcaagatgtcgtagggcagcttcgcgccgtcgctcagcgtgacgctcatgctgttgacgctcttgatgctggttttaagccgcaattccatcccgaggtcggtcagatgctgctgcatgacctgggcgacttccgcgtcgagcaccgacggcatgacccggtcagccaggtcgacgatggtcaggctcgcgacctgatcgattaacgcttcggcggccttcaagccgatgagcccgccgcccatgatgacgactttggcgtccggcttcagggccttcttcacgccctgggcgtcgtcaaaggtcgtgaaggtaaaggcgttcttggccttttccttgccttcgatcggcggcacgaagggattggagccggtcgcaatcaagagctgttcgtaggtgatggttttgccgtcatccgtcgtcaccgagtgcgccgccggatcgatggccgtcaccttagtgccgagcattgtgtcgacgccgtattgtctgtagaaatcgggattgcggtaaaccatgtgttcccgatccacccggccttcaagccagtaggaaatcagcggtctcgagtaggttgagtagggttcgtcggccaccaggacgattttgctccgcttatcgaccttgcggattccctggacgccgccgatcgccgcggcggaattcccgataatcaagtatttcgtcttcatgttctcagcccctttcttcgtaaacaatggctctgttcgggcagccggcgacgcaggccggttcgccgcagctgttttccagacacaattcgcatttcagcatcgtgtggttgtgagacagcaccagacagccgtaggggcacatcgcgatacaggtccggcagccgatgcactggtcctgatcgattttgacaacgccgtcttcaacagacagggcgccggtgatgcagcccttgacgcagtagggttcttcgcagtgacggcagttcaccgcaaaatggatgggttcgccgttcagctcgccgtcttctacgcgaatgcgggacagcggtttctgttcccgatgataggctttgatcatgctcgattcgccggagttggcgaagccgcagttgaattcacacaaatggcagccgaggcaccattcttcattgacataaacgcgtttcaatgttgctcccccttctttattctccggcgtgcttgatgccgaggatttccaattctttttccgtcatgccgacgccgcggagcatcaggcggttgcctctcagtgcttcgatggagttgatccccatgccgcccatcatttctttgatttcgttgttccacgcggtgagcagattgatcaggtgttcggtcccgatatccgggttcaagcggcggcagaggtcttctctctgtgtcgcgatgccccagttgcacaggcctctcgagcactgtctgcacaggtggcagcccagcgcgatcagcgcagctgtcccgatgtagcaggcgtcggcgccgagggcgatggccttgaccacgtcagcggacgagcggatactcccgccgacgacaatggaaatgtcgtttctgattttttcgtcgcgcagccgctggtcgactgatgccagagccagttcgatcggaatcccgacgttgtcgcggatacgggtcggcgctgcgccggtcccgccgcggaatccgtcgatcgcgatgatgtccgcgccggagcgggcaatcccggaagcgatggccgctacgttgtggaccgccgcgatcttgacgatgaccggtttttcgtaattcgtcgcttccttgagggagtagaccagctgacgcaggtcttcaattgaataaatatcgtggtgcggcgccggtgaaatcgcgtcggagccttccggaatcattcgggtttctgcaaccttcggcccaattttgcgtcccggcaggtggccgccgatccctggcttggccccctggcccattttaatttcgatggcgcagccggctttcaggtaatcttcgtggacaccgaaacggccagacgcgacctgaacgatcgtgttcggtccgtaggggtacaaagatttgttgagcccgccttcaccggtgttgtagcaggtgccgcaggctgtggctgcccgggccagtgatttgtgcgcgttttcggaaatggctccaaaggacatggccgagaacatgactggcacttccagctcgatttgcggcggcagcttagaaatcagctcgccgtgggaatcgaattcgagatcgtgaggcttcttgccgaggaaaaccttcgtttccatcggttcgcgcagtgggtcgatggacggattcgtgacctggctggcgttgagaaggatgcggtcccaataggacgggtaatccttcgggttgcccatactggaaagcagggcgccgccggtggtcgcctgacggtaaatttcttcgatggtattctgatgccagttttcgttcggacggaaggtgttttccgtctttacaattttgagggcgcgcgtcggacacatggtgacgcagcgttggcagtcgacacatttggattcgtccgcccgcatgatgtcgtcttcttcgtcgtaaaagtgcacctgttctgagcactgtcgttcgcagacgcggcatttgatgcaccgatcgaaattgcggtgcacttcaaattccggatataagtattgaattcccattacattgcctccttgctcgcgtgaacaatgatcggttcgccgccccgcggcgcccaaatgccgtcgatatccgggcagatgcggcggattgccgcttcttcactggcgatataaacgatgtcgtccttttctccagccaccattgaacgcagcttcaggcggtcattgagggccatcaggccgtgatcgaatccgcagatgatcgagaacggcccggtaatcaaaagactcgagtaagtgtttctgagcagcttcattttccgcgcttctttttcgctcatatgatcgatttcttcccagaacggtgcggcaatgattttcgcgatgtcttcgtaatcaaatcctttcttccgcttcaggtagtcgatgatgtaggtgatgacttccgtatcggtgagcaggttgcatttgtagtcgaacatttcgatgtagcggcggttcgcgtcgtaggacgaaatttccccgttgtgaacgatggagtgatcgagcagcgcaaagggatggcagccgccccaccagcccggggtgttcgtcggataacggccgtgagccgtccagcagtagccgtcgtaatcttccagcttgtagaaatccccgatgtcttccgggaaaccgacacccttgaaaatgcccatgttcttcccggaagagaagatgtacgcgccgtcaatgtacgtgttgacgtagaagacggtttcgacgatgaatttcttttcgtcgatttccccttcatcttcctgaatccggttgaacagcggattgacaaagtagcgccagatgagcggtgcgtcgacgacgttgcggttcgggcggaccggaattcggctcatgttgaccacgtcgaagtaacggtcgagataacgttctgtttcctgacgcgccttcaaatcgtcgtaaaagacgtgaaacgcgtaggaatccgcgtaatccggatagatgccgtagccggcaaatccgccgcccaatccattggaccgatcgtgcataacggcaatggaatcgacgatcgtctggccgttgatgctctggcggcctgtccggtcaatgataccggaaatcgcacaacccgacgggattcgtatttctccttctttctttaacatcctattctccttcttaatcgtcacataaaaagggcgtccacgaacaagccatctcaatggggaaaacccattgaaaatgacctgtgtagaacgcccttgctctcatgtatacaatattatagtatccctattaaatcacattccactttaaaatacaaggcgtttttataaatttaacaagaaaggcagtgggttgtcacgttttatcggttctcttctataatatatacctcaatatcaagccgctatacaccccccgtcccgcgcaggtctgcgtgtctgccgatctgtctccgttgtttgacggcttttctgctcgtttccctttgtaattttattaaaaatcacattgacaaaaaatagggattcgtgtatcatgtatatataaaatttataacaaacacagacaagggcgtctgaaaatagcgatgctattttcgatgccccttttttgtatctggttgtttagttgtttaataaggaggatatcatgtctgaaatgttagaaaagaaagatcagaaagacagcgtcgtcgatctgttcggttccaaggtttttaacgtcgcagtcatgcgcaagcgcttgccgaagcatatctacaaaagcgtcatgcggacgatcaaatacgacgaacccctcggccgtgaagatgccgaagtcgtcgccaacgcgatgaaagactgggctatggaactgggtgccacccacttcacccactggttccagccgatgaccggtgcaaccgctgaaaagcacgacgcttttatcagcccgaccggcgaaggcagcgtcatcatggaattttccggcaaggaactcgtcaagggcgaacctgacgcctcatccttcccgtccggcggtctgcgcgcgacctttgaagctcgcggctacactgcatgggacccgacctcattcgctttcgtcaagggcacaaccctttacatcccgacatccttcatctcctattccggagaaattctggacaaaaagaccccattgctgagatccatgaaagtcctgtccaccgaagccatccgtgtgctgaagctcttcggcgcagccgatgacgtgcacaaggtcacctcttctgtcggggcagaacaggaatacttcctggtcgacaaagacatgtacgccaagagaaaggacttgatcctgaccggccgtaccctgttcggtgcgatggcacctaaagggcaggaaatggaagatcattacttcggacgtatccgcggccgtgtccgccacttcatgcgcgacgtcgacaaggaactgtggtcactgggtgtgccgagcaagacccgccacaacgaagtcgcgccatgccagcacgaattagcgccggtgttctcatccgcgaaccaggcaaccgataacaaccatctgatcatggaaacattaagacgcatcgcccccaaatacgatctccactgcctcatccatgaaaaaccgtttgaaggcatcaacggttctggtaaacacgacaactggtccatcgccaccgataccggcgtcaacctcctcgacccgggcgacgatccggccaacaacctccagttcctgaccttcctcattgccgtcatcgaagcggtcgaccgttatccggaactgctgagatcgactgtcgcttctgccggcaacgaccaccgtttaggtgccaacgaagcgccgccagccatcatctccatctttgtcggcgaccagctggccgatgtgctcaacgaactcctcactggcaaatccagcggacaggcgaaggaacgcacgatggacctcggcatcaacgcaaccccgacgttcaccaccgacgccacagaccgcaaccgtacctctccatttgccttcaccggcaacaagttcgaattccgtatgctgggctccaaccagtccatcgccggcccgaacatcgcgctgaacaccatcgtcgcagaagtgctgcgtgaatacgctgacgccctcgaaggcagcgacaacttcgaagcggactgccgcgaattcctgaaaggccgtctggaagcgcacaaacgcgtcatcttcaacggcaacaactacacagacgaatgggtcgaagaagccgaaaaacgcggtctgccgaacctgagaacgacaccggaagcctttgcagaatactgcatgccgaagaatgtcgaagtcatgtccaagaacaacatctacaccgacgaagaaatgaaagcccgtcaggaaatccacttggaagaatactccaagacgatcaatatcgaagcgaaaaccatgctctccatggcccgccacgaaatcctgccggctgtcatggactgcgaaaaggatttgaccaccgtgctttcacagaaagccgctgtcggtattgaaaccaaggattccgtcgaagcggtcatggtcgaaaagattgccgctctggctaaagacctcctcgctgaaaccgacgcgctcgacgccgtcacagaaaaagcagcggccatcgaagacgctcaggaacaggcgaacagctactgcgcagacgtcatcggcgcgatgaacaccctgcgtgccaccgcagacgaactcgaaacgatcgtcggcaaagaatactggccgtatccgatctacgaagatctgctgttctacgtctaaagcacacgtcatttaactagccccaacaaaacagtctattttatccattctcctatttaacctataagtcatagacaacgtacaaaagaccggcgaacgctgccggtcttttttattgtttcgtatgttattgcgtaaacagatcgcaaaataaaaaagccctgatcgtaattaatcagagcttaaattgccttattatttatatgagcacacgtctttattcgacaatcagtgtttctctatcggcttgatcgccttcgacgtgaaagctgtgcagcaccggctgatcggcgtccattaatgagagaatcaggtagctggccttggagtcgtaggccagacgcttgtcctcgtctgaaggacgagacggcgtttccggatgggaatgccagttgccgaggggcacttcccccgccgcgcgcatctgtttgaccgctgccagctgatcctttggggccatcgaaaaatgctcgttggtgtggtcgatgttttcgacgttgtagacgtgagcgacagtcttcactttgccgtcgatggtgccgcccaaaaggccgcaggcttcctcgggcagacaggcctttgcgtgcgcagtcatcgcttcaaactgcgcttttgtgagcttgatcgtgtattgttcagccattatgtcatctccctctgcacgccgttaattcagcggattcttcgggtcgaaatcgcaggccgcctgttcgtaatcgatgggctttgtgatcgtcggatgatcggagcacaccgcgcagtccggatcccgcggcagcttgacctttctgaatttattcgtcaacgcgtcgtaggtgagcagcgagccggtgagcagttcgcccgctccggttaagtacttcaccgcttccatcgcctgaaggctgccgatgacgccgaccattgcgccgatgacgccggcttcgcggcaggtcggcactgcgccctttggtggcggatccttgaagacacagcggtagcacggcccttccccgggcacgtaggtcatcagctggccctggaagcggataaccccagcgtggcagaaggctgtcttcgtcagcacgcaggcgtcgttgatcaaaaacttcgccgggaaattgtccgtcccgtcgatgacgaaatcgtaatccttcacgatgtccatcacgttgccggagtacagatattcgtggtaggttttgacttcgacgtctgggttgatggcccgcatcgtttccgcggcggattcaaccttgggcttgccgacgtcggctgtggtgtgaatgatctggcgctgcagattggacagatcgacgttgtccgcgtcgacgatgccgattttgccgacccctgccgcagccaaatagactgcgaccggcgagccgaggccgccggcaccgacgatgagcacagagccgttcatcagccgcttctggcccttgacaccgatctccttcaaaataatgtggcgcgaatagcgctcaagctgatcgtttgtaaatgccattaacgtccgcctcccataaagtacagaaattcgacgttgtccccgtcagcgagggtcttttcagcgaaatcgccggaattgatgaaatcgtcattgaccgtcacggtgacgtactggggattttcgacgtcccgttcttcgatgagttcggcgactgtgatgccgtccttaaccgttgctgcttcgcctgatactgtgattttcatgttgtttctccttttatcttacgcgtcgtcttcaccgcggcgcacgatcaaatcgtaggtgccgtcttcattgtcgatgagctttaatatctgatggccttcttctttgatgcttctcggcacgttctgaaccggttcgccgtcgttcatgtgaatggcgatgagttcccctggatccagctcttcgagagccaccttagccttgacaaaggtcaccggacaaaccacgtcggtgatgtccgcgcggttttcaatctgattgatatcgatgtctgccatgtctgcctccaatcttgtgcttaagcttctgcgccggcgaccgcgtctgccaaaatctgctggagttcgtcggtgccgaggcgttcgagggttctgccgaagcgttcgcccttgttcgaatgggtatcaaaataatcgatggtcgcgtccgctacccgcatcagcgtcgcttcgtctttaattaacggcgtcagctctttgccgctgatgatgtggttgccgaaagtcccgccgataaagacgcggaacgcgctcttgccttcccaggcgccggtcgggcaggacttgacgcatctgccgcagtggctgcatttgtccgcgtcaaaaatcagcttgccgtcttcaaaggtaatggccccttcccggcagaccttcgcgcagacgccgcagtcgatgcattggttttcgtcgtagctgacgtcgtaagcgcccttgacgccgaagtcattttcttccatcttcaggcagttgttaatacagcccgtgacaccgaacttgaatttacacggcagctctctgccgaaataacgggcgtcgagcttccgagcgatgtccagcgcatcgatacagccggaggggcagcagcgcccgccttggcaggcggtcaccgtgcgcacgcgggggccgcataccccaggttcgacaccgccttcagccaaagctgccttgaccgcgtcgatgtcttcaagcttgataaacgggatttcaatcccctgacgggccgtcaaatgcacgtacccgtgtccgtattgatccgcaacctttttgatcgcgaccagctgttccgtcgtgatcgtcccgccgacacagcgaagtctcagcgaaaaggtgtttttctgtttctgccgcataaatccgccggcctttaaggccgcataatctactgccattttattctccttctttgtatgtggatgatacaaaaattaccgttatcacaatgatagtgctttttgtctcatccgtcttttccaaaacgttattttaacgtgtccagtgcctgtttaaaatccgcgatgatatcgtcagcctcttctaagccgacggacacgcggaccgtatcctcgaaaacgcccgccgcttcctgtgtggccacgtcggagtggatgaaaatcgtcgaggccgggtgcaggaccagagtcttcgtatcgccgatattcggcagattgagggccagtttcagatgatcgatcaaatcaaaagcccgcgccttggagccgacgcggatcgtcaggatgccccctgcctgaccgcctgcaaattgggcggttcggctgtgccatgggctcgacttaagccccggataattgaccgcctgcaccgcctcactggtttcgaggaaagccgccagcgccttggcattgctgcagatctgcttcatcctgagaggcagcgtttcaaggccgcttaaattcagccaggcgtgcaccggggcgagacaagcgccgatattctgccaggtgctgtttctcagcttcgcggtgaaagccgcagggccgaaccttttacagggcagcacctcgtcgaatttccccgattttctccaggggaaccggccgccgtcaacaatgacgccggaaatggcggtgccgttgccgttgatgtatttcgacgacgaatggatcacgatgtccgccccgaaggcgatgggccgcatcagcgaaggtgtcaccgccgtcgcgtcgacgatcagcgggatgtccgcattgtgggctgtttccgccagcgccgcaacgtccaccacctcaagctttggattagaaatgatttccgtaaagacgaatcgcgtggtggcgtcgatcgccgccgcgacgttgtccgccgagaaatcctcgacgagccgtgtcgtgatgccgaaggcttccagctccttcagccagctgagtgtcccaccgtaaagaccggccggcgcgacaatgctgtcaccgctttttaacaaggtcaaaaaacagcaggcaatcgccgctgaacccgacgcgcaggctgtggccgacaggccgccttccagtctggccatttgattttcaaaggcattgaccgtcggattgcccacccggctataggcgtagccgggtttttgattcttaaagatctgctccagctctgccgccgtcgaatgggaaaacgcggaggtttggtaaaccggcatcatggacgcgcccatcatgtctgtctggtttctcgggtgcacgtacgccgtcgacgatggggttgtttgttcatttttcataccggctactccttttctgatcaaaatcatttattacttatttaattactatttttaatatgtattgattgtaagcttttctacggtttctgtcaattccaccggttctagtatttcttgatgtgtcattataaaaaaaatttataaccagcctcaccgcaaatccgcgcaataaaaaacctctgccgattgaaaaattcaaatcgacagaggtgatttcgactgaaaggatcaattagttgttgatcagtttgtcgtcgtcgctccagctgtagagtttgcggatttcttcgccaaccttttctgaaggatgatttaatgctttcttgcgcattgcctggaagtgaacctggttgccagcgctcatttcaagcaggaagtcttttgcgaaggtgccgtcctggatgtctttcaggatgtcgcgcatcgcctgtctggtctgttcagtaacgatcttcggaccagaaatgtagtcgccgtattcagcggtgttggaaatggagtagcgcatgcccttgaagcctgactgatagatcaagtcgacaatcagtttcatttcgtggatggcttcgaagtaagcatttctcgggtcgtaaccagcttcgcagagggtatcaaaaccagcctgcattaaagcgacaacgccgccgcagagaacagcctgttcaccgaagaggtcggtttctgtttcggtcttgaaggtcgtttcgaggataccagctcttgcagcgccgaggccagcaccataagccagtgccagatccagagctttgccggttgcgtcctgttcaacagcgaccaggcacggtgtacctttgccagcgacaaattcgcttctaacagtatggccaggagccttcggtgcgatcatggtgacgtcgacatcttccggcggaacgatcgtgccaaagtgaatgttgaagccgtgggcaaacatcagcatgttccctgcttccaggttcggtgcaatgctttctttgtaaagatcagcttgcttttcatcgttgatcaggatcatgatgatatcagcctgttttgctgcttctgcagaggtgaatacttcgaagccttcatcttctgctttcttccaggatttgctgccttcgtacaaaccgacgatgacatcgcagcctgaatctttcaagttctttgcatgggcatggccctgtgaaccgtaaccgatgactgcgatctttttgcctttgagcagtgacagatcacaatcttgttcataaaacattcttgcttcagccattttatgattctccttttgatctaatttgcatattgtatacgatcttttgtttcgcattcaatacacttgttgaaaacacttatcattctaatgacaaattttgcccttgtcaaggcttttatcgcgtttttatttttgtatacaattacaaattttcaccgctttcgcacaaaaaagagccggtcaacagaccggctcgcatttgcccttagaggaaaatatacttgagaatgaacagaatcgacacgacgaccatcgtgatcgagatcttttccttcttgccggtcagcagattgatcagcgtgtaggaaatgaagccgatgccgatcccttcggagatgctgtaggtcagcggcatgaaggccaggcagaggaatgccgggatgccttcggtcggatcgaagaagtcgatctggacgacgttctgaatcattaagaaaccgacgatgatcaaagccggcgccgtcgcgaaggacggaatggccaggaagatcggcgagaagaacagcgccaccaggaataacagggcgacgataatgcccggcagacctgaacggccgccttctgaaatcccgagggagctttcgacaaaggtcgtaacggtagacgtcccgaagcaggccccgatcgtggtgccgatggcgtcagcgaggagggcgcccttgatgcgcggtaattttccgttttcgtcgatatagccggccttaaccgcgcagccggtcagcgtgcccagcgtatcgaacaaatcgacaaacaggaacgcgaagatgaccgtcaaaaactcgaatgagaagctcttcggcagctgcattttcataaacgtcggcgccatcgacgcgatggtaataccgccagaaaaatccgggatcagcgaatacagcccgagcttcggcgtcggcacgtagaagcccagcagctggcagacgataccagcggcccaggtcgccagaatgccgagcagcacactgccccgtacgcccttgacgagcaggatgccggtgaaaatcgtcccgaacagcgccagcgcgaccgtcaggccgagagttgcgttcgtcgcggtgctccatttgaacatcgtgaccagcgtcgaatcgtcattgacgacgatattggcgccctttaggccgaccagcgcgatgaacagcccgatcccagcggatatcgagagccgcaggctcttggggatcgcattgaaaatcgcttcgcgaacgttggtcaagctcagcacgatgaagatgatcccttcgacgaagaccgcggccaaggcgacctgccagctgtagcccatcttgatgcagaccgtgtaggcgaaatacgcgttgagccccatgcctggtgccagggcgaaggggtaattggtcaacagcgccatgatcagcgtcgcgaccgcagaggaaatagccgtcgccgtgaaaaccgcgcccttgtccatccctgttgcggccaacagagacgggttcaccgcgagaatataggccatgcccatgaacgtcgtgaaccctgctgtgacttcagtccgcaagtttgtgccgtactcgtcgaaatgaaaccactttgccagtttttctttcattgatgattcctttccacagattgctctgttgtacataaatataaaaccattaagacagtattaagattatcagaacaatccggaaatttcaagctttatcgaagatttctctctgacgataaagggtagtggtttcgcggtgctttttttcaatcggctttctgattttaagatggctgtgatactccggataggcctgatcccccggcatcggcggcgtgtcgtaaaagggcacgaagcccgcttcgatctggccgatccccatataccgagccttgaaatccttcaaaagcgtccagaaatcgcgacgcagcaagaagatcgaaagcaggttggcaaaaactggaatcgccagcgtgatgtccacaatggcccagaacagatcggggccgttgcccgtcagcacaatcgatgagacgatcacaatattgggcagcgggaacaaaaagcggaagacactgatgacccgatcccgcgctttgggccagcgccgcataaagtgctgaataatcgacagatagtacgaaaaccagccagaagtcgtggtcagcccgaagaaaaacatcatgacgccgataaagacgacaccgatttggccgtagctctgtctgaatgcggcaattgccagactcgcgcccatcgttcccgaattccagacccctgagcagagcaccgaaagggcggtcacggtgcagatgatcatcgtgtcgacaaaaacttccgccgaaccccaaagtccctgcgcgaccggatggggcgtatcggctgagccgtgaatcagcggcgacgagccctgccccgcttcgttggaattgatggagcgcgccagtcccgttcggacggtaaccgccaccgacgccccgacgaatccgccgctcgcggctgtcggcgtaaaggccgatttgaaaatcatcgcaaaaaccacaggcactcggccgatgttcagcgcgatgatgccgacgccgcccagcagataggcgacgcacataaaaggcactgctcgggaagcaaatttcgcgatgcgcggcacccctctataaatgatataaaagagcagcgccgaatagattaacgtgaagacgatcatgttcatcccgaagcaggtgttcaaggattcggcgatggaataggcttgagagccgcctaaaaactgcaggataaagccgattccgaataaaaaggccagaatccagccggaacggtgtccccgctttttcaccagccctttttcgaggaaatacgtcgtgccgccgtaaaattcgcctttgtcgtttcgactccgataatagcagctgagggaggtttcgacgcatttgacgatcatgccgaaaaaggcccagacccaaatccagaacaccgcacccgggccgccggtcgcaatcgcggtggccacgccggcaatattgccgttgccgaccgtcccgccgatggcgatgcaggccgcctcgaaggacgaaatgtgccggtcgctgccttcatcctgcccctttttccgaatcgaacggcccagggtccgcttcaaaatatacggcagatgggcgatcgtgaagcccttgcttcgaacaaagaaatacccgccaatggcgataataaaaatcataaaaggcaagccccaaagcagactgtcgagggcttgaacttgtttgaggtagtgcaaacttccgctccttcttcttgtgattttactaaaatagcggattgatccctttttgaacagaatcaatttgacgcatttgtgcgtttccgaacattagcggccatttgttcgatttttcgatattttgataataaaaaaacagcgaagcggatctcttttcgtttcgctgtctatcaaactaaaaaatttataacttcaatcgacgttcagcgccttttctctcgcctcgcgttcccttttctgtttgatgccgccgacgatcagccaagccgccacgcagcccagacaaacgaaaagaatgatcgtcgagagggcattgatttccggcgtcaccccttttttgaccatcgagtagaccttaatcggcagcgtcgtgatccgtgcgctggccaggaaactggtcacaatgagctcgtcgagcaccaaagagaaggacataaacgcgccagagagcaccccgggcatgatggccggcagggtcacgtggaagaaggtgtagccgcggtcggcgcccaaatcgtaagacgcctcctcgatggacgggtccatccccactagtctcgcgttgactgtaatgtaaacatagggcaggatcagcgtcgcgttcccaatgataatcgtcggcatgccgagttcaatgcccatccggtcgaagaacaacagcagggcaacccccaaaacgatttccggaatgacgatcgggaaatacatcgagtagtgaatcagctccttgccaaaaaactggtgctttctgaatccaacggcgccaagggtgccgacaaccgtgccgatggcggtggcgaccgccgcgatgatcaaggtcgtgccgaaaatcgaccagaggtattgatcttggaacagctgcttgtaatactgcgtcgtaaaccccagccaaatcatattcgcccggctgttgttgaaggaatacaccaccatcaccgcaaccggtgcgtaaacgaaaatcatcacgacggcgacgacaatttttaaaaacacatcactggcgcgccggttttctcgttgtttcacaattttctccttcccaaagccttttatcccaaatcgtcgagattaccgccgagtttcgtgtaaatgccgaccatcgcgaaaattacaatcgccagcaccatcgacagcgctgccccaaagggccagttccgcgcaatggtgaactgcctgtcgatcagattcccaatcagcatgctcgtgccgcctcccagcatatcagtgaccatgtagtagccgacacaggggataaaggtcagaatcaccgcggcaaaaatgcctggcgaggttagcggcagtgtcaccttgaaaaaggtgcgcaccgggctcgcgcccaaatcctgagacgcctcgacgagattgtaatctaacttttcaatcgaggaatacatcggcagcaccgcaaagggcaggaacatgtacagcatcccgcagatgaccgagaagttggtgtacaacatcgattttggcgatttgatcaagccgatgtgcattaaaaaggtgttgatgatccccgaatgattgagcaggatgacgaagctgtaaatgatgaccagcccgctgacccacatcggaatcatcaagagcaccatcatcacgcccgacgtccgcgcgcgcattctcgccatggccgtggcgaagggataccccagcaatatagtcagcccggtcgtccagcccgcgataatcagcgactgtacaattacgttaaggtaaaccttatcgccgagggctttgtagttggcaagcgtaaacttcggcacgatcacgccgagggcgcccttggtcataaagctcataacggcgaggattacaatgggcaccacaataaacaaaagggaccacgccgtcatcggtccgcagagtacgatcgccgacaggcggtccttcaacgattttttctcagaaatgtgtggcgttggcttcatcgactgcctcctgtaaatccacaaccgaattggttttaaaccaggatttgttgcggaaagtccgggatttccccggttcccagtacaaattaatgacctgtccgaccggcgccagttcatcttctccaaatcggttaatgcgaaccgtggagccgtcgttgagcttcacgatcattttgatcatatggcccatgaaaatatggtcgctgaccacccctttgattgaaaaatgatcgactggttccagcgaaaactgcatattctgcggacgcactgcgaccgaaaccgcgtcgccagtcttgatatctggatcggcaattaaacttctggcctgcccgttttcggtgccaactttgaggaaatcgccatcctgtcccatcgcgaccgcgtcgatgatattggactcgccgataaaatccgcgacgaagcgggtggccggttcatcgtatattttctgcggcgtgtccagctgctgaatttccccctcgttgatgacggcaatgcggtcgctcatcgtcagggcttcttcctgatcgtgggtcacgaagacgaaggtgatgcccagttttttctggagctgtttgagctcgatctgcatctgcttgcgcagcttgcggtctaacgcgccaagcggctcgtcgaggagcaggaccttcggctcgttgatcaaggcgcgggcgatggccacgcgctgtttctggccgccggacatctgcgcgattttccgcttctcgaagccctccagctgaaccagcttgagcatttccgtcacccgctttttgatttcacttttcggacgtttccgcacctttaagccgtaggccacgttgtcggccacgttcatatttggaaacagcgcgtaattctgaaacacggtattgacgttgcgtttaaagggcgggatttgatcgacgttctggcctcccaggcgcacttccccgtaggtcggcttttcaaaccccgaaatcatgcgcagcgtcgtggttttgccgcagcccgacggcccaagcagggtgagaaattctcccggcatgatatccaagttgcagtttttcacaacgtgattgtcgccgtagaatttttgaacgtcgaccaattgcacgattggctgtttttcattcatcgtctggcctccattacttgatggcgtcctccccgcgctcgttggttctgatccgcatggcatcgaccacatcagtcacaaaaaccttgccgtccccgttggtgccggtaccgatggccgtctgaatgtctgcgagaatttcttcaacctgttcgtcttcggtgacgacaaacacttcgattttcggcaaaagattaatatcgtccccgacaaaattcatttccggcagatagccccgctgtctgccgcagcccatcactgagctgaccgtcatgccctggcagttatgggtcatgaagattttcttcaaagcaacgagtttttcaggccgtgtgattacatcaatttttttcataatttctttccttttttaatttttctggactacttttcgcccatcaacttcgtgtaatagctgtccatcaacgcgatttgtttttcgtcgacggaaacgttccacgaattgtgaagcagccgctgggagctcttaatcgacgggttcttgtaataatttttcggcagatacttcgcaatggccgatttcttttcaaggggcaccgcgtagtattccttgtagcacttggccaattccttcggtctgagaataaaattgatcagctgctgcgcttctttcttatgggtcgaagccttcggaaccgcccagtactgcatgcagtattcgttgccgcccttcagcggaatttcctcgaacttatcccagttggtgtcgctgtccccgcaaagggtcggataatcccagctgaacgccaccgaacactcgccgctttcgagctgtgacacggcgctctcgccgacaaaggccttgacgtttttcttgatctttctgagcagcgcattcgcctcggcaatctgagactcgtctgtcgaagccgcggaataccccagatcctgaagggccgccccgtaaagggagttggtcgcgttaaccatagccagctgatcttttaacttcggattagctaaatcgctgaaccgggtgattttaatcggacaggttttcttattgacgatcacagaggtgtagctcggcgccatatccggcacggtatattcgagattcttatccccaatcgggccggttttcttataatcgtccacaatgtacttggtattggtgatcttgctctgatcgattttcgccaacaggtcgtgctgaacgaagggcttaacgtaagccccttccaaatcgatcaaatcgtaatcggcgttgccttggatcagcttggacatcagcgtatcggtgttgtcgacgtagctgatgttcaccgtgatgcccgtttccttttcaaagtcttggaacatttcttcggaccaggtcccgtcccagacaatgatattgagttccttgtttgattttttcgactgtccgcagccggacaggcacatcaaagctaaagccgctgctgtcaaaatcgcagcggctctggctaaatttctttttaaaatcataggacaaatcctgcgatcaagtagagcgcagccgaaatcacatcggcgatgaggaaatagggcagtgacgtttcgtactgttcgtaaatcttgacgcggcaggctctcgcggagatgacgccgaggtcagagacgacacaggcgttggcgccgaagaggccggcggagatcaaagcgcccaggcacagcggcacgttggcgccgattttcgtaagcacgaccatcaataccgggatcgcgatttgatacagggtgtagttcaggctgtagaggtattccgtcagtgagaagaacacaaacaggatgaacggaatcagattgacgaccggaatcccgccgagcacggaatgcacaaaggcttccatccccatgctgtacatgacgttctgcatgatgtagccgatcatcaggatgatgaccatatcgcacatatcgatgaagccgtcgacgatgcattggacgtattcctgaatcgtgaacaggccctggcagacgtagagaataccggtgaacaccgtcgcgaccatgaaggcgacaaagcagtcgaggccgctggcgatcagcgcgacgacgatgcagacgatcggcaggaccaaattgaggactgagcagtgcttagtccgcgggttgtccggatcgtagtcttcttcttccgcttcggagccgtcggtcagcgcgcccatttggacgccgtcttcttcaatcatgcggtaggcttccttcattttgccgattttcggcacgatgcccactgcgaagagcatggcgatgacgcaggcgacgatcgcgtaaaacatatacggaatggactgaatgaaaatatgcgtcgcggccgcgcggttgggcacgtttttcgccgccgcgatctggtagacgacgaaatacccccacgccccgacgggcagcagctcggacacgttaatgctcaaggttcggatgacgtaggccagcgcaagccgcggcttttgaatcgcgtcgatgagcggcgaaaaggccgcgccggcggtcagcgccgagacgtagtcgtcaatcgaggtggccccggcgtaaatcccggaagtcgcgagaatcgccttttcgttcctgccgaaatggccggtgataaacttcgtaaaggcgttggtcgcgccgctgcgcttcatcgcgatgatgatgccgccgcagaggaagaacgacatgtacatttcgatgttttcctgatcggcgaggctggtcagcgtgtctttcataaagccgtttaaaaatccgcccttgtaccacagaatgtacatcgacagcgtccccatcagcagagagctcatgacgtccttcgtcgtcagcgcgtagacgaacagcccggccagcggcacgaaaatcagaatcgatcccttggtcaccgactgcgggatcagccacagcacgacgttgaggatgatccagaacgtccagagcttgaccatctttttatcgatgtgtttcgggttcatgtaatacccgatgcgcttgaagatattggcagtctccataattttatcctttctaatcaaacaaacgcttttacaagcggccctcgtagacggccgtcatcacgtttacaaaatccgtttcgttcatcatcaccggattgtccgccgtttcatccgcgttggccgccgtcttggcgagcctcggaaaatccttcgggtcgacctgttcgatgtcggcgaatttgggaatgtgcaatttttcggcgagagccgccattttgtcgatgccggcgatggcgaggtcctctgcactgtcccggctgtcccctgcgcccatggcgcgggccacgtcggcgtagcggtcgaccgcgcccttcacgctgtagcgggacaccggcgcgaggaacatcgcgttggcgaccccgtggggaatgtcgtaaaagccgccgagggcttccgaaatcgagtgcaccgaggccacgtccgaattgccgaaggccatgcccgccatcgtgctcgccgccatcatcgcgtcgagggcttccggatcgtgggtttcgacggctttgacgatgttgtccgagatcaggcggatcgccgacaaagcgatgccgtcggtcagcgggttggccgctttgcagacgtaggcttcaaccgcgtgggtcagggcgtccatcccggtggagccgagaatggatcccggcaagtggtcgatcacggtcgaatcgatgatcgccgtcgtgactgagttttccggcccccagatgcagtccttttccaaggttgtggtattgttgataatcgattcgtgggtcacttcgctgccggtgccgcaggtggtcggcacacagatcagcggtgcgatcggatgctcgaggttgccgtcggtccagtcggcgcagacgccaccgttagtcatcagcgcgccgatggccttggccgtatccatcgacgaaccgccgccaatggcgatcaggtagtcaatggcgtgggccttcgcgtattcggcgccccgttcgatgtcgacgtctctcgggttcgggacgatatcggtccagacctcaaaattgagctgcttcgcctttaacgcatcgataattggatcgacgagaccagtcgccatcagccctttgtcggtgaccaccaggcccttgtccccaagcttctctgcttcgtcagcaatctgattcaaactgtcccgtccaaaaataatatgtgtcggtgtaaaaaattcaaatgcgttcatgcatatcctccttccccggattgcgttccaataaaaaaagcaaagatgcacctgaatccagttgcgtctttgcttagtcattcggatcaataaaactttattaatttgtacttatattataaagcttggtgttatactaaggtcaaatctttttttacattgcaaggggaacccatgaaaaataaaaaaacctttcgcatcggcgaattgtccaaattgttcggcgtcagcaccgacgccatccgctactacgaaaaggtcggcatcctgaacccaaagcgcaatgcggagaacaattaccggtattacacgctggacgatgtccgaaagattctgacgattcgagagctgctcagcctcgacttctccaccgatcagatccgggattttcaacaaaaccgcagcatcgccaaaacccaggaaatgctgaaggaggagttggccgtcgtcaattcggaaatcgtcgccctcttcgagaaaaagcacagcatcgaaacccgcatcacctctattgacgacagtctgtctctcacggccgatgaaacggtgcgctgtctaaatctcgaggatcgggaatgtctgatgatcagccagaccaatctgcccgacgactacgtcgactatttcgtcacccgctacatccacacccacagcaaccgcatcgacaccatcggcgcctgtgactgctacacgctggatctggccggcagcaacccggaatcccaatactaccgcactgaaaatattttcttctactcgaccaaccagttctatcagacgaattacgtgctgccagcgggaaaatacctgtcgctggtctaccagggccacttgtccaaaacgaaaaagctgatgccgaagctcttcgactacgccaaaagccaccatttaaaaattgccggcgacccgatcgagatgtgtcacctcgacgagtacgaaaccgacaatcacaatgaatttattacggagctgcagctcccggttcattaatatttaattttagttgcgcaattactgatacgggttgaaacggtcgtagcgcagggcgctcatatcaaccgcagtttcttcgcccatggccatctgtgccagaatcaggccgaccgccggcgcggagccgaagccgtgaccggtgaagccgcaggccagaatcaatccaggcaccacgtcgaccggcgaaataaccggcacgccgtcgatgcacatgtcgagccagccgccccaagagcggacgattttcgcgtccttcaacgctggaatatagccttcgatggctcggcagctggacggcagcgtcatcgaaatggttttgagctcgttcagcggcatgtcgatgccgtcttccaaaccgcagtccgacccgaaaacgaaggagccgtgcttggtctgatgaccgtagaaattggcgtcagccgtcccgagcatctgcgggaacatttccggctgggcttcggtgaccagcgcctgatcgaaatagcgggtcatcggcacgtcgatgccgacggtctgcacgatgtagcggctttcgtagcccgccgccacgatgacggtatcgccttcaaagacggtgccgtctttgaggatgacctgacgcaggcggcccttgacctttttcagggactgcacttccgcgccggtgtaataccggacgcccatcgacagggattttttgtaatagcccagtgtggccatcagcgggttggcgtggccgtcggtcgggcaccagctagcgccgatgatgtcgtcggacaggtacgggttgatttcccgcacttcgtcgccgtcaatcattcggacatcaaggccaaccttcttcgcattgtccgccagggtctgcagtttttcgagatgcttttccgttttgcccagtctcaaattgcccttttgggtgtattccacatcgacgcccagttcatcggagagccccggccacaaattttgaatcccgtacatgacgtagggcagttctctgacgtcccggccgctctgacggacaccgccgccgtttcggctagatccgccgtgtccgatgctgtccgaggcttcaagcacgatcacgtccttgacgccctttttcgctaaatagtacgctgcggcgcagccattgatgccgccgccgatgatgatgacatctgctgtttgattcatgcttgttcacctccgtctcttccggcaatttccatttcagtcgggcgcatcggcgcgcggctggtcgccggcgtcacatccgtcggggcgacgcctaattctctggcgacaatccccttgacgagcttcccgcaggtctggccttggcagagtcccatgccgcagcgcaggtaccggcgcagctcttcgatcgtaaacatgccttcgtgaacggcctttcgaatttcacccttggtgacttcttcacaccggcagaccagcaggtggtcgtcgtcagccggtacgtaggggccaattttcttcaatacttcttgaatatctgtcatctcagttctcctttaatcccggcttttgaaaaaacgggcctgcatcaatttatcgttcggtactttgatcgtcaaaaggttggtgtggtcaaaggctttggcgctgcggatcttcgtaacttccgcatcgcagactgccttgccgtcgcggccgagggccacgcccttgtcgcccttttcaggcaatggcaaaaattcgtaaggcatcgtgacttcgccgtagcccggttccacgtcttcttcgacgaggaagatggcctgccctgagcaggacgcgacgcacatgccgcagccggtgcactggctgccttccgtcacaaccggaagtgaggtgatgttgtcgccgatggagatgcacccaaatttgcaggcatcctggcacgggttgcacgggatgttctgggtacattcgatcacagggtggatgcccttcttgtgggtcacgcctggatagcgttcgatttcgtcgtcggccacaaatcctttttccaataagttttcagaaacggcgataccttcttcggtttcggtgattttcttgccgcggttctgcggtgcgaacatcccctggcgcagtgcgtccagagctttttcctgatcgttcacgcgtttcgccttttcgtcgtcgtcgagatagccaaggtaattggctacggcgagaccggcgatgcgcccttcgatcatcgccgagctggcttcttcgataccggtgacgtcccctgcggaaaagacaccgtcgatcgaggtcatgccgtcttcatcgatcaccgggacgtagccgcccttggtgtcgtccatttgacagccggccatgctgagcagctgcgccatcggtgagaggccgacagccaggcagatcgtatccacatcgaaatgcttttcgctgcccggtttgattttccaatccggtccgacttcgccgatgacgacgccggtaacgtgatcgtcgccttccgcgcgcataatcgtgtgggacaggtagaacggtacgccgcagcgggcaaccttcgaggcgtggacgccgtacccgccgactctcggtgccgcgtcgaccaatgcgacgacttcacagcccgcctgcatcagctgatagctgacgacgaggccgacgttgccggtcccgagcatcaaaatccgttcgcccggcttgacgtggtgcaggttcatcattgtctgagctgcgcccgcgccgatgacccctggcagggtccagccgtcgaaattaaccatgttttcgctggcgccggtggcaaccaagatgctgtcgccctgaacgtgtttgatttcgtcgccgatgcgcaccgtcacttccttgccgtcaaagaggccggtgactgtcgcaccgagcacgaccttgacgccgacggattccgcttcttcgagcaattgcttgccgatgttgaagccgcgcattttggccttgtgttccttggagccgaaaaatttgtgaatctgtttaaacagctggccgcctggtctggcattttcatcgaagacgacgggcttgatgccgcattttgccgcttcaatggctgcggaaagccctgccggtccagcgccgatgacaatcatatcgtagcgttctattttcatcttacacgttcctttctgctgataccccgtattgggtgcggacatctgtgccttcttcgagcggcgtgatgcaggttctgatattgggcttgccgttgacaaccatgacgcagtcggtgcagcggccaatggcgcagaagatgccgcgcggttcgtgacgtttcgcggtgtagcggtgaaccataacgccggccgccttgagggctgccgcgatgggttcgccttcgtaaccggtcatatctttgccgtcaaaggtgaaatgaacgagcttgcgttccggtgtttcacctaaaatcggatgatttgcgatgcgtttcatattgatctcctttatctctgttctcagagggccttcggctgatcccacagcttcagcttcgtgccgatgcccttcttcaatgcgttttcgtagcattccgttccccaggccacatcttcgattgggatgccttcgatggaaactaaaatcatttcgtcgtcggatttgcgcccgggcttcttgccgcggacgatgtcgccgagctgatcgatggtgtccaaatcgaggaggccgtctcttgacatgtagacgaaatcttcgcccatgcagccggtgtgttcgcggtcgccgttttcgtcgtagccttcttcgtcttcgtccgcgtagttgacgaacatcccgaggttgtcgacgaccttgcgcatgtcgacgatggagcggtaattcatattgaaggcgttggtgcagatgaaggtaacgccgggcttgaaccattcggccttgtattccggccattccccttccttacaggagatggcttcgaccacaatgtccgccgggcggatcgcttcttccatcgtcgcgcagactttaatatccttgacctgcggcgcgtttgccttgacgaaatcgacgaaagcgtgcgctgttttagactgcggcgtgctgcccttaatcaagacggtgtcgatatttttcatctgagacatgaccgccaggaagttggccttgccgataaccccaggcccgagaatcgacagcaccttggagtccggacgggccagctttctgactgcgagccctggcatggcgccagtgcgcatcgcgctgagcaggttggctgacatgtacgcgaggggcatcccggtttcgacatcgttgagcatgaacatgaggatggaacggggcagcccgcggctgcggttgcggccgttggagccgtaccatttcacaccggctttgtgaaaacgtccgcctaaatacgcgggcatcgcgatgaatcggcggtccgccgaatcgttaagcggaaatcccggaatcggtgattccttcgggaaaaacagcatcaacccgtgagcatcgtggttaggcccgcccatcaggcagtcgccatctgacagcaatcccatggtttcttccatcacatcgacacagcgtccggcatccagaacgccagcttcgatcatttgatcctcatctaaatataagatatccgcttcacggctcttcttttcgtccatccttatctgtcctccttcacaaataaaaaaaagtactgctacaccccaaacggtgcggatcagtacctctttgtacgacgtgtttatttctgttgttaaccccatgttaaacgctggcatgatacaaaggtcaaggggtctcgttaaatttttttgattttttctaaattctgcataaaaaaatccatccgcaataatattgcgaatggattatttttaaactcgattattttgtgtaatcgtagaagccgtggccagtcttgatgccgagtgcgccgccgcggaccatctttctcagaagtggtgctggagcgtatttgtcggaacccgtttcagcctggagaacttccataacagccagaacgatgtccaaaccaaccaaatcgccgagagccagaggtcccatcgggtggtttgcgccgagtttcatagcggtatcgatatcttcagctgaagcagtgcctgcagcgtagatttcgattgcttcgttgatcatcggaacgaggattctgttgacgacgaagccagcagcttccttaacctgtacaggtgttttgccgatttcgacagcaatgtctttgatcttctgaacggtttcttcagatgtattgtagccagcgatgacttcgatgagcttcataaccggtgctgggttgaagaagtgcataccgatgacgtcacggttcacaccctgagcgatttcagtgatggaaagtgaagatgtgttggatgcgaagatgcattccggtttgcagatcttgtcgaggttctggaacatttcgtgtttgagttccatcttttcgaggattgcttcgacgatcaggtcgcaatcgccaacagtgtctttttcaaccaaacctgttgtgattttgcctaagattgcgtctttcttcgcttcatccattctgcccttggatacgctgcggctcaaattcttttcgattttagctttgccgccatctgcaaattcctgtttaatatcgcagagaacaacttcataaccatctgtctgagcaaatgcctgagcaatgccagatcccattgtaccagcgccaattacgccaactttcatattattacctctcaaatatttaaatcaatacacaaacaccgagggaagatggtcatcctccctcgaaaatcgttgaaaattaattatttgttctggaacggttcgtgtttccgtttttccatgaatgctttcatgccttccttctggtcggctgtttcgaagcagtcagagaaatgtttgacttcaacctgaatcgcgtcatccatcggcacgtcgatgccttcgttcatcgcagcctttgcagcgcggactgcaatcggtgcctgaaccgcaatgcggttagcaagcttttcagctgccggcatcaattcatcctgcggataaacagcgttgacgagaccccatttcaaagcttcttcggctttgatgttgatgctggcgtagatcatttccttcgccttgccaacagggattcttctcatcaatctctgagtgccgccgaaacctggtgtaatgcccaggccgacttctggctgaccaaatatagcgttgtcagcagcaatgcggatgtcgcaagccattgacaattcacagccgccgccaagtgcaaaaccgttgaccgctgcgattacaggaatcggcagggtttcgatttttctgaatacacggttgccgtgttcgcagaattctttgccttctgctttggtatcttcagccatttcaccgatatcagcaccggcaacaaatgattttttgccggcaccggtgatgattaagcagcggatcgtgtcgtaatcaaccgcatcaatcacttcttcgaggtcgttcagaacctgagtgtttaaagcgttgagtgctttttcacggttgatcgtaacgattccgattaaatctttagcttcgtatgtaacaaaactcatattgccactcgactttcgtaagttgattctaaagctggcttactgcaggttttcccaagcagaagcaacacccataccaccgccgacgcagagtgatgcgagacctttcttagatcctctcttcgccatttcgtacatcagggaaacaacgattcttgcaccggagcagcctaccgggtggccaagagcgataccggagccgttgacgttgcatttatccatgtcgatgtgcaggtcgcggatgcaagcgatagcctgagcagagaatgcttcgttgagttcgatcagatcgaaatcatcgatggttaaacctgtgcggtcgaacagtttgtggcaagcgtggatcggacctaagcccatgacttctggttcgcagccagctgatgtaccgttgatccatctcattaacggtttgcagccgagttcttctgctttttcagcagacatcataacgagagcagcagccccatcgttgataccggaagcgttagcagcagtgatgacgccgtctttcttgaatgccggacgcagtttgctgatgctttccagtgtaacgcctttacgcggatgttcgtctgtatcgaagacaaattctttcttgcgctgttttacagtgattggcacgatttcatctttgaagcggccagattcgatagctgcattagctctttcctgagacataacagcgatcttgtcgcattcttcacgagtgatgccgtatctttcagcgatattttcagcggtaacgcccatgtgatagtgattgaaggtatcttccagaccatcagagatcatcgtatcgaggaattcgccagcgcccattctgtaaccataacggccgcctggaacgacgtacggagctcttgtcatgttttccataccaccaacgacaacgacatctgcgtcgccagctgtgatcatgtcagcaccgaggttgatgcacttcataccagaaccgcagaggttgtttaatgttaaagctggtttttcaacaggaatgcctgcgtaaacagcagcctgacgagcaactgactggccctgtgcagcctgaaggacacagcccattaaaacttcgtcaacgtcatctggcttgatgcctgcacggttgaccgcttctttgataactgttgaacccaactggacaacaggtacatctttcaaagaacctcccattgaaccgatagccgtacggcaaccgctgacaactacaatttccttagccataaatttccctccataaattaatttacaaaactaaaatgtgagtgttcacattgttatggtgaccctagcgggtctctgttaaaactataacaatcatatcatactttatgaatttgtcaataagatttcattattttgcaaattattactctttttattttaccgtttttaagaaagattcaattcaaaataaaagggttgcagtctttctacatattatataaaaattttcggccttctgcatcaagttcaatttaaattttctaaaaattaaaaattttctttgatatgcgcttatcttatttttttctgcgcatgatctgtatttcatgctataatgttgacgaatatctaaaaatttttaagcaatccaggtggaaagcaaattttcatcttttatttacaaatcaattctggaatcaattcttattgaaaagattttacacggaggcagtatggagtttaacgaaattctcgaattaatcgatcgttttgatcaaagcgacgccgtttcattaaaatggacccacgagggcgacgcgctcgttctgaaaaaagccggcgcttatccggcaaaagcggtggcagccgccgctgcaccagccgttgttccggccgctgcaccggcgccagcgcctgcagtcgatgcgccggaaacaaaggacgcaccggaagccgaaagcgccggcgacacgatcaacgcgccgttggtcggcaccttctatcaagcgccgtcaccagatgacccgccttacgtcaaggctggtgacaccgtacatcagggcgacacggtcggcctcatcgaagcgatgaaaatgatgagcgaaatcccggcgccctttgactgcgaaattctcgaagtactcaaagaaaacgccacgatggccgaattcgacgaaccgctgatgcgcgtcagaaagctgtaagccatgttccgtcgaatactcattgccaaccgcggcgaaatcgcggtccgcgtgatccgcgcctgcactgaaatgggcatcgaatccgtggccgtctattccactgccgacaaagactcgctccacgtgcagctggccacccgcgcggtctgtatcggaccgccgccagctaaggacagctacctcaacgaaaacgccattcttcaggtcgccaaatcgacccggtgcgaagccatccaccccggatatggctttttgtctgaaaatgccgacttcgccgaccgctgtgccgaagaaggcctcgtctttatcgggccttctggcgacgccataagaaaaatgggcgacaaggccgcggcccgcgagctgatgcaggcgaacggcgtcccggttgtgccgggcagcgaaggcagcgtctctctcgaagagggacagaagatcgccgacgcaatcggctacccggttctgatcaaggccgcagccggcggcggcgggcgcggcatgcgcaacgtcgaccgccccgaggatttcgccgcgaagtttgcagaagcccaatccgaaactgtcgccaatttcggtgacgaccacatgtacgtcgaaaagttaattcaaaatccccaccatatcgaattccaggtgatggccgataccaagggccacgtcgtacatttcggcgaacgggaatgctctattcagcgcaaacaccagaagctcatcgaagagagcccgtcccatctgctgacgccggaggtacgcgaggaaatgggcgcggccgcggtgaaggcggccaaagccgccaattacgcgggcgccggcaccatcgaattcgtgatggacgacgatctgcactattacttcatcgaaatgaacacccgaattcaggtggaacatccagtgactgaacaagtctgcggcgtcgatctcgtccgcgaacagatccgcgtcgccgctggtctgccgctgtcctacgaacagaaggacatccaccagaagggctgggccatcgaatgccgcatcaacgcggaggacccgatgaacggctttcgcccctctccgggcaaaacgaatttcgtccacttccccggcgggccaggctgccgcatcgactccctgctctacaacggctacacgatgagcccgttttacgacagcctcgtcgtgaaaatcatcgcgtccggtaattcccgacttgaagcgatccagcggatgcgccgcatgctcgaggaactcgtcatcgacggctacccgacaaccgcagagctgtgctacctgatcatgcaccacaccgcctttgtccacggcaattacaacaccggcttcatcgaaagcgagtacgacaccctgctcaagtggaaccgggtcggcgccgggctggaccctatcgatatcggcgacgctcgattatctgaaaataaaggagatcggtcatgagcagcaacccattccaaaagcgccgcgaagaaatcttcaacctcaaggcccttcgggaacggcgcagcatcacgacgatgcccgacgcgatcccagttcagcagtgcacgacgatttgtcccaagtgcggccacgcgctgaccctggacgagctcgaagccaatctgcacgtctgccgctgcggctaccactttccgatcggctcccactaccgtctccagctcacgatggacccgggcacgattcgggaaatcgccaaaggcgtcaaaccctttgactggctccatttcccgggctacccggaaaagctcaaggcacagcggaagaaatccggctccaccgaaggcgtctccgccgtgcgcggcaaaatcggcggctaccctgtagtcgtcgccgcgatggacacccgtttcttcatggggtccatgggctccgccgtcggcgaacgcatcacccaggctatcgaattggctgaacgcaaaaaatggccgctgatcttattctgcgccagcggcggcgcgcgaatgcaggaaggcatcatcagcctgatgcagatggccaagaccagcgccgcgatggaacggctctcccgtaagggtgtgctgtcagtcatcgtgctgacccacccgaccaccggcggtgtcacagccagcttcgcgatgctcggcgacatcaccctcgccgaacccggcgcgctgatcggcttcgccggtccccgcgtcatcgaacagaccatcggcgaaaagctgccggagggctttcagcgtgcggaattccagcaggaacacggctttgtcgatcaaatcgtcccccgtcgggacatgcgcaagacgctgattcagatcctgcgtctgcacgaccgctcctgaaaaaatccattaagatttagataagagaaaggaaaagatggcgaatcaagacaattcgaatctttcggtccgcgagcttgaaacgcggatcgaccgcctggacaaacgcatccaggacatcggcgatcccatcacgccggccgacgtcgtccagcttcagcagcttcagcgcgaccgcgacgagctgctgcacctgtgcgccgacccgacaccggtggaccgcgtctacctggcgcgccaccccggccgccccggcgtggtcgactacgtcgcccatttattcaccgatttctttgaacagcgcggcgaccgcctttaccgggaagacccgagtatttacggcggcatcgcgatgtttgacaaccacccggtgaccgtcatcggcacccgcaagggcaaaacccttcaggaaaacctcgcctgccatttcggcatgccctgcccagaaggttaccgcaaggccagacggttgatgcaccaggctgaaaaattcaaacggccgatcatcaccttcgtcgacaccgccggcgcctaccccggcaaggaggccgaggaaaacggccagggcgaagccatcgcccgcaacctggctgaaatgagtcagctgcgcgtgcccattatcgccgtgttcaccggtgaaggcggcagcggcggcgctttggccctcggcgtggccaaccatttgattatgctcgaaaacgcgatctactcgattctaagccctgaaggctttgccagcattctctggaaggaccccagccgcagcgacgaggcctgctcggtcatgaagctcaccgctcaggatctctacgacctgaaggttgccgacgaaatcgtcaaagagccccttggcggtgcgcaccgcgaccccgacgccgtgtaccacgcgctgcgcggcgcgatccgcgaaaacctgcgcagcctctcgcgcctgagcggcagcgagctggtcaaccgccgcatcgccaaattcagggcgtacggcattgtcgatacgagaaattcgtaacccccattgaaagttgaggctttaattttatgaatggcatcaaaattatcggatcgggatcggccgtcccggataaggtcgtcaccaacgacgatctcgcgcaaattgtcgataccagcgacgcctggatctctgagcgcaccggcatccgcacccgacacttcatcgaaaaggacgagaccgcgtcagacctggcgatcctcgcggccaaacgcgccctcgccgcctccggcatcgcaccggaacagatcggcgccgtcgtcgtggctaccattaccggcgacaccacctccccgagcacggccaaccgcgtcgcgctggcgctgggcgtccagcccaacacgccgagctttgacatctccgcggcctgctccggcttcgtttacgcattgaaggtcgcccagggcatgatcgccgacgaaagcgaccgtccctacgcggtggtggtcggcgtcgaagcgctgagccgcgatttggacttcaccgaccgcagcacctgcattctctttggcgacggcgccggcgcggtggtcgtcaaaagcgacccggacgcgccctttgacgcggtgctcggcgctgaaagcgacccggccatcggcgtccccggcgacatcaacaaaaccgaattcatcacaatggatggccggaaggttttccgcttcgccgtccgcatcatcccgaaggtcattaaggattatctcgccaagaccggcgaaaccctcgacgactacgatcaggtcatttttcatcaggccaattcgcggatcatcgaacacgccgcgaaaaagctcaagctggctcctgaaaaggcgtatcaaaatctcgaccgcctcggcaacaccagcggggcttccattccgctggccctggatgaaatggtccaacacaacatcgttcggcccggctgccgcatcctgtgcgtcggctttggcgccggcctgacctggggcgccgccggcatcacctacgccgcatctccccgcgtttgattggaaaggagttcttatgaaactgattagtgaattgctgcacacccaatatcccttcgttcagggcggcatggccaacatcgccaccggcgcctttgccgctgcctgctccaacgccggcgggctcgggctcatcgcctccggcggatgggacgccgaaaagctcagagccgaagtcagaacctgcaaatccctgacggacaagcccttcggcctgaacctgatgttaatgaaccccgatgcggacaacatcgccaaaatggccgttgaagaaaaaatcccagtgatcaccaccggggccggcaaccccggcaaatacatggaagcctggaaggctgccggcattctcgtgattccggtcgtcgcgtcagtcgcgctggccagacgcctcagcggcgaaggcgccgacgccgtcgtcgccgaaggctctgaaagcggcggccacatcggggacgtcacgacgatggccctcgtgccccaggtcgtcgacgcggtggacgtgccggttatcgctgccggcggcatcgcggacggacggggcgtcgccgcggcactggccctcggcgctgccggctgtcagatcgggaccgtgctcctcgcttccgaagaatgcccgatccacgaaaattacaaaaaggccgttctcaaagccaaagaccgcagcacggtcgtcaccggccgttcctccggcgcaccggtccgcgtcctgcgcaaccagatgacgaaggcctacctcaaagaagaacaggccggcgccgatttggccacactggaaaaattcaccctcggcagcctgcgcaaggctgttctcgacggcgacaccaaaaacggcagcctgatgtccgggcagatcgccggcctcgtggacgaaatccgcccggtagctgacatcttcaaagacctctacactggcgcccagtcggtcatctccggccttcaggatgtattcgaataagcaaaggagaacgcgatgacactcgcatttttatacgccggtcaaggcgctcagcacgtcggaatgggccaggacctttacgaaaaatacccggctttcgccgacgtcttcgatcgggctgacctgcccttcgatttgaaaaagctctgctttgaagggccggaagatcaactgaatcaaacccaatacacccagccggccatggtcgccttcgccatcggcgtcaccaatgtgctgagagaagccggcatcgtaccggatatggcctgcggcctttccctcggggaatattccgcgctctacgccgccggcgtctgggacgccgccacgaccctcgacctgatcgccttccgcggccgagccatggctgaagcgtccaaaggactcgacgtcggcatggccgccgttctcggcttagacgccgaaaaactcggcgccatctgcagcgaagcctcggcggccggcaaagtcgaaatggccaatttcaactgtccgggacagatcgtcatttccggcgacgccaaaggcgtcgaacaggcctctgccctcgccaaggacgccggcgccaagcgggtaatcccgctcaaggtttccggtcccttccacaccagctacatgaagccggccggtgacgccctcgccggcaaattcaagaccattactttcaatgaaccccagttcccggtgctgtttaacgccatcggcgacgtcaaacccgccggcgtgacgattccggagctgctcgaaaaacaggttcagcaatcggtctatctcgaacagagcattaaaaagatggccgacatgggcgcggataccttcgtcgaaatcggaccaggcaaggccctttccggctttgtgcgcaagacgatccgcggcactaagccgatgaaaatcgacacagcggacgatctcgccgctgtcatctcagcattatcgaaataaagaggaaccatgaaaaaagaaaccaacgccaatccaatcgtcctcgtcaccggcggaagccggggcatcggccgcgcgacctgcctcgcctttgccaaggccggctacgacgtcgccgtgaattacgccggcaaccaggccgccgccgaagacaccgctcaggcctgccgcgagctcaatcccgaagggaaagtcgctgtgtacgccgctgacgtcgccgacgctgacgccgtcgacgcgatgttcaaggccgtcaaggccgacttcggcgccctcgacgtgctggtcaacaacgccggcatcacccgggacaatctgatcgcgctgaccaagcctgaagatttcgacgcggtggtcgcgaccgatctccgcggcgtcttcctgtgcatgaaggccgcctcccgaatcatgatgcgccagcgccacggccgcatcatcaacgtcagttcggtggtcgggctccgcggcaacgccggccaggtgtcctattccgccgccaaggccggtgtcgtcggcatgaccaaatccctcgcgaaggaattgggccgccgcaacatcaccgtcaacgcggtcgcgccgggcttcattcaaaccgatatgaccggcgccctcgacgacaagcagaaggccgccgcgacccagaacatcccgctgaaccgtctggggacccctgaagacattgccggcgtcatcgccttcctggccagcgacgccgccgcttacattaccggacaagtgctgcctgtagacggcggcatggccatttaacaaaggagaaatacgattatgaataaagaaaaccgcgtcgtcatcaccggcatgggcaccgtcaaccccctcggcaacagcgtggccgaaagctgggccgctgccaaggcaggaaaaaacggcatcgccgaaattacgctgttcgattcgtctgaacagaaagtgcacctggccggagaagtcaaaaatctcgacatcagcgccgtcatcaaccgaaaagacgcccgccacatggaccgcttcacccagttcgcgctggtcgcagcggacgaagcgatgaagcagtcgggcctcgacatctccaaagaagcggacccgtaccgctgcggcgtcatcatgtccagcggcatcggcggcatttccaccatcgaagacaaccagaaccgcggcatgaaacgcggatttgaccgcgtctccccgttcttcattccgtccgcaatcccgaacatggccgccggacgcatcgccatcgcccacggcttcaagggctactcgacctgtatcgtcacggcctgcgcgtcgtccaacaacgccatcggcgacgccttccgccagatccgcgacggctacgctgacgtcatgctcgccggcggggcggaagcctgcgtcacaccgctgtgcatcggcggtttcaccgtcatgcaggccctgtccaccaatccggacccggaaacggcctcgtgcccctttgacgcggaacgctcaggcttcgtgatgggcgaaggcgccggcgcgctgatcctcgaatcgctggaccacgctcaggccagaggcgctgaaatcctaggcgaagtcgtcggctacggcacctcgaccgatgcctaccacatcacggccccgtctccagacggcgaaggcgcggcagccgcgatgaccgctgcgttaaaggacgccggcatcgcgccggaagcggtcggctacatcaacgcccacggcacctcgacgcctctcaacgaccagatcgaaaccaaggccatcaagaccgccttcggcgatcacgcgaaggacatgatggtcagctcgacgaagagcatgacgggccacctgctcggcggcactggcgcagtcgaagcgattttcacggcgatggccctccacgatcaattcgtgccgccgaccatccactaccaaaatcctgacccggactgcgacctcgacatcgtcccgaacgaagggcgcgaagccgatctcgactacgcgctgtccaacgggctgggcttcggcggccacaacgctgtcgtgatcatgaaacgctgggaggcttaagatgagcgaaacgacccgcgaacctcacgaattgtccgctgcgcagatccaggaaatcctgcctcaccgctatcccttcctgctcgtcgaccgcatcctcgactacatccccggcgaaatggccatcgggcgcaagtgcgtctccaacaacgagatgcagtttctcggccattttccgggctatccggtaatgccgggcgtgcttttgatcgaagccatggctcaggtcggcgcggtcgcgatgctttcccttccggaaaacaagggcaagctcgccttcttcggcggcatcaagaacgcccgcttcaagcgtcaagtcgtccccggcgacgtggtggaaatcacgacggaaatcacgaacacccgcggccctctcggaaccggaaagggcacctgcagggtggacggcaaagtcgtcgcccgggcggaaatcacctttgccctgtcggaccccactgcagaagcttagacaggagcggcgatgtttactgaacctttagccgagatttacagaaaactgcgcctctacttttaccgcgaagtggccctgcagagcagccagaactcgctgaccttttccgaatccttctgtctcgaagcgatttattcgctgggcgagccgacaatcaacgccttcgcccagttcatgaacatctcgtcgcccaacgcgacgtacaaggtcaattctctggtgcagaaagggtacctgaagaaggtccgctccgacgaagaccgccgggaataccacttggtggtgacggacaaattcttaaaatttcacgaaaccaacacccgcggctatgaaaaaaccatggaccgcatctgtcagactttcaccgcggaagagctgtcgaccctcgaccaattcatgacccgcatcaacgacgagctcgtcgaatcaccaccggtttaatccgcgatgcattgccgcttctgctccggccgcctgccggtacaggagcggtttttctttgttttgcacgctttagcttttctttcagatttcgaaatattaaagttgacgatggcggagcttacggatataataatggcatttaaaaagcgtacacacaaaacaaaatagaattgcgaaaaaagaaaggaacccgaaatgatgactgaagcacaaaatacagaaagtacaccgtttccacaagcaatgccgacgcctgaagattacggcgcgcctattaattccgacgacgtcaatgattttatccatatggtcgaacaggccttttctcccattgaagcctggtaccgcggcgaaacggaagtcgacgacgtggtcgccctcgttcaggatcagtttgacgcctacgaaaaggcggcagcgccttaccgcgacctgctgaagcgcacctacgtctggaaggacgaaatggacgcggcggcccgccgcacccgtgtaagcggcgatccgaagaatgacacggccgacaagaccttcgaccgcatcgcttattcccagattcagttcgcggtcttccgcgccaactactgcgtccagcagatcatcacctccgcgcacaaggcgacccaagcctttgaaggcttgatcaagcacgtgcctcagctgctcgaacaaggcgaagatctgagaagcgtcccgtggactgagctgaccctgctcaaaaagtcccgccgcggcgttggaccgtttcggtatcaaaaataatttatcattaactccaaataaaacgcccaactccgatatgctgaacgtatatcgcagttgggcgttttttcgctcgtatttgcctaatttcacgctatttttcaaatgaccttaacgcagcctcaggatgatcaaaatcccttaataaggcgtcaagcacctttaattcgccgtcgtcagtattgcggtcggtgacgtagcggcacacgtccttgaccgcctggcgcgcgttgtcgacagccacgctgtatttcgcctggttgagcatgctgatgtcgttgctgttgtcgccaaaggccaaagtctcgtccatcgacacaccgaaaagcgcctgaatcttggccagagacgcgccctttgacgccgccttcggcaccatatccaccacacgttctccggcgcaggccacgttcatggttttccgccatttcggcgcaaatgccttttccgtgacctcctcgacgtggtcggcgcggtagaccgaaaacttgatgcacggcgtgtccagctcgaggagatcatcgaccagctcgcagtcgaagtgatagacatcccgcgtgaactcgtaggcttctttatcccgcttttcgaaatagcacacctccccggtgtcgtacagggtcatacagccgtccagcgcccggatatcgcgcacgatcgcccgggtgtccgccatcggaatcgcttcgcggtagacgatcttatcctgataagacgccatcgcgccgttctgggtgatgtaaaaaatctgatcctgaatgggcgcgaacacccgtttcaggttcgaagccggccggccgctgcagacgccgaaaatcacgccgcggtccatcaaggcatgcaccgcctcgaaataagccgctgacaaatcctggccgcagtccggaaagagcgtgccgtccgcatctgttgcaatcagtttgatcatttcacaatctcattctcaagattcaaggtgtgcttaaacacccgattgaatttcttcccgcattcgtccaaaatcatatccgtaaacaccgaatgttcctgagacagcacgttaagggtcaccgcgtcatcggagatcacgcagttgacgtcgcggacgaccccgtccatatcccgatctaaatattccgcaatctggaggatcgagctgaacacgtcgatgatgttgaggtcctgcttggtcagcatccgcgcgtattcggcgtcgacctgtacctttttgccggtgcggtgattcagcgcggagaaggccgcgatcagcatttctttgtgggtcaggccgttgattccggcgtttaagatcaaataaaagctgtgcagctgatggttggagtactgaattttgatgcccgaatcgtggagcatggccgccgtgcgcagcgacttgtccaaggtccggctcaatggcaggccgtgaatcggcgccagctcgttgaacagcttgcgggaaatgcggtaaacctggtaggcgtggatgcagttcacgtccagctggcgcgcggtattaaccagcgaatactcgaaaacctccggtatcagatcgccttcgccgtagccgatggattcgtacaaaagcccgtcccgaagccccgccttcgagataatcagctggtcggagtcgatagcccccatgatttccatcacggcttgactggcaccgatgaaaatatcggcccgggccttggaaagccccttgatgtttttccgttcctgataatccatcgccgccgtcttttcgcagaccgtcttgacgtccttccggctcattctgtaattctgagcgatttccagcggataatcggtcattctgcggtggatgcgccccatattgcggatagtgccgccgaccccgatcaccgggtagtccttggcttcagccagcagcggatactgcgaaaaggcgccttccaagaaaacgtgcagcttttccagatcggattttttcggcttgtcggtcagattgaatttttcagctaaatcgaccgcgccgaagggcaggctcacgccggccttcttttcgcggttttggatcagcaccagctccgtcgagccgccgccaatatccattaaaagcccgtccttgatatcgatggtgttcaccacgccgaggtaatcgtacatcgcttcctgttcgccggggatgacgttgatgtcgatgtccgcctcttccttaacccggcgcacaaattcatcgccgttttccgccttgcgcaccgcggctgtcgcggtggcaatgacctgatcgagctggtacgcgtcgatcatccgcctgtaaattttcatcgtattgacgcccacgtccatgcgctctggatccagcctgcccgtccgcgtcatgccttccccgagacggacgttgactttcgcgtcgtcaatcaccgaaaaatagccgttttcttcgtgataaatggcgaccaccaggtggacgctgttggaaccgatatcgatgaccccaatacggttatgttcttgcattttactttcccttctggtttatttcaataaattagctccattacctatttgatcattataccacaaagatctggtctgaatcccactgtaccgcgtcttttgcgggcgcaggtaaatcgcagccagcccgacgtcaaaggccatcaacgccacagaggagccaaagcccggcgcagccgacgcggcggtgccggcagtggcaagcagaattaatatatccgtcaggctgtggataatcaccggaatgaccgcgttgccgcttcgccagtaaaccgctccccaaagcacaccagtgccgaaggcctgaatgacctgcatcgccgtgaccgccaaggattggccaaaggcattcatcatatgcagcgcggcgaacaagcccgcgccgatgagtaccgtgcaccacgcgcctcggcagctgtcggcaaagcgcacccgcagctgagcgaccaacccgacgcggaaaaaagtctcctcgaaaagcccgaccgatacaccgaacagaaccgttaaaatcagtttctgcggcgttagcgcggcgagattttttgcgacgccgcgaaacaccggcgccatcttcgagacgccgttgatccctttaaactgctgcatcccctgagggctggacaggaggagcaaaagcaacaaatagatcacgattttgagccattctgaccagctcagccggatcgacgtcccaatgccctttgcggaaaagcccaagaccctcggcgtccagccgtaaatggcgtacagaaaaatgagaatcagtgcggacaaaatgagcctgaaaataatttccgttccaatcgattggggcagcagccgcccgacgccgaaaaacagcgcgctgacggcgaaaaaatagagcacggcgcccgataaggggcgttcccgccagaagccttgcaaaaatcgtttcaaatcgttcatccttatctgctttctaaaaaaggaccctcgacgatcgaaggtcctgtgtttaagcttattttttattttttctttttgtcttttttgcccttttctttcttggtgcctttttcttcaacggcaccgccattggcgtctgcgatgactttttctgcgacgctcgccggcgcttcttcgtaacgggcaaaggccatttcaaattcgccgcgggcctgggtcatcgagcgcagctcagtcgcgtatttttccaattcagacagcggcgcttccgcggtgatcacctggagtccgccgacagaaggttccatccccatgatgcggccgcgtttcttgttcaagtcgcccataacgtcgcccatgtattcttccggcacggtgatcttcaggctgtaaatcggttcgagaatgaccgggttcgccttcttcatcccttcgcggtacgccagcgcggcggccatcttgaaggacatttcgtcggaatccaccgggtgataggagccgtcgtacagcgtggcctgaacgccggtgaccggatagccggccagcacgccgtgctgcatacattcttcgaggcccttttcaaccgccgggataaagttgcgcggtacggccccgccgacgaccttgtcgacaaagcggaaatcgtcgttcgggtccggcatcggttcaaatttgacaaagacgtgaccgtactggccgctgccgccggactgtttcttgtgtttgccttcggcgtccgcgctcttcttgatggtttcgcggtacggcaccttcatcggagagagctcgacgtcgacgtcgaatttctgtttcagtttattggaaatgatttccagctgcatttcgccgatgccggaaatgacggtttgtttcgtttccttgttgcgggtcaccgtgatggtcgggtcttcttcgatcaggcggtgcagcccggtggagagcttgtcaatgctgcccttgtccttcgcgtcgatcgccatcgaaatcaccggtttcgggaagtcaatcggcgggtagacgatcgggtcggccggatcgcaaagggtatcgccggtcttgacgtcggtgagcttgctgaaggcgccgatgtcgccggcgaccaggctgtcgacttcgatctgcttgttgccgcgcagcacgtaaatgtggttggcctttgccttcacatcctgattggcgtcgatgatttcggtgtcgctgttcagcgtcccgcccatgaccttaaagatcgagagcttgccgacgaacgggtcgacgacggttttgaagacacgggctgagaacggcgcttcgctcgaaatctgacgttcgatttccttggaatcccgcgggtcgatgccatcgacatcgttgccttcgtccggagacggcaggtagtcgatgatcatattttcaatggtttcaaccccaatgttctgaaccgccgacgcggacatcaccggaaccaaatcgccggcgagcacgccctggcgcaagccgtggtgaatttcttcggtggtcagttcttcgccgtcgaagtatttttccatcaggtcttctgaggtctgggccaccgattccatgatcatttcacgataaggttccagcactttgatcagctccgccggcacttcggcgtcaaaacagcggttgtcctttctttcgcggcccgtcatatcgacaatattgacgacgccgcgcatttcgctgccttcgccccaaggctggataaacggcacgattttgttgccaaaggacgccttgagttcttcgacgactttgctgattttagcgttttcgcggtcgattttattgacgacgatgaatgccggcacgtcgaccttcttcagcatgtcgatggccttttcggtgccgacctgaacgccagccaaggcatcgacgacaatgataatggcatcggcgacttcgagagccgccgccgattcccctacgaaatcaaagtaacccggcgtgtcgataatattgagcttatgcccgccgtattcaattggaatcaccgaggaagaaattgaaaacattcttctcttttcttcatcgtcaaagtcagaaagcgtattgccttcatcaatgcggcccatacggtcgattgcgccggcgttaaaagccatcgcttcgacgagtgaggtcttcccactgccaccatgaccgagaagcaaaatgttgcgaatgttttttgtcggataatttttcataatcttcctcctgaaactgtttagtaagtctatttatttaattttaaccaatattgagattgttttcaacctgtaaagctttcaaaaatgtaaaggttatgcaaaagaccacaattaatcggtttttatcatatttttcgcaaataaaaaagctgcgggatttccgcagctctgttgtgttgaaaactttaattatttggcacttgcctttttcttccgcttgggcaggccgacccggcgctttttcttactccgcccgaagacgctctgaagcttcgtcagggtgtcgctgaggggctcgatcacaccttccttgaccgtatccactgaggtcttagcgtcggtgaccatcgcgtccgcgttgtcaataatattcgtaattttttctgcattgtcgtccagcaggctgttgattttttccatcgtcctgcgcgtttcgacgatcagcccgatcaaataaacgaccaggaagagaatcgaaacggcgatgatgatccaaaaaacagccgacagcggtatcatctgattcattcggccgcctcttcttcgtccgaatctgcttccgcttcagatgcgtcttcttcgtcctgaagcacatcgttgaattcttcttcgaaatcgtcaaattcgtcgtcaacatcctgttcgatgtcgttgattttatcttcgatttcgctgcggtattgattgacgcggtcggtcagggtgtcggtcgcgtcctgaatctggtttttcaggctgtggccgtattccttcacctgatcgtgcaggtcgtcccatctttccttcgcgccgctcgcgatactggtccgcaaatcatcacccgtcgatggggcgaaaagcagcgctgccgccgcgccgatcacagcacccgcgaatataccaccgatgaaataagattctttgttagccattgcaattctccttgaagtatagtctttaaaaaattttagaatgccaatcttaattgccgctttaggccagtcgagcattcaaaggcattattcttcttcttcgaagccgctttcgaccagttccaccagcgtgtcgaccgcttcgtcttcgtcgtcgccgttggcttcgatcgtaatcgtcgtcccttggccgatgccgccggacatgagccccataatgctttttgcgttgagccgggtgtcgccgtaaatgacgtcgatatcggattcaaactgtcccgcttccgagacaaagatcgacgccgctctcgcgtgaagccctgccttattggtcactgttacttgttttcttttcatgcgcttttcccctttcgtgatgcttcacattacatggtctggatgccaagttccttcagcgtatcctgaacgtactgacggatttctgtgccagtctgcatcgtcatcgccttgtcggcgacggcctttgcctgttcgaagctgacagaacggataattttcttaacctgcggaatggacgacgcgctcatcgagaattcgtcgagcccgagtccaagcagaatcagcgccgccaccggatcgccggccatttcgccgcacatcccggtgaatttccccggtttgttgtgagactgggtgatgacatttttcaccagccgcaggattgccggatgcagcggatcgtacaggtaagagacgttctggttcatgcggtccaccgccagggtgtactggcacaaatcgttggtcccgatggagaagaagtcgacttcgtcggcgatgatatccgcggtgatcgccgcagacggaatttccaccatgatccccgtttcaaggtcgtgatcgtaatcgacgccttccgcgtccagttcctgcatgcattccttgagaatggccttggcctggcgcacttcgtcgacgttgccgatcatcgggaacatgacgcgggtcttgccaaaggctgaggctctcagaatcgcccgaagctgcgtcttgaacatgtctggcttggagaggcacagacggatagctctgagccccaggaacgggttcatttcttcttctaacggcaggtacggcagctttttgtcgccgccgatatccagggttctaatgatgacgccttcgccgtccttgaattgttcgatgacggttttgtacgcggcgaactgcttgtcttccgtcggcatttcgtcggaattcatgtacaggaattcgctgcggtacaggccgacgcccttgccgccgttgcggacgaccccttcgacatccttcgggctgccgatgttggccacgactttgaccttgtggccgtctgtggtttccgcatcctgatccttgagttcagccagttcggccatgtaggcttcaaaggccttttgtttttctttgtattcggccagttcttcgtcggtcgggtcgacgattgcttcgccggtgctgccgtcgacgatgatgatttcgccggtctttgccgtcttggtgatgtcctgaaggccgagaatcgccgggatttccagacttctggccatgatcgcagtgtgggaggtgcggctgccgatgtcggtcgcaaagcccttgacgtgaaccttgtccatcgtcgccgtgtcagacggtgccaaatcttccgcgacgatgactgcatcttcgtccaaatgggaaatatccatgatttcgatgcccatcaggttgcgcagcagccgatcgccgacatcctgaatgtccgcggcacgccctttaaaatacggatcgtccatcgcgtcaaacatcgcgtagaactgatcgacgacggcttttgtcgccgcttccgcattgatcttgtcgttttcgatcgattgagtgatcgcaccgacaaattcagggtcttcgaggaacatgctgtgggcgtcgaaaattgccgcttcttcctcgctcatttcgctggcggttttttccttcagcgtattgagctgatccttgctctttgccaccgcggcgttaaagcggtccagttccgcctgaacgtcgtcaatcgactgctgaaccaccgtcagttcctgcttgacgtaaacgatcgcccgagcgatggcaatccccggcgacgcgttaattccttttttcaacatcgtgtaaacctccctcaattgttcaattattcgttatatctgtttgcggccttcaaaggccttgatcaatgtcacttcatccgtgtattccacatcagcgccaatgggaatgccctttgccaaccgagtcacctgaatgcccgccggcgtaatcaaattgcttagataaaccgcggtggcctcgccctccggcgtcggattggtcgccatgatcacttccttcaccgcttggtcgttgagccgcttgatcagctcccgcgcccgaatatcctgaggaccgacgccctccagcggcgaaatgacgccgtgcagcacgtgatacaggccgttgtactcgcgggtgcgctcaatcgcgtagacatcgcgggtgtgctcgaccacgcagatcactgagcggtcccggtttggatcagaacaaatgtcgcaggtgtccttatccgtaatggaaaagcagaccgggcacagatgcaccttgtccttgactgtgaccagggcgtccgccaatgcggtgatgtcgtccttcggagcgtcaatcaggtgaaaggccagccgctgtgccgtcttttcgccgatgcccggcagcttcgtcagctcgccgaccagccggtcgatcgattctggataaacactcaatcaggacaaccccggaatgttgatgccttgggtcagttgccccatctgatcgctggtcagggcgtcgacctgtgtgcccgcttcgttgactgccgcgacgatcaggtcttcgagcatttcaatatcgtcttcgtcgatgacgtccggatcgatgtgcacggctttgacgcgcttcgcgccgtccattgtcacggtcacggcgccgccgccggcggttccctgaacttcctgttcttcaagattcgcctgggcctgggccatttcgctctgcattttctggagctgcttcatcatatttttctgattcatcttgccgccgccccgtggcgcgcgtcttttcatttttcccattgatttctcctttgatgttccttttcattataccatgtttatgttcaagacttcatcattttttgtaaatattcttttatttgcggacgatgggcacattgccgacgatcgccgccgtcttttcagcgaggctcatctcactgaagtttttttttacacttttgattgtcagctgaaccttccggcccgcgacgctgcccgccagcttttcaagcttcgcctgggagcgggtgcaccggtcgcaggccatcctgtcaccgctgtcctcgaaaaagcacaattcgaaatggtccgcgtccttttgaatcaggcgccctttttcgaacatcttgccgtccagcggcgccttctttttcagggccgcggtcatttttttcttgagggtctgggcgtcggcgccgccttgtttcggcgcagccgccggttttgcctgtcggggtgccgcctgagccttcggagccgcggcagcattttgttttgggcgcgcttccggggccggcgccgctgtctgagcagcgggcttctgcggtgcggccggcgtcaccttcggctgagggctcggggccggttttatcgctggctgacgcggcggcgcagtatcaactgtccttttaaccgctggcgccggatccgccgcgcggatcgtctgcgcggtacacagcttcagcaccgtcatttccagcacgatctccgccacgtcgttgtacttgagcttttccttggcgtcgattaaaacgtccatgatatcgaacagctggccgccgcccgtcagctgggccgtcgccagaagcgcgtcgtaatcgtcctgtccgatgccgagaatggccatcgcggtttcgccggtggtctggacgatgagggcttgatgcacggcgtcaatcatctggtcaagaatcagtgccgcgtcccgcccgcgcgccttcagcgtcttgagcagggtcagcgccgacgccgcgtcctgctccgcaatgtgggcgataagctggcggatcgtctgctgatcggccatgccgaggaaatccaaaacctgactgtaggtgatcggccggccgtcttcccgcaggtcgatgacctggtcgaggatgctcagcgcgtcgcgcatcgagtgatccccgcgggccgcgatgaactgcagcgcttccggctcgacctgaacgtcgagatcctctaaaatttcggccattctggcgacgatggcctcctggctgatcggccggatgtcgaagcgctggcaccgcgagagaatggtcatcggcagcttgttgggctcagtcgtcgcaagaatgaagacgacgtgtgccggcggctcttccagggtcttgagcagcgcgttgaaggcctcccgggtcagcatatggacttcgtcgatgatgtagaccttgtagcgcccgagggtcggcgggtatttgaccttttcccggatgtcccggatttcgtcgacgccgcggttggaggccgcgtcgatttcgatgatgtccatgacgccgggctgttcgatttcccgacaggtttcgcagacgttgcacgggttgccgtcctgattgttcgggcagttgatcgcccgggcaaaaattttggcaatcgtcgtcttgcccgtcccccgaatgccggtgagcaggtaggcgtggccgattcggccgctcgtaatctggttcttcaatatccgaatggccacttcctggccgaccacttcgtcgaatgatttgggccggtatttccggtacaacgccatgtacgccatcgctcgtctccttcttctctaaaatcacaatctcgatgtgaccattatagcctttttagccgcagttttaaagccgtcatttgccttttgaaaacgaaaatcgttgtgatataataacgacactgctctaaatttgtaacttattttggattctggaggtcttatgtcaaagctcactcaaaagcacccgcatctgctgccgcagctggcccttttcgccgcggccatcatctggggctcgtctttctttttgatgaaacgcgtcgtcgccgtctttcccaccttttacctattggcgctgcgcttcaccatcgccacggcgctgttgtccctcatcttccgcaagcgggtggccaagctcaagcctgccgatttaaaggcgggcttcgtcatcgccgcgaccttctgcctggcctacgccttccagacgatcggcctgaagggcacgacgccggccaagaactccttcctgtccgccacctactgcgtctttgtcccgtttttgtcctgggccatcgaaaaaatccgcccggaccgcgccaacatcgtcgccgttttcctgtgcatcgtcggcgtcggcctcgtcagcctgacgcgccagttcaccgtcagctggggcgacggcctgaccttgatctgcgggctgttcttcgcgctgaacatcatcgcctccgcccactacagccagaccatcgacgtcaccctgatcacgatcatgcagttcgccttcgcggccgtcttctgctggatctgcgccttcttcaccgaaacctggcccgcccacattccggcgtcctgcctcggcgagctgatctacctggcgctgttcgcctccggcttggcctacctctgccagaatttcggcctcaagcacgaaaacacgacttcagcctcgatcattctctgtctcgaggccgtgttcggcgtattgttctccgtccttttctacggcgaacgcctgacgccgcggctgctcaccggcttcgccgtgatcttcatctccgtcctgatctccgagctcaagccccaatggctgaacaaaaaaagatccgctgagtaaattcagcggatttttttattagtcttcgatgatgtacgcgtcgacgatttcgccgtaatacgcgatgtgggcgtctttgttcgcgccgcagaccgtgctgtccttgtccggcgggtagaagccgtcgaattgagaatcgatgaggccgagttcctggcgctgtctgaagacgacccggcattccagggtcagcggcagttccttcacggccggcgcgtccactttttcgccgtcgacgagagtcaagccggtgtcggcaattttgtcgacgtcgcgcccggagcaggagccgcagcggccgacgatcttccggacatcggcggtgcgtgccgtcggaatgttcacggtaaagaccgggttcttgtccagctgaccgcgggtgaaacggccttcgcggatgtaggcggcaaacaccggcttgccccattcgatcccgagggtcccccagccaatcgtcatcgtgtcgactttgtcggccgtcttcgtcgtcagcagaatgcccttgggcagctcttccacgattttgccggcgatatctttaagttcaacaggttttctgttcatgctatcctccaaaaatttttctttatttttataatctaggcgcattatatgggaacaagcccaaatttttcttaagacttttttcgtctacccccttgacagatgcggtccgatgcgtgtagaataagtgcaactaaattgcattatgcaattcaattgcactactatttacacaaattgaggcgatgaaatgaaatttggagaaaaactgaaaaaaatgcggcaccgcgccgccatgacccaggccgaagcggccgaaggcgccggcatttccagacgcacctacattggctacgaacaggaaggccgctacccgagaaaccgggacatctaccgccgcctggccaaaaccctgaactgttccctgaactacctgctgaccgaggacgaggtcttcgtcgaggaatcggccagacgctacggcagccggggcaagcgccaggccgaagaactggttgccgagctctccggcttgttcgccggcggcgagctttcggaacgggacaaggacgcggtgatgatcgcgctgcagaaggcctatttcgactgcaaagaagacaatcgaaaatacggcagaaggcggcggggtcggaaggtagaagacgatgattgattcctccggcatctaccggcgcgcccagcattttatccgccagtacggcaaccgccgcctggagctgatcattcaaaagctcggcatccggctctacgaagtgcccgatctcgacgagctcctcggcatgtacaccgtgcgctggcgccaccgcatcattttgatcaacccctccctctcggaggatctgcggcggatggtcctcgcccacgaattgggccacgaccagctccaccgcgctctggctaaaggagaagccctcagcgaaaattccctgtttgacacagtggatcacaccgagtacgaggccaatgccttcgcggcgcacctgcttttagatcaggatcaggtctacgagctcgcccgggacggccgggacgtcgtcgaaatggccaaaatcatgcgcaccgacgtcaacctcgtgctgatcaagcttcaggaaatgacccgcctgggctgggacctgcgggtgccgctcgtgcccaacgcccggtttttcgcaaatatggactgctcctgacaatattcattcattgatattcattatggaggaaaaggatgaaacccgcctatctctgcatcgatctcaaatccttttacgcgtctgtggaatgtgtgcagcggggcctcgacccgctgaaggccctcggcgtcagcagccggccgcggctgtttgaggtcaagcagcagatcgcctatgtagagaaaaagctcggccggaaaattccttttctcatcgcgccgccgcagatgcgccgctacgtcgaggtgtcctcgcagatttacggcatctacctgaggaccctgtcgccggcggacatccacgtctactccatcgacgaggtcttcatcgacgcggccccttacttaaagacattggcgatgaacccccgggagctggccgagcatttgattcaaaacgtctacgacgcaacgggcatcaccgccaccgccggcatcggcaccaacctgtacctcgccaaaatcgcgatggacatcgtcgccaagcacctcgcaggcgacgccaagggcatgcgcatcgccgagctcgacgagcgcgcctactgccagacgctctgggaccacaagcccctcaccgatttctggcgcatcggcccgggcatctcgaaaaagctggcccgataccgcatgacgacgatgggcgatatcgccgagatgtcccgaaacaacgaggagctgctctaccagctgttcggcgtcgacgcccagattttgatcgaccacgcctgggggattgagccctgcacgatggccgacatcaaggcctactgcccgcgggaccactccctgggctccggccaggtgctgcccaagccctaccctcacaaggatgcggccctgatcgtccgggaaatggccgatcagctggccctcgccctcgtcgaaaaggggctcgtgaccccatctgtcacgctgcacgtcggcttcgaccgcaccgccctcgacggcggccgctactgcggcccgatccacatcgaccattacggccgaaaggtgcccaaaagcgtccacggcagcgtcgacctcggcggcccgacagcgctgacctccaaaatcgttccgggcgttctgcgtctgttcgagcagattgccgaccctgacctgccggtgcgccggatcacgctgaccgccaaccgcgtgatcccgaaggcgtcgattgtcgtgcagtgcaatttctgggacgaccccgccggtgaaaagcgggagcacgcactgcagcaggcctttgtcgcggtccgaaagcgctacggcaaaaacgcgctgttccgcgggatggacctgctcgaaaacgccagaaccctgacccgcaacgaagagattggaggccaccgcgcatgaaccgaaaacagctgatgcgccagggggcgcctcggcacgagggcgacgccttcagccgccgccacccgccgatgtccacggcaaaccgcgccaaaattttcgcgcccttcgcggcgctgaccacctacgacgcggccctgaggacccgcgaagccgtccacgcggccagcccctgtccggagctctctgacgacgcggccgaagccctgaacgccgccctcaaggcgctttttgagcggctgagcgcccatccgtcagatggtgttcccgccgcgctgacctacttcgagcccttcgccggggagaccggctacgtccggcaccgccggggccggatcctttcggccaatctaaaaaagcgcaccctgacgttgacctgtcagaatgcgccgcagccaatcgccttcgcccatttgctcgagctgcatttcctttaatcttcaaatttaatcttcaaaccggcggccgcatttcggacagtaggcgaagtcctcgtccgtttcgtacccgcagaaggcgcagcggtgccgcggcccccggcggaagccgccgccgtctgatccgaccatttcatgaagatcctcaggccgaatcgtgacgtcctcgccccgcgcgatgcgtcggcccacctccggatcgagggcgtaaaccgcgccgcagcagcgcatccgaacgaaatactgccggtgccatttgaagcacggaatgaaaaacaaaagcagctgggtataggtcatccacacctcgtaggcggtgaactgcccgcaccgcggacagacgcccgtctggtggtaaggcagtgctttctgcccatcggtgacgccgatcattaaaaacataggtcctccttttaaatgcttacaatttgaggggcagcggcgctgaacccgctgtcgttttgtcttgacgaaaactttccctttggctacaataacaacaaaagatagtttaatcgctgaattttatatttttatgaatgagaggtaatatccatgacgatgaaattggttcttctgcgccacggccagagcgaatacaacaaggaaaacaaattctgcggctggcacgatgctgaactgtccgatcagggccgccaggaagcggcagacgccggcaaggcactcaaggaagccggatttgatttcgatgtctgctacacatcttatctgaaacgcgccatccacaccctggatctcgcactgacaagcctggaccgctgctggctgccggtttacaaaacctggcgcttaaacgaacgccactacggcgcactgcagggcctcaacaagagcgacaccgccgcgaaatacggtgaagatcaggtgaagatctggcgccgttccttcgctaccaccccaccgcttttgaaggaagacgatccgagaaatccagcccttcaggaacagtaccgcagcgtcccgaaggaagacctgccgctgggcgaaagcttgaaattgaccatcgaccgcgtcatgccttactacaacgaaaccatcctgccgcagatgctcgccggcaagcgcgtgctgatcgccgcacacggcaactccctgcgcgccctcgcgatgtcacttgaaggcatgagcgaagacgaaatcctcggcttcaacatcccgaccggtgtgccgttggtttacaccctcgacgacgaaggcaaattcatttccaaggaatacatcggcgatcctgacgtcatcgctgcaaaaatcaacgcggtcgccaatcagggcaaagccaaaaaataatcgtgttaaaaaatcaatacgaagatccaaatcggatcttcgtattttttttacgcctgtttggccgctcggcccctgccggtaaacacgatcgagagcacgacacagaccatcaggaagaacgggtaatacagatacggaatgatggcgacgctggagaggccggaaaggcctgccgcgatcaacagctgcgccccgtagggaatgatgccctggaaaatgcacgagcaggtgtcgagaagggacgccgtcacccgcgggtctacgccgtattcctctgagatgtgcttcgcaatcggcgcggcgacgacgatggccaccgtgttgttggccgtcgcgatgtccatcagtccggtcaaaagggcgatgccgaacatgccgccccgccggccgttgaaatgattgcggatccactgcaggatcgcctcaaacccgccgtactcgcgcatcagcgccgcgatggacgcgacgagaatcgtgacgatcatcgtctcgaacatgccgctcgtcccggtgcccattgccgagaaggctttaacgtaagtcaaggtgccgcagcaggcgccggcgatgagaaagagcacgatccccgcgccgaggacgacgaacacgttgacgccgagcagggccgcaaccagcaccgcgaaatagggcagcgccagcccgacccggaagggataatggccgaggctgctcggcgcgccgcgaaaggtcagaaatgccgtgacgatcagcgtcacgatcgccgccggcagcgcgattttgaagttcaccttgaatttatccttcatctcgacgccctgagtctgggtcgccgcgatcgtcgtgtccgaaatgaaggacaggttgtcgccgaacatcgcgccgccgaccacggtgccgacgcagaccgccaaatccaatcccgcggtgtgagccaccgacgcggcgatgggaaccagcacggtgatcgtcccgacgctcgtgcccatcgccatcgaaatcagacaggcgataacgaagagccccggcacggcgaagcgcgccggcacgatgttgagcagcatgttcgcggtggacgtcacgccgcccgccgcctgcgcaatgccgctgaaggcccccgccagcagaaagatgaacagcatgatcgtgatgttgtcgtcgccgatgccctgggcgcagacgtggatcttttcgctgaagggcagcttcggattctgaatgaaggcgacaatcagcgcgatgccaaaggccacgacaaccgacatgatgtaaaagcccatcttccccttgatcgggtggatgtactcaaaatagatgccgctgcccaaatacaaaactaagaaaacgagaatcggcagcagggccaccccgttggccttcggtttttcccgtctactctcctctaataaactcatgctttcccccttttgatggttttcatcgtgtaccgcgtggattcgacctgccccttgaggcccgaggtcacccacagcgtgttgtcgtcgtccagcagaatcatttcaaaatccttggcgtgatttttccaataggcgacggccttcttcttgcccaacacgaacatcgccgtggacagggcgtcggccgtcgtgccgtctttgcagacgatggtcactgatttgatgccgccgtccgccgggtagccggtcttcgggtcgagaatgtggtgatactttttcccgtccttgccggtgatgtagcgctcgtagccgccggaggtcaccaccgcgcggccctctgtcagcgtgagcacccccatggtccggctggtcttgttcggatcggtcaggccgatggtccagggcgagccgtccggctttttcccgaagacctggacgttgccgccgagctcaatgttgccggctgtcacgccgtcctttttcatgatgtcgacaatgcgctgggaggtgtaccccttcgcgatgccgccgaaatcgatctgtgtccccgccggcaggctcaggcgcttcatctcggcgtcgtagctgagcttgtcagccccgacattttgaagcgtctgggcgatggccgacgcagtcggaatgtcccgcttcttgtcctggtcgagctcgccggactcgctgtacacctcggtgaatccccacagcttcatcagcgggtaaaccgtaatgtcgaaggcgccgcctgtggaacggtaaaccgacagggatttttggagcagcgtgtcgagatccgaggagacggtgccgcctccggccgcgttgagtttactgacctcgctcgtgtccgagcccaccgagagcagcttgtccagccgattgatttccttttcgccgtcgtcgagccccttctcggcgtttttgccgtaggccttcaaattcatgaccgtcgtcatcgcgatgacctggcggctgaccggctcgcccgacgtgccgaagctcgtgccgcagccagacagcgtcaaaagcgccgccagcagcaccgccgccgtccctaattgtttatgtcgtttctttctcatcgttcctttcactctgcatcattctgatttttggccttaaaaaagcttccggcctccccgcgctgtacgcatcagaaaccagaagcagaaccctttgtgatccgttaaattacgctttatccttttcctcctgagcttccgctgcctcctgttcggcctcgagctcagggtcttcatcttgcttaatgcctaaaatgtcaatggtctgctgatccatctcgccgccgtaatatttgtcgagcacctgttgaaacacgtcgatactcgggtcagtcagatggaacagcgtcatcgatgaacgcagcttcaaatcgtcaggaaagcccattacctgtctggcgtcgtcagtgtcgagcttcagcagcgcctctgaaatttcgatcagatgggcgcgcagcaccggctgctccagataagcctttgcctccgccatgtcggcgatggcgtaaaactgagatttggcgctgaaaccaagccccgcgatttgcggaaagatgtaccacatccaatggctttgcttgcgccccgcctgaatttccttcagcgcggtcgggtaatcccgttcttgtgccgttaaaaaacgattcatcggcaatgccatgttgttcacctcttatttaaacaaagtttaaaacaaagacttcagccaggaccatagggtttgaagcgggtggcgcaccatcgcctttaagaacgtgatgctctgctgctggcgcttggcttcgtccgccatctgctgatcctgcgcttcggttttcaagcagttggaaatttttgtcccgtcaatttttgtgctatagcctgtcaatttgttttcggtgacggtgtattggattttttcgcccttttcgtattcgtcgacggcttcaaacatcgtcttccactgtccggacgaattggcaatcacgatttggctgtcggccggttcgccgtttttgagcagggttacaaccacagcgcttgggcggtcgtcgtagcggtttttgtgatcggtccaggtgatccgcaccgggatgtcaatcgtatccggcgtgtgcttgtgaatcagaaggaagccgccttccatgctgcccatctgcgacaaatcgtaatccgtcacgctcgcttctttcaccgtgtagcggatcgccttgccgtccgcaccgtatttgcggacgctgaaagcggtggtccagccttcaccggctgaaatagacgcttcgtcgaccggatcgctgctgccttcggcgtagagcgtcagcttgatcgtcttggggcggacgccgtcctgatcgtcgctgtcgtcccagatccggttgaccttgatgtcgaccttttccgggtcagacgcgatgaccaacgtctgcgtttcgcccgatttgatcgtgacgtcggccgtctcggatttttcataacccgcagccgcggtctgcgtttcgaccgtgtaatccccggccttgagctgattcgcttcggccttgccgctgccgtctgttttcaccgtcgcggccaccgaaccgtcactcttgtttttaatgacaagctgcgcgcctgacacgccgaggctgtcgtcgtcggacgcggtgtcctgaatcgacagcgtcccgtaggccgtccccgaaagggtgccttcggtggacggtgcgccgccctgggcgttcttgaaggtgaggctccccgacagatcgtagtgggatgccgcataatccgtcaaggtgaccgtcacggttttcccctgaaccttgaccgacgcagactgggtcttgtcgtccgctgagggcgtcaggctcaaattgtcctgattcttaatcgtcagcccgtccggcagcgtgaccgtaaaataatctcctgccttcgcggcgtccgaattgattttgaaggtaaccttgtaatctgaatcgccgtcctttttctgttcgacggtgacagactgggttaaatcttgactcgactggctatccggctcggcgtgcacacgcatcaggcagaacaggctgacgagcatgaccgtcatcaaggcgatcacaatcgtgatcagccattttgtttggatactccgttttgttttcataatctctctttcttatctgaatctctctgttaaaaatctataaagatacagcttcattatatataaaaagagagaattgctcaagtgctgagccccattccttcataaatcttaatgaatttcgatgcggccgacgcagtccggatgctggattttagccttgaccttgtcgctgaccgcctgcccctctaacagcgcgacgagcttcagcccgaggtcgacgcaatagcccagaccgatgcccgtgacgatgtggcggtcgacgcagattccttcacccgtggcatccgcccctttgagttgatcctcgaaccccggataacaggtgacgtgatagccctttaatatcccaagtttgccaagcactgacggtcccgcacaaaccgcaccgagatacgttttttcgagattcgctgattttaagagcttgcgcaggcccttgtgggcatatagattttgaaccccgagcccgccgcccggcagaaacaaaagatccgcgtctgaaaaatcgacctttttaaatttcttgtctgctttaatatctacaccgtgagatgaatgtacggtcttttccttcatgaccgagaccgtcgtgacatcaatgccgccccgccgaagcagatcgacaatggtcaggcattccgtttcttccatgccgtcggccataaaaatataagcgtgatgcattagatgactctcctttttctttgaaatataacataaataatgcgttatctttacatttatattatacgccatccaattgaaaaaacgcaacgaatttgatataatacttctaaatttaagacattaagggggccttgattttggataaaaaagtttataccatgctgaatgaccagatcacaaaagaatattattctgcatatttgtatctccaaatcgcagcgtatttcgacgaacacggtctggacgggtatgcagcctggtacgaaaaacaggcgcaggaagaagaagaacacgcgatgaagttctaccgctatcttcacgaaaacggccagaccgtcaagctgggacaaatcgacgcgcctgatgtcactttcaacgattttctcgaaccggttaaagcggcactgggtcacgaacaatacatcaccggctgcatcaacgacatcatgaccgctgcgcgggaagctcacgattaccgcaccgctgaattccttcagtggttcgtccacgaacagggcgaagaagaagttaacgccaaccgcatggttcagctgatggaaaccttcggcggcaaaaagatcggcttgttcttcttgaacgaaaaagttaaagaacgtcaataagcgatgcccgcgcatcaaaaaagctcaaagcttattttaggctttgagctttttcttttgtcaaaatcaaaatgggaaagtgacattttgattaacagctcctccttttatgtataaattttgatgatcctgctaaaaaaataggggcgtgtacttatatttagtcgtttaatttgttataataaaataaacaaacaaatatttactttaactgttgtgacgtttatttatgttgcaaaggaagtgaatattttggtcaaaaatgtacgcactcaccttctcaccgcttttgacaaattaatccaggcccattccttggatcacatcacggtttatcagatttgtcaaaccgccggcgtgagcaggcagtctttttactaccattttagggatattgtcgatttattgtccgcctatatccaggaaacctttaatcagcagatgaacgtccaccgcgtgccattccactggtctcaatcctttgatcatctgcttcgttatgttcaaaaaaatcaagttaaattctcacacatctattattcaaaattcttttttgattttaaacaaattcttgaggattatgcaaagtctattctgcggccgaccgtcaaggcccgcgcgcactactaccgcgtccctcttcatatggaagatgttgagctcatcgtgtggtttttcaagaatattttcgtcgaagaaattctgcactttatcgacaatggtgcgatctcgccatccgaaagcgtgatgaccaaatacctgaccttcgtcgacctctctatggatgaagttgtcatccacgctttcagcaccgattctgtcccttcaacgcggacttaaatctcacggcacataaaaaggacgtttccaattgaaatgcatcattcaatggaaacgtcctttgtttattttatcgcgcgttcaatttcactcatttatttttcaacatcacgttttctgttgaccgtgacaagggtgatgcccgctgcacaagctaagatcagccacgcgattgtgttgattgtatcgccggttttaacgccaacgcccgtatgcggcacgattggcgtcacatgggttgtcgtgtacgtattgtcgagggtatacccatttgccggcatgccctctgccttcgtcttcaacgtcccgtcgccattgtccgtcaccgtaactttgatcagcttcggctggaaatccttctgataacctttgggaaggttcgtttcgttcaaaaggtaataatggattccgacgtctttgagatcgtaattcaatgcgtcgaaggcgaaactgccgtccgccgcggtcacggttttcatcggcaggcctatgccgacaccctgagccgtaactggcgtcaacgtgaaggtaaagccgttcaatttgccgtcctgcttgccgttgacggttttctgccctttaatgacggcagaaccagctgcatcgtatttatttttaaattcagcgttttgaccgctgcctgtgaccttggcctgaagctggccgttgccgtcgtctgtgacctcgaccacgatgattttttcgctgctgtcgtaggtgacgcctttcacattccccgcgtcttccttgactgtataggtgtaggtgccggcttgattgtaagtgaccgcgccaaaatcgatggtgccgtcagccttgttggctgccgttgtctttttcggcatcggcgtgcccgccgccgcggaaatggtgaaattgaactcgccgtctttaagggcgcggccagtcaaagctttatctgccgagagcgaggtcgtgatggatttcggcgtgtacgtattggtaaacaccgcatcgctgcctgcgcctttaactttagcgctcagcgtaccgtcgccgttgtcggtgaccacaacctggactgtctttgtgctgctgtcgtaatgcacgccgtcgaggctgcccttttcttccttgatcgtgtaggtgtaggtgcctgcctgatcgtaattaatgctgccaaaattcactgaggcgccgtcgtttttcacggtcagcgtgttgtttttggcgtctttgggcatcggcgcgtgattttcgccagtcagcgtgaagctgaattcaccgtccttcagcggccggccttccaaatccttcaccgccgtgatcgacgcgttcacactgccggtcttgtaggtgttattgaacaccgcatccttgccgccgccggacacgtcggctttcagctggccattaccgtcgtccgtgaccgcaacggtcaccgttttgacactgccgtcgtagcttacgccgccgagattccccctctcttcctgaatcgtgtaaatataggtgccggcacgatcgtaggtgatggtgccgaaatcgattttcgatccatcgtttttgaccgtcacctgaccgtctttggcgcctgtcggcatcggcgcgctgtccttggctttcaaggtaaagctgaattcaccgtctttgagggcgcggccggtcatcgtcttctgcgctgtgatgtcggctaacgcgggctttgctttgtacgtgttggcaaaggtcgccgccgatccggcgccattgacaacggcagtcagggttcccttctgcgtatcttcgttcacgttaaccgtgacggttttttcactggaatcgtaaatgacgccgccacttccctctctattttccttaatggtatacgtgtaggcccctgtcttatcgtaggtgatgctgccgaagttgacggctgagccttcgtttttaactgttattttgccgtcttctgcgcctgccggcattggcgcgttgtccttcgctgtcaaggtgaagctgaactcgccgtttttgattgcccggccgctcaacgttttaaccgctgtgatcgaggccgccgccggttgaagctgactggtatttgcaaaggtcatggcgtcgactttttgatcccccttcattatcgtcgatgccgcggtgattggctgatcctttccgctttgggcgacctttacagatactttgtacaccgtagaatcgtaagttgttcccgaatcgtctcctttcttttctttaactgtataattgaaggttttgccaacgtcgcttgcgctgtatgtcagcggatcgaattgaatcttgccgtcggcattgtttttttttgtctgcagcacattgccatctttatcgagcaattcgaactggtaaatatgatttttacccggcgcctgaccgttgagagttttagccgccgtcagatttacctcggcgtctttcgtcgtgtagaccgtgttgccgccggctgtgttcatcaccgtgtagcccgccggcacgccactcatattgacgaagaaccgagcgaaaagcgtcgtgtttgccggcagtgcctttttattcgtaatgtgaatcttctgcggatcgttggcgtcctgcgtgatggtgaaataatcgctgttcgccgcgctgacgtatttcacgtgggcatctaaggtgtccgtgaagtcgatctttccggccgcgattgcattgttatcccagaatttgaacgaatacatcacctgctgatctttgttcgcgttggtgatttcggtcttgttgaccattttttcgccgttgacggcgttgtagctggatccctgcagcacgtagccattgcgttcggaataggatttaccgtcttcgttgtaattgatcgacgcgtaattggtgtatttcgaatgctgcgtatcgtcgactttgacccagtaattgatttgaatgcactgatttttcaattctccggaataaacgaaggtcagcttgtctccagaaatcgtcaggttatacaagctcgaatcgaccgtctgtccactcggataataggtgacttccggcgtttggctcgtgaagtgcatgccgccgggcagcgtatcagtgacggtgatgttcgacatatctgtctttttcgcgttgacgtacaggcggtacttgtacaccccgtccgtattggatttgatcacgccgatctgcttggcgctgtttccctcaccatccgaataatcgtaatcgccgtaactgacgtcgtcattgtcaaagccatccttgacgacggcgcgggtttcactgccctccgtaccgcttgaggacgagctcggattgactgtgatcgtcttctgcgcgccgccgatcgagattgtgccggactttgacgtgtccgtgtcgtttttcatcgtcaaattgacggcaaaggagccgttcagcgccgatgccgcgttgggcccaaagatcagcttgtactgaccgccgccgaggtcctctactttactgaagtgctgagacgaaaccgaccagtccacattggacacaatttccgtcggaatcgagacgaggacgtaatcgccctcactcatcgatccctgatcaatcgtgtaatcgaccgagtaggtcgccgtcacgccattggaccacgtatccgactgagacgtgatcaccgcgtgaaaattggacgtcttgtccgcgccgccagccgccgaaacgcgcgacggcagcgcgccaatcaccagcaataggcctaaaaaagccgttaagacgaatagtctcccctgtttttccatagcaatcttcccctctcttaaacaattttttactctaactgttgtgttatttttattttaatttcagcttaagaaaaggaacatagacagattgcgtcatttgactaaatgcgcctgacaattttcacttaatgttgaaaacgaatacgatttaaatcatatttatggctttgcaagaaaaaacatccttactgtgaatgcagtaaagatgttgattgtttgatcgatcaggattttacttattcttcttcaaaaacagaatgcccgaaaacggcgccagggcgcagaccactttgccattttgaacgctcaagcagtgtttcggattttcaacagtgccgccgtatttttcgtcgttgctgtgaatcaacagctcgtagtccgcaagcgtgccgggcagcacttcgctgtgtcctttgtcgctgaaattgaacagcgcgaggatcgtttcgccccctccgcggcgttcaaatccgtagaccgtccggtcttcgccgtgaacttgggtccattcaaagccgtcccggtcgtagtccttcgcgtagagcgccgggtgatttaaatacaaatggttgaggtcgcagatatagtggtagaaggcttcgtgaatcgggaattccagcaggttccagtcctgctcccgcttttcgtcccattctctgaagtggccgatttcgttgcccatgaagttcagcttcttcccagggtgggcgatcatgtaggcgtacatcgcccgggcctgggggaatttgccgtcgtagtccccgttcattttctggagaatcgtcgccttgccgtgcaccacctcgtcgtgggaatagggcagcaggtagtgctcattgtaataatacatcatcgagaaggtgagcttgtggtaccggccgaggcgctgctccggcgaggattggaaaaatgagagggtatcgtgcatccagcccagatcccatttgtagtcgaagccgagaccgccttcgtccaccggcgcggtcaccttttcaaaattcgtagagtcttccgccatcagcacgcagctgggatggcgcgccttgagccctttgttcatcgtcttgatgaaatccaccgcgttgtaattcacgccgcgggcttcgtcgccctgccagtaaatgatacgcgagatcgcgtccatcctgaggccgtcgaaatggtaggtttccagccaataattggccgccgactgaaggaagctgcagacttcgccgcgggagtggatgaagtttttgcttccccattcgctgttccccacgtcctgattagggtattcgtacagcggcgtcccatcgtaattggccaggccgtagtcgtccaccgcgaaatgcaccggcacgaagtccatgatcacggcgatgtcgtgctggtgcagctcgtccaccagcgccatcagccccgccgcgtcgccgtagcggctcgtcgacgcgaagaagcccgtgttctggtagccccagctgacgtctgccgggtgttccgacagcggcagaaattccaccgcgttgtagccggactgcacgagataggcgatcagcggcccggcgatttcttcgtaggtgtaccagtcaccgtcgggcgcgtcccccttcttgcgccaggagcccaggtgcatttcgtaaatgttttccggcttggataccccgtcatctcgtccgtccatccatttttgatccttaaaggtgtaggcgccgagatcccggatcaccgagcggtgtcccggccgcagctccatgccgaagccgtagggatcgcagtgctcaacacagccgccgttgtgataaatttcgtaggcgtagtagtcgccgggcgccgctccggcgatctcgcattcgtaaaaattgccgtcgtaaatttcgtgcatcggcaccgttttttcgccgtcttcctgccacaggcgcagatcgattttatctgccgccggcgcaaaggtccgaaacaccgcgccgtctgccgtcaaatgggcacccaaaaacttgtgggcgtcgaaacaatgtccagtataaaattggtaaaaatccataacttcccctcatgcttgtcagattgtgcgctcaaatgagaacgcttgctgtcttttattttaccacggcgcgccgataaaagccacgcgacaccgcacaaaagccgtgccgcttttaattaaattttatgtttcggcgataaaatacagttgaactccaaaataatatcagaagtaaattgaaaaaagggaggtcttatcatgtcgatcttggcgggctatatgctgccccatccgcctgttgccgtgcccgaaatcggcaagggcgaagaaaaaatcattcagaaaaccctagacggctacgacgccgtcgcccgagacattgcggccctcgcgccggagacaatcattttgtcgtcgccccacgcgccgatgtaccgggattatttccacatcgcgccggggagcgaagcctttggtgatttcggccccttcggcgcgccggacgtcacctttgacatccattacgacaccgcgcttcgcgacgcgatcgtggatttggccgaaggtgaaaagtttccggccggcacaatgggcgaacgcaccccgtcgctgaccccggatcacggcaccctcgtgccgttgtatttcatccggcggcgataccccaacttcaaactcgtgcgtctggggctctccggcctgtccctcgaggatcactggcacctcggcgagctcatcgcgaaggccgtccgccagaccggacggcgctgcgtctacgtcgccagcggcgatttgtctcactgccagaaggctgacggcccttacggcttccacccccaaggcccggaatacgatgcacggctgatcgacgttatgagtcagggggatttcgaagcgctgctgcacttcgatcccgcctttttagacgctgctgaggaatgcggccaccgttccttcacgatcatggccggcgccttgtctggcctatccgttacgccccaggtactctcccaccagaacaccttcggcgtcggctacggcaccggcattttccgtgccgaggacccttacgtcgccctggccagacagactgtcgaagcctacgtcaagacaggcacgctcatcgccgtgcccaacgggctgcccgacgcgatgacccagaaccgggctggcgtgttcgtctcgatccacgaaaggggccagcttcgcggctgcatcggcaccttcatgccggtctaccagaacatcgccgacgaaatcatccacaatggcgcggccgccgcgacggaagacccgcggtttcggcccatcgcgcccgctgaactgccagccctcgatatttccgtcgacgtgctgacgacgccggagccggtgcagtccgtcgacgccctcgacgcgaaacgctacggcgtcatcgtcaccaacggcgcgcggcggggcctgctgctgcccgatctggacggcgtcgacaccccggccgaacaaatcgccatctcgaagcaaaaggcgggcatccgccaggacgaaccgatttcgctcatgcgcttcgaggtggtgcgtcacgaggccttaaaatgagcgcgccgacaatctgcccggtctgtccccatcactgccggctcgcgcccggagagaccggaatctgccaagcgcggacgaaccgcaagggctacattgtcccgtccggctacggggtgctcgcctcaatggccctggacccgattgaaaagaaacccctcgcgcgcttcatgcccggttccaacatcctgtccatcggcttttacggctgcaacatgcgctgccccttctgccagaactacacgatctcccaaagggcgcccaagcagaacacccgccgcgtctcgcctcgggaggtcctggccgacgcagccgacctcaagcgcacccgcggcaatatcggcgtcgcctacacctacaacgaaccgctgaccaattacgaatacgttcgggatacggcgcatttgattcacgaggccggcatggtcaacgtgctggtcaccaacggccagtgtaccgatgcggtcctgtccgagctgctgccggacctcgacgccgtcaacgtcgatttgaagggcttccgcccagagatctaccgcgcctgcggcggagacctggagacgacgaagcacttcattgcccgcaccgcggcccactgccacgtcgaggtgacgacgctgatcgtcccgggcttaaacgacgatcccgacgacatggcaaaagaggcggcgtggctcgcggacgtcaacccggacctgaccctgcatctcacgcgctactttccgatgtaccgcgcggtcaaaccgccgacgccaatcccgacgctcaacgccctcaaagctgtcgctgaagcgcatttatcacacgtcctgctcggcaatgtataaccgcacacaaaaaaacggcgcgtcctcacaacgcgccgttttgctttattcaaatcacaattctattattctgttttctttctgttcgccgcccgcttttcgcccagggcgacgaaaattttcacgatattggttttcgaaagccggccgacgaccgaaaatctttcttcaccgtcgtcggtgtggaccgtgccgatcggcagacagtcgacctcgtaatgcagcaacttttccgccgccgaaagcaccgtgtcctccggaccggcgtagacgattttcgtccgcggcgtcatcaccatcgagatcggcattttcgacaagtcgtcccgccccatcgcgctcttgatcaaatccttccgggaaaccacgccgataacgtcctccggcgtcccgacgaagagggtgccgatgtcctcggtgaacaggcggtaaatggccgaatccacatcggaatcggcgcgcacgacgatgggctcagacatgtaatcccgaatgcacaggctggcgagcttttcctgaaccggatcctcaccgccgccgacgtaatagtagccgaggtggcgccgcgctgaaaggatctgccccgacagcagcaccgcgagatccccccgaagggcgctgcgggtcacctgcagcttgcgggcaattttttctccggtaatcggctgttcctttttcacaatttccgcaatacgtttttggcgttcagtgagctgcatcggttcctcctttttcgcgttaatagtccattatttgatacccatttatcttatcacagttataagtatatgccaatacgatgaaatcctttttaacttagttttagcaaagagcgatagatttttcgcaagttacggcacaaaaaaacaagcgcctgaacagaatttaaaatctattcaaacgcctgctttggattacctataaatttgaattacacgaacagcttgcgcacgacagtgatgcgcttgttgacgagatcctcaaacaaatcgccgtccgtcggattgccgacgatcgcgccgtagtgcatcggaatcgcgactttcgggttcagcgcgttgacaaaatccgccgcttctttggcgtccatcgtgtacgtcccgccgacaggcacaagagcgacgtcggcgtcgatcgccgtgttttccttcaaattgtccgtgtccccagcgatgtaaatcgtcgtgccgtctaaatcgagcacgtagccgagccaggcgttcgccttcgggtgaaaggccttggttttgttgtaggccggcactgcctgaatgcggacgccgtcgatcaaaacctgctgcccgggcgcgagaccgatggcctggcggtcgccggcgtagccctgaacctcgtcgatgcacgtcgccggcgcgacgaaggccgtgtcatccttgcagaccttgtcgaggctttccggatcgaagtggtcgtaatgatcgtgggtgatcagcaccaaatcggcgtcgtgggacgcgtcggtcacctggaagggatcgctgtagaccacagcgctgcccgcgagcttaacactggagtggctgttaatcgtgatgtttgagatgttcatggctcactccgcttctccagccttccaggctgaaagggccttagccagttgatccggacaggacgtgccgcggccgcggcagtcgatgccctgcagtttgtcgatcaccgtgtccaccggcaggccttcgaccagcttcgccacacccttggtgttgccgtcgcatccgccttcaaaggcgacgtgagtgatcacgccgttgtcgtcgatgtcaaattcgatcgcgcgggaacaggttcctttggttttgtaaatcatgtcagcctccttcatgctgaaaatctttaggcgattcggctgaaacgccgcgccaaacacgtttatatccgtcagccgtctccgagaatcggctcgatggtcttaagatagtagccggcgatgatctcaggcgcgtcggccatgtctctggagatccaccagtccagggcgtccacaaaggcgccggtgatgtgactcaaaaggaaatcctctggcagatccgcctcggcgatagctccgccccaaatcgcctggaatgtctcggtcaggctgtgcttaaagtagtgcagaaacagcgcccgggagctgcctttgagcatcatgaccaggttgcggtgatcgtcccgcaaatggtaaaaaatgtgggtcaccaccgtcgccgcgtcgggcttgacgccggaaaaatcgtgggaggattcggcgtgctgatggggcgcaaccacgtgggcggagatgtccgcacacagctcggcgagcagggtgtccttcgtctcgaaatgggcgtaaaaggtgctgcggccgacgtcagccaaatcgataatctcctgaaccgtgatgtccgagtagcgcttctgcgtcaaaagcgtccggaaagcggagagaatcgcctgacggcttttctgtttcctgcggtcgggccggtttgccatcgtcatcctcctctctgctgcatcggttaaatcgttaatggtacaaattcaccattttgttcggtaacgaatagttgcgcatttttgattattctatcggaatatcttttattttacaataaatttaaacgaaataaaagattggaggccacttcatgattcaaaaatggctcaacaacgacacccggccgaccctcgtctgcgtgatcctctcagggatcgcactggtcttgagtctcgccgctcattttcatccgattccggctttttctgtatttgacccggcctgggcagccgccgtcctctgcggcgtgcctatcgtcttcggcgccgctcaggcgatcgtcaccgagcaagacatcacggcggacctgctcgtctccctggcgctgatcgcctcgctgatcacccgggaatggttcgccgccggggaagtggcgttcatcatgcagatcggctcgctcctcgaagactacacctccgaacgggcgcgccgaggcgtcgaagcgctgatcaacctgacaccgaaaaccgccagacgcgtgacggacggcgcggaaacggtcatccccgtcgaacagattcaaatcggcgacaccctgcgcgtcctcgccggcgaaacgattcccgtcgacggcacgatcgtggccggcagctccgccgtcaatcaggcggcgatgaccggcgaatccatcccggtggaaaaagccgccggcgacgcggtgctcagcggcaccgtcaaccagcagagccccatcgatatccgcgccgaacgggaaagcgccgactcgacgctccagcgcatgatcgacctggctcgggaggccgacgcgaacaaagcgccgatcgtcggcctggccgataaatgggcggcgtggatggttctcgtggcgctgagctgcgccgtagtcgtcggactgctgacccaccagttcagccgcgccgtcaccgtcctcgtcgtgttctgcccctgcgccttcgtcctcgcgacgccgaccgcggtggccgccgccatcggcaacctgacccgctacggcgtcctcgtcaaaagcggcgacgccctcgaacgcattgccggcgtcgacaccatcgcctttgacaaaaccggcaccctgaccgaaggcacgccggccgtcacagcagtcgtctctttaaaggatggggtcagcgaaaaggctgtactcgccggggccaccgcccttgaacgctactccgaacaccccctcgggaaagccatcaccgcccacttcaaagaaacggacggcggcgccctgcccgactgcgaagacgtcgaagtgctccagggcaaaggcatccagggaaaggtcgacgggaaaaccctctttgtcggtaaggccgccctgttcgacgacgaaaccgtctctgccgcggccgaccgcatcgccgcggccgaagccacgcccatcgccgtcagcgcggatggcgacgtcgtcgggctgatcgccctggcggacccggtccggacggacgcgaaggacgccgtcaccgccctcaaatccttagggcttcacccggttatgctcaccggggaccgcggcgccatcgccaagggcatcgcggctgaagtcggcatcgatgacgtcaaaagcgacctcttgcccgaggacaagttaacccatctgaaggcgctggaaaaggacggccaccgcgtggccatgaccggcgacggcatcaacgacgccctggccctgtcctcggcccacgccggcatcgcgatgggcggcatcggctccgacatcgccgtcgaatcggcggacgccgtcctggtgagcgacgacctgaagcgcctgccccacctgatcgacatgagccaccgggccatgaaaaaaatcaaggtcaatatcatcgtcgcgatgattctgaactttacggccatcgtcctttcgggattagggctgctcgtcccgatcaccggcgccctgtggcacaactgcggctccgtcttcgtcgtcatcaacgcggcgctgctcctgcgcgtgaaggaccgtttccaaaaataagcctatgctgtcaaaattgcatcaaaaaaagaaggcctgacgccttctttttttagtttgagataaaatttgaattattcgagttcctcggcctggatcatcgccgtatcctcgagaaaatcgttgagggcctcgcagacgtcctcggggtcgagctcgtggacctgggctgcctcccgcagcgtctcgctctgagaggccgggcaggagatgcaggccatgttccagtccgcgacgaggtagtccgccgccgacgggtgcacctcgatgatctccgccaccgtcatgtcgagggtcaccgcgccgccttcagagggcgccgtctcccgagccgcctgaacgcgcatcattttgtcccgattcgcctcgaaccgcgcgcggtcctgccgggatttgtccataatcgctttgatttccttatcgtccatttatgtctcctgctttttcatcgtggcttattccgggaagatcggctggttggccgcgtccatcttttctttctgccgcggcgtcggaagcatgatttcgatcgcctgatgggccacgccgatgtcggcgcgcttgtagctgccgccgaattcgccgtcaaccgtccacgccgtctcttcttccatctcgaaggtgatgccccgggtctggaacacctcaatgtaggggctgtccgtgctgcccgacagcagcgtcgttaagatctggttgatttcgatccacatcggcggcgccttaatcagcatcacctcgaaaattccgtccgataattcgacgcggtcggagaagggcatctcgaagccgcccatgctcgtcgtgttggagatacagccgaagagcacttcccgttcctcggtcacgccgtcgtgagtcattttgaaccggctgcggtatttgaaattctggggaatcgtcaaaatcgccttcatcatgtaggccgcgtgccctaacgcgttcttaaaggtctggctcgtgtcgtaggacaccgaggtgaaggcgccgaaggccgcgatgtagttgaagtatctgtcgttgagccggccaatgtcgtagcgttcggtgtgttcgcccgcgatcgtgtggcattggtcaatcaggccctcgggaatgccgatgcccttggcgaaatcgttggtcgatccgctgggaatgtagccgagaatcgggcggtgggtcatgtgcatcatgccgttgatcgcgtgattcaacgtgccgtcgccgccgcagcagaccacgacgtcgaagcggccgtcggtttcagccaaaatggactccgccgtcagcccttccgacggcagaatcgggtacaccgtcgattcgcagccgtccttggcaaattccgcgatgatatctaaagcgtgggtgttcgccaggccggttcccgcgacaccgttcattaaaatgagtaatttttttctttccatttgtcttgtcgatcctaaaatacagattttaaaaattataacatagaacctttgactttacataaaaaataccgaaggtcacttaaccttcggcaaagttatcgcttttttagacgtccaaatcgatcagcccgctgatcacatcctctacgtctgctttttccatcagcttcggcaccggataggccgggcccatttcgccaacaacctgtgcggcgagatcccgcacgtcgccggggcggattgccgcaaaggccgtcggcagaccgagactgacgttcatccggcggatgcgttcgattaacgcctcggccagctcttcgtcttcgtcccattccgttccgaggcccgcattgtaggccaattccgccagctttccggcgcaggcgtccgccgaaaaggccagcacagccggcagaactgcggcttttaaagacgccttcggcaggttgtaggcctcgctcagcacattggcgatcgcgtaggtgtagcccgccatcccccggctgaaggcctcgccggccagaaccgacgccttctggagattttggagggcgcgccaatcgcttaggtccgccgcgcgcttttcgagattgtcgaagacgagacggctcgcgtcgagggcctcgctccggacgtcgtcggcgtcaaacaagccgatgtaagcctcgaccgccaccgacaacgcttccatgcccatcgccgcggtctgttcggcgtccagcgccaacagcaggtccggatcgagacagacggccagcgggcagagcttcgggtcgaccaccgcgaggcggcggcccgtttcttcgtcgaaaacctcagcggcgatcgacgattcgcagccggagccaaaagccgtcggcacggcgaacagcggcggcagacggtgaaacacgcgcccgatgccggccattttcggcaccggcttgacgttggtcacccgcgctgcaatcagcttcgcacagttcagggccgattcgccgccgaccccgagaacgccgtcacaaagctcagacaggtagcggtccaccgcgctgtacacgtcgtgaagctccggtgcctccgcttcctgcacgtagatcaccgattcgatgtcctgatcggccagatcgctttgaaggtccgccatcaagggctgcgccgcggcagcctcgtcgcagacaatcagcaggcgccgcgcgtccgtcatcgcgatgacctccggaaagcgccgaaccatgccgacgccggacagcaccggcggcttgggcagcttgaccaggggcagcaccgcccgcgctgtgtattgaggtatccgctccgcgtattttctgattttcatcgtcattcctccgcttcgtggtatgggtttattctaaaattacaggtttaaaaaggcccgccatttgtcttcgttaaatccgaggatcacgcggtcgggcagggccagaatcggccgcttgacgagcatgccgtcctccgcgagacaggccgccgctgcttccgggctcatttgaccgacctgatccttcaggccccgttcccggtacaatttgccgctggtgttgaaaaatcggcgtaccggcagctccgagcggcccatcagcgccagcagctccggcgccttcagccgatcggctgcgatgtcccggctctggtaggcgacgccgttgtcgtcgagaaattttttagcctttcggcaagtcgagcatttcgggtagtatacaaacagcggcagcggctttgaaagctcgtcccagtcgtaattctgacggtattcgtcggtcaggtggtggctgtcgccgatgtaatccgtcgtcaatttgtcggtgtccggatcgtaggtgaatttgctgaccgccacgttgtcgagaattcgggaaatcatctgatcctccggatgaccctcggcgtagttcaagaacgtgtcaatggcgaacccgtgggacgccatcgcaatcgtcttccccgggtgggcccgcaggatcttcatgaccgcagccgtgacccggcggtacacctccggcccggattcgccgtccggcggcgcaaactggcttggcgcctcgcgcatcgcgtcgagcagattcgggaaaaacacgttgatttccgaaaagcgccggccctcggcgacgccgccgtaaatttcggtgatgtccggctcgatcagaatcggcaccgtgtccttccggtccccgagaatgtaatccagggtctggcgcgcccgggacaagggcccggtgacgccgagatcgatcggaatgtctttaaagtacgctgtgagtaatttaccctgcgccatacccaaatcgttgagcgggatatcgcttcgtccctgaaggcgcatttcttcgttgtattttgtcgtgccgtggcgcacgagataaagggttgttgtttccataatgctcctaattgtttttcttcatactgctctattataccacgagacgcgccatctgccaaaaggtcggcgcggagtcttaaacccgcagtgcgcatgaaaaaacgcctcggaaaaatccgaagcgttgtgatgacgacagctattttattcctgttccaaatcgaagatcttcccagggttgagaatgtcgttggggtcgagagcttttttgatggcctgcatcattttgaattcggccggatcggtgtattttgcaaaatccgcgacccgcttgtagccgatgccgtgttcgccggacatcgagccgcccacgctgtagaccagcgggtaaacgtcggcgtggaaggcgtcgaccttttccttccattcgtcgtcgtcaaagccgtaattcatcagcgccgtgtggatgttgccgtcgccgatgtgggcgcaggtgatcgtcgggatgtcgtgcttcttttcaaaggtcgggatggcttccatcacgtcgatgattttatccagcggcacgacgaagtcttcctgatagtatttcgggctcgcttctctcgccgcttcgccgaagttccggcgcaggttccaaatcgtcgatttcggttcgatgatccgcacgtcttccgcgcccatttcccgggccacttcgtcgatggtcaccagctgttcgtccatgtaggcttcgttgaaggtttcgatggtcatgatcacgtagacgcagaattcttcagcgaagggcgccgtcacatccaggtattcagccacggcgttgattgccttgtagtccagatattccatactggtcgccacaatgccttccttggtcaggcggttgggcaggcgcagcgccttggcgttgtcgcggaacaccgcgaccacatcctgacggtatttcggcagaggcaggagcttgacggtgatttccgtgatgatgcccagcgtcccttccgagccgatcatcagctgttctagcgcgtagccgcaggcgtttttcttcgtccgcttcccgacggtgacgatgtcgccggtcggggtgacgaccttcatcgcgtaaatctgatcccgggtgacgccgtacttgacggcgcggtccccgccggcattggtcgcgacgttgccgccgatcatgcagctggtcgccgagcacgggtcgcccgcgtaaatcaagcccttggccttcgccgcgtcctgaagatcggaggtgtagacgccggtttccacgacggcgtacagattgtctgcatccagcttcaaaatgtggttcatcttcgtcagcacgaggacgatgccgtggtacaccggaatggctccgcgggaaaccgaggtgccgccgcttctcggtgtaatcggcaccttgtactggttggccagacggaccactttcgcgacttcttccgtcgattccgggaagacaaccagctccggcatgtgatgaaaacggggatccccttcctgatcggtctggtaggactggagaatatccgggtcctgtttgaccttgtgttcacccaacgcgtcgacgagggcgtcgaccaattcttttgtgactggattaaaactcataccatcagccttctttcgtattatgatgttaaatttgtctagaacttatattgtatacaatgttacggactctatcataacacctgattacaatttacattatttgtttttttaagaaaaatcaattacatatttatattaaaaaagcaggcgctcagcctgccttaaaaacactcatattttctcaaagggttcggcgcccgtttccttgatgaccatcggaatccccgagacgcagaacacgacgcggtccgcctctgcagccaccatttggttcacccgtccggcgatgtcccggaacagattgcccatgcggtacgccgggacgaggcccatcccgacctcgttggtcacgatataactttccttcttcgttcgaagggcgtggagcagatcctgcacgtcggccagaatgtgatcctcgacctcgccggcccgggccatcgagatgtggtcccagtccttttcgagtgccatcatttgattggtgatcatcaccgtcagacaatcgtacagcaccgtctcagcctcagcgaaggccggatcctgcatcagcgtgcggtagtccttgtactgctcgatggtggcccagcgcgccggccgtctcgcctgatggtgggcgatccggtccttcatcccgtcgtcaaagggaatcgccgtcgcgatgtaggccactggcgcccggccggccgcctccgaaatgaatacctgtttttcagcgtaacggctcttgccgctgcgcgcacctcctgttaccagtgtaatagccatgactccccctttactcgtccttgtacgcctggctggtcatgatggcggtcagcgccgcgatcagccggtcgttttcgtcctttttcttgacggccgcccggaaataagcgtcgccgagaccgacaaaatcctcgcaggtccggatgtagattttctgcgtttccagcagcgcgttgagatctgccgccgtgccgtgggccagcttgaacaaatggaagtccgccccggacggcaggacttcgagccccggaagctctgacagcgcggtgcgcacccgatggcgttcccggctggtgtaggatttcgtgtcctcgatgtatttctgatcctcgaatacggtgtccagcgcggtcagtgccagggtgttgacactccacggcatctggatcgccgccatttccgagatgatctgcggatgtccgaccgcgtagccgaggcgcagccccggaatgccgaagaatttcgtcatcgagcgcagcagcacgattttccgattgccgtccaccagcgaaaagcaggattccttcgacgaaaagcccacgaaggattcgtcgacaaaccactgcaccgtattcgggcagcggtcgatcagcgagcggatgtacatcggcgaataggcgacgccggtggggttgttcggattgcagaggaagaccgcgtcgggcttcgcctggcagatgtaggcggcgaaggcgtcggtgtccagacggaatttagacgcccagtccgtctgccacaggcttatctcccagccggccgccgtcagggcttcggcgtactcgttgaaaatcggcacgacgatgacagcgcttccgccggaaaaggccatcgcgtacaaatagatcagctcgatgccgccgttgccgagaatcacccagtcatccgcgacgcccagccgtctggccagtcttttcttgtgccgtctgccgtcaggctccgggtagcgcccaaggtcgccgagggcgtcctccagtgcgtacttcaaatggggcggcatgcccagcggattgatgttgaccgaaaagtcaagcatccccgaacggtcgccctgatatcctccgtgacgattcatattgtcctcctcatctctctcgtttcgctattctatctcagctgaagaaatacgacggcgatgtacaccaccgcgcccagcgccgcaaacaccatttccgagccggtcatgatcttcaagcactgatggacggtgtccgccgtcagcggtgcgtccgcgtcgccaatggtcggcttttccaccacctcgccgaaatacacattggtgccgccgatctgaacccgcagaagcccggcggccgccgattcgggatgcccggcgttggggcttttgtgcatattgtggtcccgcttgtaaacgcgcacgccgtttttaaaatcgaacccgagggccgcgccggcgatgagcatcatccacgagccgaggcgcgcgatcgggaaattaaaggcgtcgtcgagcttcgccgggaaaaagccgtaatgggtgtagggcttctggatgtagcccgtcatcgagtccatcgtgttcaccgccttgtaaaccatcgccagggtcagcggcgaaaggaaccagacgaagtgctgcaggatcaggccgacgaacatgtaaaacagcggcgcgagaatcccgtcgatggtgttttccgccgtcgtttccaccgtcgcgcgaatcacgtcgtgttccgaaagggcgctcgtgtcccggccgcagaggtagccgacctgcacccgcgcctcctcgagatcgccggccctcagcgccttcaccacgccctcaaccgcctggcgcagactcttttccgcgagggtcgttccgaggaaccacagggtcacgacgacgaacaccgccggatggattttcaggcacagccactgcacgccggtggtcaccgcgccggtcaccgcgatgacgacgacccacatcaaaaggcccttggctcgggaggcgtctttgatttctggcgtggtgttcagttttttagtcagggcgccgatcaatttgccgatccagacaatcgggtggggaatttttaccggatcgccgacgagccagtccagcgccaccgccccgaggatcagcagcatccaccacaaatagggtacagaaccagccatcagtgctgctggctcccgtcgagaatggccatgatctgatccatgtcgaccgcttccttcaccgtcttggccaataaatcgtactgactttccttaaaggcctggtaatcgtggacggcgccggccgcgatgtgcttcttcgccttgatctgattcagcaggctttcccgcagctcgtcgttgtcgaaaatgccgtggaggtaggttccgacgacggtcttgtccggcgaaaccgcaccgtcgtagcgcccgtcggcgagcttcgcgaagggcttcgtctccgcggttctcgggcgggactgccccatgtggatttcgtagccgcgcacctttttgtcgtccgggtcgatgtcgagaaagccgttgagcatcgtgcccgtttcctgggtcgtcgtcttcgtttcctcgagctcggtgtcgatgtcgagcaggccgaggccttcaatgatgtccgcttgggattcgacgtggtgcgggtcggaaatggtcttgccgatgatctggtagccgccgcagatgcccaccaccggcacgccttcttcgtgttttttgatgatcgcgtcggccatcttcgacatcttcaggtgcttgacgtcgtcgatggtgttcttcgatcccggaatcacgaggagatccggttcggaccgttcgatttcccgttcgttcttgtaatattcgaccgacacttccggatacatgtcgaacaccgtcgcgtcggtgaagttggagacgtggcggaggcggacgatgccgattttgatctggccttcgtgtttgccgtaccagcggtccgtcaccgagtcctcgtcgtcgatgacgacccgggtgtagggcaccacgccgaggcagggcacgtggagcatcgggtccatcatctcaatccccggcttcagcagttcgacgtcgcctcggaatttgttgattaaatacccggcaaagcgcgcctgttcgtcgggcggcaataatttgatcgtgccgtaaatggacgcgaagaccccgccgcggtcgatgtccccgatgagaaccaccggcgcgtcgatcatttccgccagccccatgttgacgatgtcgttgtcccggaggttaatttccgccgggctgccggcgccttcgatcacgacgacgtctgcctcagccgccagcgtgttgtaggcgtccatgacgacgtcggtcagctggctcttgtagcggtggtattccgccgcgtccatgttgaattcggcgacgccgttcaaaatcacttgagagcccacatccgaattgggcttgagcagaacgggattcatgcggacgtccggttcgacccgggcgcattccgcctgggtgacctgcgcgcggcccatttcctttccgtctttggttatgaaagaattgagcgccatgttctgcgccttgaagggtctgacggtcatgcccatgtcacttaaaatccggcacatcgccgcgcagatcaggctcttccccaccgacgagccggtgccctgaaacataatttttttagcttgctttcccattctatctcctcgatcctatttatctgttttctctaaagccggctcagcagctcgtccacattggtgacgatctccggataatccagcgcgggccggtcgacgcagagcacctgcgcgccgctgtccttcgccgccgcgatcttgtccgccacgccgccgacgtcgccggagtccttcgtcgtcacgaagcggatgccgaattggtcgatcatcaccgcgttcatcgccttcgtaaaaggcccctgcattgcgacgatatggctcggcttgtagccgagagcctcgcatttggcgaggacgccggaggtcggcagcacccggatgtagagccgctttttgtccagcggctggtaatgggccagctcccggctgcccgtcgtcgtcagcacgttgcccggcgctttctttaaataagcgaccatcgcgtcgtaatccggaaaatggcggacggcttcctgaagtgccggcgccatcgcgccgatgcccggccgctcaaagcggatgtagcgcagcttcgccgcggcgcaggccgccatcgcgttcgccgaggccgccttcgcgtaggggtgggtgccgtcgacgaccgccgtcaccccgctttcagcgagaaaggcttcgagctcgcccgcgtccatcgcgccgatgtgccacttcaaatgggcgttgggcttcggcgcgttgtaatcggatatggatgagtagatcacgtcgaagccgcgggccgacagctgttccgcggcctcccgcccgtcggcggtgcccccttcgacgaaaatcaaagggtgtaccctctgggcgtgatcatcttctggccgtcgtcggtgacgtaggtcttggaattgccgatgatcacgagggaaaacatgttgatttcctgatcgcacatctgatccagcgtcgtgatgcattttttctggccgtcgcgcatcgcgttctgcacgatgcccaccggggtcttcgggtccttgacctcgagcaggatttcctgacaggtgttgatattggtcgggcggcccttgctcttcggattgtacagggcgatgacgaagtccccttcgccggccaggcggatgcgcttcttgatcaattcccagtcggtcaacaggttggacagggaaatcaccgcgtagtcgtgcatcagcggcgcgccgagaatcgacgccgctgcgttgaccgccgaaatgcccggcacgatttccacctcgacgtcggccttctgcttttcgacgagctccagcatgatgccggccatgccgtacacgccggcgtcgccggagctgaccagcgtcacggtcttgccttctcccgccaaatccaagcattcctggcagcggtcgacttccttgcgcatgcccgaggctttaagttctttgccctgcacgcagtctaaatccttgatcaaatcgatataggttttgtatccgacaacaatatcggcgtcggccatcgaggccagcgccgcaccggtcatgtggtccgcgttgcccggaccgagacctgtcacgtaaattttcttctgattcatctttctctctgctttattttttgattgaattggccctgcgccacagggacagggtgacgccgccacccttgaccaccggcgccacgcaggcgccgtaatgggaggccgtgtagccggccggctcgctgacgccgcgcagcccggtcacccgttcgacaaagtccgagccgtcaaaccggtcctgcaccttgcggatcgcgtcgtccgccacgatttcgaccgccgcaccgaactgctcggccgccgcgatgagcccctgctcgtgcgccttcaggccgatggtcgcaaagaccgccagcgccctcgggtggatgtgatgggcttttaaaagcgccgcgatttttcccgcgatcaaatccgccggcgtgtgctttctgcagccaatgccgaggacgatgtcccggggaatcagctggacttcacaggccgggtcgagctcccagtcgtcccgctctgaaatgacgatgcggtatttggcgccgtcattttcagaaagggtaaggcactccggcagcgccacgcccgacaaatcacaccccgcctcgttgacgacggcggtcttttgtctgtcgagaatggccgcggtgacgtttttggccgcggtgaaatccgtaaaggtgcagccgatctgctcggctaaggtgtcgaccgcgatggcgccggcgacgtcggtgcctgtcgtgatcaccggcgccgcgccgatgcgcccagccaaaagccgggccgcggcgttagcgccgcccagatgtcccgacagcaggctgatgacgtactgccccttggcgtccagcaccagcaccgccgggtccaccgacttgtgcttcaggtacggcgcgatgccccggacgacgatgcccgcggccatcacgcagacgaggacgtcgtaatcggccatcgcctgcgcccaaaaggtgctgagcttgccgcccggaaagggggctgccgtctcgtccgcgtatttctccagggtgaagaccgccgcgtcgatctccggcgtcaccgccttcgcgcagcgcgcggccagcgccgcaccgtctcggctgacggccagaaaagcccaacgcttcatcgcggcttattccttcgcttttctgaattcgtggctgaagctcgggtcgtagagcttcgacagctcgtagcggtcgccgaggaaatcgccgacgaggatctgcgcggtcttgtggatgtccgccgccttgaccttttcttcgatgtcagcgagggtcccctgcacgatcttttgatccggccaggtcgcccgctgcaccaccgccaccggcgtcgtgtccggataggccgtcgtcagccggcgcaccacttccccgatgttctgaaccgacaggaaaatggccattgaggcccggtgcttcgccagggattccagctgttcccgttccggcaccggcgtgcgtccttcgagacgggtgcagatcacagtctgggagacgtccggcagcgtgaattccttcttgagcaccgaggccgacgccgtaaaggacgacacccccggcaccacttcgtaggcgatgcccatggtttcgaggcggtccatctgttcgcggatcgcgccgtaaatcgacgggtcgccggtgtggacgcggacgacgcgcttgccggcttcgacaccggcctggatgacgtcgagcacctcgtctaaggtcatcgacgccgagttgtgaatttcagccccttccttgtggccttccaataccttgggattgacaagggagccggcgtaaatgatcacgtcggcagcgtcgatcaggcgcttgcccttgagggtcatcagctcgggatcccccggccccgcgccaatcagataaactgtgtttttgttcattttaactcctttaaatcaacggcgtgctgcagatgggccgcgaacagcgcccgcacttccggcagctccccgagccccttgaccatgcagttcacgtcgaagccttcggcactcagccggttcttccacgaatcgggatcgtcgccggccatgtcgttgagggcgtggtcccccgcgacgaccataaagggcatcagcgtcacccgacggatgtgctgggccttcaaatgcgcaatgacgtcgtccagcgtcgggtagccttcgacggtcgccatgaaaatgcggccgccgccgagggccttcaggtagtagtccatcgccggataagccgcattcgcgtggtgttcggtgccgtggcccatcagaaccgccgcgtcaaccggcgacagctctggaatttggttcagcacgatatcggtcacggcttcgaaatcctcgtggctgctgagaagcggccgcccgatcttgatcgatgggatgcggtcgagataaggtctcagttcgtgaagcatgccgtaaaattcgtggccgttgatgacgtgggtcgtctgacacaagacctcgtcgcagccagccgcgacgatcgcttccatcgcctccgccggggtcatcaccgagatgccgtcccgctttttcagctttttgatgatcattttcgacgtgtacgccagaaaaaatgcgctgtctgggaaggccgcgcgcagatcctcgcagatcgcttcgatcgttttgtgataggtgtcgtggtaagaggtcccgaaggagatcaccagtaatgcctgttttcccattctcttctcctattaacggccttccgcgatggcttcgagggccttgcggttgtccgcgatggttttgtcgatgtccgcttccgtgtgggcgagggagacgaaaatcccttcgtactgggacggcggcagcatgttgcccatatcgagcattttcttgaagtaatcggcgtacatatcggtgtcgctggtcatgacgccgccgaaattttccaccttctgatcggtgaagaacagcgcggacatgccggcgcagcggttgaccaccgccttgacgcccgtcgccttgatattggcttcaaagccatcggtcaggcgtttggcccgcgcggtgacgatgtcgtaggtttccggatgggccttcaggtagcgcagggtgttgagccccatgtgcatcgcgatcggattgcccgacagcgtgccggcctgatagaccggaccgtccggcgcgagcatcgccatgatttcagccgggccgccgaaggcgcccaccggcatgccgccgccgatgattttgccgatggtggtcaaatccggtttgatgccgaaaagttcctgagccccgccgtaggcgacgcggaagccggtgatgacttcgtcgaagatgagcagcgcgccttcttcgcgggtgatttcccgcaggccttccaaaaagcccgggttcggcggcacgacgcccatgttcccagccaccggttcgacgatgacgcaggcgatttcgcccttattttcagcgaacagcgccttcaccgattcgaggtcgttgtaggtggcgacgagggtgtccttcgcggtgcccttcgtcacgccggcgctcgtcggttcgccgaaggtcagcgtgcccgacccggatttcacgagcagggaatcggagtggccgtggtagcagccttcgaatttgatgaacttttcccggccggtgtagccccgagccaagcggatcgccgacatcgtcgcttctgtgccggagttgaccattcggaactgatcggcactcggaaaagcgtcgacgagggtttcggccatttccacttcgatttccgtcgccaggccaaaggtcgtgcccttggccagcgccttgtccacatcctgatagtaaatatctgacgcgtggccgaaaatcaacggcccccacgagcagatgtagtcggtgtaggtgttctggtccgcgtccgtgatctgggagcccttgccgtggtccgcgaacaccggtgcgatgccgacgtttttaaaggcgcgcaccggcgagttaaccccgccgggaataacctttttcgcgcgcgcgtacaattgttctgatcgttcgtgattcatcttaaacttatcctcagtcctggtatttcgcgagcagttccttgaggatcggcgcgaaataggtgatgatgatttcggcgccggcccgcttgatgcagatcaggctttcgaagatcgcccgttcgtcgaggagcccttcgtcgacggcggtgcggatcatcgcgtattcgccggacacctgataagcggccatcggcaggaaggacaaatccttcgcctggctcagcacgtcgaggtaaggcatggccggcttgaccatgacgatgtcggcgccttcttcgatgtccagttccacttccttcagggcttccttgccgttggccgggtccatctggtaagcgcggcggtcgccgaaggccggcgcggaatccgcggcgtctctgaacgggccgtagaaggtcgacgcgaatttcgccgagtagcccatgatcggaatgctttcaaagcccgcttcgtccagcgcgtgtctcagcgccgcgatgtggccgtccatcatatccgacggggcgaccatgtcgacgccggctctcgcctggctgaccgcgaccttgcacagggtgtcgagggatttatcccgcttgatgtcgccgttgtcttcgaagaagcagcagtggccgtcggccttgtattcgcacaggcagacgtcgccgatgatgtagagttccggcgcgatggccttgatcttgcggatcgcctgctggacgatgccgtcgtcggcaaaggccggcgtcgcttcgccgtccttcttggattcgtccggaatgccgaacaggatgatgtattcgatgcccgccgccttgaagctttcgaccgcttcgtcgaggcggtcgatggagtagcggtactggcccttcatcgacgggatttcttctttgatattttccccttcaatcacgaataccgggtaaacgacgtcgtccatggacaggcgggtttcgcggatcagtttgcgaatcttttcattttttctcagtctggttggtaacatgttgagaccttctttcatcaatgctgtaaacacaaatctttataaaattattatacccttaatgattttttgtgcaatcttcttcgatggccgccatcagcccgtcgatcgtgtaggtgtcggcctggatgtccaccggcaggccgagggccttcagctgttccgaggttttcggcccgatcgaggcgcatttcgcgccggaatcccgaacgaccgccgcgcagtcttccccgattttttcggcgaaatatttcgccgtcgtcgaggaggtgaaggtgatgtaatcgacctgatgggcctttaacatcgccgcgacgtccacgtcggtccggtcttctctgagcgtttcgtatatcttgatttcgtcgaccggacagatttcagagagcttttcggcgacgtaggctctggcgtttttcgagcggggcagcaggatgcggtctgccgccgtcagcgttggccccagcgcttcgacgagggcttcgccgatgaaccgcgccggcacgacgtccggtacaatgccgtgggccttcagcgccgccgccgtcgctttgccgatggcggtgacggtcaggccggccagagcccggctgtccttgcccatgtcgtcgagcttctggaagaacaaatcgacgccattgacgctggtcagaatcaagtgggtgtagtcgccgaggtgggcgatggccgtttcgagtcgcgccatttccgacgccaccggctgaatccgaatcgtcgggtacatgaccgcctcgccgccctgatcctgaatctttgcgaccagcttggacgcctgggctctcgagcgggtcacgacgaagcacttgctgaaaaggggccggctgtcgaagaaacgcagctcgtcccgcaggcccacgaccttgccgatgacgatcagcgccggcgcgccgagcccggcggccttcgcggtttcggcgatgttggcgagggtgcccgtcaccgtctgctgtctcggcgtggtggcctcacgcacgaccgccgccggcgtgtccggatccatcccgttttcgatgagcttcgcggtgatgacctcgatatttttcatccccatcaaaaagacgagggtgcccttcgtcgccgccagcaccggccaatccaaatgggccgcgtcgttcttcaaatgtccggtgacgacctggaaggaggacgcgcagtcccggtgggtgatcgggatcccggcgtaggccaggccgccgatgaccgaggtgatgcccggcacttcctcaaaggggacgccggcctcgtggagccgcaccccttcctcgccgccgcgcccgaagacgtaggggtcgccgcccttgaggcggacgacggttttgccctcgaggccgagcttgacgaggagctcattggtttcctcctggggcagcgcgtggtgtgccgcccgcttgccgacgtaaatccgttcgcagtccgccggcacgtactcgagcagggcgggattcacaagggcgtcgtacacgacggtgtcgcactgggacagcacccgcctgcccttgagggtcagcagctcgggatcgccgcagccgccgcccaccaaatacactttgcctattttctgactcatccctctacttcccctttcagttgttcggccagacgacggccgagggcttccgcctcgcagcagctgcccatcaccgacgccatcgcgagccgttcgcccgaggcgtcgccgtagacgccgtggagggtcagccggccgttgcggccgatgtcgcagtaggcgccgatgggcagatggcagtcgccgttgagggcgacgaggaaggcgcgctccgccttcatctggagctcagcctgctgatccttgaccgattcgatcatctgccgcattttcaaattgtcttcgcggacttccaccgcgagaatgccctgggccggcgcgcagacgaaatccgttggctccagcggcacgacgttgtaggccgggttgtcgtaaacgccgaggcgcttcatcccagcggccgcgagaatgatgccgtccagatgctcgctgtccagcttgcggatgcgggtgtcgatgttgccccggatgttcacgcactgaatgtccgggcgcatccgcgcgatctgaaacattcggcgcttgctcccggtgccaatgacggcgccctccggcagctcctcgatgccccagacgtcttcgtgggtcaccagcacgtccgccgggtcctcccgaaccggcggcgccgccaaaatcagcccgtcaggcagggcggccggcatgtccttcatgctgtgcacggccatctgaatttcgtcggacaacagctcgtcctcgatttccttcgtgaacagccctttaccgccgatttggtccaacggccggttctgcaccgcgtcccctttggtcttaatgatcttgatctcaaaatcgacgtcgggattggccttgctgagctgatcgatcatccatttggtctgggtgacggccagcttgctccccctggacccgacgtacaccttttctctttccatattaggctcccctttctgcctcctccttcagccgttccagcggccagccggcgatctctttcaaatcgctgcgctgcgccgccttcggtcggccgtcatttaaaatgcgggttctcaaaattttcaaatactttagtttttctccgacagattccggatactgctctctgagcgttctagcgatctcccgggtcatcgacgggctcgcgccttcggtgcagaccgaaagggtcagatccccccggcggatcaccgacggaaaaaagtagtccgaccggtccgggtcgtccgccgcgttgacgagaatgccccgggccttgcagtcatcgacgattttagcgttgagggcgtggtcgtccgtcgccgccgcgcagatagaaacgccctcgagcattgcggccgagtagggcgcctcgctcacggcacatccggcgacagccttttcgccgccgtctggccggacgagcacggtgacctcgcacccggcctcggcgaaggccgcagcccggcggctgccgaccttgccgccgccgatcaccagcgctttcagcccgctcatttccaacagaatcggcagtttcatcggcgcctcctctaattttcttccgtttcgatcagccagtggtaggccttcttggcctttttcacgctggcgtcgtcgtcgagctttttaagcttcttgatcgtcggcatcaccatttttctgaactcggagcggacgatcttttcgagatagtcgtagtctttgccctcgaaatgatagcgcttgttcaagatgtcgatggtttcatcagcgcggccctgagccttgcggttcagcccggcgaccatgccgtcgaccttagccttctgaagccaggccatcatgtcgtcgaccgcgtcctcgacggcgacggcgattttctgcgcgaccttttctctataagccttggtttcgtcgatgatgtggttgaagtcgtcgatggtcaacagcgtgacgccgtcgacctgggcaagggccgggtcgatgtcccggggcagtgccaaatcgatgagcagcagcggcttgtccagtgccgggaaggcttcgctttttaacaccgtgtgaggcgacgccgtcgcagagatgatgacgtccatgtccgaaaccacgctgtagcggtcgggatagggcacgaccttgacttcgccgtgataggtatcctgataatccagcggcgggtggtaggtccggttggtcatcgtcacgtcgttaaagccctcggcgtccatgtactggagggcgagagtgcccattttcccggagccgatgatcaagacctttttgtcctgataatcctctgggaacaggcgcttgacgtgcttgaccgccgtcgacgagagagacagcggcgtttcggaaatcttgtacacggtcttgatcttcttcgagaaggtgatcgcttcgcggaaggccttggtcaggaatttgccggcgccgtggattttttcggcgttggccagcgcgtccttcgactgtccgaggatctggtcttccccgaggatcatcgagtccagccccgccacgacccggaacagatgccacaccgcgtcccggccgtcaaaggtgtagagatacggggcgatttccggggttttgtagtcgaagtaatattcctttagggcctcgaccgccgcatccgcgtgctccgccgccgcgtagatttcgctgcggttgcaggtcgagagcaccacgacctcagcgatgccccgctttttcaacgtctcggtcaccgcttcgagagagcgcacggtgaacgccgctttttcgcggacctccatcggcgcctttcggtgatccagtcccactgctacgatttccacaactgcctcctatctttcttctttctgcttaatgctttccagctgctttgcccggtaatcgctgacgatgcgctgcgcgcgctgcggcagctcccgccattcctttttgccgaaatccgttgtcggtattgccggcagcacggtcagggacacctctgccgggtaaatccaaatggacccggggcgcatcatccgctcggtcccctcgatcacacagggcaccaccggcacccggtccgccttcgcgatgcggaaggccccggatttaaaggtgtgcactgcgccgtccctgctgcgcgtgccttccgggaagatgaccatcgaatagccttcggaaagccagtgctcgctttccttcagcgccttcaccgattcccgcgggtgatcccggtcgacgaatacgcagtggagctcccgcatccacgacgcgatgccgggaattttggtgatctgctttttcgccatcatcggcttggtgtcgtcgcccaaaaagccgatcatcagcggaatatcgaaataccccagatgattggcgacgtagaccgccggcccgtccacgaggttattaagcccctcgacgcggacgtgcccgccggccatcgtgaacatggtccgcgcccatctgccgacaatccggtgcagcagggcgtcgtgctcggcagttttcccctgacggccgaggcggcggatcttgaacagcgcggggatcgcgatcagctggtacagccaaaaacggatgaaccagatcaatgtccgaaaaaacgccatgactgcctccttttgtttcacttacacttttatttttaattcaaccgcgctgaaccgccgtcattaaatagaccgggttctgcgccgtcatcatcgtcaggcccccgaccattcggccgcggctgacgccgatttcgacgacctcgacgtcgtcgaagcgttcgctcatcaatactcgggcccgggccgcgttttccagcgtgatgaagttggcgttgattttgccgcccggcgccaggtgcgcctgggcccagtcaaagatgccggccatctcgccgccggtgccgccgacgatgattttattcaccggcccggaaatgccctcgagggcctccggcgcctgtccggcgatcagctctaccggtgccgcgtcgaaatgatccttattctgaaggatcagcgcctgggccgcttccttgccctcgaccgcgtagaccttgccgcggtaggccgcgtgggccgcttccatcgtgatgccgccggtgccggcgccgatgtcgacgaccacgtcgtccggctgaatgtccagaaaggcaatggtcagaatgcggatttcccgcttcgtcatcggcgccttgccgcggacgtaggcctcgtcctgatatcctgctatttcactcatctgttacaatcacgactgacataccccgttccgagaacgtcagtccctcctctgtggttaatctcgtaatccgttcctccggataggataaatcctctccgacgtacagtattttgtcgtctaagccttctgccttcagcgcggcggcgatgtacgccgtgttgtgggtgtcgtcggtcagcacgccgacggtgccgtggcgcttcacccggccgatcaagtcctgatcccggccgtgcaggctgatcaatgccgcgtcctgccagggcctgccgattttcgcgaacaggtaggtcagggacgacacccccggaatcgcctggacgtgtgcggcgccaattactttccgcgcgtagctgagcaggctgtaaaagccgcagtcgccggacacgaccagcgccgtctttttgtgggggtacaccgccttgaccgccgccatgacctcggtgagcttgccgccgccggagccgacaatgtggacttccttgcccgaggcgtcgaagctctcgagatggcgcttgccgcaggcgacgacttccgcctcgtcaatggccctcagggccgccggcaggatgtagtccggcgcgccggggcccaggctgaccaccgtcagcttatcgtatttgggtgctgttttcatttgaataatgcctcgaatgctgccgcgccctccgactggccgagcaggccgtatttccggctgaagagcacgacctcgaccgcgatgttctggtagaccttgcgttcgcagcggatcttgacccgttcggcgaggtggtcgaagtagtcccggccgaatccgtgggcgcgaagggtctcgaccgcgtcgtctgtcgtcgtgcagtgcatgatctcggagacgcaggcctgatccgccccgtccagcgccgcgtaggccgcgaggatttccatccgcgcgtcggagtaggacgagtgggtctggaagatgccgccggcgaccttgacaagcttgcccaggtggccgacgaagaggatgcgtgcgatccccatgttttccgcctgctcgaacatgtagccgacaaaattgctgattttgaccatccggtcggacttgagtccgagttcggccgcgaaatccgcgccgtaattgcccggcacgaagaggatatcgcggcagcccttttcttttaagacagagagctcgaggcgcatggacgccttcagggattcctcgctcatcggcgtgacaatgccggtggtgccgaggatggacagcccgccttggacgccgagcttcgggttaaaggtgcgcttggccagttcctcgccctcgggcagagagaccgtcacctcaaatccgccggtataatcgtaggcttccgccacttccgccagggccttgcgcatcatcgcccggggcgtcgggttgatcgccggctcgcccaccgggatcgacagccccggcagggtcacgacgccgaggcccttcccccgcttgaagacgacgcctggatcatcgatcagccgcacggccgcgtaaacccgggtgcccttggtgacgtccgggtcgtcgcccgaatccttgaccaccgcgcaggaagccgtcccgccgtcaatgcggcagtcgaacaagtcgatcaccaaatcccagcccttgggggtggcaatctcgacggtgtctttaatctcgccggtgaagagcatcagggccgcggccttggacgccgccgtcgcgcaggagccggtggtgtagccgtagcgcatccgcttgccgcccttttcgacgtagcggttcagcgggtgtttcaggacgtcgccgctcatttcgcttttttaatcagcactgtggacaggtacgggaccttcttttccaggtccgcgatgtcccgggtgaccctttcgctgtccatgccgatgttggaaatcatcacgaagtgatcttcgaggtggcgttcccggagggccttggcaaggcccttcgcgttggcggagaccttcatgacgacgatgttctgatgggcgtcgagcaccgcgtccacttcttcctcagtctgggtcatgccgacgacgccgagggattcttcgccctgggtcagcggcaggttcaaatgggccgccaggctgcagaaagacggcacgccggagatggtttctaccgccatgccgcggtcgatcaaaaattccatcacgtaggagtaggtcgagtagaccatcgggtcgccgagggtcaggaacaccgcgttctggccccagttcagcatgctctgaatctggtcggcgttttcgccccactgtttttcgagggtttcccgttctgcggaaagcgagagcatcgggaagtccatgacgacgagcttcgtttccggtttgatgtagggcttggcgatctggagggcgatgctcggcttgcccattttcttcgtcgggctgatgatcacgtccgccgattcgatggccctgaccgccttgacggtgagcagctccggatccccggggccgacgccgatgccgtagagtttgccttttttctgttgttccatctcgcttaccaatcccttcccaatttgtaaagcatggcgtttagaatcgcgccgaccaccggactgccgccctttctgccgttgatccgaatgtacggaatgtcgtaggggtcgagctcgtccagcgcggccttcgattccgccgcgccgacgaagccgatgggcgcgccgacgattaaatccggcttgggcgcgccgtccttgatcagatcgatcagtctgtagagcgcggtcggcgcgttgccgatcgcgaaaatcgagacgtcctcgcggttgacggccttttccatcgcgacggtggagcgggtgacgccccgcttcttcgcttcggcgatgacgtcgtcgtcatggacgaagttgagcacgtcgatgtgctgcatggccagggcccggttgttgaccgccgctttgatcatgccggtgtcggcgtagatgtgcttgccggccttcaaggcgttgagcccgcgggccaccgcgttgttcttgaattcgatcaggcgcgcgtattcaaagtcagccgtggtgtggatcacccgtttgacgatgctgtccgtttcttccggaaacttgatcccgccgagctcccggccgataatttcaaaactctttttttcgatttcatgtggttcgttgacgtaatcacgcattatttttccctttctcctttgggtttaaaattggggttgcattctggatttaaaattcgttgcgcagcagctgcacgccgccgggcacgatccgccgctcgaaggcgctgtcgatctcttccgctgacacgtgcttcagcagctcgcgcatcaagtcgtcccgggcgaggcgccccggctcgtggagaatgccgaccaccgtgccgctgtggccgatgacgacaccctcgccgccgtatcggctgctcaagtcaatgagcagcggcaggtagggcttctcgaggactttctgattgagcagcgccgatttcgtcgtcgcgttgccgacggtctgcaggttacgccggtcgacgccccgctggaaggtggcgacgatgccggcgaaggccgcccggtcccgggccgtgtagattctgcgctggcctttgaagccgacggtgtccaccgtccccttgaagttgatgacgaggatcgcggcctgcaggttgtgccggaaggtcttgatgacgccgccgtcgataaagtcgaacaggttgagccgcgggaacatgatgttgtccgacggctccaccgcgatgcacagcctggcgatttccgacgcgtccaggtgcaggtcgaaaaagacgctgagggcgccggccagcgccgccaggtcggcggtgctgctggccatgcccttgcccctcggaatttccgacgcgatctcgatgttcaagtggtgcatcaccttttccgacaggccgtatcgccacaggaaatagtcgaccatggccgcggcctttggcggcaggtcgatgcgctggggctcgtcggagatcgtcgccctggcgtaaaggtcgatcgggcaggacacgaggcagggccgcccgcggtagataccttgaatccactcgccgcaggagcccggcgctcgggtcgtcagccgcctcacaggcgtgctcctttgagcgctctcgcgcactcgagcatcgcgatcaggaagtcgtcggcgccgtcggcgtagaaatgcaggtgggggtagcccgccagcgtgtgcgccttgacgtagccgccgccccaggtctgttcgcccgaggctctgcgcttcgtcaccgtgtagatttccggcaccggttcaaaggtttcgacccggctgtggtgaaattcgtgagcgcgaaaacgataggtccggccaccgaagtccgccgcgacgtcgacgtagccgaaatgctggaggcgttcggtcatgatcgtcgtcgccggcaggaagccgatgccgtcgtggcgggcgccgcccttattctggagggactgggtcaataccatcagcccgccgcattccgcgaagcagggcatcccagcctcgagctttgccttcaaatcccggcgcatcgcggcgttggcttcaaaggcttcgccgaagacctcggggaagccgccgccgatgtatagcccgtcgaggccgtcgggcaccttgtcgtcgtccaacggactgaagggcaccaggttcacacccagggtcttcagggcggtgaaattgtcgtgataataaaaattaaaggcgcggtcccaggccacgccgacagtcagatccgaataggcgccggcgcaggccgcgaagggatcggggcggccggtgcgcggggtgatttcggagagttcgagcatccggtccaggtcgacgtgggcggcggtcagttccccggcgcggcgcaccgtctccttgagcttcggcagctcgtccgccgggatcaggccgaggtggcgggagccgaccgtcaggtccgggtcctcggggatccacccgacgcagggcacgccggccttggtctcaatcgcgtttttgagcagctcgaaatggctctgggatttgatccggttgacgatgaccccggcgatgcgcaggtctgggtcgtagttcacgtagcccatgaccagtgccgcggccgacgccgccatgccccggccgtcgatggtcaggaagaccgggatcccgagggtcttcgccagaaaggcggaggagccgacttcgctgccggacatgctgccgtcgtagagccccatgaccccctcgacgatgcccaagtcgtccgccttcagccggcgggcgtacagggtcttgatccgttccgggtcgacgatccaggtgtcgagattgaccgacggctcgccggtgacgaattcgtgaaacatcgggtcgatgtaatccgggccggttttggccggcacgacgtgacacccccgcgccttaaaggcggccatgattcccatggtcgctgtggtcttcccgacgttactattggttcctgctagcatcaacccgtgcatctgatcctcccgcgcttttttatttgacttcttgtctgcccgtaggcatacccctaattgtattattatacctgatttaaatcgataatgagagatattttttagcagttaaaaggcacatgcttatcctttattaattcgtgataattcgcacttttttcgatttcttttcttaatttataatcaggacgccttgattttgtcgagccaggcgtcaaaggcttcgacgtcctgggggtaggcgccgtcgtccggcgcgacgccgtgcttgaccatgtcttcgtagacgcgcatcagcatcggcttccgcaggttggcctgttcgcagacttcgctgttcttcaggacctccactggcgagccggtggcgatgatctggccgtcggagaagaccaccagcttctgggcccagcggtaggcgaagtccatgtcgtgggtcgagatcaggagggtcttgtcctgagcggcgaggcgttccagcgcttcctcgagcattttcgcgtttaacgggtcgagggccgccgtcggttcgtcgaaaatgatgacttccgagtgcatcgcgatgatgtcggcgatggtgatccgcttcttttcgccgccgctgcagtagtggggcgcgcggtgcttgaattcggacaggttcatttccgccagggcttcgtcgacgcgcctttcgacctcgtcgtcgggcaggtcgaggttgatgggcccgaaggagacttcccccatgaccgtcgaggcgatgatctggttgtcggcgtcctggaagacgatgccgacgccgcggcgcagctcgttgagggattcctttttgtcggtgatcttttcccctttgaagtagatttcgccggcgtccggatggaggacgccgttgacgtttaagaagaacgtcgatttgccggcgccgttgttgccgacgatgcagatccgttccccgggcatgacgtcgaggttgatgcccttaagggcctgatggtcgccgctggaataagtgtattgtaaatctctgatttttaaaatgggttcgttagacattgatattcactccttggaaggtcatgatccagaccaaaacaaaataagccgtcggcacaaggacccagaacagctgctttttcgtgacgggtttcttttcttcgtagaatctcaaatcgccgttgtagcagcgggcttccatcgcgtcgtagaattgattgccccgcttcatcgacacgaggaaaaggttgctggcggtgctgccgaaggaattgatcgagcgcttcagcgtggtgtagcccagacgggattctgcggagtttttcatgcggcgctgcgtatccatcaggataaagataaaacggtacatcaaattcatcagctcgatgatcagcttcgggaaatgggcgtcccggagcacgctgaagatttcgttggacatggtcgacagcgacatcatgtacatcgcggaaatggcgccgaaggccttgcaccagaggttgaccgtcgccttcgcggttttcggcgtgatgatcacgtagccccaatgggttgggatgttgacgagggccgtggcaaatggggtcttcgagaaattaaataagataaagatggagccggcgatcatgaaggccagcggaatgccgaggaggccgatgtagtgatccatatccaattcgccgaggcagacggtcacgaaaaaggtgtacagaatgacgccgaaggagacgtaggggtcgttggagatcaggcagatcaacagcagcagcatgccgtagccgatttttaatttcgcgttccagccgccgattttcgagtggtaggcgtacatgtcgatagacagtgtgccttcgccgtgcttgtggccaaagccgtggtggtgatgggcttcgccgcggtgaatccaggatttgcggatcccgcccacgacgaggagcgccagcggcggcaccagccaaagcagataaataagatggtattgatattgcatggacaatgcctttcagtttttcattatttcaaaaaaataggctgggaggtcatccctctccagccccataaattatcattttattgttacagctcttggtcttctttgcccagctttttacgttcgacgaaacggcccaggaagaagaacagaatcccaacgccgatcccggtctgcacacagaacagcagggattcaacttcgcccggcagttcaccgccgatggctttttccataattggtgtggcccagactttgtagcttgagtcgttcttttcaaccagttcaccgccggcgtcatccgatccgccgaattttgcgccgtgggatgaaccgtatgcgaacggaacgacggcgatcaaaatgcaggcaatgatgcagatccaaatggttttcttattcgatttactcataacacttcacctctcacttacgcttcaatgaatccgagggatttcatttcgtcggtcgcgtagttttcaagcgcgatgatgatgacgactgaaatcagcccttcgataatggccagcggcacctgcgtcgcggcgtagatcgccatgttggtgaccatcgctttggcgaagccgacgttgctgtggtgtgcccacgccatctggaatgaggtgacgcagtaggtgaacaggtcgcctaaggtacaagcgatgaagatgttgactttcttgttccagtgcagcttttcgcccagtttatacagaccgtaggacacgaacgggcctgcaatggccattgagaagcagttggcgccgatggtggtcaggccgccgtgagccagcagaatggcctggaacagcagcacgatgatgccgagcacggcaacggctgccggtccgaagagcagcgcgcccagacctgtcccggtcatgtgtgagcaggaaccggtaactgacggaattttcagcgaagagatgacgaaaataaacgcacccgccatggccagaagcggcatggtccggcggttattgttcgcaatctttctgattgagaaaaatccccaaacgataaacggcaccgcgatgacgccccagaaaatgcacaggctcagtggcaggtagccttccatgatgtgcattgcgttggcagccggcgcgacgccaaaacaaatcgctacagctaacgaagccgcaacgacccacatttccttctttgacaaacgagttgacatgaagaaacctcccttataaaaattttttatgttcagttcgccgtctcgtcttgatcaaaatagatgagtccaattttgtaatttactgtattttcaagacgggcgtgtgacggctgaccacgataatataggtcattttcctgaaccgttaattactaaaatattatattgattctaaacaaaaccgtcaatatcctcatttaaatttacaatcttaagttgtccgtactttttgaggtttggattttacctttttaaagtcccaaattcaggagttttaaactttatttaagtgtttttttggcgtgcaaccatcacttttttgttgatacccttaagatgtatgcggtttctactccatctccatcccatctagctgccgaatctgatctctcctgtaataaatcacagcagtcacctgaacgcggtggtgctcatctctgcgccagcgcctgcctggtaactcttacctcatacccgcgcataggctacagctcgtccttcaattggcgaaaagcttcgccgaccgataccgattcgttccttttggcctgatcgaggccggtctgcatcatcccgtcaaattcggccttggtcatcgcgtcccgggcggccaatttgtccggaatgttcagcgaaaagggcacgccgtcgtgcatgatcacctgccggtaggtcatgtcgataaagaccgagaccggaatgcccagtctgtcgagaatcgcctccgcctgctttttgatatcaggctgaatccgcgcggtgacgtttgctgtttttgctgccatcgtgtccacctccttattggtttctgtgtaccacgatgtcaagcgtttcgcaatacataaaacagcccacctccgatcttagaattaagctttcatcttcttttggtctcaggtcttattttgctgtatagaattgtgcagattgcaataacatttctcaatacattcaatgcgtgttataatagaatataattatttcaagcggcttttaacaatgtttttggaggagaatcgatgcggatagaagacgttgttgatcaaacattattaaataaatatgaattttataattatggccacgcacttgaaattttggttgacgcttacccggaggaatggaaagaattaaaagaatgtctgagtcaattaaaattatcattagcagacattaaaatttctggtgggaatgaatcccccattccgaagaaatttgatgatatcctttaccctttcgggtggcgtgaaattcgcatcagcggagatctgctcgtgaagaaataccccagacaaaccgcgcaaagacggggcaaattcaaaaaagagccattcgaaactatgacacttgaaggctatattgacggtcacaatattgactttttgaaaaataaggtggcctttgacttggaatggaacagcaaagatcaaacctttgacagggatttactagccatgcggacgtatttcgactgcggcctagtggacgtcggcgtcattgtcacgcggtctgagggcttaaatgagatctttaaaacgcagacagacaataacggcaaaccgctgatgcgaaaatacggcgcaagcaccacttggatcggaaagcttttgtatcgattggattcgagaagaaacggaggctgtccgattctagcgattggcattggaaaggagtgtgttgaaatatgagcgaatcagacattttattacaggataccatatccgatctgcttcaatttacgaatggcaaaaaatacaacaccatatacgccgacccgccgtggcagtttcaaaatcgaacaggcaaggtcgcgccagagcacaagcggctcaatcgctattcgaccatgacgatagatgaaatcaaacagcttccggtttctgaaatagcgggtgacaaggcgcatttatatttatgggttccaaatgcactgcttcccaatggattggctgttctggatgcctggggattcgaatacaaaacgaatatcatctgggaaaaggtcagaaaggacggcggccctgatggacggggcgttggattctactttagaaatgtaacagaaattctgctcttcggcattaaaaaacacagtgccccaaataggactttaaaacctgcgcgttctcaagtgaatttgatcagaacgagaaaacgggagcacagcagaaaaccggatgaaattatcccaattatcgaagaatgcagtcaaggaccaagaattgaacttttcgcgagaggactgcgcgatggatgggatatgtggggtaatcaggcaaacagcgaatacgagccgacatggaacacctacgcaaaccatacggtggccgataccggacagcagcaaatggacttgttcagctcatgattttttaacccacgaaggaaattagacaagaaatttatttcgaaaaattgctcccccgccccgggcgggtaatttaaaacgccgaattgataagatcatcaatccggcgtttttttaacatcaagacttatgtcgactgcatcccattccgctaacgctggaggggaagcagcgcccgccaggtgtgcggtccgacgatgccgtcggctgcgaggccgtgggcgcgctgaaattttttcaccgcggcctcggtctgtgcgccgaagatgccgtccgcccggaccccgagcgcctgctgcaccagtcgggttatttgaccgcggctactgcgtgtcagcaccggacacatcgcgtgcgttttcgggccggcgatgccgtcgacttgaagccccgcgccgtactgggcgttgagctcctgctggaggcttttgacccaggcggccccggcgggcctcacctgggtgtggggcgcggtgactttccgcccggcggcgtagcgcatccaggcgtccttcccgccgtaaaacacgttgcggtcgagggtcgtgcccgcgtactgccacatcgcgatggtcggccagccgacgtgagccggcgcgtgggtcgagtacttcgcgtcccaaaggccgtagtcgcgggccgcgagcttcgcgtagcgcgcggtctgggagtcggagcagtagaacagcgggcgcaccccggtgagcgccgtcacccggtcgagccactcgagggccttgtccggcccgtagcgcagggcccggccctcccagtccagggcgagcaccgcctgcccgacgtagggctcgacgagcttcacgaaccagtctgcctcgtcccgcatccggttgtgctccggcctggcgtaatggtaaaagccgatgagcttgtctgcggcgagcgcccccttggcgtgccgatccttaagcgggtcggcgaaggtgcgcccctccgacgccttgatcacgaaaaaagactgcacgtaataattcacactgaggttgtaattggaaatatcgacgccgtagagcatctgcgccctcctttctatttgtttaaattacaagattttcgtttcattcgtcatgatttcaaatgcgtctgcatcattatttaggacttcacatgcggcgcatcgcattgtttatacaatgatctgtaacatcattgacgccgctgccctcacccgcggggcctgccgccgtgattctcctgattccggtcgagctccggcagccccgtaagcgaggtgagcatcgagatcagcgccgccagcgccgccgccgaaagggcgggccgccatggggcatcggtgatcccggaggcggtcatcagcgacgccgccagggtctgggcgaaggtccgcgccgcccgtctgcccgccgcagcgagccacgcccgggcgccgtcacggctgatttttttcattgggtcctccctcctccccgccgagatcgcgcaccggcagggtcagcgcccggcggtacagggcggccgcggcggagttgccgcccatcttgtggtacacgtcgaacaaatggtggaggttggtgatctcgccggtggtggtccagccccgggccagggcctcagtgcaggcgttgaagagccggtcgtggagcagggtcacgcaggccagctctgtcagccccaggcgttcggcgatatgggacaatgccgatgccgcccgggccgcccgttttctgcgccttttaagccgctcgaggaggaatccccgcaccggcgggacggcgagggacagcgccgtcagcaccaggaccgccgccgagaggacagcggcggcccgctcaagccacatcgtcaggccagggcgacgtcggttttgtcagtggtgacgcgctgggcggaggcgacccccaccaccgcgtcggcgccgaccccgagggccccggcggcgaccatgctgtcgagcttggccttgacctcgctgtcgaggaggctcgccttgaagtcgccgatggtcaggcccatgacttcgccggatgccaaattaaatttcacgttcagttctttgcttactgccattttgtttctccttttgtatattttcctaattgctttgccaaatttttcggatcgtttttgtcccgcgccttacgcgttcacgagctcctcggtcgtgacgatgtaggcggattccatcgcgatttcggtcagcccgtcgtaggcgtcggccacgttcaggatctgctccggcgtcgccgcggtcagaatcttgctgacgtcgcggttcacggttttggtggagccgtcgtctaaatccttaatgttgcgcatccgcagagtctgtccggttaatttcttcgtaactgccatgtttggttctcctttttacttttcaatttcactacattgtttgtgttttgacctgataattttcaggccttggcttcgggggcgctcccttttgtctgagacacccatataatgcacggaaatctaaaaaggggtgacaaaaaaatccgacttttttaaaaatgtttccgcagcttctgcatcgcgcggcgtttggcggttttcacggtgttgaggctgatgccccggcttttggcaatggcctcccgggtcatcgactgctcgaaggcgcaggtgatgatcgcccgctccagctccgagagctccggaatcgcagccatcagccggtcgatctgggcctggcgctcggcagcctgctcggcgtcggcgatgttgtccgcggcgccgccgtgcttttcctcgaaggggacgtcgtcgggccggaagcgccgccaccgcgcccgaaacttggcggacagggtgcgcttgacgtacaccgggaagtagacaccccggttcgggtcgaaggcgcgcaccgcctcgatcagccacagggcgccgtcggctcgggcgtcctcaaaatcgggaaagggcgccgccagcttgacgatcagcggcttgaaggcgaggatcaaggtctcctccgcggcgcgctccccggccgcggcccgggccgccagggcgtcgatttcggcgtaggagcgtctgcccttcccgttctgtttagctttttctgtataggtttcattattttgattttgatttgcgttgttttcagttttcatttgcctctcctctgtgttaagccttgtcctcatcggggatcatgtcccagagggccttggtgtcggcgtcggcgagggcgtcgatgagcccctcgcggcgcttcgcgtcgtctctttccggttctgccgggtccaccgggcgggagagggccgcgtcggcgatccagctttcgataaaggcgggcatccgcgctgccttgcggcgccgcgccgggttgtggcccagccagttcagcatccggacgagctcgccggccacgtccgccctggggaaccgtttggcgagggcgtcgacgtcggccttggtgaccgtgtagcggccgccgccccgaatgggcagcatcgccgcgggcggcacttctggattttcctgactttcacttgaaagattttcagtacgtatttgtccggacgcgccttttggcgcaggccgggaatcactttgctttgttttcttttgttttactttattttcttttgtggggttttggtccaccataactgggccgttttcgttcccaatcaaatcgtaggccggatcaatctgggccttgctgtgccgcttgccaaaggtgtaaacctcctggatgtagcggctggtcaggatatgggcgtcggcgtaaagcttgggatcaaaaatgcgccgcgcgacgcacacatccaccacctgctgaatgcgctcgggctcggtgctgctcgagtacgccatcaccagggccatgtcgtcgctccacggcaggtagtagccgtggtcgccgtaaatctgcatcagcaggtggacgtagatgccgaagcccgccgcgccgcattgggcttccagcagttgcagggccgtgctctggcgcgtatcgaacgggaaatagtccaggccggtcttgacgggtcgtgccatatttggcctccttcgcgttaaatttgtctcagcggggcgcccgtctgtaagctttttccagtgtacgccttttcgctcttgaaggcaagtgtaagtttttgtcatcggcggttttcccgctgtctaaatcgctaaaagcgtggttttatgcggatttaaaacgtctaaaaataaaaaatccctcgattttcgagggatgatgtgcaactcaaccgtatttttttgtcattgtttttgcgtctgcttcacagccgtctcagcagctcccagaagtagagcaggacttcccgggggagcagcttcgagaagaaccggtggatggtacaaaaaagtcccggggtcgaaacggccatgcccaggcggttggtccgcagggagcggcgcgccacccggtccgccgggacgccgaaggcgaagttcttgatcgccggcttttcgcccttagcttcggccgccttggcgatcgggatgaactcggtgtcccgcatccagtaggggcagaccgccgtcacccggatgtgccgcgggagcagctccatgcgcagcgcccgggtgtaatggtagagaaagatcttggacgccgcgtagacgttgaagtgctggaggggctggaaggccgccgtcgagcagatttcgaggatgcgaccgcccgggcccatgaaggacagcgccgtgaccgtcacgtccaccgccgcccggtcgttgacctcgatcatgttgtccgagtccgcgaggggcagtttttcgtaattgccgattttgcccaggcccgcgcagttgatcagcaccgccacctcgacgtctgcttcagtgagcgccgtcttcagcgccgtcaagctctcgggcttcgtcaggtcgagtgggagcacgcgcgtcccgcaagcgagttcacccgccagggcgttcagccggtcggcccgccgggccacgagccagatttcgtcgaggtctttctccgtccggtcgaggcgcctggcgtattcccggccgaggccgctggaggcgccggtgatcagcgcgatgcgcttcttactccctgtcttgggctttttcgccgccgcgtagacgagcatttcgatgagcacgaggacgatggcgatggccgcaaagagcacgaagacccgcccggaaaagccgacgcaccaatccaccgcgcgatgcagggtttctaaaaatgacataagccgccttctttcgatttacaattcaatttacaatttaatttacacgctgcgtacacttttgatttattgaccttaacctatgataccacattttctcatcattttaacccgtcatcgggttgaaaattttgcaggccatatatgaaactttattcatctgtttgcaaatcgatgtaaaccgtgttacgatgagggacagcccacaaaacaccatgcaaaaccgtgacgcggtatatctttatatgaaaatttattcatcttttagtcattaatgcggtgctgatacatccggactgaaaacagatcagcctgatccgcacgcgttatagtcaaaggcattgtatgattggtagaaaggaaacgccatgctccactcatttttaaatatcctcagcgacgcggcggtcgacaccgtcaagctcatccccttcctcttcgtgacctattggatcatggagtatttcgagggcaaggccgcgagccactcgacgcgcctcctgctgcgggtcgggcccttcgggccggcggccggcgcggcggtcggagtcatcccccagtgcggcttctccgccgcggccgcgagcctctacgccggcgggctcatctccaccgggacgctgctgtcggtgttcctgtcgacgtcggacgaaatgctgccgatctttttgtcggagcacgtcgccgtcgggaccctcggccgggtgctcctcgccaaggccgtcatcggcgtgctcaccgggatggccgtcgacggggtgctgcggctgcgccgctacggcgacgacaagcacatccacgacctgtgcgacaacgagcactgcggctgcgaggacgaggccgaacccgcggggctgcgcgccgtgacccgctcggcgctggtccacacgctgaacatcaccgccttcgtcttcgcgatttccctcgtcctcggcgcgctgatcgactgggccggggtcggcaccatcgaaagcgtcctgaccgaccgccccgtcgtcggcgtctgcctgtcggcgctgatcggcctgatccccaactgcgccgcctcggtcaccatcacccagctatacctgtcgcgcatgctgaccgccgggcagatgatggccgggctgctcgtcggcgccggcgtcgggctgctcgtcctcttccgcaccagccgccactggaaggaaaatttgaaattcaccgtgctgctctacgtcagcggcgtcgcgtgggggctgctgtttgagctgctgcatttgtcgttctgatgaattagaagaaaaaacgcctaaaccgcaatcccagcggtttaggcgtttatttttatttctgatattggcatcccgctctgggaacaactgtacctctttattattaatcgttagactcgagtttaaataattaatttccgtattacccctaatgaaccaacagcaattcactacttggctgttaattttactttgccattgacagttagttccaaataatatccatcttttacatcaatttcagctttctctcctttagaattaaattcagcaataaatgaatagtcttcttcattattaacatttacctggctgatcttaacatttccgctcatgctttcagctaaataatgtccagctggtacagtaaaatgtacagcaccgctactggataatttaccatatttaccagtttcaccatctgtgagaattatcgtattagtattattagtattgtcagaagatgtctcttcagtagaattgcctgtttgtttacgaattacattagcataataatctgggttattttctacttcttgataattaaaaggctcgtatcctttttcatatatattaattttagtcttattggacttgatgcttgctacagaatgatcctgattcacataaatatcatatcgggtaccttcatcgccatactgaaaatagtatctataaccattagcccaatctgggcctacataaaatccatcaacttcatccgtatccatgccaatctgtttaatggctttctgcatattagcaagaagctttttatctggaaaatctttattaaacacaaagtctcctgattttaagtccttcaatgtattaggcttagcagctttttgacagccagtcattatacaaataaaagctagtaatacaataacaataggaaataaccttttcttcataattttcacccccccaaataacactaaaagcgttaaaatcgcctgcacaattttagctgcttacggcatttcttttttcatagttggtctacttgctggcctcctcctttttactatatttataatattatacacaatttaacataatctgccaaaattcgatcagattacctcattaaaaagcactgattgttttagctttcacacgaatccccgttcgccgctgaattataagataaaagctgtgtgtttggcgtcgagtttgggattgccctgcggcgcgccagcgcctgaaatgccgcgaagcggctgaccgtatctccctctcatctcatctcttatcatctcgtatcctatcttctcctctcctatacgaatttcctgtgagaaaaatcggtttatcctatattttgtcaaaaaaatagagacacacgcttctattgaaacatgtgcctctcggtccgtacttggaaataacattttttaatggtgttttttatggatatgttgctgacggacctcatcagactacgctactattatagcgtatttccatctcaaatgaaaggcatttgggggtaacactgaaacgcccataatacgggcctttcgcgcgaatccccgtttgtctacccctgaatcctacgcaaatccccgttcgtttggattatacgcaataaatgcctgactgtttccctcaggcgcaggtacaaaaatacagaaaatgaggctataatggaatcagattttgaagaatttgctcctattatatagtgcttgattagaaaggaacccaccatgcacgattttgccaacaaaacggccttggtcaccggcgcctcccggggcatcggcgccgccaccgctgaagccctcgctcaaaggggctgccatttgattttgacctgcgcgcgttcgatggacgcgctgaccgccctgtcggtcaggctgtcgaatacctacgaggtgccggtcacgccggtgcgctgcgacgccggggacgccggccaggtcgccgcgctgtttgacgcccacgttcaccgcctcgacattttgatcaacaacgccggccgctcggtcaccggcctcatccaggacctgacccccgaggcctgggacgcgctgatgcgcaccaacctctcgtcctgtttttacaccgcgcggctggccattccgaaattcctcgaagggggcggcggcgccatcgtcaacatctcgtcggtctggggcgacgtcggcgcggcggcggaggccgcctactcggcgaccaagggcggtgtcgccgccttcacccgggccctgggcaaggagctggcgccgagccgcatcccggtcaacgccctcgcctgcggcttcatcgacacggcgatgaacgccgagtacaacgacgccgagcgcgaggccatccgcgccgaaatcccggcggaccgtttcggcacccccgaggaggccgcggcggccgtcgtgcgcctgctggaaatgcccgactacctgaccggccaggtgatccgcctcgacggcggctggatctaatccgcccccaggtctaaaaaccacagtttgatgtcttgaagttacacctatttgtgggcggcgtcatcttgaagtttcgggctttttgatgtacaattaaaagtacaattggggaaatagggtatacccataaatacgttttcgcaaatgcgatgaggagggaatttaatgaatcaaaaacaattagaccgcatgcaaaaagaaccggggttcattgccgcactcgatcaaagcggcggcagcacaccgaaggcgctgaaggcctacggcattccaaagacccgctatcgcaatgacgaccagatgttcgacctggttcacgaaatgcgcacccgcatcatgaccagcccgtccttcaccagcgacaaaatcctggccgcgattctatttgaaaatacgatggaccgcaaggtggaagaccaatacaccgccgactacctctgggacgtcaagggcatcatcccgattttgaaggtcgacaagggtctggccgaagaaaaggacggcgtccagatgatgaagccgatgccgcagctcgacgatctgctgaaacgcgccgcgaagcgtcacatcttcgggacaaaaatgcgctcggtgatccactcggccaacaaggccggcatcaaagccatcgtcgaccagcagtttgacattgccaaacgcatcatcgccgcgggcttcgtgccgatcatcgaaccggaagtcgacatccacgccgaagacaaggccgaagcggaacagctgcttcacgccgaattcaaatcccatcttgccgcgttggaagacggcgacaaggtcatgttcaaggtgacgattccgaccgaagccgggctctatgccgacatcatgaaggacaaacacgtcgtgcgcgtcgtcgccctgtcaggcggctacacccgcaaggacgcctgcaccaagctcgctcagaacccggggctcatcgccagcttctcgagagcgctgaccgaagggctgacctgccgcatgaacgacaaggatttcaactacatgctcgccgattccatcgacaaaatttatcaggccagcatcaaataaacggaatttgtgcttctcagccgctgccgcttgcagcggctctttttttgttctaaactaatattattattttggtgtaagttaagcatttgttaggatttattaaataattgataaagaaaggaggcggtaagatggctgacgccgcgcgcaaatcggacccgtcggattttgcccagggcagcctgacgcgcatcattctccatcaggcggtgccggtgatgctcgcccagatcgcccagatgctctacaacatcgtggaccgcatctacatcggccacatgccgggcacgggcgaatcggccctgagcggggtcggcctggtcttcccgatcatcacgatcatcgccgccttcacgggcctctacggcaccggcggcgcgccgctgttcgccatcgcccggggcgccggggacgacgcccgcgcaaagaaaatcctcggcaacacgacggcgctgctcgtcggcacgtccttcgtcctgatggcggtgggctatctcttcgagaagccggtgctgatcctcttcggcgccgacgcccacaccctgccttacgcggtggcctacacccggatctatttgatcgggacggcgttctcgatgttcgcaacggggctcaccccctttatcaacgccgagggcttcccgcgcacggggatgatcacgacggtgctcggcgtcgtcatcaacttcgccctcgacccggtgttcatcttcgcgctgggcctaggggtcgccggcgcggcggtcgccacggtgatttcccaattcgcggcggcactgtgggtcttccggttcatgacgggcgacaaagccctgatgaaaatcgaccgggcgtcgctgcgtctcgaaggcgggctcgtccggcgcatcgccgccctgggcacctcgggcttcatcatgaactgcaccaacgccctcgtccagatcgtctacaacgcgacgctgtcggctatcggcggcagcctctacgtcgggatcatgacggtcatcaactcgatccgccagatggccgagctgccggcgctggggctgacttcggggacgtcgccggtcatcggctacaactacggcgcaaaggcctacggccgggtcaaaaagagcatccgcatcatgttcgcgctgaccttcgccttcagcctcgcgatttggatcttcatctcggcctgtccccacctgctgatggcgatcttcaccggaagcgcccgaatgatcgccgcgggtcagcacgccgtacgcgtttacttcttcggcttcgtgttcatgagctttcagtacaccggacagacgacgttccaggccctgggcaagccgaagcaggcgattttcttctcgctgctgcgcaaggccttcatcgtcgtgccgctgacggtgctgctgcccagatggctcggcgtctacggcgtattcgcggcagaacccatctccaatgtcgtcggcgggctggcgagcttcacaacgatgatgctcacggtctatcgaaaactgccggcggaaaatcgtcggaaaaccatatcatcaaaagcaaaacgcctgtgacgtacaggcatacaaaaaagccctggaagattccagagcttttctgcatttttataagggatctcttcggatgcgggcacgccccccgctttctttagaaatcagcttctgaaagctatacatgggtttcagaagatatttttattctacctataggggtatgtgttgtcaagggcagattcttgtttttttgtgtaattttttctttcgtccaattgaatttttacaaaagcaaaagtattttttattttgcctaaatatcggccgatttaaacgattttcttccgaattttgtgaataaatgtaaaaatgcatgttgactttgtatcgggatgacgatataatgaaaacaacatcattctgggaaatcagaacgatgatcttaggtttacacattgcagcgattgattatttataaggaacagacagatgaagaaaattgttaacgacgaacgactcatgatcaaaatttgcgatatgtactacaatcaaaatttaagtcagaaatccatcgccacgaagctcggtctttcgcgccccaccatctccagaatcatcagcaacgcccgcgcgaccggcgtcgtcaccatcacgatcaagaacctcgaaatgacgaattacgtcgagctcgagcacaagatcgaatcgatttacggcctgaaggaggttgtcgtcgtcgaccattacgacgatcccgtcaagcagaaggaagagctcggccaggttgcggccgactacctgaagcgcatcgtcgtggaccgcgacgtcgtcggcgtctccatgggctcgaccctctacgagacggccaagcacctcgacgcctgctcggcgaagaacgtgttcttcgtcccgatgatcggcggcatgggacatctgcgcagcgagctgcactccaacaccctcgtccagctgatggcccgcaaatttggggacggcaaattcattccgatgcacgccccggcccgggtcgccaaccgcaccatccgcgacgagtttctccacgaaaccagcatcgcccgggtgatcaaaatgtgcgactccctggacatcgcgctggtcggcatcggctacccgaacaagacgtcggcgatcatggccaccggctattacaccgaggcggaaatgaacgcgatgaaaaaggcgggcgtggccggcgatatctgcatgcagtttttcgacgaacacggcgacacggcgccctttaaaaagcagaacaccgtcatcggcatcgaaatcaaaaaactcaggaaggtgccccacgccatcggcgtggcctcgggcctcgaaaagctcaacgccatcaagggcgccatcgagggcaaatacatcaacacgctaattaccgacgtcgactgcgcgacgcagctggcggagaataattaaattatttcttttgtttataccaatttgttttataaggagatttgttaaaatggatgaaatactcaatctggatttaaatgatatggcgcaaacggagtttgactgctcctgcgggagacatcacaacttctcgattcacgacgtcgccatcggcagcggcaccatcaacaagctgcctgaaattgctgcgcctttcaaagaaggccagatcctgatggtctacgacaacaacacctatgaagctgccggcaaacaggcgcaccagatcatggtcgacgctggctttaacgtcaaggaactcttgttcgaccgcggcgacgacatcctgattccggacgaatccgttgtcggacgcatcctccaggaactctccggcccgacccctgaagacacccgcctgatcgtcggcgtcggctccggctccatcaacgattcctgcaaatacgtgtcattccactgccacctgccgtacatcatcgtcggcacggcaccttcaatggacggctacgtttccgacggtgcgcctttgatgagcgccggcagaaaaatctcctacccggcacacctcgcctacggcgtcatcggcgacaccaacatcatgaaggacgcgccgcaggaactgatcgcggccggcttcggcgatgtcgtcggcaagatcaccgcattggccgactgggatctggccgtcaaggtcaagggggactaccgctgcgacacctgtgtcaccctcgtacagcgcgccctggacaaatgcttctccaaatccaacctgctgccgcagcgcgatgaagaagccatcaaatacttgatcgaagcactgaccttaaccggcgtcgcgatggcattgatccgcatctcccgcccggcatccggcgcggaacacatgctctcccactactgggaaatggattacgtcgaccgcggcctgaacccgatccaccacggcacccaggttggtgtcgccacaccggtcatcgcccgcttcttcgaagaactggccgacatcctgccggaaggcaccggcgaactctgcccgcgtcatgaagaaatcgaaaaactcctccgcgacggcggcgcaccggtctcaccgaaggaaatcggcatctccagagaattgttccacaacagtctgctcaagggctacaccgtccgtccgcgctactccgtcatggaatttgcgaaggaacacggccgcctcgaagaaatcgccgacaagatcaccgctgaactttacgactaagtcaatctagcgaaagcatctgccttctggcaggtgcttccgctttgctttttatccgatttgtaaacaattttaatattaatacgaaataaaggagtcctatgcaagcgaaagaccaagcgttaaaagacatcaagctttttgttctcgacatggacggcaccgtctacctcggtgaaaacctgatcgacggctccctcgacttcattcacaaggtcgacgccgatcccaatcgggattacatcttcttcacgaacaacgcgtcccgcgtgccgaaggtttacgtcgacaagctcgcccggatgggcctcgacgtcgacgaatccaaaatcgtcaccgccggcgacgtctgcgcggaatttttaaaggaaaactacccaggcgcgaagatttacttaaacggcacgccgctgctcgaagaaaactggaaggaaaagggcctcaacctcgtccaggacgacccggacgtcgccgttcagagctttgacacgacgatgacctacgaaaagatggacaagatctgccgctacgtgcgtcacggcgtcccgttcatctcgacccacatggacatcaactgcccgaccgaggacgactacatgcccgacagcggcgccatgtgcgcgctgatcaccgcctccaccggcgtcgaaccgagatacctcggcaagccgtggaaggaaacggtcgacatgatcacggcgatcaccggctgcccggcggacaagatgggcttcgtgggcgaccgcctctacaccgatgtggccaccggggtcaacaacggcgccaacggcttcctcgtcctgaccggcgaagcggatatgcagaccgtcgccgaatcggacgtcgaaccgacgtgcatttacgattcactttacgaaatgagtcagtatctctaatttgatttgtcaacataggggggaaattaatggcaaaatacgtgatcggcgtggactttggcaccttatctgcccgcgccattctgattaatgtggaaaccggcgaagcgaagctgcgcctcagcgaacagccctacgctcacgccgtgatggatacggcgctgcccagcggcaagaagctgccggtggactacgcgctccagcatccccaggactacatcgaaagcctgtcggccgtgatcccgggcgtgctcgaaaacaacggcgtcaccgctgacgaagtcatcggcctcggcatcgacttcacgtcctgcaccgtgatgcccatcgacaaggacggcactccgctgtgcctcaccgacaaatacaaggacgacccgctggcctacgtgcagctctggaagcaccacggcgctcaggattacgccaaccgcctgaccgaaatggcgctggcccggggcgaaaaattcatcgaacgctacggcggcaaggcctcgtcggaaacccttttcccgagactgtggaaaatcgccgaagaagatcctgagctttatgccgacatggacgaatacatcgaagccggcgactggatcgtcggccagatcaccggccactacgtgcgcaactcctgcgccgccggctacaaggccctttacagcgacagcgatggctacccgagcgaagccttcttcgaagccctctcgccgaagctgaaggacgttgtcgcgaaaaaactgaaataccccgtcgtgcccatcggctccaaggccggggaaatcgacgacaacggtgccaagatcaccggcttaaacaaagggacggctgtcggcgtcgcgatcatcgacgcccactccggcgtgccaggcgcccttcaggaaccggaagaagaccagatggtcctgatcatggggacctcgggctgccagatgctcatctcgaataaggaaacagtcgtgcccggctgcttcggcgtcgtcaaggacgggatgctccccggcttttacggctacgaatgcgggcagtccggcttcggcgaccacctcgcctggttcgtcgacaactgcgtgccggtatcctacgcggaagcggcccacaaggccggccagaacatccatcaattcctgacggaaaaggccgcccagctcaagcccggcgaatcggggctcctggccctcgactggtggaacggcaaccgctcgatcctcgtcgacaacgacctgacagggctgatgctcggcatgcgcctgaccaccaaaccggaagaaatgtaccgcgcgctgatcgaagccatcgcctacggcacccggatgatcctcgaaaccttcgacaaatccggcatcgtcacgaaacacatcttcgcgaccggcggcatgagccgcaagaacgcgctgctgatgcagattttcgccgacgtcaccaaacggccgatctcggtggccagctctgaaaacggcggcgccctcggcgcggcggtgctcggctccctggcagccggcaaagcggccggcggctacgacaacatcttcgacgcgacgaaggtcctggtgcagccgcctgaaaagacctacacgcccacccctgacgccagcgcggtgtacgacaagctcttcgccgaatacagccagcttcacgattacttcggccgcggcgccaacgacgtgatgaaacggctgaagaaaatccagctggacgtcatcggtcaggactaagtcctcattactttgctttcaaaaattttatatatatgagaggttaatattatggcaaaatacgttatcggtatcgacttcgggacattatcagcccgggcaatcctcgtcaacgtggaaacaggggaagaatctccgcgtttgagcgaacagaaatacccgcacgccgtcatggaaacagaactgcctaacggcgtcaagctcccagtcgattacgcacttcaggatccgcgggactacacgatggccatctccgccgtctgccacgacttgctcgaaggcaacaagatcaccgcggacgacgtcgtcggcctcggcattgacttcaccgcctgtacggtgctgccgatcgacaaggacggcgtgccgctgtgcaccacggaaaaatacgaaaaggatcccctcgcatgggtccagctctggaaacaccacggcgctcaggactacgctaaccgcatcactgaaatcgcggaaagccgcggcgaagacttcctgccgaagatcggcggaaaagaaggctccgaagcgatgttcccgagactgtggaagatctgcgaagaagatccggaactctacgacgatatggacgaatacatcgaagccggcgactggattgtcggtcagattaccggccgctacggccacaactcctgcgccaccgccgggatccgcggcctctggtatccggatgcgggcttcccgtcacctgatttcttcaaggccttgaatccgaagatggaaaacgtcatcggcgacaagatcaaatacccgatcacgacggtcggcaccagagccggcgtcatcgacgaaaagggcgctgaaatgacaggcctcaacgtcggcaccccagtggctgtgccgctgatcgactgctactccggcgttccgggatccttaaacgcgccgaaggctggccagctctgcctcgtcatggggacgtcaggctgccacatgatgctcggcgacgaataccacatcgtcccagggacttacggcggatcgaaggacaacatgattccgggcctctacggctacgaagccggccagtccgggttcggtgatcacctggcctggtacgtggccaacggtgtgccggaagaatacgaaaaagccgctcacaaggccggccgcaacatccatcagtacctgaccgacaaggctgaaaagctcgcaccgggcgaatcgggcctcctggcgctcgactggtggaacggcaaccgctcgatcctcgtcgacaacgacttgaccgggacgatgctcggcctgcgcctgaccacgaaaccggaagaaatctaccgcgcgctgatcgaagccatcgcctacggcacacggatcatcgtcgaaaacttcgaacagaacggcgtgccggttaaagaaatctacgcctccggcgggatgagccgcaagaacgacatgctgatgcagatcttcgccgacgtcaccggacgcccgatcaagatcgccagctctgaaaactgcggcgccctcggcgcagccgtcctcgcctctttggcagcgggcagcgacaacggcggatacgacgacaccatcaccgcctgctcgaagctggtctccgcaccgatcaaggaattcgaaccggacgccaaggcgcacgcgacctacgacaaactctttgacgaatacgtcaagctccacgattacttcggccgcggcgaaaacgacgtcatgaaacgcttaaaagccatccaggctgaagccatctcttctaaagaagattaagctgtcttttcaccatttctgattttcctctaggactcgggatatttcccgggtcctttttttcacgctttattttttttatttaaccacacaaaaaaaaggccgccccgggctttaaattaagcctgagacggcggattggattgagatataaatttgggtttacaatgtgggaaaatcttagtgattctgttcgtattcgacgatcgcgtcgacctttttgccggagcgttcgtttctgacgtaggtttcgttcaggtacgcgctgatgagttccttcgcgagcatgttgccggtgacctggcagcccagggtgatgatgttgcagttgttggacaggcaggcgcgtttggcagagtagacgttccagacgttggccgcgtaagcacccttgaccttgttcgccgccagcatgacgccgatccccgttccgcagaacaggacgcctctgtcgtattccttcgcggcgaccgcttcggcgaccttagtcgcgacgtgggcgtagatcacgtcgtcagaaccgaaatcggtgacttcgtggcctaagcttttgatgtattcgatcatttcttctttataagcctgagcgttcgggtcgcatcctacagcaattttcatttgagttcctccaaattggttttgatttgataatcctattgtaaaccctttcagaaatttatgcaatataattttccgtatttttccttaatttctcaaataatttgaacttattttaacaaaagaaaaagacggctgaaattcagccgccttcgcgtttttattttcaaaacacattaaaaacaaattatttggcttcgattttggtgatcccgcccatgaagtgcacgagcttttccgggatcgtgacggagccgtcggcgttctggtagttttcgagcactgccgcaaaggtccggcccacagccagcccagagccgttgagggtgtggacgtactgggtgtgcttggtgatcgggtcgcggtagcggatgttcgcgcggcgcgcctggaaatcttcgcagttggagcaggacgagatttcgacgtagcggttgtagctcggcatccagacttcgatgtcataagtcttggccgcggagaagccgacgtcgccggtgcacagttcgaccacgcggtacgggatcttcagctgcttaaggatttcttcggcgtcgttggtcagtttttccaattcgtcgtaggattcgctcggacgggcgaacttgaccatttccaccttgtcgaactggtggttgcggatcaggccgcgggtatcgcgcccggcggagcccgcttcttctctgaagcacggcgtgtaggcggtgaagtggatcggcagcatgtcgttgtcgaggatttcgccgcggaaggtgttggtcagcggcacttcggcggtcggcaccatgaagaagtcttccttttcgaggtggaaggcgtcttcttcaaacttcggcagctggccggtgccggtcatcgacgcgcggttgaccatgtacggcgtcgacatttcggtgtagtcctgttcgacggtgtggacgtagagcatgaagttgatcagcgcccgttccaggtgcgcgccctgtccgcagaacatcgagaagcgggcgccggtgagcttgtgggcccggtcgaaatcgaggatgcccagatcagtgccgaggtcccaatgggccttcggttcgaaatcgaatttgcggggttcgccccatttgcgcacttcgcggttgtcgctgtcgtcgaggccgtaggcgatgtccgggttcgggatgttcggcagcaccaggagttcgtcgcgcagctgcttttcgatgtcggccagcgcgtcgtcgtccttcttgatgtcttcggagacttccttcatttccttgaacagcggctgcaggtcttcgccggcgagcttgcgctgcgggatttctctggagacctggttcttcttggccttgagctgttcgacgcggccgatgatttcgcggcgcttgtcgtcgagttcgagaatgtgatcgacggaaaatgtcccgctgttgcggctgttcagcgccttaaccaccgcttccgggttttctctaatacgtttgatatctaacatggctacactccttatcgtttcgtcttgattgcattatgcgttgcggccgcagcagttcttgtatttctttccgctgccgcaggggcacgggtcgttgcggccgattttcttgcccttgactacagtgttgcggttgcggcatttcttgtaaattttcttctgggtgtccttgtccaggatgtcgttccattcgcttaagccgtaaagccagggtgccggcaccttgaccatgttgtagtacagcttttcgaaatcgtaatccatggcaatcatcgtgtcggattcgatggtgtcgagatcaggcagcttccctttgatgctttccagcgcgccgtcgaggtagcctaaaatttcagtttccggcatgtcgtagcgcagtgccaggtccgcgactgtcccttcgacgtggggatcctgacggccgagaatgtcttcgtaaatgtgtttttcccgttcgcagaagccgtcccagaacgcctgctgatccttcggatttttggaatgatcttcgatggtctttttccaatccgcgtaaatactcatgttttttatcctctcctctattgtggaatttctcttttgcatgtgcttttattataacaaagatatttaatccggacaattagagatgggggttttctcgcaatccggctaaaaaaacgcgaaaaagcctcccgccccggcgaaggggcggaaggcatcagattccctaaaaaggatttgggcttacatcattttttccagcagctcatcccggctcatcggactgtagtaagccggcggcacgtcgagcatggtcttgcagccgtactgcccttcctgattcatccggtggcaggctctcgcgcaggccacgaggacgctcccggtgaattccgggttggagtcgagcttcaggctgaattcgacgacggccttgtccttgccgtccgggccgacgccgccgctgcggatcacgaagccgccgtggggcatgccgctgtggtcgcgctgcatttcttcttcggagatgaagtggaccgtcgtgtcgtagtcttcgaaataagccggcatcgtcttgatgtcgtcgacgatatcggccttgtcgtcttcggtcacgtcgtcgtcacagaccacgaacacttcgcgggtgtgcatctgtctcggggtcagctccggcaccgcgccgccgcggatcgcttcgatcacgtcctgcaccggcagggtgtactgtctggcgtccttgacacccggaatctggcgcaccgcgtctgagtggccttggctgacgccccggccccagaaggtgtaggccttgcccaccggcagcaccgcgtccatcatcacgcggttgaccgagaacaggcccggatcccagccgcaggagacgatgctcgtcttgtcgttggcgatgtccgacgcgttgacgttgtccacgtgccacggaatgtcggcgtgggtgtcgaaggattccacggtgttgaagaagtgggcgtattccggcgacatccaaggcaggtcggccgctgagccgccgcacaggatcatcacgtcgatgtcgtcctgcatggtcttgcagtcgtcgagcttgtagacgccgacgccttctgtcgcgatcttcaccgtttccggatcccggcgggtgaatacgccgaccaattccatgtccgggttctgggcaatggccgcttcaacgccgcggcccagattgccgtagcccataatccctactctagttttcatatcgatcctcccatcgaattatttagctttctaatctattattctactccggtgggaggggtttgtcaaagggaattaacgcttgttggaacggcgccagatgtgcatcttttccgccgcagcgatcaattcgtcgcggaaatccggatcggcgatattgatcagctgttccgctctttcccaggtggttgcgcccttcaaataggccatgccgtattcggtgacgatgtacatcgggttggtgcgggtgtcggtgacgatggagccttcggtcaaagtcggcttgatgcgggagtgcttgacgcccttcttgtcggtgaaggaagaggacatgcagatgaagctcttgccgccgttggatttgtaagcgccgaggacgaagtccagctgtccgccggagccggaaatctgacggatccctgcggattccgcgttgatctggccgtataaatccatgtcgaccgcgttgttgatcgagatgaagttgtcgaattcgccgatgatgctcgggtcgttgacgtagttgacaggcgccgccatgcaggccgggttgtcgtcgaggaagtcgtagagcttcttcgtgccggagccgaaggcgtaggtctgtttgtagcggtcgcgggccttgcgggcgccggtgatcttgcccttcatcgtcaggtcgacgaaggaatcgacgtacatttcggtgtgaacccccagatccttcaggtccgattcgccgattaaggtgccgacggtgttgggcatgccgccgatcccgagctggagcgtcgcgccgtctggaatttccgcgacgatctgacgtgcgacagccagatccacttccgtcggttcggtggcgccgccggtttcgcgcatggccgggttgtccccttcgacgatcatgtcgacttcagagatgtgcaccgcttcttcgatgccgaggcagcgcggcacagaggtgttgacttcgacgatgacgacgtcggccttgttgacgatttcccgcatgtgggaggcgttaggcccgaagttaaaccagccgtgcttgtccatcggcgcagcctggaacatcgcgatgttcagcggatgggacatgtcgcggtagtatctcggcacttccgagtagcgcaccggcccgtggaagacgaagccgttgcccacttcgtggcggtcgatgccggagtagaaccaggaattccaggtgaagtgatccgccgggttttcgacgtcgaagatcttcggacgagacggaataatcccgccgtagatgttcaggtcgtggagctccggcatgcgtttggccagcgcttcgtccagcttctgtacggtacaggtgacccatccgtaatcgatgtagtcgccgtccttgatgaccttgaccgcttcgtcggcggtcgtcagcttgtctgcgtattctttaagataactcattgaaccctcctcgatacttgtaaacaaaaaattctctttttacgttaaaattataacatttattgccgcgcctttcaatttaaatgcgctgacttgtgatctaattgccctttaaaaccgattccaggcgggacttcgccgccgcgaccgtgtccgcgtccagtgcggtgcccgatcctgaagcggtgccggtcaccgcgtaggtggtggtctgccagcccgacgccgacttcgccagctgggcgaactgcttcgcgctgaaatccgtcttgatcgtccggcccaggccagccatcacggtgctgtagtgggtgagcacctcctcagaggccattttgcgcatcaccgcgtcgagcaccagcagctgattggcgctgctcttcgcgccgaaggcgagggcctcgctgccgcttaggtggttggtcccgacggtgaaggtgtggccgcccgaggtaaaggtctcgctcgaggtgactcggatgccgtccagctcgtcgaccgtcgtcttgaggccctcggtgctgagtctgaggcggtggcccgcctggatgccgaagaccttttccatcgccgaaaccgccgcgctgaagcttaagctgttgaggggcgcggtgccgccggcgccgtcgtcgaccagcgccgtattcgggacgctcaccgcctcgatctgcttggtctcagggttgaccgcggcgaaagcgtacatcccgttctccccggcgccctgattcgtggcgatggcgagggtgaagggcgcgctcaccgacgcgcccgccgccttgtccgaggtgaacaccgcgtccccggccgatttcgcgatggattcgacgtggaagccgatcagacacagcgcggcgatgactgccgccgccacaatgggtccggtgtagcgccgagtgcgggtggtgtaccgggtgtccttggagggccgccacaccagccagccgagccaggccccgaggcctgccgcaattgctgcggccagggccaccgcccaggacgggaagacgccgaggcgcgcgccctgaaccaccaccatcaaaagggccaggcacatcagcgcccacagccctttcgcggcagcgctgaggatcgtctcgcgtttcatggcaattcctttcttcaattttactctttactctttaatgacgccctactggtcgacccgggtcggcacggtgatgacgatgtagcgggcgtcgtcgtaatcgtaggcacaggtggagagggtcacgattttcgagaccgtcagccggtcaatgcccgaatggaaatccgatttcgattccgtctgtgccagcaccgcctggaccttggccaaatcgaaggccgagtaaatcaggctgtccgccggggcggtgtagccgcggatcaaatcgaggcggtaattgccctctggcgtcaggtaccacatgtatttgtgctttttgtagtagctcgcctttttgaaatggccgagcatgccgaacatcgagccgtttttcatcgcgtggccgtagatgatcgtgttgggcccgctcatatccttcgggctgttgacgtcgacaaagagcgtccctgagaaattgcgggttccgttgaagagcttgtgcaggtactcgctgttgtccttcccctgcaccaccgggtagttgatcggcgtgcccttgcagtagagccagccgacgacgtccgggttttccgccttcagcttgtcgaagtctaccgaaatcggcacgtggtttttgtcgtcgtcaccttttgacttgaccgcctgggacgccgtcttcttgtaggcgtcggtgccgaccttgtatttcaaataaatccgcaccagctgatagcccgagaagacgatcacgccgatgcagatcacaatgagaagccgatataaaaattttttcatttgggggcgggctttctaaagaatcccgcggacctcgtcgatattcgcgaggccctggtccacgcagtatttttcgaggccgtcgacgatgtccaccgccgtcgtcggggcgacgaagctcatcgtgccgacctgcacgcaggccgcgccgatcatgatgaattccagggcgtcgcgccagtttgtgatgccgccgagggccatgaccggaatttttaccgcttgaatcacctggtgggccatgcgcagcgcgatgggcttgaccgccgggccggagagccccgcgtagacgttgtcgaagacgatgcgctttctgtcgatgtccaccgccatgccctggatcgtgttgatcaggctcaggcccgccgcgccggcttcttcacaggcgcgggccacagctaccaaatccggggcgttgggcgtcagcttcgccataatcggatgggtcgagacttcgaccaccttgcgggtgatgttgtaggcctgatccgggtccatgccgaaggccatgcccccgcacttgacgttggggcaggagatgttcagctcgatcagggacaccggcaggtcgttgaatttttcgaccgcgccgaggtaggtcgcctcgtccgagccgccgacgttggggatggtcacggtgtcgatgtccttcaaatggggccattcccgttcgatgaaggtgtcgacccccgggttttccagcccgatggagttgagcaggcccgacggcgtttcccagaggcgctcgccggtgttgcccggccggggcgtcagggtcagccccttggtgcacaggccgccgaggcggctcaaatcgtaaatcttttcaaattcgcggccgaagccgaaggtccccgacgccgtgacgacggggtttttgaaggtcacacccgcgaattgagttctcagtctgccgctcattttgcacctccccacatcagcgtttctctcgtgaagaccggcccgtcggaacagacctggcggttgccgtccaccgtcgggatcgagcagccgagacacacgcccataccgcaggccatgcgtttttcgagggacaggtagacgtcgtgcttcggcggcacgacgtcggccagggcctgcatcatgatgttcggcccgcaggcgatgacggtctcgccgcgcttgacctcgacgatatcggtgatgatgccgccgatgttgacgatgacgtcgtccgccacctggttaaaggcctcgacaaaataggactcgttcgagaagccgagataagcgcggaccttgcggcgcttgtgcctgcgcttgaagtccttgatcgtgtagagcagcggggcgatgccgatcccgccgccgacggccaccagattggacttaatttccgggaagccgttgccgtgggggccgtccagggtgatggcgtccatcgggccgaggcggctcatcagccgcgtcccctgccccttgaccatgtagagaaaggtcagggtgccgctttcctcgtcgtagtcacagaccgagatcggccgggagagaagcgggtcccgctcccaggcgcggagcatgaagaactgccccgggcgcacctcgccctgccaggccacctccatcaggtagatgccctcggcgatcgcgtaattggatttgattacagccattgcaggatatccttcttcatcgccgcagccgcgtcgcggatgtagtcgacgaaatcaggaccctccgtcttgccccggtgggcgcagatgatcccacgggatgaattgatcacggcacagcgggagcgcttgaagatgtccgcgatgtccttgccgatgccgccctgggcaccgtagcccggcaccaggaagaaggtgtgggggcagcgggcctggatgtcggcgaaggcttccggataggtcagcccgaccaccgcgccgacagccgagtagcccgattcgccgacgagatcggcgccccaggtttcgacgaggtccgccatcttttcaaagaccatatcgccgtcttctaatttctgttcctgaaggtccttagctgaggggttggaggtgtgggtcagcacgaaaatccccttgtccttgtctttcaaataaggcaggtacggggagatggcgtcgacgcccatataggcgttgacggtcaggaaatccacctcgaaatccccttcgaaatggcccttggcgtactgttcggcggtggaggaaatgtccccgcgcttgcagtcgccgatgacgagcttgccctgttcgcgcgcgtatttgacggtgcgcgcgtaggcgctcatcccctcgaggcccagggcttcgtagcaggccacctgcaccttgtagcaccccgccagatcggcggtggcgtcgatgatcttcttattgaattcaaagattttttcaccgctgtccgtgtccatgtcggcgacgcacgccggcaggtattcgagcttcgtgtcgaggccgacacacaccgggctttcagccgctgcattatacaaacgatccatgatcatagatgattcgtcctcctttcacggtcatcaagacctgtcctttgagccatttcgcgtcgaagggcgtgttgtggctcttcgagacgaatttcgagctgtctacctgccagtcgaggtccggatccaccaggaccaggtcggccgggtagccttccgcgatcaggccgcttttcaggcccagacggcgcgccggcgtctggctcatcatctgggacaggcggaccaaatccatgccgacggcagaaaacgcggtgtggtacatcgcgaacgccatttcaaaattgttgatccccggcgagcccttgagcttgtcctcgtcggagtggggcgcgtggtcggtgccgcagcagtcgatggcgccggagagggccccttcgagcagggccttgcggtccgcccaggagcggaacggcgggtgcacccggtagcccagccccgaggcgtagacgtggtggggcgtcacttcgcaggtgatatcgagccccagctttttcgcgccgatgatggcgtcgagggtcgccttcttcgagatgtggcagatgtgcagcttcgcgccgggaatgccttttagtatgtcgatatcccggacgacggtttccgtctccggttcgttgtgggtcgcgatgacgatgccgtatttggcgctggccttcagggcctcgcgcatcacgtcggggttgtcgacgttgtggccgtcgttggagaaaatcggcgtcaccttggacaagctgtcaaaatccaccagatcgaaggtgaagttcgagaaatccttggtcaccgccgagacctgaatcatttcggtcaggcccagggcgttgccccgcttcatgttggccgccaccttgtcggccgtgtccatcacaggtttggtgttggccatcgggcagacggtggtgaagccgcctttggccgccgcgtgcaggccggtggacaaatcttctttgtaggttaagcccggatcgcgcaggtggcagtgcatgtcgatgaacccgggcatcagcaccttgccgccgccgtcgatttctctgtcgtactgggtctggacgcggccgcgggccttgtagaccttgcggatcttgccgtcctcggtcatgaccttgccctcgcgcacgccggtgccgtcgacgaccttgatgtttgtaaaaagtagtctcatgtcaaaagcctcagttttcttctggtttaaatttagtgtaggcgtcgcagtactcgcagcggtagattttttccgcttcgtcgacgaggtagaagtggacgtccttcaccggttcgtggttggtgatgcaccgcggattcttgcacttcatgatgccgacgacctcccggggcagggtcagcttgagcttgctggtcaccttgccctgctggacgaagttgatcgtcacgttggggtcgatgaggccgaggacgttcatgttgatcttgaagtccgtttcgattttgatcatgtccttagtgccggttttgttgctcgggatgttggtgagcagcaccaccgggtcagtcagctcgtcgaggtggagctgcttgaagatgtgaatcccgtggccggcttcgatgtggtcgatcacgatgccttttttcagttccgatacgttaatcattgatctacccccagtaatttgctgatcagcgccatgcgcacgtacatgccgaatttcgcctgcttgaagtacacagcccgcgggtcgtcgtcgacctcggtggcgatttcgttgacccgcggcagcgggtgcatgacgatcatgtcgtccttggcgcgcttcatcttgtggcggtcgaggatgtagacgtccttcaagcggatgtattcttcttcgttgacgaagcgttcccgctggacgcggctcatgtacaggatgtcgacgtcgccaatgacgtcgtcgaggctgtcggtttcgacgtaggagccttcaggcagcatggacaggaagtattccggcatgcgcagctccttcggcgaaatgaagatgaagcggttgcccgggtagcggttcaaggtcttcaccaaggaatgaatggtgcgcccgaagagcaggtccccgcagacgccgacggtgtggccgccgcagctgcccagcaggtggcggatcgtcagcaggtcggtgagggtctgggtcgggtgttcgtggccgccgtcgccggcgttgatcaccggcatatccggcaccgactgggcgaagagccgcgccgtcccctcgcgggggtggcggatcacggcgatgtccgcgtagcaggagatgaccttcgcggtgtccatcagggtttcgcccttggacaccgacgaggtggtcgggtcgtcaaagccgaagacccgcccgccgaggcgcatcatcgccgattcaaagctgaaccgcgtccgggtcgacggttcgtaaaacaagctggccatgagcttgccccgggcccagtccatcgccgcttcggggtcggcgatgatccggtccgccagttcaaaaatgctctccagctccgctactgtaaaatctccaggttcgatcagctggcgtccctttaattcggtgcgcgccgcctcactctgtctgtctgacatgacagcctcctcactttataataaaacaggtttcacgttgtacctaaaaatgcttatactttatttattttatttgatttgggcgctttcgtcaataaaaaaggcgcggcccgcgccccgcccggcgccgtaaaaatttctagtgaatcgacaatatactttatccttttttcaatgaaatcgtgttatcatggtcgtgattgattttaagcggatcacacaccaggatttttagcttggagggagtatagatatgtcagacaattttaaacaacccactgtcgaggatttcgaacggatgtcctcgccccaggaaaaacggctgtgggccgatttcctgaaggataaggccgcggcgcatttccagcgcagcatcatggccgggatggatcattttttgttctactgccctaagggggaattcgtcgtcgagctggaaaaattccaccatttttccgactccgccggcaccggctccggccgcaagggcgacgccctgcgcagcatgggcttgaagctcttgtccttcacctaccgggaagtggacgccgattttgacggcgtgtgcttcaagatcaacaagaccatcgaacgggcgaagaaccagaagagcctggtcgacatcccccacagacggcgcctgcctctggacgacgacgaaaccgtccacgcgaacagcggctacaaggtcacggtgtccggcgactacaagctcgagggccgggaagatttcgcgaagcgcaaggccgacgaaggcacctacaccggcaacgccgaccttttgaagaacgtcgctgacgacgtctccggcggcacctacggcggcaacgcggcggtcatgggcggcttctccaccgacgtgccgacttacggcggcaacgccgggatcaccgacagcctcggctccgcctcggacgtcccgacctacggcggcaattccggcatcaccgacagcctcgggaagaccgcggacgtgacgacttattctggcaacgcccacattcttaaaaatgatgacaccgacgccccggacgggtatacttataatcagtacaacaagcgcccgatcgaggacatcccgctcaaagggaattggcagcgggtcaaggcggccaaggcggccgaaaaggacgacgcgggggagcctgaagctgaagcctattccggggcttcagcccgccccgaagcgccagcgcccgaacccgtgaccgaaccggcacctgcggcagaagccgcgccagagccagcccccgaccccgcgcctgcgattacccacacgcccgccgcggcggcagcactgaaggccgcggtggagcccgaaacccggaggcctgaaatgacagataaacctaaagcagcaccggcgcgcaagccggacaagcatattttcatcgcgaagaacgccaccgtcgtcggcgacgtgcgcatcggcgaggattcgtcgatttggtattcggccgtggtccgcggcgatcaggcgccgatcaccatcggcgaccgtaccaacgtccaggacggctcggtggtccacgtggacatcaagacgccgaccatcatcggcgacggcgtcaccatcggccacaactgcacgattcacggctgtgacatcggcgacaacgtcctgatcggcatgggcgcgacggtcatgaaccgcgcggacatcccggacaactgcatcgtcggcgccggcgccctggtgacccagggcaaaaccttcccggaaggctcgctgattctcggctcaccggccaaggcggtgagaagcctgaccgacgaggaaatccagggcatccgcgacaacgcggccgaatacatcgagctgatggacaacgaagagggccaggatttcgaggcgattcccggcggcttcgtcaaaaccctcgactgattgtgtgaacccctatatggtttattaatgtgatgcgcggcttcggccgcgtttttttaatgcgcgtttttagctgtcggcgtataataaaggcagcgacaaacaaggagggtgataggatggattggattcattcggttcgggcgattcagcgggcccaggcgaaaaatcagctggtgattttcgtgggctctggggtgtcggccaattcggggctgccgacctggaaacagatgatcagacagatcgcccagaagctgccggcggacttcaacagcgacgcgccttttaaccccgaggtctacctgcggattcccgagtatctctacgagcaggacacctccccggatcacgtcgattactaccggacgatcaccgaaattctggccagcgacgcgccggccaaccccatcgacgagctgattttcgagatccgcccccaccacatcgtcaccaccaacgtcgacgatttgctggagcgggcccagtcgctgaacacccggctttacgccgtcgtgtcccaggacgccgacctgctctctgtgtcgtcagaccggtatttgatcaagatgcacggcgacatcaaggacccgcggacggtggtcgtcaaggagagcgactacctggactacgagcagaatcacccgctggtctcgacctttatccgctcgctgctcatcaaccacaccttcttgttcatcgggtactccctgaacgactacaatttgaatttaattctcaactggatcaatttcttcaggaagcagcaccaggtgaagggccggccccagaatttcctggttcagaccaagaccccgtcccgctacgaggtgcgccgcctggccagccgcaacctgtcggtggtcgacctgaacaccctgccggacgtgatcctcgggcgggcgccgattccgccgtctctgaccgcggccttcgggcgaaggctctacgcctacctgcggtgcatcaccgacgacagactgttccagcacgtgctctccctggccgacacgctggacgagcggctgacgccgctgctcacctacgggcgcatcgccgcggacgacctgctgaacgccttcgacttcggcccgtcggaggtggtgtacacgacgctgatcctgaaggatccggaaatgttcaggcggcttcggccggtgttcgccgaccggcgcgcggcggccccagccgccttcgccaaggccggcatccaaaccctcgcctgcgccggagagacgcccatcaccctgcccgatctgccggccagaagtgacgaggaaacgatcctcctcagagattacctgggcaaccgctacctcgatttgcaggacgatctcgagacggcttccccggcggcgcagatcgactacggccacctcctcggccacgacccggcggcggctgtcgcggcggacgccgaggccctggacccgagcgacaccatcgcctggctgctccacaccctgcgggcccatttggtcgagcggcgcagcgcggccgatttgtcccggctgttttcggccgagtgggtgcgcacccagccgggaacgggctttctgcgccagctgttccagtccacggcgacggaccagttcgcgatgatgaccgaccgggaccgcctggaggaccggctccgcgccgcccaccccgaggacgacgcccgggtgatccgccacatttacggacggctctcagcccgggcccggggctattggtttttcatccgggacaaccacctgcccttcgacgcctcgaccaacgcccaggcttatctcaagtacgcgattcaggggatgctctgcctggcgggctcgcccggagcggcccgctcctgggacgacgtggacgtcgacatcgtgacgaaattcgccaagccccgggagctgacccgatggttcgcccgctaccgcccgaaggggattcccttcgccgaccgcggccgggcttttgccatcttcgacaacctctgcgcgagtgtcatggccttccgggacccgcgctggctcgatccgttatccaatctggtgacgctgatttcggcgaacccgttaagcctcggcgaggcgcagcggctgcgggaggcgggcctgccggcggtgctctcggtgctgatccgccacccggaacgggcggccggcgtcttcccgacggtggcgaggctgatctgcggccagcccgggaaaatcccgaacaagggccggtggctggcgcttttgacccagacggatttcgaaaagcgcctcggcaaattcccggaatacgcggcggtgatcgataccctcaaatcctgatatttcccgggaaatatgcatcaggacgcataagcgccttaaattcagcttaaattttaaacgaatcgttgtgaaagccttgtgctttttgtgtaaacggtttataatacaaccataaggaaatttccttttccagatagatacaaagaagttgtcggtttggcagaattcgtattctaatcatttcgcctccttgttttaaattatttaaaaaagaggaatttaataatttgtttggcagaattcgtattctttgacaattgaataactttttgatcgtatttgtttggcagtattcgtatctttgtaaaacgatttttcttcaaaaatcgaaagtcagtcgttcggcagaattcgaaatttacatcattgttgccttaaacctaaaagaggtgtaaggacgtaagcatttggtttggtcgtattcgtattcaattttttaagacttaactgatcatgaccagaatgttgtcggctcggcggtattcgtattcatgggcgcggtgaaattgacaagaagatttcaggaagcgccggaaagttcgtttatgtcaattagcataagataagctcccctcggatcgtgtgaggggagctgtttttttttgccctttttcttttccctgcattgtcctttttttatcctttgttggcgaatccctttcttgtttgagctgtgaaatcgtgctacaataatgctgaacatttaggcatcatatgcggcagatcaggggggatctatggattatcagaacatcacaaaggacacggcggcggcctacatccagaacgaaacgaatttgtttccgaaggatgcggtgctcgacgtctacgaaatcggcagcgacgcgtccaaggcggacgacgacggcgacggcttcgtcaatttcctgttccgggtgacggatacgcgcaccggcggctcggtgatcctcaagcaggcccggccctacgcccgcacttttgaaagcgcgacgccctacgtccccgaacgcaacaccctcgaagcgcggctgatgctgatcaagtccgcgatcaccccggaatacatccccgaaatttacctgatcgacgcccccaaccacctctacatctgcgaggactgcggcgatctcaagatctggcggttcgaaatgatggccggcaaaatctacccgaagatcccggcgatggtcggcgagctggtcgcgaaggataatttctacacctcggagctctacctcgagccagagacccatcaggagctggaggcggccttcgccaacccggtgatgcgcaatttgtttgaaaacattttgttcctgccgaaggccatcggcccggacgacgcggcgtatccaaaacggcaggcgctggcccagcaggtctgggcggatcacaccttccgcactgagatgctcaagctgcgccacatttacatggccaagtccgagtgtttgattcactccgacctgcacacgtcgaatttgatggtggacgccgaccacatgaagaccatcgacatggaatacgcgttcatgggcgcgtgttccgcggattcggggtatttgatcggcaatttgatttaccagtacgtccgctggttctactgcccccaggccggggaccacacgccgacggaaatgcgggcctacgcgctgtacaacatccggatgttcctcgagtcctatttcgcggtgttcaaggcgtgctggcaggaagacgtccgcgacatttaccgcgggtttgacgattactgcgattacctgctcgaccggtatttccacgaaaccatcggcttcgccggggctcagctcatcagccgggtcggccggggcacccgcacgccggacatcgacacgattccggaggaatccgaccagatcgaggcgtgccaaattctcttcgttctcgcgaaggcgctggtcatgcaccgggaagacatcgcaactatcggcgatttcgtcgacaccatcgttcgcgtcaccgaggacaccagagcggccctcggcaaataaatttaatgaattgaggataagacctgagcgaaagcgcaggtcttttctatttaatgaaatttttcgccccaataaaaataaggcagaccctcagatctgccttatttttattttacgccccttcgttttcccgcttccgggcggcctctacgagatcgccaacgcctcgaaagatttccgtcggacggtaagcgtaggttttgatggattcctgagtcgacaccccggaaagcaccagcgctgtctgggtgccgctttccatgccggcgatgatgtccgtatccatgcggtcgccgatgatcagcgcattttccgaatgacagccgagcatacgcaggccagtgcgcatcatcagcggattcggcttgccgcagaaatacgccttcttgcccgtggccagctcgatcggcgcaaccagcgcccggcacgccggcacaatgccgtcttcagtcggccccgagacgtcgtaatccgccccgatcagccgcgcgcccttcatcacgaggttggtcgcaatagtcaggctttccatcgaataagacggcccttccccgacgacgacgtaatcggggtcgacggcgttgttcgtgataccgacgtcgtacagcgcgttcatcagcccgccttcgccgatcacgtaggccgaacagccaggcttctgactgtcgagaaatttcgcggtggccagtgccgaggtgtaaaaatgctcttcactcacctccaggcccatgcgcttcaaccgctgagagagctcccgcggcgtgtagactggattgttggtcagaaacaaaaagggcagctcccgctctttcagccattcgataaattccggcacgcccggcagaattttgctgccgtggtaaatcacaccgtccatatcgcacaaaatgcccttgattttatcaaattggatcatattgtctccttttcctctgttgattttgctttaaataatgtctctattctatcatccgcgcctcgggcttaaatcgcatttgcgtaaagctcaggttaaataggtaaacaggttattccgcgtcgatcgtaaacggaaaatacgacgcgtctttcttttccgtataattggcctcgagcatcgccttgtgggcgagaaattccggatcggtaaagcttagggcgcccggctcacagccgcgaagacaggcctgacatttgatgcagacgccgtgaatttctgctttcccactgaccgggttgatcgaaacagaccccatcgggcagagcctgacgcacacactgcagcctgtgcatttttccgcgtccacttccggcttggccttgagaaaattcgccggggtgccgtcggccttaaggggtctgtaatacggcgccgccggatcgcccggcaccgcgacgcgcttcagctggcgctcgtattccacttgggcgagatttacaccgacctgctgtccgaaaacaatcgcgtccatcaagtcctgatcactcggacggcctgtgccaatatctgcaaaggcgtgggcgcagggcgcggccagtgccgcgacgacaatgaagccattgtttgagagcaggtctaccagttccgccaaactgttttcgtagtcccgattgccgtaggtcacgaccgcaatggccggcgtcttgttccctttcagatgtgcctttaaagacggcgcgatgaggttaggcaggcggccggcgtaggtcggcatcccaaccaccgccagcgtctggctgtcgaaaacggtgtcctgctcgcgcatccgcggccgcgcccagtttttaaaatgaagctgcgtgccaaagacactggccacgcccttcgccaccgccaaagtcatccgacgcgtgttcgtcgtcggactgaaatagattgccatggtttttgtaatttccattgtccccctcctgatgaaaatttttattgaattgaattctaatgtttgattttttccacttcgtccatccagagccgcaccttcgcgtcggacggcatccgccagtcacccctcggcgacagcgcgaccgacccgacctttggcccgtccggcaggcaggagcgtttgaactgctgcgcgaaaaaccgccagtaaaagcttctgagccatttgtaaatcaccgcatcggtgtacgtgccgtcaaaggcgcgcttcgcgagcaggtacaccttctgcgggccgtagccgtttcgcacgacgtgatacaggaaaaagtcgtgaagggcgtagggcccgacgaggtcctcagtcttctgagcaatcttcccggattgatccggcggcagcagctccggtgaaaccggcgtgtcgaggacgtccttcaaaatgtcgcggatgccttcggagcccttgcggtccgcgacgtaatcgaccaaatagcgcaccagggttttcggcacgccggcattgaccgcgtacatcgacatgtgatcgccgttgtaggtcgcccagccgagggccagctccgacaggtcgccggtgccgacgacaatgccgccggactggttggctaagtccatcagaatctgcgtccgctctctggcctgggcgttttcgtaggtgacgtcgtggagctccagcgggtgttcgagggcgttcaaatgatcggtcaccgcgccgccaatgccaatttcgtggaaggaagcaccgatgccgtgaatcaaatccaccgcgttgttgtaggtccggtcggtggtgccgaatccgggcatcgtcactgcgtggatgtgatcgcgggacagaccgaggcggtcgcaggcttccgcgcagacgagcagcgcaagggtcgagtcgagcccgcctgaaatcccgagcaccatcggcacgttgccaatatggcgcagccggctcatcagcccgacggattgtatcgcaaaaatttcctcgcagcggcggcgtctggcggccaggtctgacgggacaaagggcgccggatcgatggtacggtcaagggcgtcaaaatccgccagctggcagggaatctgccccagcggttccccaacactgccctcgtcggcaaagctcgtctgtgtgcggcggtcgtgagccaagccctcgatatccacatcggcaaacacaatttgcgcgccgtcgacgaaacgctcggtcttcgcgaggcaggcgcccttttcgtagatgtagccgtctccgccgaacaccaggtcggtcgtcgattcgccgatgccgcaggacgcgtaaagataagcggcgttgcaccgcgccgactgctggcgcaccagctcttcccggtactcgctcttggcaatgagctcgttgctcgaggacgggttgacgatcaccgtcgcgcctccggccgcgagccggcccgacggcggcatcggcgcccacatatcctcacagatttcaacaccgattttgatgtcgcgattgtccgtgtcgcagaacaaaaagtccgtcccaatcgggaaatcctgtccggcgtatcggatggtctgggtgcctctcagcgaagcggccggcgtaaaccagcgccgttcgtaaaattcgtggctgttgggcaggtgggtcttcggcaccgcgccgagaatttgtccgccctggagcaccaccgcgcagttgtacagccccgcgccgacgggaattggcgcgccgacgacagccagcacccttttatcctttaagtgcgccgcaagggcctcaactcccgcttctgcccgagtcagcagcgccgactgcgcgaataaatccccgcaggtgtaggcggtcactgaaagctcagggaagacgacgacggccgcctgacgggcctccgcctcatcgatcaggtccgaaatggcctggacgttggccgacacatcggccactttggtctgcgggacggcgatcgccgtgcgtaaaaatccatattctttcataatttctgtctcttttctaattcttaatcgtagattcaaagggctccacccagatatggtggcatccgcaggtgcatatttcctatcgcggcaactttccactcttttgcacaattatccacaaaatgtgagtggtttcttttaaaaattgtgcacactttaagaaagggtaaaggtggcgaaattcagccgttttgcgaaaattatccacagtttccacgttttccacacgatttatccacaattttcacgttttccacgaaaaatggaagccgtttcaatgaagttatccacttttccacaggttatctacatcttgtgtcaagtattttctggtaaaaaaatcggccactgtgcattgacagcggccggtaagttgcgcttacgctttttccttctggtccatcgcggcctgaatcaagtgatcaaacagcggatgcggacggttcggtctggatttaaattccggatgagcttgtgtcgcgataaaatacggatggttcggcagctcaaccatttcaaccagcacgccgtctggggatttgccggagaacaccatgccggccttttccagctgcggaatgaattcgtcgttgacttcgtagcggtggcggtggcgttcttcgatatcctgggtgccgtacaccttgtaggcgagggtgcccttttccaggtggcacgggtaggcgccgaggcgcatggtgccgcccatattttggatcttcttctgttcttccatcaggttgatgaccggataaggtgtttccggatccaattcaatggagttcgcgtcctttaagccgacgacgtttctcgcgtattcgatgaccgcgagctgcagcccgaggcagagccccaggaacggaatattgttttctctcgcgtattgaatggcggcgattttgccttcgatgccgcggttgccgaagccgccggggacaataatcgcctgttcattgccgagaatacggtcgacgttttccgcgttcaaatcttcggagtgtacccatttgatgtgcacttccgcgttgttggcaatccccgcgtggcgcagcgcttcagcgacagacaggtaggcgtcgtggagttcgacgtacttgccgacgatcgcgacgttgacgcgattttcgaggttcttggcgcggacgaccagtttcttccattcgtcaagcttcggcgtgcgttccggcaggtgcagctttttcaccaccagattggccaggccttccttttcgagcatcagcggcacttcgtagagctcgctggcgtcgagattgctgacgactgcgttcttgtcgacgttgcagaacaggctgatcttttctttcaggctttcttcaacttcgtgttcgcttctcaacacgatgatatccggctgaatcccaatggagcgcagttctttgaccgagtgctgggtcggtttcgtcttcagctcgccggacattctcaaatagggcagcagggtgacgtggatataaagcgtgttttccgcgccgagatccccgcggcactgacggatcgcttcgaggaaaggctgagattcgatatccccgacggtcccgccgatttccgtgatgacgatatccgggttgagcgggctgtccgcgaccttggacacgctttccttaatttcattcgtgatgtgcggaatgacctgaacggtcccgccgagataatcgccgcggcgttccttggtgatgacgttccaatacaccttcccggtggtgacgttgctgtactggcctaagctttcatcgatgaaccgttcgtagtggccgagatccaagtcggtttcagccccgtcgtctgtgacgaaaacttccccgtgctgataggggctcattgtccctggatcgtaattgatatacgggtcaaatttctggattgaaaccttaaagccccgggctttcaaaagccgcccgagagatgccgctgtaatccccttgccgagggacgaaaccacaccgccggtgacgaaaatatactttgtcttcatgctgcctccgtgttcattaaataaaaaaatcactgcaaaaggcgttttttttttgcagtgacaaataaattgctttttcctgtcaaacaatacttatattttaaaggataaccggtacaatttcaaggcctatttatttttccaaatcggcgccagcgcgcggcgcagttcccggtagcgtctgaatccgtcgacgtagaccgatttcgtgtggggctgatagacctgtctgagtctggcgcactgctgagcggcgtcctcgggcgtcgtgtaggcgccgatggcgaggccgcaggacatgagcgcgccccgggacgggaactcgctgccgccagcgaccgacaccgtcgcgtcgagcacgttggcgacgatccgcggcagcaggctgtcctgttccatctcaccgccgaagaaaatgtggtcgatctgatcccggtcgccgaccgcatcccacaccgcgtagccgatggactcgtagaccgcgcggaccatctgcgccttggtcgtttccccagtcatgccgaaaaagcagccgcattcccggctttccgcacgcttaatgcgctctgtcccgctcatcagataaggcaggaagagcaccccgcctgcgccgggctcgctcttcgccaccagctggtcggcgaggtcgagatcgtagccgccggtgagctcgtcaagggcccaggacacgttgcgctgaatgtcgagggttgagatgagttcgatggccaagtcgtcagtcaaatgggagatataattgcggctgctccggctcggatcacactgccggcggtttaagatccggcccactgccggcgcgtcgcccaagagaatgccgaaatccccttcctgcaccgcaccgatgccgaacatgcccgaggcgatttcaccgccgccgacggccacgggtatccccggcagcagacgcatctggcgggccgccttttcggtgagctcgcccgccgtcgtgcagccgtccagcacgccgggaagcttcgagatcgcgtcgtgcagttcgagcaccgtgagcatctgattgggaatgcgcccgttcgggaaatgcagcagccccgcgttgccatcggagaaatccgtcacgatgcgccccgtcattttgtagcgcagccagtccttttccatcagaatcgcctgaatctgacggtaaatttcgaggcggtggcgcttggtccatctgagaatcatcagcgggctgccgctgttcgggtagagcccgaggttgcggtgaaccagccgccccatgcccgggtttttctgcgtgacgtattccgcttcctctttggcgcggcggtccgtgttcagcacggcattgccgacgggttcgccgccctcgctcaccggccacagaccttcgcccgcgccggtgaggccgatgccgacaacgtccgagccgtagacgccgctgtgttccattaacatggccaccgcggccgcggcgttgtcccaaaaaacgttcatgtcgatttcccggtaatcgccgaccgaaatgatttcattgtcgacgacgaccttgtcgatctccttccctctcagatcgaacaagacggcccgggttttgtctaatcccccgtccagggttacgatgtatttcatccgatgctccatttttcgcgtattttctttaatagtatatcaaaggcgccgggaaaaatccaccgctgacacacgccctcccgtccttccttaactttacttttgacagcccttcttttataattttggtaacgaaagattaagggagaaactaggatgaaactctattcatggaacgtcaacggcatccgcgccgctgaaaagaaagggctggtcgactggatcaaatccgaacagcccgacgtactcggcattcaagagctcaaggccaccgaagaccagctgcctgacacgcttaaacagattgacggctaccacgccttcttcaacccagcggaacgcaagggctacagcggtacagccgtttattataaagaagcccctctggacattcacaccggcctttccgacgaccgcttcaatcacgaaggccgcaccatcgtcatggaatacccggattttaccctctacaatatttacttccccaacggcggccagggcgacgaccgtcttcaattcaaaatggatttctacgactgcttccaaaaggacgtgaacgccctcgtcgcggaaggcaagcgcgtcatcgtctgcggagacgtcaacaccgcccacaccgaaatcgacttgaagaaccccaaatccaacgcgaaacgctcgggctttctgcccatcgaacgggaatgggtcacgcagttcttaaacgacggctacatcgacacctaccgttatttccatccggatcagatcgaatactcgtggtggagctatcggttcaacgcccgggccaacaacgccggatggcgcatcgactatttcttcgcctccgacaacgccaaggatctgctcgaggacgcggcgattcacaccgatgtcatgggctccgaccactgcccgatttcgctgaccctcaagatttgacaaaacaatacagaaagagagcacagccatgcttatcgatacccattgtcatttagatgaccccgccttccagaaggatctcgacgccgtcatcgcgcgggcgcaggcccagggcgtagcctggatcctcgatcccggcacgacggtcgcgaccagcgaacgggccctttcgctgtcccaccgatacgactgcgtctacgccgccgtcggcatccaccccgaggactgtgccgacgcgaagcccgaagatttcgcccgcattgcagcactcgccgccgacccgaaggtgctggcgatcggcgaaatcggcctcgactaccattgggacgacaacccgccgaaggcgcaccagaaagacgtctttgtccgtcagctggagatggccggggaactcgcgctgccggtcatcattcacgaccgggacgcccacggcgacgccgtggatctcgtcaaatcccagtccttcagccgggacgccggcggcgttttccactgctactccggatcggtcgagacggcgaaaatcctgctggacctgggcttttacctcggcttcgacgggccgatcaccttcaaaaataacaagaagtcgccggaggtcgtggcctacgcgccgctggaccgcctcctgatcgaaaccgactcgccctacatggcgccggttccccaccgcggcaagcgcaacgagccggccttcgtcagcgacatcgccgccaagatggcggaaatcaagggcctgcccctggaacaaattctggaggccacccaggccaacgccgaagccctctttaaaagaaagggtgcagacgcttgaccccggaagaaaaacgccacgcgtttaggacaggcttcttcgacggtctgcccatcggtctcggctacatctcggtctccttcaccttcgggatgatggccgtggaaaaggggatgccggcctgggcggccattttgatctcgttcactaacctgacctccgccgggcagttcgccgggctcgacgtcatcgccgcgtcgggctcgatgatcgaaatggcgctggttcagctggtcatcaacctgcgctacgcactgatgtccctgtcgtggtcccagcggctccatccggaatttaactgggtcaagcggatgatcatcgccttcgccgataccgacgaggtctttgccgtgtcctcggcacgagccgccggcggcaaaaaactgcgcttcgtctacatggtcgggctgatgatcatgccgatcgtcggctggaccggcggcaccgtcatcggcgcactggcctcggccatcctgcccgacgtcgtgcgctcggcgctggggctcgccatctacgggatgttcatcgcgattatcgtgccgcccgccagagatcaccggtcggtggccgtggtcgtgctggctgccgtcgcggtcagctgcctgttccacttcacaccggttttaaaccggctctccagcggttttgtaatcatcatctgcggggtcggcgcgtcggccctcggcgcctggctcttcccaatatctgaggatgcggtcgacgcggagatcgaagccgacggcgaagcgcatttgcagaaaggaggctgtgatgacgactgaacacctgctgatttatacggctgtgatggccggcgtgacctatttgatccgcgtgctgccgctggtgctgttccgcaacgaaattaagtcaccctttgtcaaatcctttctgtattacatcccgtacgcggttctcggcgcgatgacgatccccgccgtattcacagcgacccattcgataatctcggcctgcgtcgggctggccgttgcggtcatcatggcctggcaccggaaggggcttttacccgtcgcggtagccgcctgcgtcgcggtgttcgtcaccgaatggctcatgcgcatgctttaatacggtctttataagaaagaagttatgatgaaaaaacattttttattttcgatcctcgccgccgtgctgtgcctgatgctttcgcccggcgctgtgcgcgctggggcgaacccccttgcgggcacctggaccctcgcgccgaaaaccaaaaccgtcaaccgcgccattccaaaggcggccttcaaggccaagacccttgtcaaaattgccccggacggccaggcctctctcagtttcaacacctggaaaaaacaccgcaaaatgcgcagaacttacaagggaaaaataaaaatcaagcaaaatcatcaggctgaagtttcaggcaaggcgctgaagcgctttcacgtcaaagccctgaccgcgcattacaaagtctcgccacggcgcttgaccctgaagagcagcggcgaggcggtcaccctgatccgcaaaacccaaaattaacaggagtctttttgtatgaaacccaaaaccaaacgcaaatactttttcttcgacatcgacggcaccctgaccgaccgcgccaccaaccaggtggtgccttctgccaaagaggcgatccgcctgcttcaaaaaaacggccacttctgcgccatcaacaccggccgggccgcctacaagggcgccccggtcatggacagcgtcggcgtcgacaacatgatctgcaacggcggccgggggctcatcatcgaccgcaagctcgtccgcaacatccccctggattttaaggccgtcaaagccctttacgaccaggcggtttccaagggctacggcgtcctcgtcgcccaggacaattccatcgacgtctgggccgaaaatttcgacttcatccgcaaggccggggaacgcctggaaccgacccgctacatcatcgaccgcgactacgttccccatccgccggtctacaaaatgtacatcgccgttcccccggaagaagaagccaacctgcccctgctgcaccatccggaatacggtgccctgcgctttgaagcgggctacctcatcatccagcccgatgaaaagaaaaacgggatcctccggatgctcgatgtcatcggcggggatcccgaagaaaccgtcgttttcggcgacgataccaacgatctggatatgttttccgatccgttttacaaaattgccatgggcaacggccacccggatctgaaggcggccgcggacgaagtcgcgccgaaaaacgtcgacgacggcatctacaaggtctgcaaggctcacggctggattgaatagagattttttcccagagcttcggcctgcttcagggccggatgcccttcgatgtctccggcatggttgacgccgcccacaaaaagcgtgtctgtgagcttcgccttcgaaaaggcgtaaagccagctttcaacgctctgtttgacgccggtaaacatgtcccggcggtcctgatccgcgcaggccagcaccacgacttttctgaaacggtaaggctttctgaaatagggggtcattcgatcaaataatgtcttaagctggccggggatgctaccgaaataaaccggcagtgcgaacaccaccgcgtcagcgttcataatcttttccgcaatgtccggggcgtcatctgaaaacacacaaagacccgtcactgcacaggcttcgcagccggtgcagtaacggatcttttttgtttgaagggaaattttttcgacatggtggcccgcggcccgggcgccctcaatgaaggcgtccccgaggcgttcgctgttgccgcggcgcagactggccgcgatgaccacaatgtttcgggattttgtcatggatttcttagccgatcatggtcttgagatcgtcgtcaacgttggtgatgccgccgatgccgaactgttcgaccaggacgttggtgacgttcggtgacaggaaggccggcagggtcggtcccaggtgaatgttcttcacgccgagggacaggagggccaaaaggacgatgacagctttttgttcataccatgcaatgttgaagacgatcggcagatcgttgacatcgtcgaggccgaagatttccttgagttttaaggcgatgagggccagagaataagagtcgttgcactggccagcgtcgagcactctcggaataccgccgatgtcgccgaggtttaatttgttatatttgtatttggcacagcctgcggtcaggatgacggtgtctttcggcagtttttcagcaaattccttgtaataggaacgggatttcatgcggccgtcacagcctgccatgacgacaaatttgcggatggcgccggattttaccgcgtcaaccactttgtcagccaaagcgaagacctgttcgtgagcgaagccaccgacgattttgccggtttcgatttcggtcggcgccgggcaggatttggccatttcgatgatggcagagaagtctttgtggccttcagcgtctgcgtcgatgtgagcgcatcccggatagcctgcagcgcctgtggtgaacatgcggcctttgtaactgtccttcggcggcacgatgcagttggtggtcatgagaatcggtccgttgaaagattcaaattcggttttctgctgccaccacgcgttgccgtagttgccggcgaagttatcatatttcttgaagaacggatagtagtgggccggcagcatttcagagtgggtgtacacgtcgacgccggtgccctgggtctgttccaaaagcatttccaggtctttcaggtcgtgaccagaaaccaggatgcccgggttggtgcgcacgccgagatcgacttcggtgatttccggattgccgtaagcgccggtgttggccgcgtcgagatcggccatgccctgaacgccgtatttgccggtttcgagagtcagcgcaacgagatcgtcaacactcaggctgtcgtccaatgttgcggccaatgcgtgctgaatgaaggcatcgacttcttcatcgtcttttaacagggcattcgcgtgtttggtgtaggcggaaaggcctttgagcccgtaagtgatgagttctctcaggaagcggacatcttcatcttcggtgctcagcacgccgactgttttggccttggcttcgaactgatctctggcgatctgaaccgtcgccgcttccggcagagcggacggatcgtcgacttttgcgagccattcggccttgaccttttcggttgtttccacgcggtcggcgatggcgtctaagtcaaagttcgcgttggtaatcgttgcgaacaaattgacggtgacgaggtggttgacatcctttgtcacttcgccgccctgttttctgacggctgtagtcacggcagacaggcctttggttacataaatcaaaaggtcctgcatgttggccacatcggccgttttcccgcagacgccctggacagtacatccctggcagcgcgccgtttcctgacactgataacaaaacattttctgatcctgcatgttggtattcctctctttcattgcgttatgaatgatccgtttgatttcatctgatggttttattatagtgctttttctttaaaactctgtggttataccaacaaatttataaatttttataaaaaaacgacaaataacgcatttcacccgatttttttctttgactttgccatcacatctttttataatgagtatgttgcaattttatcaagtcaatcggcaaaggcgccggaagcttagggcttctgacgcctttttttgttgacttatttaagtgatggaggtttagtaattatgaattcaggtaatacggcttttgttttgatctgcgcctgtctggtgatgatcatgacgccgggactggcctttttctacggcggcctcgggcggcgcaagaacgtgctcaacacgatgatgatgtccctgttcatcatggggctggcttctgttctgtggatcgcctttggctattctgtcagcttctgcggcgatcacggcggcatcatcggcacattccatcaggcgtgcatgcgcggcatgttcaagggcaccagcacctacgcgccgtcgattccgaaaatggcctacgtcgtctttcagatgatgttcgcgatgattacgccggcactgatcaccggggccgtcgccggacgcatgaacttcaaggcgattttcttctttatcttgttttggctgatcctcgtgtatttcccgctggcccacatggtctggggcgccggcggactgatcggctcaaaactgcacgcccttgacttcgcagggggcgacgtggttcacatctcttctggcttttccggcctgattttggcgttgatgatcggacgccgccagggctacaaccgcgtctcctaccgcacccacaacattcccttcgtcgttctcggcgcggcgctgctttggttcggatggtacggctttaattccggatcggccctcgccgcaaacggcctggccgcccacgcctttgtcaccaccaacacggcggccgcaacttgtatgatgatctggatgctcatcgacgtgatcgtttccggcaaaccgacggttgtcggcgcgtccaccggcgcggtcctcggcctggtggccattaccccgggcgccggcttcgttccggtctgggcatcctttatcatcggcggtgctgccgcgccgatttcctactttatgatctcttatgtcaagccgaagctcggctacgacgacgccctcgacgcctttggctgccacggcgtcggcgggatctggggcggaatcgccaccggtcttttcaccagcaaggcgatcaaccccgccgcgaaatggaacggtctgtttctcagcggcggcagtcatctgcttctgatgcagctggccggcatcgccctgaccatcgtcatcgctgtcgtcggctccctcgtcatcgcgaaaatcctatcgctgttcatgccccttcgagtcaataaagaagatgaacgccgcggtctcgacgaaacgcagcacggcgaaaaggcctacccagcgtttaccggtatggattaatggaaaagagaggtaaatcaaatgacaaaaattgaagccattgtgcgggaagaagtttatcaggatctgctggacgcgctgaaatccgtggatattcacggcatcaccgtgtcccaggtcatgggctgcggtacccaaaagggctacacccgcgtggtccgcggttcaaaagtagatatcaacatgctgcccaaaatcaaatttgaaatcgtcgtgtccagcgatgcctttgccgacgaggtcgtccgcattatccgcaaaacagcggtcaccggtcagccgggcgacggaaaaatctttgtttacgatttaaaggatgtgattcgcatccgcaccaacgaacacggtgtcgacgcgatcaattaaatcgaccatcaaaaaaactgctgtggggttaacgccccgcagcagtttttgtttttgcgcttattttttatgttacatcgattccggtgcgctgacgccgagaatgccgagcacgttttcgagcacctgtctggtcgcgaggatcagcttcagtctggcgtgcatcagcttcgcgtcatccacacggacgcggcagtcgttgtaaaacgcgtggaaggccgaggccaattcctgtccgtaatgcaccatccgagacggatcgttcttgcgttccgcctgaacgatggtgttcggcaggtcggacatgacttcgagcaattccatttccttcggatgggtcagcaggctcaaatccgccggcgcgtccaaatccacttcgccgccgagctgtcttaaaatgctgcagatgcgcgcgtgggcgtactgcatgtagaacaccgggttttcattggattcttgaatggccaggtcgaggtcgaagtcgaagtgggaatccggtgagcgcaggttaaagaacacgcgggccgcgtcggtcccgaccattgtcaacagctccgacaagccgatggccttgccctgacgcttggacatccgaatcggttcgccgtccttgatgaggcggacgagctgcatcgtcacgacgtggagccgggaatcgtcttcgccggccgcccggatcgccgctttcagtctagcgatgtgcccgtgatggtcggcgccccagacgttgaccgcgcggtcgaacttccgggtctggagtttgttcagatggtaggcgatgtcccccatgaaataggtcggcagaccgttctgacggatcagcacgtcgtccttttcgcagccgtaatctgtcgtcttgaaccaggtcgcgccgtccttttcgtaggtcgcacccttatcctttaacagcttcagcgctcgttcgatttcgccgtcgtcgtacatgctctgttccgagaaccagacgtcgtagtgtacgccgtatttggccatatcggtgtgcatctgtttgagattgacgttcagcgcgaaatcgatcagcttgcgcttgcgggtgtcgtcgtcttcgtcgagcagacccacaacctgatcttttccgccttgatccgcgatgtattcctggacccgttccataatgtccttgccctggtagccgtcttccgggaaaggcacgtccagacccatggcctgcttaaatcgcgcgtcgagagaatccccgaatttcgcgatctgattgccggcgtcgttgacgtagaattcgcgggttacgtcgtagcccgtccaggccgcaatttcagcgagcacgtcgccgatcgcgccgcctctggcgttgccaatgtgcatcgggcccgtcgggttggcggagacaaattccagattgtaggtcagtcccttgtggccttcggtgcggccgtaatccttccccatggattcgacttcgccgatgacgtcgtaatgccaggccggatccagcgtaaagttgataaacccagggccggcgatgtcgaccttcgacacaatgcccttgagattatcgtcagctttcagctgttcggtaatggcttcggcaattttccgcggcgccatgtgggcttccttcggcagctgcatcgccacgttcgtcgagtagtcgccgaatttcgcttcgcggggcactcccagctgcacgtccggctggtgttcgatctgaaaggcaccggccgacaccgccgactgcaccgcgtctgctgccgcctgtttcaatttattctctattttctctctgatataggtcatcaatactcctctttacctttaacttattttcgttccttgatctcgatgtccatcgtgttggccgtcacttcctgcccgttggaggaaatgatgtagtccaaatgcacgtgaaggggcccaaaggattcgtcccgttcgatttcaatctgccgcgtgtcgatcgacatcggcacctcgccgaggggcgtcttgtaaacggccatgcagctgctgcccgcttcaaattccatcatgctgttgatcgtaccgagacggatcaccgacaccttgtccggttcgatgcggaccgtggtcgtcgtgccggacatgccggagacctctgtctcctggtaattcaggcagggggtttccccttcccagaccagatcgccctcggtcataaattcggtccgttccgtgtcgccttcaaccgcagattgactgaccaccgtcagccagaccggccgcgtcggcttcttttcacgcacgttcatcacgggcctccctttcttgtttcaatcctgcttttactttaatgtgtaatccgtcactttcttgcgtttcgccgtctgaatcagccgttcaaccagctcgctgtagctcacgcccatgttttcccacatcattgggtacatgctgatgtcggtgaagccgggcatcgtgttgacttcattgatgtagatatcgccagtatcccgatcgacgaagaagtccgcgcgggtcgggcctgcgccgtcgatggccgcaaaggcgtcgtgggcgtaggtgcggattttgtcgatggtagcgctgtcgatttcggccgggatgacgattttcgaatcctgatcgtcggcgtatttcgcttcgtaatcgtagaattccttgctggcgaccacttcgcccggcagcgtcgtctgaatgtcgccgtcttcttcgaggaccgcgcattcgatttctctcgcgttgaccgcggcttcgatcaaaatcttcgagtcgaactgcagcgcgttgtcgaccccggcgacaaattccgcccgatcgtgggccttggtgatcccaaccgacgaacccatgttcaccggcttgatgaacaccgggtagccgagcttgtcttcgctggccttgactaacgcgtccttatctctgcgccagtctctgtcgaagaaataaatgtaaggcacgaccggaatgccggcgcgttcgaacaaaatcttcgagacgaccttgtccatcccgacggcggaagccagcacgccgcagccgacgtaaggcttgttcatcatttcgaagacgccctgaatcgtgccgtcctcgcccatcggtccgtgcatcatcggccagaacacgtcgatgctctgaatgagcggatcggtgaacagcgaaaaatccgtccggatgtggtcggtatcctgttcccaggagccgtccggcagtttatcccaatctccagtataaatcatccagcgaccgtcttttgtgatgccgatggtcaccacatcatatttgtctaagtcgatcactttcaagacgttgtacgcagaaacccgcgccacttcgtgttcgcccgactggccgccaaatacgagccctaatttgattttatctggcattgtaatctccttgtcattttcatttaaagattttgtttcattataccctttttccctgcgtttgaataccaaaaaaagaaaaccccgaaaggttttccggggttttcgctgcaaattgtcgttattccggcaggcgcgcgttgacggcttccttgatttccgcaagcttcgcttctgcgtcttccgggctcttgcccttgacggagtagtagatcttgatcttcggttcggtgccggacggacggatcgcgtaccacgaatcttcgttgaagatgaatttcaagacgttggaaaccggcagatcgatttttgaggtttcgccggtggtcacgttggtgcagacctgtgattgataatcgtcgaattcgacgagcttggcgtcggcgaaatgatcgaaatgatcggcgcggaaggcgtccatgatcttcgcgatctgagccttgccttcgatgccgtcgagctcgatggactgaattgtttcgaggaagtagccgaatttcttgtacagcgcctggagggcgtcgtagagggtcatgccccgttctttgtagtactgggccatttcgacgacgagggccgacgcgacgacggcgtccttgtctctcgcgtagtcgccggccagtgcgccgtagctttcttcgtaacccatgacaaaggtgtgttcgcccgatgccttccactgggtcatcttttcgccgatgtatttaaagccggtcagcacgttgtaaaccgctgcgccgtaggatttggcgatgactgcgccgaattcgctggtgacgatcgtcttgacaatcgccttgttgtccggccagtctctggatttgagcatgtagtcgacgagcaggccgccggtctggttgccggtgagcacggcgtaggtgccgtccggtttgtggcagcagacgccgaggcggtccgcatccgggtcggtcccgaagatgatgtcagcgccttccttttccgccatttcgatcgcgaggtcaaagacggccttttcttccgggttcggcttcgcgaccgtcgggaaatcgccgtccggctgttcctgttccttgacgacctggacgttttcgtagcccaattccttgagtacgcggcgcaccgggatgttgcccgagccgtggagcggcgtgtaaatgattttcaaatcgctgcccggattggccttggccacgcccttgaccgcttcgatataggcgtcgtccacttcctttggcacggtgataatgtggggatcgtcgtccgccgccaatttcactgagaaataatcggtgacggtgtgaatctgttcgacgacgccggccgcgaccgcttcggtgatctggccgccgtctgggccgtagactttatagccgttgtaaatcttcgtgttgtgggacgcggtgatgacgataccggcagcggtcttcaggtggcgcaccgtgaaggacagcaccggaaccggacgcaggctgtcgtaaatataggcgttgatgccgttagccgcgaggacctgagcggaaacctgtgcgaattccttcgagaagtgtctggaatcgtaggcgatcgcgacgcccttttcggcgttggccgggtcttccttgagcagatactgcgctaagccctgagtcgcgcgggcgacgacgtaaatattgatgcggttggtccccatgccgatcttcccgcgcatgccggctgtcccgaaggacagctccgtgtaaaagcggtcttcgagttccttttcgtccgtaatgctctccagttccttttttatattctggtcgtactttccaaaatcgagccatttctgcaaattggttttgtaatccattttgaactccttacctaataaatttatttaaaatgatctgtcaatgttagtcggttacaattattataaatcaaaccctaccattgtacaagaataaagcgccgagttttagacgtaaaaaagcacgcttctaaataaagaagcgcgctttgttttcaccgcaccagtttcgcccctttaatccagcgtgaataaaaaggtatcgccccaatgcctgcgctgaacaaaccgcgccgttcggttggtgttgtcgtacacgacagaccactgggtgttgctggtgatgtcctcggggttgggcgcctgggacgacgcccgcaaagctgcccacgccgcctctaccgtggcggcgccctcgtcgaggattgccgcgatggccagcgcgcgctctttgccgtgaccgaacgcaccgttgatctgattgggtttcacctggtcggcgtatagggcgtagaaattcgtgatctcccgcgccggcgtgaccgtcatccttcgtgtgggatccaacagatcgtactccaccacgacgctgtcacccgattcgtcgttgataaagaaatggtaatcgcgccccgccatcgcgtgcatgtcgtagcggcccagcagttcgacagcctcccgggtcgtggccgcgcggtccagcaccagccgaatggtcagagcggtgttgatcgcctccgcttttgcgtgttggtcgaccggcacgctgtccagagtcagcaccgcgatgctcacccccatggcgttgacgccgtcaagacaagcgaaaggcgcgagcagtgacgcagcccgctgctcgatgctcatgtcggcctcgttcgcgccgaggttattcaagcaggcgaaggcgatggacgcgtagccgtctttgggattcgcgcggaccaataaagccgaggtgtcctctttgaaatcgtaattccgccctgtgagcactgccgtgtctgtcttggcacagaaagcgctgcagccgaaggacggcggcgcagctttaacggatatcccgggaagggcctgcgccacggcggcgtccgtgaatgtctggtcgtctctggcggcttcgccgatcagagcgtccaaatcgtagtcgtaattgaccgtcatttcgtacaaattgtactcgccctcgtaggcggtgagccttttaatcgaggctgccgttgatacgcgtgggttactttttttcatattctctccaatctgcactgatgagatgtgcgcgaaaatttttgattgacgatttgggcctggttattctaactcttcatctagccaaataagtatttatttatatcatgcggggcgatgctgcctttgtcaaggatttcattaaaacttaaaataaaaaagaccgggagcgcgcattttttgcgcttctcggtctccttgtctgcggttaataacgataatcgtaaatccgcgtggctttcttttcgctgcggggcagatcgccgatggccaccgcctttggaatgatgccgacgtttatcacggacttgaaggtatctctcagctgcttttcaaaggccttgtacccttccttcggcagcgacgtttcgacaaagaccgtgatgttgtcccggccgttgacgtgatcgatgaacacctggtattcgctgctggcgccgtccacctgcttgaggacgtcgtcgatctgtcccgggaacatgttgacgccgtggaccttgaccatgtcgtccgtacgcccgaggatgacgtcgatgcgcggcaggtcgcgtccgcaggggcagggctcgtcgtcggggatgatccgggtcaagtcgtgagtgcggtagcggatcagcggcgctccttccttctggagagtcgtgatgaccagctcgccgagctcgccgtccggcaggacctcgccggtcttcggatcgatgatttcaaagtagagatagtcgtcgaaatagtgcatgccggtgttgtacttgcagttgatcgcgatccccgggccgtagacttccgtcagcccgtagatatcgaagagctcgacgccgagctcgtccgcgatccgggcgcgcatcttttcgccccagcgttccgagccgatgacgcccttcttcagcgcgatgcggtcgcggatcccgcgcttggtgatttcttccgctaacagcagcgcgtaggaggacgtcgcgcagagcaccgtcgactgcatgtcttccatgaatttcagctgcttggccgtgttgcccggccccatcggcacggtcatcgcgccgagcttttccgcgccgagctgaaagccgatgccggcggtccacaggccgtagcccggcgtgatctgaatccgatccttcggcgtaatgccggcgatttcgtagcagcgcgcgaacagcgtcgcccaatcgtccacatccttttgggtgtacgggatgatcaccggcgtccccgtcgtgccggacgaggagtggatgcgcacgatttgttcttctggaaccgcggcgagccccagcggataagcgttgcgcagatccgccttttcagaaaagggcagcttctcaaaatcagcctgagatttgatatctcccggttcgatgtcctgaaggcgcttggcgtaaaagccgccggccgccttgacccgtttcatctgaaatttgatctgttcaagggtttctgatttcattttcatggatcttatctcctcaccatttcagcgccgagggccagcgcctttttattcatgtcgacaaaagccggcttgacccggcggatcatcgcctgttccaccgcctcgagggacagccccatcgcgccggtttcggccaatgcgccggttaagatcacgttgagcaccttttccgagccgcacgcctgggccgcctgatcgccgtcgacgatgtagcagtgcgccgcgttgtcctgaagccatttcagcaccgcttcgccgtcgtaggcgctcttcccgagagacgccgtcaccgggtagatgggccggcgattgacaatgacgatgccgtccggcttcagcgccttgagattccgcgccgcctctccaggttcaaaaccgatgaggacgtcggcctgaccgtctgggatcaaaggtgaggtcaccgcttcatccggcgtttcgccgattctcacgtgggagaccacggcgccgccccgctgggccatgccgatggtttccgccgttcgggcctggtatccgctgtccatcgccgcctgggcgataatccgggaagccaacaccgttccctgtccgccgacgccgcaaagtaatgcgcttttcatcgtttcacctccatgcagtgtttcgggcagacctgattgcaaaggccgcatccagtacagagcgccgggtcaatgaccgccttctggccattttccgtttccatcatcgtgattgccgggcagcccagctcgttgatgcagcgcttgcagccgatgcaggcgtcctgatccacttccgcgatgccctgcttcggcacgatcgcgatacacggcgatttaaagataatcgcccgaacgcccttttcgtccgccgccgcctgaatcgccggaatggcttcgtcgagattgaggggatccaccgtccgcacgctggtgacccctgcgccgcgcagcacactttcgatggacaccggtgcaacccgttcgcccatcatcgtcacaccggtgcccgggtggggctgatgaccggtcatagccgtcgtcgaattgtccagaatcgcgaggacgatatccgcctggttgtagacgccgttgatcgcgccggtaatgccagaggcgaagaaggtcgaatcgccgacaaaggcgaaattaacggtggacgggtccacgtgattcatcccctgagccatcgtgacaccggcgcccatgcacaggcaggtgtctaccatgtccagcggcatcgcgttgcccagggtgtagcagccgatatcgccgagagcgacgattttccgaccgcgcatcgctctcttgaccgcgtaaaaggcgccgcggtgcgggcagcccgcgcagagcaccggcgggcgcaccggcagcgccggcgcttccggcagatctactgaatgaagatccagcgccacgcccgtctgcttctcgatgatgcccgcgacggcgaccgctgacagctcgcccgcttcgggaaccgcacctgagcgcttgccgatgacgtcgacgcccatcgccaacaggtgatcttcgatgtaggggtccagctcttcgaaaaccagcaccgaatcgacctgatccgcaaattgccgggccgcctgaatcgggaacgggtacggggtgttcaccgtgaagaccgtaaactgatccgcatggcctttgatcgcatcggcggtgtaggcggcggaaatcccaccgcaggcgatgccgatcttcccagagccggcgatcgtgttcttcccattttcggagaaagtcttcgccaatgccgattctctcgcgaaaatctttttcttattctgataggacaacccagggaaaatgacccattttttgtctttgacgaagccttcagccggttccggcggcacaaaggccggcacgtcgacgaccgcgcaggcgtggcacacccgcgtggtcgatctcaaaattaccggcatgcccttggcctccgacagctcaaaggcgtactgcacctgctcaaaagcttgttccggagacgtgcagtcgaggaccggaatcttcgcgaactgaccccagctccgggtatcctgctccgtttgagacgagatcggccccggatcgtctgcgacgtaaatgaccatgccccctttgacgccaacgtagttgacgcacatgatcgggtccgacgcgacgttgagccccatttgtttcatcgtcaccatcgaccgggccccggcgtaggccgcgccagccgcgacctcagcgccggccttttcgttgatcgaccattcgacgtaaaccccgtcgggcttgcgcttcgcgatggtctcaagggcttcggtggacggcgtgcccgggtagccggcgaccacctgaaccccggccgccagcgcgccgcaggcgaccgcttcgtttcccattaataattccttcatcttactccttctccgttgatcctttgatcgaataaaaaagcctccgggcaggcttatctgccttcccagagactgaatcatctgctcgtttcaatttaacacagcgttaaaaatgtgtcaaggctcaaaggtatttcgacgcctctgacacgctgagatgggccatttgacgctggtgcccgtcgaggaaatcccgcacccagtccgggtcggttttcgaatactctcttaggctccagccgatagccttgttgataaaaaattcgtcggagcccaaattcatctcgatcagctccgccaacagctcaggattggtttgttctttcatgccccgctggtggtcgatcgccgcacggcgcatccaaaaattggcatcctgcgcccagcttctcatcatttcttcgatttttggccgataggcgggatcgttcaagccgatgcgcccgacgactttgtcgaggccgtcgatggtgtcccaccactgcttgtgcctgagatagggctcgatgtgccgaacgtcatccggcgttaggcgccgctgcacgccggcgagggcgtcaacgacaaaatactgcatctcccggtggctgtcaccgaagcaaagatttaaaaagtcgtagtcgatcgccggcgcccgcttaaaggccttgattgcttccttgtaggcctgacgcctagcggcggctggaatgccgtaaaaggcgaactggttacgcatgtaggccgccattggcacggcgcgcgcgctgtccgccacggccgcaagagcctgcttcaccgctgtgtatttctgattcgcttgtttcatcctggacctgcgtttctaaagccctccggctttttgcatattataccataatttcttatatttaaccgaaggacagcttaaacgctttgactttcagaaatataaatgtaaaaaataaaacctcagcccgcaccatattgcgagactgaggttaaaagctatacggcttttatcccaagcgtctgccatcgatgccgatggtgacgatctgccacgggataaatttgccggaagcctggagggcatttttcgccgccatggccaggccgccacagcacggcacttccatgcgcacgacggtcacgtcctgaatgtcattttcagcgatgatggcggtaagcttttctgcgtaattgaccgcgtccaatttcgggcagccgatcagcgcgacccgtcccttgatgaagtcttcgtgcatccgagcgtaggcgtaagccgtgcagtccgccgcgatgagcagtctggcgccgtcaaaatacggggcctgcgtcggcgcaagcttaatctgtaccggccaattcgtcagctggctcttagccgcaggcgctgccgccggagccgggtcggcgtctcttcgaatctgtctgacctgtgagcctgggcatccggcaaagggtgccgcctgctgagccttagccgccttggcgcgggcgaccgccgcttcgtcgtaagccggcgcttcccgttcttcaaaggtaatggcaccggtcggacattccggcagacagtctccgaagccgtcgcagaaatgctcgcgggtcagcttcgcgacgccgtccaccatttcaatggccccttcgtggcaggccgaggcacacagcccgcagccgttgcatttttcttcgtcgatatggataattttgcgtatcatgaacatgtcctccgtcacattttttcattctaatcttcaatggtgcctctattgtgacagaagaacggccgaacgtctgttgttataaccacattttgcgttttttattccgccgattcggtgatgatcttccgagacggccgtagaatgaagacgatcaccgcaatggccagggaggtgacgccgagggacaccgggtaaatcagcatgatcgtccgaaaggtcggcgaccgcctgaagatttccgcgatccagaacatccggaagacgcagatcccgacgatggacaccagcgccggcattagcgacaggccaaagccgcgcaggtagcccgagccgacctccagccacgcggtgtagaggtaggagacgtaaacgtaatccgtcaggacaacaccgtagcggatgaccgctgggttggacgaaaacaatccgagaatggggcgcaggccgattaaaatcaatatcgccagcgtgccggaaaacagataaccctcggccagacaaagccaaaaggttcggcggcagcgttcgggcaattttgcgccgtagttttggctggtgaacgtcgtacaggcctggttgaaagcattgagcatataatacgcggcgatctccacactgaaggccgccgaggcagccgccatgattgtcgagcccaggctgttgatcgccgactgaatgatgatattggcgatacagaacatcgcgtcctgcaggcccgacggcaccccgatgtgcagcatcttcttcaaacttttgcgatcgacgtgcagctcagaccggcgcagccgaatgccagcatccgcgcggttcaaacgcatcgtcagaaaaatcgaggccaccgcgttggcgatcacggtcgccaccgcgacaccgctgacgccgcggcccaatcccgcgacaaagatcaaattcagcgcgacgtttaacacaccggaaagcgccagcgcgatcagcggcgtctgcgcgtcgccctgacttctgaaaatcgccgcttcgaaattgtaaagcagaatgaccggcatgccgatcaggtaaaggcgcaggtacaccgcggcgtcggccatgacgctcgcgggtacacccgtccagcgcagcaccggctccacgaacagctccccgaccacgagaacagcggcgccggccaacacggcgaaaatcaccgcagtgtgcgcggtgcgcaccgcttcgccgcggtcccggcggccaatggcgtgggcgatcaccacgttggccccgagggaaatgccgatgaagaaattgacgagcagactgacgatcggcgagttggcgccgaccgcggccatcgcctctttcccggtgaaccgcccaaccacggccacatccgccgcgttgaacagctgctggagaatgccggtcagagccagcggcagtgcgtagatcaaaatctttttccacagaccgccgtggagcatatcgatgtcgtgtgctgctgtcatgactgccgaattaaatcgaaaaacatctggcgctgttcagactcagattcgaaaatgcctctggccgccagggtgaccgtctgagtcccgggcttttggacgccgcgcatcgtcatgcacatgtgctccgcttcgatcttcacgatgacgcccttcggggtcaagcagcgcgccaccgcgtcggcgatctgccctgtcagccgttcctgaatctgcggccgtctggcgtagacctcgacagtccgcgcgagcttgcttaagcccactaccttgccgtcaggcagatagccgatatgcacctttccgtaaaagggcacgaggtgatgctcacaggtcgaaaaaaacgggatgtctttgacgacgacgatcccgcttccgccgccttcggcgtcaaactgtctggccagatgggcgtccggcgtctgacccaatccgccgtagatttcttcacacatccgcgcgattcgatccggcgtctccaaaagcccggggcggtctggattctcgccaatcccctctaacaacaggcgtaccgcctgtttgattttatcctgatccatgctctatttttcctttctcacttacgctcgatgccaatcgccggctccgccaaaacgccattgcctcacttatgatataataagggctgattcattcttgataaaattgcgtattttatcaaatttatcaaaggagaaaatgatgtcaaacaaacccaagacccgaaatttgatcttcacagcgctgctcgcggcgttcatggccattctcggcccgctttcgatcccgctgcccggcggcgtgcccctttcgctgctcacttttgcgctgttcctctcagcctatctgctgggctggcgtctcgggacgctggccgtcgtcgtctatctgctcctcggcttcttcggcgtgccggtgttttccggcttcaccgccggcgccggcaagcttctcggccccaccggcggctacctgatcggctacattcctgccgcgctcatcgccggcaagctctgcgccacccggcggaaattcgtgccggcgctgatttcgatgctcatcggctccaccgcctgtctcgccctcggcacgatctggttcatgttcgtgacccacaccgcgctgatcccggccctcgtcgtctgcgtcgtccccttcatccctggggacatcgcgaaaatggccgcggcggccgctgtcggcaaaatcttagacgaccggctcacgcggagcgggctgtccattcaaaaattcgaggccggcgaaaatccgaagcgccgttcctaacggttgtccaccgcttcggggttcatgtcgtggtgggaaaggcgctgccacgcggcgtcttcccacttcgtcccgggcctgccgtagttgcagtacgggtcgatcgaaatcccgcctcggggcatgaaccgtccccaaacctcaatgtatttcggatccatcaacgcgatcaaatctcccatgatcgtgttcatgcagtcctcgtgaaaggcgccgtgttcccggaacgagaacaggtagagctttaagctcttgctttccaccattttcttgtccggcacgtaggcgatcacgacgtttccgaaatcgggctggccggtaatcgggcacaggctcgtgaattccggacagttgaatttgacaaaatagtcgtggtccggatgtttattttcaaaggtttcgagcatctccggcgcgtaatccgtcgggtagacggtgccggcactgccgagcttcgtcagatgctcttttttcttatcccgctgatcgttcatttgcttctcttcctctcacgctttttcgtactgcgccatcgccggatcggcgacgccgttcgccgcaaaggccgcggcccggtccaggcacgtcccgcatttgccgcaggggcggtcgcccccttcgtagcacgaccaggtcagctcgtagggcacgccgagctcgaggccgagcttcaccactgccgccttgtcgatatcgacaaagggcgcggcgatttccagctggtggcccgagccttcgtagaccgcacggttcatcgcgtcggcaaaggccggcgagcagtccgggtaggcaaagccagccgaatcgtcggcgtgggcgccgtaaagaatgacgtcacagtccttggaaagggcaacgctcgccgcggacgacaaaaacaggccgttgcggaagggcacgtaggtcgaaaccggcttctcgccgccggtggccgcaatctgttcggcgtagctttcttcggggatcgcctgatccgaacccttgagcagcgcgcagtcgctgtactgaaaaatcggcgtcagatccagaaacagctgctcgacgccgtaatgcgccgcgacggccttggccgcttcgatttccttgtcgtgcttctggccgtactgaatcgacagcgcgatgacgttttccgcgccgaggcggtccaccgccagccccaacgccgtcgtcgagtcgacgccgccgctggtcaaaaccatcgccttcttgtattgatcgaataattgcttcatctttatcctctattcaaatctaaatatccttacacgccgcgggtcactggatcccagatgatcttgtgcagctgaagctgcagccgcacgccgttgagcttccgcttttccataaaggtcacaatgtccaccggctggatcatcccgaagaccggacttaaaaacacgtggcaggtgcggtcgagatcgtaggccgcgatgatgcgcgcggcgtcttccaaatcggcccggctgccgcagacgaatttcacgctgtcgtgggggcccaggtattggtaattttccggccgcatcgcgctgacgcaggccgggccgctggccgaaagcttgcagtccagcgtaaagaccggccggtgggccgggtcggcgcagaaaggcgcgatgtcgatggaaccgttggtttccacctcgacgcggcagccgtcgtcgatgaggcgggcgatcagcccgtcgatgccgtgctggagcagcggctcgccgccggtgagcgtcacgttgtgcgtgccggtggtcttcacccagtccgcgagctcggccgttgtctcgtcctttgcggcgcagtccgcgcggttggcccacttcgtgtcacagtaatcgcagttaagattacagcctttgaagcggataaaggcggccaattccccggcatgggggccttcgccgtcgatgctgacaaatttttcagccacctgcatgtcagtgccctccctgatctttatcctcaggctcgtaagccgccatgttgttcggcgtctcgtaaacctcgacgcggcggacgtcgtagccctttgccgtcatttcatcgcagaacagctttgcgagattttccgccgtcggccgaacgggaatggcccggccggaaaagccttcctcggataaagcctgcatcgccgtctccgagaagcttccggcttcgtagatcaagcgatggtcaaagccgtcgcaggcagccttgagatccgccttcaaatcgccgaagtcgacaagcatgccgcggtgctgttcgtctgtctgcagggtctccccttgaatttccacggtcaccgtccaatgatggccgtgaagattggcgcatttgccggcgtagccctttaaaaaatgggccgcgtcgaaatgccccttcgttttgagtgtgtacatcggtttgccttctttcccaataaaaaagccctgcataagcagggcgttatcatctattgaagccctggttttgtttatcgacaggatggtgcaatcgaactgtcgtcagcattatagaccaacgcggccgcaaaatcaagctttgcggccgcatctgttattttcaattcgtctaatattaatagttgccctgctgggttgtgcccgcgtcgatccgggtcgtgaccagcgtcggatcgtaatggtcgagataatcgccgatttccgaaaaagatttcggataggtgcggttcatctgcgccgcgatcgtcttctgataaagcttttgagacgcgctggacacgaaaatcttcacgtgcatgcggctcggttttcggttattcaccaaaatcgagtaagccatccgtccggcgcggtacccttgattgtagggatcggtgtaaagcgtcgccagcacgttcttcccgacggtggcatcgccggccacggtcgaaacgccggcttccgccgcgaggggcgcgatgaccgccgcctgtttagagaggccgcagtacatcggaaagtacaatgcactgcattccgacaccgcagtttcgccgaggctcgccgcttccatatcggtgctggtccgggacagatcgtaggttttcgaagcaaccccggcttcgtcgagcatcgccttcattttgttgcactggtagacgctgtccggttcgctgggatcgcggaccagcccgacggttttcaaatcgggggttacctcgatgagcagcgacagcgtgtccggcaggctcggttcgcccgatacgccggtgacgttgcggccggtccggtagtcccagttgtcgctgacggtcataccgagggcccgctggaaattgaccacaccgacgctgagaatcggagtctcgcttgtcgcgtcctcggcccccatcagcgctcgggtcccgcaggtgaggatcagatccttgttctgcttgaccatctgtttcgcggcttttttcgcttcatcccgggttttgacccgcttttccgaaaatttgatgtgggtcgagccaaaaatatcggtcaccgcatccatcgacccctgaaccatctggtcggcgcaggtgccgctctttgattgaatgatcccaatcgtgtaaacccgcgagccttcttctttggaatccttgtacgtcgtaatattgacgcggtctctgaatacataagccaagaccgcagcggccgccgcgatcgcgatcaccgcgatgatgatttttttgcgtttactcatcctgccgcctcctattcacttttcaccgtgggcgctgtgtaagtcacggtattcgacgagcggagcttgtcgtccccggagcccatctgactgacctgaatcttgtcgccctggcgcacatcgtcgacgctgatcgacagatgctggccgctcttgtacttcgtcgagacctgcttgccgttcacaaagaccttgctccaccgcgtgaagttttctccgaagaggtgcacccggttatcgtaggtgtagacacggtcaattttaatgtcgtttaagcccatttcgatgtcggtcgccgggtacgggtccttgccgttgtaggcgtagcgcttgccgtaaagcagatcgtactgcagtgtcttcagcccgcgcatgtaagcgagcgagcccggcttcgtcccattttcgatcatcttctgctgataattcatcatcgtgccgccgtgaacgccaaggcgcccgagcatatccgccaccaggttgtaagacgtgcggtccgcgtcctttttctccatgccgaaattgttccaggtgatgtactttgtcttgaagatgtcgccgctcttcacttcctgattcgtcaaatccatactcggcacgtggtccccgaacatgatgacgagggtcggttcgtctcggctgtcgagcatcttaatgtagttcttgatccactgatcttctctgtggagcatattgacgtagtattcccatttgtaattgagggcctgatccttgcccttggccttgaccttgacgtccggattcgtgaagaccttgtaatccggataattgccgtgggtcgcgacggtgatcgtgtagacaaaatccttgccctttgtcgaatccatcgcttccttggtcgagtcgatcaggatgtcgtcggtcggccaggttttgatcgggttgtattccttcttcgtgatgtcgagcatttccttggacgtgaacgtatcgaagcccatcatcgagaaggcattctgccggctgtagaagttcgcgccgttgttgtggacgacatggctcttgatgccgagcttcttcagatccgacgcgtagctttcgcagtccttcacgtgcttgaggaccgttttctgcgggtattccccagggccaaagaactgcatggacatgccggtaagcatttcaaattcggtgttgcacgttccggcaccgacgaccggcacttcgagatagcccgtcgaataattcgattccagcgagtggaaatacgggatcggatcctccgacattgacaggtatttcacatccgtcggatccatgaaggattccagcagcaccacgacgacgttgacctttttgtcgttgatccaaacggtcttgcccatatcggtgctcgaggtgaccttgtcgaccgattccttcgaataattccacggcttgctcattcctcggctgaaaatactggtgccaaagccgtagagaaagccgtaatccgaatagccctgggccagattgccgaagtaggcgctgagctcgtgccggctgcgcaggaaaatcgtcgagcccggaatcagcgcgatgctgaccgccacggcgataagcctgatcggaaacggccatttgcccttctgcttgcggcccttgaaaaagaggagcacgacgtagacaaaaaagagtataatcgcggtgacaatcaccgccgttaagccgcccgagacgtattggctgcccttcatcgtcagaaggtccgaaatcatcgtcaaatcggtaaagccgaatggcgacacgcgggcgagcagaatgacgccgttcacgacgccgagaatcaataataacccggtgatcagcgtgcgcagaaaggtgcgccgcctgacgagaaaagtcagcgagtagatcaggtaaaccaccagacagttgtagagaaacggaatggtgtggtgcgccatgaactcgaaaacgccggcgaaggagtgccgggcgagcagctcgatgataaagacgacaagcaccgccagcggaatgtgcagccaaaccgcgtggtcgttgaagaatttgtccgggccttccatttttttcgcggccctgttgacgaaccgatcggcctgtttccagccgtagcgcaggtagagcccaatcgttctcaataccttggtgaattttgaggagccgcggacgtccacgtcccggagttcctgctcatcgtcctcttttccgtgcgcctccgattcgaatttgacctcgtctctggtaattctcgggttgtcgcggtcttccgaggcgtccttttgttccagatcttctggcgtttctgatttcaagttgtcggcttcatctgccgctctttgatcctttttcttacgcgatgccatcggcgtctcctttcccgtcgtgctggccggatgcggccgcttccgctgccggtgcgatattgccctcagccacgtttttgtcgattattgcttcaactaagttgtacagcgaaacggagccccgcttcgtgccgatctgacgcttttcgatttgatcccggcggacgtgatggcgccgccagtcaccgccgccgttggaattgttgagcagcaccggctgaaggttgtccatcgcccgggcaaacctcgcctccggtgtgaccccagcgtcgaattcctcaaataaggcgcgcagctttgcgccctgatcctcaggcagcaggccaaagatccggtcagccgcccgttcctcgcggtcgttctgcgtctgtttcgccttttcgtcataggcataggtatcgccggcgtcgatctcgacgatgtcgtgaatcagacacatcagcatcccgcgggccaaatcgaaatcatcgtcggcgtactcggcgagcagggccatcatcacggccatgtgccaggcgtgctcggcgtcgttttcggcccgtccgccgccgctcaaatgggtctggcggaacacgttcttttccttatcgatttccaatataaaatccagctgctgatgcagccttttctgatcgatctcttgcatcaaacttacctctacataaaaaagaaggcttttcagcctgcttcctttgtttttgattcttccgtcttgtggtccagtacgaccggctgtgctgggtcgaacaggatttcgcggagggtgtgtgccttcaacaccgttgcaagctggtgctgaatcgccagcagatgtccctgaacgcggcagtcctcatcgtggctttcacaccacgggcaggcgtaattctttccgtcgacacacgccgcaacgcccggcgcatcgcccagcgtctccatcacatcgtacagcgtcaccgccgaaagggactgggccagctcgtagccgccgtcggcgcctctagtaatggcgacgatcctgccgccctcgagctttttcaaaattttgtaggcgtactgcctgggcaccttttccgcacaggcgagcatcgcaacggtgtgccttttgccgtcggaaaggccgcggatcagccgcaaggcgtagtccgtctcttttgaaatcaacatcatgttcttttcactttcctctatacacaatcaatgtttgatcaatctttgacgcaaattttacatcttgctgtcaaaaatccctagtcgtccattttttatgaacgcattttatcacaggaaatggggcgctgcaaatattttcagaaactctctgtcttgatttaagaatctggaggatactgctctattttttattgatgaataagatatttcccgggaaataacgtcagtctagaaaaaaaacagcaacaaaaaagcacggtgcaaacgcatcgtgctgagttttcatggcggagaaggagagatttgaactctcgcgccgcgtgaacgacctacacccttagcaggggcgcctcttcagccaacttgagtacttctccgtactgcgcttcaggattctacgctgattgtatcaatgaatctcaaagctttattcaattaaaatggccgagagggtgggattcgaacccacgtgggcttgcacccaaacggttttcaagaccgcctcgttatgaccgcttcgatacctctcggaatgcgtcgtcacagtacgcgacaactgcatgaaatattataacaggggctttcgcccctgtcaattcttttatttaatctttttaatatttttacaattaaaatttcagactagcagaccttgacaacccagttgaacggatcttcgacagtgccgtgctggatgccaactaaggtgtcgtaaatcttctgagcgtacgggccgatttcgtcattgttgaagaccatgtcttcgccggcgtagttcagcttgccgattggcgcgacaacggctgcagtccccataccgaagacttcttcaaccttgcctgcgtggtagtcgtccaacagttcctgaattggcaggatccgttcttcgacggtttcgccccagctcttgagcagctgaatgatggatttgcgggtgatccccggcaggatcgtaccggtcagcttcggcgtgacgaatttgccgtcgatcttgaacatgatgttgcaggagccgacttcttcgatgtttttacggcttgcgccgtcgagccacaatgtttcttcgtagccttcttcgttggccttttcggtcgcggccaaggaacctgcgtagttgccgccgcatttcgcttcgccagtcccaccggcaacggttcttgcgtaaacctgttcgatgtgcattacagccggtttcaagccgtcttcgtagtaggagccgactgggcagagaataataaagaatttataggtgctggatacgtgaacgccgatgtagttttccgtcgcaaaaatgaacgggcggatgtaaagggaggtgcccggagcggtcgggatccaatccttttcgatttcaacgagtttttttaacgcttcgagcgcaaaatcttcgtcgattggcggaatgcagaggcgcttagctgagcggttcagacgtgcgaagttttcctgcgggcggaacagctgaacgtggccgtccggcgttttgtaggcctttgtgccttcgaaaacttcctgcgcgtaatggaaaacacaggcggaaggatccaggctgatcgggccgtagggttcgatcgtcgcattgtgccagccattttctggatcgtaatccattgtgaacatataatccgtgaagatgcggccgaaaggcagattgctctgatccggcttttctttcagggttttcgctttgacaaacttgatatccatttatttctcctcatctatcaatcgccgtcacgcgattggtcatttgttaacaatagttttattttaacaatcatgtatacaatctacaagacatttattgtactttttctgatacaatttcaatttgaacgtcaccgtgctttttgatacactaccttttatgaaacaaaggatcaaacacacaacttcttcaacgacttttcccgcgccgccggacggcgcagctgacgcactgctcacctggttttctgaaaacaaacgggacctcccgttcagacgtcccgcacgcacaacccgagccgacccataccgcgtctggatttctgagatcatggcccagcagacccaaatcgacacgctgattccctacttcgagcgctttatctccacccttccgacgctggatgacctggccagtgccagcgaggagaccgtcctcaagctctgggagggcctcggctattattccagagcccgcaacctgcgcaaggctgccattcaaattcaggctctcgggcattttcctgacacggctgaggcgctcgcgaagctgccggggatcgggccttacaccgccggcgccatcgcgtccctcgcctttaatcaaagggccaccgcggttgacggcaacgtcctgagagttgccgcccggctgatggacagcccggctgatacggcgctgcccgccgtgcgcaagtcggtctcggcctggctcttaacctggatgccgaagaaccggcccggcgatttcaacgaagcgctgatggagctcggcgccctcgtctgcacgccgaaatccccgtcctgtctgatctgcccgtggtgggacatctgcctgtctctaaaaaacggcaccgtcgacaagcggccagtcaaatcaaaacgaacgaagcaccggaccgaaaaaatcgccgccgcggtcgtcaccgattcaaccggccggctcctgatccacaaacggccggacaccgggctgctcgccggactgtgggaactgccgaacgtgacggcggccaataaaaaagaaggcgcggccgccatcaaaaaacacctcgaagcccagctcggcgctgccgtgtctgatccggtctttttaaaaaacgaccgccacgtcttcacccacatcacctggcagattgctgtttaccgtttctcgcttgaggcggacgtcacgccaaaggacgacacctgggtattcgccgaccgggacgatctcgaacagcggtttccgctgccgaccgccttttccaagctgctttcttgacacaaaaaatccgaaggactgtcattttaggcccttcggatttgtattgccgcattttagtcgagcttgtacagtcgccctggttttctcggaagatccgcaggcgcatcgtcgcggtagccgaccacgcagtggccgatcccttcgtaatcgccttcgatgccgagggccttcaggatcgccttgccttcgggctgctcaaattcctgctttgcccggtgaatccagcacgcgccgagaccgagaccttcggccgccgtcagcatattgccgatgacgagggtgccgtcgtacatgtaggtcggcgctgatttgtccgccagtaccacgtaaaccaccggtgcgccgtaaaacggatcgctgtccacgcccatgatgtctgcattcagcttagacagcgtgtcgcggatcgccttgttgcggatctgaatgatgatcgccggctgacgattccggcccgaggccgcgttgagccccgccgctgagatctgatccagcaggccgtccggcacggcgtccgatttgaattttctgcagctgcgccgttcgagcagcgctttcattgccatgttttccatattctataccctcctctaattttcaaagctttcgcttgtgtatccttataaatcgcggctgacctcattgctccagtcggagtaatagcgtttgccgccaatcttgacgtaggcgcgcaccttgcccttgacggtgcagcccgaatcgttgacgtagaccgccaccgatgtggtctgatcgttccagttcgccggccgcaccgcttcggtgtcgtcgtccttggttttcgtgatttcgacctcgtagccgtccgcgttatccactgcgttccacgaaaaactgatgccgtccatatcctgaatcttggtatcctgccaatcctgtgccttcggcgccgggagagctgaaacggtgtaaacgccgttgagcaccgtgccctttcggccggacgcgttgtaggccaccacgcggatcgttgtcgtgcccggcggcagctcgatcgccttggtgtacaaggtagactttttcgtcggtgccttgccgtctgtcgtgtagtacagcgtatcggttttgcgccccgccttgaccgtgagcttaaagccaatgtcgtagctgcccggatctgaggcgaagctcggccggctgaccagcagtgtcttcttgagcttgagcatgtcagcgtcgcccgtcgcctgggccgccttgtcgatgagcttcgaaacggtcgaattgctgcgcccctcgctgatgtaaagatcgatcagctcgcggtacagccgtttcaaatcacgcttgtccgacgccgctttgatgccgtggttgacgattttttcgccgagctggagctcgccgattttctgcgccgcttgtccgccggcaatggccgtgcggcggtcgatatttgcggcgatcgcgacctgggttaacagggttttcgcgtcgctgtccttgttctgggccgccgcggattttgcccgcagcgccttgccgtaattcgtatcctcatggctcttggcctgagcgagatacttgtcagctgtctccgtctggcccttcgccagcgcggccgccgccagaccttcgtagccctcgacgcgccggctgttcatcttcaccgcctcgcggaaggacgtctgggccgccgtgtacgccttttgatccaggttgcggttgccgacgtcgatcgcggattcgtactgatgattctgaaacaacagcgccgccgcaccgacgccgccggcgatcaaaatcagcaccacgatcaccagcgtcaccttgattcggcctgcggcgggccggcgcttgaccggctttgcggccgtcctctgctttcgggtctgcggctttgctttagtttcagttttgacgggctggccgcatcgggaacaaaatcgcatccccgactccagcggcgccccgcacttactgcatttcatttttctttatctccattgcttttctctttattttagcattttatgtcctttagggcaacggcgcgcaggcgcggacaaaggcctcgaagacggccaggctcttaggatccttctcgaaggcgcattctggatgccactgtacgccgagaagaaaagcccggttcggatcgctgacgctctcgaccacgccatcctcggacaccgcctgcacgatcaggcccgcccccacatccttcaccgcctgatggtgaatcgagttgaccgcgtaggtgcccgcgccgatgataccgcttaaaaaggtgtccggcagaacctcgaccgtgtgaatcggcacgtcgtagggcgggtgctgatggtgctcggtatctgtcgggtgtgccgtcggcaaatcctggtacagattgccgccgtagagcacgttaaaaagctgaatgccgcggcagatgccgaggacgggtctgtccgccgccgctgcctcgttaaacagtgccacgctcatccggtccagcggctcgcaggtttcgtccgcatcggtcaggcgcggttcgttgtaataggacggcgtcacgtcctgaccgcccggaaagagaaagccgtcgcaggtcttcacaaaatccttcagaatcccttcgtcctcggtgtagggcagcatcatcggaatgcccccagccgcaaggaggccgttcatgtacccgggcagcatccaatagctcttccgctttagatccaccaatggcagaataccgatttttggttgcttcatcgtttaacctcgtatgctataataaaattattcttattataaacaaaaataaatgaaaaaaacggcggtgaatgaaattccccattatttacctattttttactgtaatccgctgtaaattttatatttctccattatattgttaaattgaaaaattgtgacaatttaattctatttgaatttagaaagagagtacactatgccaaatgaaaatctaaccgccactccggcagcccagcctgtaagtccttacgactacatgcagaaccgcgaactgtcctggctgaatttcaacgaccgcgtcttgagtgaagcgcaagacccgtcggttccccttctcgaacgcctccgcttcgtccagatctttgtctcaaatctcgacgaatttttccgcgtccgtgtcggctcactgatcgatatggtgcctgccggcgacgcctaccacgacagcaagaccggctggaccgccgacgaacagctccagcacatttaccgcgcggccagaaccctctgtgccaaaaaggatcgagtctacttccacctcgaacacaagctgcgccaccaggacatctggcatttgtcttacgacgaactgaccgacgacgaacaggaatacattgaacagcatttccagaatcatatcctgccgctgctctcgccgctgatcatcgacgcccaccatccgttcccgcacctgcagaacaaaaaaatcgaaatcggcgtcgtcctgaaggatcaggcggaacgcaaggtcttcgcgatcatcccaatccccgacagcttgccggacgtgatctacctgccgtcccgccacgcactgcgctatatttccaccgaagacgtggtcttcgattacgcggatatcatcttcgacacctacaccatcgtcgaaaaggtcaagatgtcaatcacgcgcaacgccgacatccacgccgacgacgaagatttcgaagtcaacgacgatttccggaccgtgatgcgcgatatgctcaagcgccgcaagcgcctggcacccctccgcctggaattgtccaataccatcagcgacgaatgctacgatttcttgaaaaagaagctgcgtctggccgacgcccagattttctacgtcaagtcgccgatgcgcctaggctacgcctacccgatcgccgacaagctcaacgccgaacaaaaggctgacctgctctacgcgccgttctcgccgcagatcccgtcttcggtgaatatgaaacgcaaaatggagccgcaaatcaaggatcacgacattctgctgtccttcccctacgattcgatggaccccttcgtgaaaatggtctccgaagcggcggacgacccgacggtgcgttccatcgccatcacgatttacagattgtcctcaaagagcaagctggtcgaagcgatctgccgcgccgccgaaaacggcaagaacgtcaccaccttgatcgagctccgggcccgcttcgatgaacagaacaacatcgactggtccgaacggctggaaaatgccggctgcaccgtcatctacgggacgccgggcttcaaggtccactcgaagatctgcctgatcacccgggaaagaaacggcgaaatcacctaccagacccagatcggcacgggcaactacaacgaaaagacggcgaccctctacaccgatttgtcgctgctgaccgccaatcaggacatcggactggacgccatgcacttcttccagaacatggggctcgaaaaactcaacgccaaatacaacaagctgatcgtctcgccgtctaccctgaaatcgacggtgctgaagctgatggacgaacagatcgccctcggcgatgaaggcgaaatgttcttcaagctcaattccctgaccgacgtggacatcatccacaagctcaaagaagcctcctgcgccggtgtgaagatccacatgatcatccgcggcatctgctgcatcgtgtcgggcatccccggcgtcaccgaaaacatcaacgtgcgcagcgtggtcgggcgctacctcgaacactcccgcatctaccgcttcggcgccggcgacagccagaagatgtacatcgcctcagccgatttcatgacccgaaacaccgaacgccgtgtcgaagtcggcgcgccgatcctcgacccgaagatccgcgaaaaaatcaaccacatcgtcgacatcatgctgcacgacacatccaaggcacgcattctcgggccggacaagctgtatcacccgatcaccaacgccaagggcgcgccgctgccgccgtacaactgccaggaagcccaggccgaggaagccatcaaaaacagcttccgcccgcagaaggacaaaacacctggcgctgccgacaagcccaagcatcgggaatccttcttctcaaggctgttccgtcacgacaattaaacctgatcccagattcgattcaaaaggccggacgatttttaaaccgtctggcctttttgtttttacaaaaaaatacagcagcttaaaaaagctgctgcagttttgattcccaaaattattgattgtcgatatcgagttcctttaaatacttcttgaaccgatcgccgaccccaggcatgcgcagcccgtattcgacggtcgcttcgaggaagccgagcttatcgccgacatcgtagcggcgccccgcgaaatcgtaggcgatcatcttttgacgatgggccaattttctcagcgcgtccgtcagctgaatttcgccgccggcaccccggccggtgtgttcgagaatttcaaaaatgtccggcgtaatgatatagcgccccaaaatcgccaaatcgctcggcgcttcgtcgatggccggcttttcgaccaaatcgtcgacgtcaaattcgtaatcgttgatgggctttccggagacgatgccgtacttgtcgacctgatccttcggcacgcgctgcaccccgatgacagacgactggtatttattgtagacgttgatcatctgcttgagcgccgggttttccttgttgtagacgatgtcgtcgccgagcaccactgcgaaaggttcatccccgacaaattccttggcgcagagcacggcgtggccgaggcccttggcttcgccttggcgaatggtgtaaatattagccatattggtgatatcttccaccatctgcagctcagcgttcttgcccttcattctcaggttgaattccaattccggcacgtggtcaaaatggttgatgatgatttccttgttgcggccggtgatgatcaaaatgtcggtaatgcccgacgcgacgatttcttcgacgatatactgaatggtcggtttatcgacgatcggcagaatttccttcggtaccgatttggtcaccggcaaaaaccgcgtgcccagaccagccgccggaataaccgcctttttaacttcctttgtcataatgttctcctattaataatctcgttcaaatctttgggaaacgcctctcgcgtttctcctattaagtataacggctttaccgttaatcttcaagtttttcaaatatgccgaccggcttgaggccgagggccgcgatccgatttcggtcgagacgcgccgtgacgtcgacaatctgacgccccgccatgcgcttcgcgagtgccggcgtcaggattcgtcccatccccggccacgcaccgagcacgacgaccagctccgcgcttctcgtcgcctcggcgcagcttccgcagaaggtgaaggcatcccgggtgcggaacagccgccacttggcctgatccatgccccagggcaggtaaagggcgaagggctttccgccttcaatgggccgatcctcaaagggcgccgccatggccttgagcagttccaccgccggcgtttccctcaggtcgtcggttcccgggacgttggacagccccagcaccgcgatttttccgccatgtgctgtgatcttttgaacaggcggcagcagccacgccttcattttttcgaaatgcgccgtattggcggcctgaaaggcgtcgattaacgaccgttccttctgtttttcaaaggccgataaattgttaagctcctggctcaggcgccggccccctgcgccggcagataagcctaagcccgctctgcggcgcccgctttctcctttggcgaggatttccaagaccttctgccccgacgcgccgcagtccgcggcgacgtcctgccaatagttggccagcacctgttcaaaggcagtccgggccgcgtccgataccgcggccgcctccgcgtcctccggcgtgcagtagattcggcggctgccgtccggatccatcacgtcgagcacagcctccatcggctggtacctgccgtctgccccgacgacgatcggcgcatccctgcgcatggccttcagcatggtgccgtcgtcgtaaagctcgggcagcgcgatgacgtgaaccgctgcggcgtcctcacggtccgcagccgcttcgtccgcggcgcgctgcagcgcgcggatgccccccggcggcagcgtcgccttgacggcgagcacggtttcctccgggcattggtaggccgcctggcgcaccaccgactcgatcagcctgagggaagggctgccgtcttctccagccggcgtcatgccgcagagcgtgataaactggcaggtcttaaaaatccgccgcggctgactcaaaatcgtcaggccgccggaagcgatctgttcctcgagggccttgcgcagccctggctctacgcctggcagtgccatctcctcctgaacgcccaaagcggcgtcctcgtccgggtcggtcgccagaacggcgagccccatctccgcctgaaccgcggcccaggccaatcccgtcacggtcaggccgatcacgccggccgtcatacggttgtcttcttttatatcgctgtttgcgttccaattcgtgttcatcatgatgctattatagcaaagatacgcattctcaaaaaataaaaaactgttccgatttttacaattttttgccaaaccttcgcgttatcataaggttatcaaatcaaacagatcaagacaaaggcgtcgatcaccaatacggtgacgacgccttttttgattgatggaggcaaacatgaaattttcaagagttgaaatcgtcacagacaatgcgaaattggaaaccttgctgagtgcagtcggacagtacggcatctccggtatcactgtttatcaggttttgggatgcggcgttcagtacggctctaaagaatacgaagggggtacaaaggaaaccccgacactgctgccgaagcaggtggccatggtcgtcatgccgacggatcaggtcgacgcctttttaaaattcgtcagcgaagaattgtacaccggccacatcggcgacggcaaaatcttcgtttcagatatccaggaaatcatgcgcgtgcgcaccggcgaagtcggcatcgaagcgctggaacctcagaagcactaatcccacatgtaaaaacttcaagcattgattacaaaaaggaagtgaattctattggctgctaacaaaaaactcggcatgggcagtgtcgtcgccaccggcgtcggtctgatcgtcgccacaagctgtctgctctccctcgggcagggctcctcggcaatcgggaccacgtttatcatctcgatggtgatcgcctgtgtcatcaacattctattcgctttatcggtttcggagctcaattcgctgatgcctaacatcaccggcgggctgccgcagtacaccctcgcgagcatgggcccctttgtcaccatcgtcatcatggtgggcgggtatctggcctgcaacacgatggtcagctcggcggaatgtgcgatgttcggcaacaccattcaaagcgttttcccacaggccggcattccggcttcggtctactgcgtcgtcctcgtcgcgattttgatcctcatcaatttaaacggcgtcgacattttcgcgaaggttcaggactttgttgcctacgcgctcatcgtctcccttttgattctcggcgttctcggcacgattaaagtcggcaccggcacaccgatcaatcagccggcggtcctctcctctaaattctcggacatcaccggtctctgcgggttggccttcttcctgttcatcgggtgcgaatacgtcattccgatcggggacaagatcgacaacccccgccggaaaattccggccggcatggtcatctccctgcttttggtgctgaccttccagatcttcatgtgcatcggcttcagccactacaccccatgggcacagctcggcaagagcactacaccccacgtcctttacggcacgatgctgttagggccggtcggcacgtactggatggcgatcgtctctgtgctcgccgtcatctcctcggtcaacacggtcatctcctctctggcgtacatcgccgcagggatggccaaaatcggactgctccctgaaattttcaacaagacgaacaagaagggcgcaccggtcgccggtatcctcctctttggcgggatcatcctcgtcatcaacgccgtcggcctgtcgacctcttcttcactgtcgttcttaattctctgcggatgcgcgttctggatgctgtcctacatcgtcacccacatcaacgtgctcatcttcagaaaacgcctgcccaacgcaccgcgcaaattcaaggtgccgggcggcccgatcattccagtgctcggcgccatcggcatggcctggatgttctggaacatctcttctgatccagcggaacggacgttgatttacatcgtctgcctgatcatggtcgtcgtcttaagcgtctacgcggtgctgtggattaaaaaggtcatgcaccgcccgctgttcaagcccttcccgatggaagaagtcatggcgatggacaacgacctctactcggtctaccacgacccgaaaaccggcaggctgcgcgccaatatcgcccgcggcggcgtgacaccgcttggcgaaagcgaatcgtaatcccaaacctgtgcaattgatttagagataaatataaaatttaggattttgaaaggacataaaaaatgagttacccaaaaattgattttctgtatttaagtgaaccggatatgttaaaagcaggcgtcgatgacgtcgtggcctgtactgactgcatggaagacctgctcaagctgctcgacaaaggcgactaccgcatgggcggtgaaaacggcaactcccacggctgcatggtcaccttcccggacgagccgcagttcccaggcatgccgaaaaacggtcctgaccgccgcttcatggcgatgccggcctacgtcggcggacctttccaggttgccggtgaaaaatggtacggctccaacaccgccaacagagaaaaaggcattccacgttccatcctgatggttatgctcaacaataaggacactggcgaaccgctggccttgatgtccggcaacctgatctccgcttacagaaccgccgcgattccaggcgtcggtgtcaaacatttggccctcgaagacgccaaagtgctcggcgttgtcggccctggggtcatcaaccgcgccaccatcgaaaccttcgcggccctgcgtccatctctcgaaatcctgaaaatcaaaggccgcggccaggcatccatcgaccgctgcatcgaatacgtcaacaagaaaatgccggggcgcttcaaagacatcatcgtctgtgatacccttgaagaatgtgtccgcgattccgacatcgtcagcttctgcaccagcatcaccggcggcgatccggccaattatccacacgttgaaaccgaatggatcaagcctggcgccctgttcacctgtccgatggccggcgacttcagcgacgacatcatcgaagacccgaacaccaagctggtcgtcgacaactccggactctacgaagcctgggcggaagaatatccgtacccgacctacaacaccatcgccattccagggagcaaattcaccgacatgattcacgacggcaagatcgaagcctccagaatcgaagacctcggcggcattttaaacggccgcttcccaggcagaaaggacgacaagcaggtcatcatctactccatcggcgggatgccgattgaagacgtcgcctggggcaaggtgctttacgacagagccgttgaaaaaggcatcggcgtgaagctcaatctctgggacagcccgtacttctattgatcctgatcctaaggatatctcctttaatctgaaaacatccatttactgacttcttcacaaaagactcctgaggacagttcctgccttcaggactcttttatctatattagaaaccgaggaacacatgagtacaagattaaccacccacccgattttagggacgtacgaaaagggccctaaagtcaatttcacttacgacggcaaaccgatgaccggctacgaaggtgagccgattgcgatggcgctcaaggcagccggcgtcatggtccaccgctacacctccaaaaagcacagcccgcggggtattttctgcgcgatcggccgctgcaccgactgcgtcatgatcgtcgacggacagcccaacgttcgcacctgtatgaccccgctgaaagccggcatgaccgtccagacccaatacggcgtctcggctgaaccctttccagaattggaggaaaaagcatgaaacgtgttgatttaatcgtcatcggcgcaggcccagccgggctttccgccgccatcgaagcctccagccgaggcctttccaccgttgttttcgacgaaaacgcccgtcccggcggccagctctttaaacagattcacaaattcttcggctcaaaggaacacaaggcgaaaatccgcggcttccgcatcggccagacccttctcgacgaagcgggcaaagccggcgtcgacgtcgtcctgaacgcgaccgttatgggcatttacatggaaaaggaagtcgtcgtgagaatcggcgaagccatcgaacacatcaaggccgacgcgatcatcgtcgcgaccggtgcctctgaaaacatggtcaccttcaagggctggaccctccccggcgtcatcggcgcgggcgcggctcagaccatgatgaaccttcacggcgtcaagcccggcagccgcattctgatgctcggcaccgggaacgtcggcctggtcgtctccttccagctgctgcaggccggatgcgaagtcgtcgccctggctgacgccgcgccgtctgtcggcggttacggcgtccacgcgtccaaggtcgccagaaccggcgtacccttctacctgtcccacaccatcgtcgaggctgaaggcagcgatcacgtcaccggcgtcaccatcgccgaagtggacagccacttcaacttcattcccggaacggaaaaacatttcgacgtcgacacgatctgcgtcgcggttggcctgtcgccgatgagccagctgctcaaaatggccggctgcaaaatggaagacaatccgaaacgcggcggtcaagtgccgattatcgacgcccacggcgccacttccgtccccggcattttcgccgcaggggatgtggccggaatcgaagaagccagctcggcgatgatcgaaggccgtcaggccggactctacgccgctgaatacctcggctacattgaggacaccgacttttcagagggcgaagacgaattggatgcggccctctcaggcctgcgccagggcatgttcgcgccgggcaacaagggcaagcgcatcgaaaagaccgacgaaggcatttcggtttccgattcgctgctgcaccacggcttcgtcgccgacgacgaaatcgaacgcttcccaggcgtgacccacagacccggcgtccacccggttatcgaatgtacccagaacatcccgtgcaacccgtgccaggatgcctgtccgaaaaaatgcattgaagtcggcgaaaaaatcacgacgctgccccacatcaacgaagacaacccgtgtgtgaactgcggcatgtgcgtcgcgtcctgcccaggccaagcgatcttcttgatcgacgaagactgcggagacggcacggcggaaatcaccctgccttacgaattcctgccggttcccgaaaagggcgcggtcggcaaagcgctttcacgaaagggcgaaccgatctgcgacgcgacggtcgtcaacctgcgcaccgccaaagccttcgatcagaccacactgttgacgatgaaggtgccgaaagcctacgcgatgaaggcgcggtttttcaaagctgaatagaaacgagaatgaaccatgagtgaaaataaacaaccattaaccacattaagcgaccgctgtgcggatatcggtccctttgtcccagcgccggacgacgacatgatcgtctgccgctgcgaagaagtcacaaagggtgaaattcggaaggccgtccacgcgggtctctggaccatcgcggaaatccgccgctacctgcgctgcggcatggggctctgccagggtcaaacctgcagcaaactggtgaagggcattgtcgccagagaactgggcgtctcccctgcgctgctcgaaccggccacatcgagagcgccgatgcgcccgactgaaatgcaggtcatcgccacagaaagcgaggtaaacttctaatgaaaacaacagcagacgtgatcgtggtcggtgccggcatcatcggcaacgccatcgcgtattacaccgcaaaaaaaggccattcggtcatcgtattggaaaaaagcgccattgtcggcaacggcggctccagccgtaacggcggcggggtccgccaatccggccgtgacgcgagagaactccccctggccatgtacggcatcgaaaatctctggccgggcctgtccgacgaactgggctacgacgtcgaatacgtcaaaaaaggcaatctccgtctcgggaaaaccccggcacacttgaaaattctcgaaggcttggccaaggttggacagagctgcggcctcgacatgcggatgatcgacggcaaggaagtgcaggccatcaacccctacatgtccgacgaagttgtcggcgcgagctggtgccccactgacggccacgccaacccgctgaaggcgaccctcgccttttacatgaaggcgcgggaactcggcgtgcagttctacaccgaaacaagcgtcacgggactgaagaaaaaggccggcaagctgaaaatcgtcgaaacagacaagggcatcttcgaaggggataccattattttggcctgcggcctcggcgcccgccccatcgcgagccaagtcggcatcgacatcccaatgagctctgtgctcctcgaagcgctggtcaccgaacaggaaccggatatgttcccgcagatgctcggaacggcagaagccgacttttacggccatcaaaccgcccacggctccttcgtcttcggcggctcctccggcctcgaagcggtgaacagcgacaacggcacgccggtgacccattcgatcacggcgccgtgtatctgccgtgggatcatcaaatacatgccccggctcgccaacgcgaaaattgtacggacctgggccggctggatggaccacatggtcgacggcgtgccagtcatcgaccgcatcgacgaagtgccgggcttgattctggcctgcggcttcagcggccacggcttcggcatcgcgccggctgtcggcatgacggtgtccgaactcatcgaagggccggacacgacagtcgacatctccggcttgacctacgaccggtttaaagcaaaggcttaaagaaaaacgtgaaaaataatcgactcgatttgaaatcagcaaaatttaacaattaatgaatttgctctcgtaattgctgttgacgatctgatcccggtatttcttcggggtcagacccgtcgcggatttaaagtagcgggtcatctgtgactggtcgtaatacccgcagagctgcgccaggtccaccattttgatcgatctgccgtgggtcagctgggacagcgtattttgaaagcggatcgcctggctgaactgcttcgggctgatgcccatcgtttggctgaaaactttatcgatgtagcgcgtgctgtactgcatgtgagccgccagctcgtccatgcggatgcagccctttgacttgacaatccattgaatgactgcgtctacgaaaagcttctgggccacgtccttttctgcatcgacgtgataatgcatcgcctgaagcagaatgtccgtgcgcatgcccatgaaatggctctggattaaatcttcttccagctttcgatcgatgatgcagtcgtcgaggggcacaacctgatcgcagaaatcccgaaatttcccgtcgataaagggcggcagcacgccgggatcgaagcggatgccaaagtaaaaatgccccggctccgtctctaacacgttgtggctgggcacgggccccatcacgcgggcacggacatcattctgataaaaatcaaactgaatgtcgatcgagccgtccggcaccccagtggttctgcaccgtgagggatcgggggaataggcgtaggtttgggtaatccccgcctgatgcacccgacggacaaaataggtatcggtgctcagtgcaaaaaatggctgaatggccatacaatcatcctctctagaacgcaaaataaaaaagaacgcaagggcagaattagcgcgcccttgcgttcttttgatattatagtggattttacgccactttgcaaatcctttaaaaattacgaacggctgtatttttcttcaatcgcggaaattttatccagccgtctctgatggcgtccgccttcaaattcggtggtcagccaaacccggagaatgtccttggccagctcgtcgccgaccacacgggctcccagagccagcacgttggcgttgttgtgcttgcgggtcatcatcgccatgtattcgttggtacagagcgccgcgcgcacccctggcaccttgttcgccgaaatgctgatgccgatgccagtaccgcagatgacaatcccgcggtccgcctgtccggagacgacggtttcgccgaccttccggccgtaatccggatagtccaccgaatctgtgctgtcgcagccacagtcgatgacttcgacctgatattgattcttcaattcttcgatgaacttctgtttgagctcgtatccgccgtgatccgatccaatcgcaattttcatgttactttctccaatcgtgaatttgttctttttctattttatcatattttcacaattccgaacgtattggttttcattttaacataagtcaacatcattcggtttgaaagtctggatcgtgagactggtccggttccttttcgatggcgtcgatcatcgccatgtcttccggcgcgatttcaaaatcaaacagctttgtgttttccgcgatgtgctggggatttaaggccttcggcagcggaatgacccgatgctgcagcgcccacctgaggatcagctgcgccggcgtgacgccgtagcggctcgcccgttcgacgatgagggggctgcccacaatcgttccctttcccagcgggcgccagccttcaatcatgatgtcgtggcccatgcagaaatcggtggtggcctgctggtcgagccccggatggaattggatttgatccaccatcgggatcacttcggtgtccatcagcgccttcagatgtgccggcttaaaattggaaacgccgatcgcccggacgcgtcccgatttgtacagctcgatcagcgccttccaggtgtcgacgttgaccgcttcccactggtcagagagcgcgggcaccatcggccagtgaatcaaatacaagtcaagcacgtcgagcttcaaatcggccatggtctggtcgaaggcccgcatcgtgttgtcgtagcctcgatcagtcttccaaaccttactcgtgatgaacaagtcatcccgatccagttcgtatttgtccagcgcgcggcggatgccttcgcccacgtgaacttcattatgataaaaagccgcgccgtcgatcaagcggtagcctgcgccgaccgccgcgtcgatcgcctcgaccgcgcgcgcgtcgtcagggatttggtaggtgccaaatcccaggcagggaatcgccgtgccgtttctcaacggtacgcggtccgatgcacttttaagctgcatgatgatcctccttttggattactggttggattgtctttattgtaccttaattatcttaaggctgtacagttttttgcggccgattgacgatgtaaatgcccagcgacacgcagaccagcgccagcagcgccggccagccgagggcctgatttttttcgccaaggagccacgccgaaagaaacaccccggccacaggcgtgacgaagaagtaaatctgcaccttggaaaccgggttgtgcgccagaagcagcgcccacagcccgtaagccaccgccgacacaaaggccagatagatcagcacggcgatcccttgaacattcagggcgccgaagcggccgccgaaaattaagcccgcggccgtcaaaatcaacccgccgaaaaagaactgccagccgctgagcaggtagggttcttcccggccgccgaactgccggagcagcgccgctgaaaccgacgaggcgatcgtcgagagaatcataaagccgtcgccgagcagcgaaaagggctcacctgtatgcaggcccgaaaggttgacgagcaggatgccgaaaaagccgagggcgcagccggcgagtttccgcgcggtgagccgctcctgcctgaaaatcaggcacgccacgagaatggcccaaaaggtgccggtgccgttgatgatcgaaccccgcaccccggacaaatgtccgagactgatgtaaaacagcgtgtactgcaggatcgtctgaaacagggcgagccaggccacacagggccaggcgctccgcttcggccaaaagggccctttaaaaatcgccctgccgatgagcaccgttaaaatgcccgcgagggtgaagcgcagaccggcgaacaaaatctggtcggcggtgccgccaatcgaaagaaagcggtagccgagcttgatcatcgaaaaggccgagccccagagcaggcagctgacgagggccaggccgaacacgaccggccccctggtcagcggatcctttgaattatttatttgtgccacattgtcctcttttctttattttctttacttctcttttccatactttcgcattcaaatcctttgcagatttctattttacacgcatggccgcgcgtccttgtgctaaaatggttgcggtcttattttaacatttttatttacagaaaggaaattgtgtaatggaaaacaacaaaactgaaaaaatgaacccgacccgtcagctcgtctacgcggccgtgttcattgctttgtcctttgtcggcgccaacatcaagatcatgggctccatcgcctttgattcgctgccggccttcatctccgtgctggtcctcggcgcgccttggggctttgccatcggctttctggcccacattttaacggccgcgacttcaggtttcccgctgacgctgccggtccacctgatcaacggtgtgatgatgggtgtcacgatggtcgccttctactggagcgtcaaactgctgctcgaccatcacgtcaacagcatcgtcgcctacgtcgtcggctgcgtcgtcgcggtgattttcaacgtgccgattgcgctgctcgcgacttctccattgatgacgttcaaggttgcgatggccctcgtgccggtgctgattcctgcagccttcgccaacgtcatcatcgcctgcgtcatttaccgcttcctgccgaagcgcatgcagcggctgacgcctccggggaaataagatgaccggccatgtcttccgctaccgggatttgtgcatgacgcccgttcccggcggcaccgtcgtgctcgccgcggacagctgcgcctccacaggcgaaaagccgaacgacacgctgaaatgcccgccctatcactgcggccgcgtttcggcacgggtcgtattattcgagctgctctgtgtcggcgccgacgtgctgatgctcgctgacggcgtctgcagcgaaatggacccgaccggccgcggcatcatcgagggctttcacgatgaaatgaagctcgcgggcctctcgccggaacagctcaccggctcgaccgaggaaaatttcaacacgtcgatgaccggggtgggcaccgccgccgtcggttatttcccgggaaattttgaaccgccggtctgcggcgcggacgaccttctcgtcagcgtcggcaagcctgccgtcggccccgccttcctccatcacgacgcgccaattgccacttacgacatgatcaaaaccctttccaaggaccccgacgtccacgagttggtgtcggtgggctcccacggcatcgcctgggaagccaagaacaccgcggcgctgcatcacctgaccgctgaactcgacgaaaacagcggactcgatttgaatcaatccggcgggccgtcgtcgtgtatcttggccgtcatgaccgattcggcgtttgtgcgccacaaggatcaaatgatcttgaccccggtcggccattttgtttaattttggccatcaaaaaagtcagccttctcggctgactttttttgatgcagcttaactgctgttatttttttaatcgctgtttctgatccgcgccttattccgcgaggaatgccttgatcccctcgacgtgcttttcgccgacgacgcggccctgggcgtaaacccggcgcagatcggcgggattgtggcagatgctgccgatcttcagcgggaaatcgggcatcacgacgtaggtgccgccttcagatgcgcgccggcgcacgtaggcccgctgtttgttgtagaaatcgtggcgttcgtccaaatccttcaccatttccgggtatttgcggccgaaacgcatgcgcaggtagggcatgtatttgttgtgctttttgatgtaatccgccggctgagtcaggatgacgacgttgcggttgtagcccatctcctcaaaggccttgaggggaatggaatccgagatcccgccgtcgaggtagagatggccatccagcgccaccggcgttgaaaacaccggcatcgatgcagacgcccgcatccattgcaggctgtcctgggcgtcgtcgcagcggtgataaaccggcagaccgctttcgatatcggtcaccaccgaataaaaggccgtcggattctcgttgtaggccgccttgtcaaaggggtccagctcgtcgggcaggacccggtagcagaaatcggcgccgtaaaggtcgccggtcttgaacagcgagcgaaagctgcaataccgcggatctttacacaatgcgaggttgtagcggatcgtccggcccggctggcgggatttgtagttgcagccaaaggtcgcaccggccgaaacgccaatgatcccgtcaaattcgatgccgttttccatcatcacatcggtgacgccggcggtaaacatgccgcgcatcgccccgccttccaaaaccaaaccggttttcttatccgccgttttcaatgtcatttcttcttgttttgatgattcattttctcccataagacattcctgattacgattcgataatgtgctgaatgacgtcgcgcttgccgagaatcaaaatcgtgtccttctgttcgagaatcgtccctggggtcaccgcggtgtccaagctgtttttgcgcttgatggccaggatgttgatgccgaagcgcttccgcgtatccagcgcgctgacggttttaccggcccagtccttcggcaccgaaatttcgtaaatggcatgatcgtgatccagttcgaaataatcgatgatgttgtctgagcttgaacggatcgcgatccactcagcgagctggcgttcggggaaggcgatggagtcggcgccgttgcgcagcaggaatttggcctgaatatccgagcaggctctggaaatgatgtagttggctcccagctctctgagcagatctgtggtttccagtgaggcttgaaagtcatcgcctatcgcgacgatgcacgtatcaaaattccgaatccccaatgacgcgaggaaatccggatcggtgctgtcgccgatcagcgcactggtgaccataggtaacaccttgttcacccgatcttcgtcttggtctaccgccatgacttcctgaccgacttcgttcagccgcatcgcgatatgacgtccgaagcgtcccaatccaattaataaaatcgattttactttcatgttcaatctcctatccccttaaccgactgtcaaatcttccttcggcagacgcgaatggtaaatcttgggtcccgacgacagcgcgaagaaaatcgtcaggccgccgacccgtccaaaatacatcagcagcacgagcaccgttctcgaaacaagcgacagatggggtgtaatgccgagggtcagcccaactgttccgatggccgacgcggtttcaaataaacacgtcagcatcggaatatgatccactgacgaaatgataaatccgccgaccaaaaagagggtgatgtacatcatcagaatcgcgcccgcgcggcgcaccgtatcctcgggaatgttgcgcccgaaaaagtggacgttgccggactgcgcgaaaaccgagagggcttccgccagcatgaccgcaaaagtcgtcgtcttcatcccgcctgccgtcgagccgggcgagccgccgatgagctgcagaatcgtcaaaactgaaacgccggtatcgttgaaacgggtgagatcgacggaattgaagcccgccgttctcggcgtcaccgcctggaaaaacgccgccatccatttcgcgccctcggccttcggcagcgcctggggctgaaagaagaagaagtacagcgtcggaatcacaatcaagaaagcggttgtcgacagggccaccttgctctgcagacggtactgcttcaaatgccatttgtgcttgaccacatcgttccagacgataaagccgatgccgccgacgataatcaacagcgcgatggtgatggaaatggccggattacttacaaattccgtgatcgagctgtatttctgatgcacgcccatcaaatcgaatcccgcgttgcagaaagcggaaatcgaatggaacaccgcgtaccaaatgcccttgccgaccccgaattcccggataaacgtcggcgccatcaccgccgcgccgatcccttcgatgatggccgttcccttcaggataaagccggtcagccggatgattccaccgacctgaggcgctgaaatcgaatcctgcataaaggagcgctgcatcaggccgatgcgccgcccggacacgataaagatcgacatggccatcgtgaccacaccgagcccgccgatttgaatcagtgcgatgatgaccgcctggccaaaggcggtccaataggtgccggtgtcctggacgatcagccccgtcacacacaccgccgaggtggaggtaaacaaggtgtcggcgaagctggcgtgcccgggaccgcgggaggcgatcggcagcatcaaaagcaaagcgcccgccaagatcacggcggcaaatccaatggtgatcagccgcgccgaagacaggcgcctgcgcattttcccgggatccgagaaatcgttaattgaaagaagttccattttttttatttatccaaaatagacttaagattgttctgaatgtccgccgccacgtccggtttgttcatcgaatagacgtggacgtggttgatgccgttggcaaataaatcgacaatctgttctgtcgcgtaggcaatgccggcttcgtaaatcgaggccggatcgtctctgaaatgatcgacgatgttcaggaaggactggggcataaaggcaccggaaagatcgacgatgcggctgatctgcgcggcgttggtcaccggcatgatcccggcgataatcggcacattgatccccgcttcccgaatcttgtacatgaaattgtagaataaatcgttgtcgaagaacatctgagtcgttaagaattcgcagccgcagtccaccttttcttttagatgctggatgtcgtccttctgacgggcggattctggatggccttccgggtagcacgcgccgccgatgcagaactcgccgtcgaagcggtgaatttcgtcgatgagctccgaggcgtggcggtattcgccgggaacgtaatccttcggcagatccccgcgcagcgccagaatattttcgattcccgccgcctttaacgctgtaagctgggtttggatcgtcgtcttgtcgctggacacacaggtcagatgggccagcggcgtcacgttcatcgctttaatacttttcgcgatgtcgacggtgtattggctcctcccgccgccggcgccgtaggtgacactcatgtaggcgggatcgagctttgcgatctcttcgaccgctgacataatcggttcaaaccgcgcttccgtcttcggcggaaacacttcgaaagataacatcggtcgatcgactttgaattgttcactgagtttcatttttcttctctccttactggttctgccagcggtcgacaaaatccgcaatggccttgccatccttcaggcccttttgataaagcttttctcccgcttccggatccgtccccagggttttcatcccggcgatggaatccggcgcgacgatcagcacctttccctgtttttccagctcaagcgcctctctcagctgccggttgtaagtcagcgcgcgccgcgcaaagactttggctgcctccggataatggcgcttcagaattttcgaaagccatttgtcggaggacgtcttccggaagaaatttttaggccgggtcagaatcaagaccaccgcgtccgcgccgtcgtcaaaggccttttgaatcggaatgggattggaaatggcgccgtcaaaatacaggtgactgccaaccggcgccggccgtgtgaacactggcaccgaacagctggcaatgatcacctgatattgatcttgagcgaaatcttcttttgtaaaataatgcgggaaaccggtttccgcttcggtcgcgatgaccgtgcagagcgccggattcgccatcatcgcgggataatccagcgggtattccccgtccgagttggacagggtttcgtacacgtagtgcaggtcgatgaaagcgtgctgcttcatcagcacctttaaacttttgtattcttttcttaagcagtattgactgtagtacacgtaatttcggccgcgctgccccgctaaataagaggtgacgttggccgaaccggccgagataccgtaggtcatgtcgaagcggaccttgtcatcgaggcaggtgtcgaagactccggcgccgtaaatgccccgctggccgccaccgacatcgatgacggctaccttgcccgcctgtttgttttgtgctgtttcgttcatcgtattctccttattcttgcaaaatatggattgctcaaaggcatacctcatcatagcacaaaacgtttaatgcgtttcactttcttaattaatctttatttgtaatcgatgcgagaaattccttggtccgctgatatttcgggtgattgaaaatatcgtccggcgtgccttcttccaaaatgatcccgtcgttcatgaacaggattttattcgccgccgagcgggcaaatcccatttcgtgggtgacgacgatcatcgtcatcttggccttggccagatcgctcatgaccttcagcacttcgccggtcagctccggatccagggcggacgtcggctcgtcaaacagcatgatatccgggttcatcatcagcgcccgggcaatggcgacgcgctgtttctcaccgccggagagggtcgacggcatcgcgtcgatgcggtcgctcaggccgacctcgtccaaaagcttcttcgtgttggcttcgatcgtccccttgtcggccttggcgacaatgcgcggcgcgagctgcaggttctttctgaccgacagatggggaaacagattgaaatgctggaacaccacgcccattctagaaatgatgcccttgatttccgctggcggcgcctggacgccgtccttgaccaaggccttgtcttcgatcatgatcgtgccgccgtcagcctgttccaaatcgatcaggcagcgcagcagcgtcgatttcccggagccggaagagccgatgatggccaccacatctccctgctcgacttcaaagttaatattttttaacacgtgattgtcgccgaagcgcttgtccagcgacgtcacgcggatcatcgttttgctcatggattcccctttctcttagaaatctgtcttcttttccagctgcttaaagatgatcgtgatgaagaagttgatcaccaggtaaatcgcgccggcgacgataaaggcggtcgggtcggcgtcgcggacgacggcgcccttcgcgtagtacatgatttccggcacggcaatcgcggtgaccagcgcggtgtctttaatgaggacgatggtttcgttggaaaccgccggcagggtcacgcggatcatctggggcagcacgacgtgccacatcgtctgggcgtgggtcagccccagcaccttcgacgcttcgtactggccgtcgtcgatcgcgagcaggccgccgcggaagatttccgcgaaataggccgcgtagttcagcgcaaaggcgatgcaggacgctgaaaaccgctggaaggttaaaaattttccgatacccgggatgtagggcagcccgaaatacacaaagaacagctgcagcagcagcggcgtccctctcaggatgtagacgtaaacctccgcaatccacttcaccactttcagcttgctccgcagcatcagcgtgattaaaaatccaagggggatcgacaccaccagcgaaatggcgaacaattcaagtgtcgtgccgagcccagccatgattgaggtgagcaggctgatcacattttcactcattcaagtctcctttattttcttatcgttattttgtatctatcctatagatgtctgaaaaaaacaataacagacctcccggattgcgggaggcctgtctgcacttacgcgagatcttcaattatttgttgtaaatgatatcttcgccgaaccattttgtcgaaatcttaccagctgtaccgtcagccttcatgtcatccaatgccttctggatcttgttgagcatcttagtgttgcccttcttgacggcgacaccgtactgttcaggctggaggctttctccgacgatcttgaagtcggaattgtgtttcttgatgtagtatttcgcaacgacagagtcgacaaccatcgcatcgatgcggccggcgtcgagatcctggaagcaggagacgttttcgtcaaattcggtaggtgaaccgcctgcaattttgtcgtaaatcggattggcctttaatgcatcttcagcggacgagcctttctggcagccgactgtcttgccagctaagtcgctgaccgaattgatcgacgaatcctttttgacgacaatgacctgatcgttttccagatacggcgtggtgaagtccatctttttcttccgttcgtcggtgatcgacagaccgttccaaatcgcatcgatgttgtttttgttcaattccatttccttggtatcccagttgatggcctgaaccttaaatttcatgttcatgcgttttgccgcttcgcgggccagatcgatgtcgaagccgacgattttgttcttcttgtttctaaagcccatcggcgggaaggtgtcgtctaccccgatgacgaaggtcttgctgtcatttttcgtatctgacgacgacgatgaactcttcgacgagctgctcccgcaccccgcaacgaccaccatggccaagcatgctgtcagcagcactgccagaagtttctttttcatgtttccgctcctttacgaacggtgttcatttcgtaaacaccgcatattctttaagatactttttattatacacttcatcactgtaaaatgctaacattattttaaatttctattaagtcggagcgttgcgttcatctatccgccgcggaggatgcctgtgccgctgtccacttctctgcctcagccgcggttttcgcgagatagcggatgacctcagccgggtaatgcccgaccgctgtttcattcgtcaccatgacggcggcggcgccgtccgccaccgcattaaagatgtcggaaacctccgcgcgagtcggcacaggggcgtccgccatcgaggcgagcatctgcgtgacgaccatgaacggcacctgtgcaaggcggcatgcctgcgcgatgtccttctgcaccgcgggcagcgcccacaatggcagatcattgccgagatcgccgcgggcgatgacgatcatgtctgcctccggcaaaagcgccggcagcgcccgcacaccctgcttattctcgatcttggcgaaaatccgcacgtcggccagatccgcgtcggccagcgccgcgcgaagttcacgcagcgtctccggtgaggtgacaaagggctccatcacagccgtgacgccgtacgtccgggcgtcggcgagattggccctgtcgtgcgccgtcagggctgggccggccacatccttgccttcgatcttcagagattttcggctcttaataacaccgccgcgcaggatgtgaagggccgcgcttcgatctcccacgctgacgacagacgcttcgattttgccgtcgtcgatcagcacccgatcgcccggctcgagggcgtccaaaatgcgcgctgccaagggcagctccaggttttggcctggatcggccgcaaccggcgccatctcactgaggcggagctccggcccctgcagatcgatcagcagctccggcgagacgccgcacgcgtcggccgcctttcgatagttttcaatgaggtcccggctgtccgcgagcgacgtgtgggacaggttgagccgcatccccgtcatgcccgcccgaaacatcgccgtcagcgtcgtttccgactggcaggccgggcccaatgtgccgtaaatttcagtcaaggttatccctcctcaagcgctttgtgcgttgaacagatgacgctcactgcgcatcccacatctgccgaatcaccttttcaatggtttctctgtcggccttaaaactgccttggatcatgttgtccttgccgccgccccggccgttcagcttcgcattcagctccttggcgcagccacgcagcgcaacgctgcctgacagcagcatgtagctgtaggatccattgtcttctaagttgaacataccaaccgtgccgcagtgcttttcatcgagcagctgcgtcgcgaaatggcgcatggtgttgcggtccatccctttttcaaacagcaggaccagcttttcgccgtcggcaatgcgttccgcctgattttccagcgaaactgccatccagtggtgcacctgcatctccatctcatcggcatggttcaacaattttttaacggcggccgcggtcgacgtcatcggcgcgctgagcagatgcgagacagcttcattttcgcggtaaatcccttccgtataggccagggcacgggcgccggcgagcatgtcgatgcgcacgcccccgcgatgggccgacagcgacaacagcttgatcatcccgatttcgccggtacgcttaacctgtgtcccacagcacgcgcactgatccacgccgtcgatggtcaccaatctgacccgcccattcagttcttttttcgagcggtaaggcagatcctgaagttccgccgcgtccgggaaccagcacctcacgtccacattgcggtaaatggccgcgttggcttcgcgttcgatctgcatcacgtccggccaggtcatttctccgtcgaaatcaatctgaatgacgtctcccatgtgaaagccgacgttttcgtagccaaatttcttgtgaatcagccccgaaacgatgtgttccccggtgtgggactgcatattttcaaaccgccactgccagtccagctcaccgtgaaccgccgtcccaggcgcgatcgctttttcacaaaggtgcaccacctggccgtcaattctctgggtgtccgtcacgggaatatcattcagtcggccccgatcgcccggctgcccgccgccttccgggtaaaacgccgtgtcgtcgagaacgacgtgccagccgccctttcccttttcacacgtaatgacttccgcatcaaaggtctttctgtacggttcgcggtaaaacaattcttcaaattcttccatgtcaaaccctccgttcgtctttttatgagattagtataacctaaaccgatgagggtgatgtgatgaatttggtggaagctttgaattctgattacacgcccctcacggggcgcgacatagttgcagcacgtccagggcggccagcgcgtcatttctactcacacgcccctcgcggggcgcgacctaaataattaattttttccgctgcgtggtttaagatttctactcacacgcccctcgcggggcgcgacacatttgcgccggatcgatctgttgcaaatgcaatttctactcacacgcccctcgcggggcgcgactgattagcaacgaggatttactttttgatcgaaatttctactcacacgcccctcgcggggcgcgaccggtcttacgcctgttctggcgtagacataatcatttctactcacacgcccctcgcggggcgcgacggcaaacttgcggcaaattttaattacaaaaacatttctactcacacgcccctcgcggggcgcgaccttcaagggcattgacgacgacgcgaacgcagtaatttctactcacacgcccctcgcggggcgcgaccttgccttttgtgattactagccgcccgtccttaatttctactcacacgcccctcgcggggcgcgacaaaattgggcgcaactgggtgatcgacaggaacatttctactcacacgcccctcgcggggcgcgacccgtacgtgcgcggcgtcaaggaaaacatgaccgcaatttctactcacacgcccctcgcggggcgcgaccaaaccatcacgatcgtggggacgaaatcgggcatttctactcacacgcccctcgcggggcgcgacctccaccaccgcgggcacgcgcactgacatcaaatttctactcacacgcccctcgcggggcgcgacaggaaagcaggtgatttcgtggacattccggaaatttctactcacacgcccctcgcggggcgcgaccaacagcgccacgataataaaatcaaattaaacaatttctactcacacgcccctcgcggggcgcgactatttcgcatggacgtcaaagctgacaatgaaaatttctactcacacgcccctcgcggggcgcgactcggcagggatactcgcggcaggcggttgacggtgatttctactcacacgcccctcgcggggcgcgacctgtgcgttgatcgaaatcgcattcaaaaattcaatttctactcacacgcccctcgcggggcgcgacgcgacgcaggaagacagcgtcactcgaaaagtaatttctactcacacgcccctcgcggggcgcgacatccagttgcggccgatcttgcgggcggttttgatttctactcacacgcccctcgcggggcgcgacgcgcgtcgttctgaaaatctctaatttctgcgcgaatttctactcacacgcccctcgcggggcgcgacccatcttgccaccgaattcgccaagggctttcgtatttctactcacacgcccctcgcggggcgcgacattgttatccccctgttgaatttaaaatttttatttctactcacacgcccctcgcggggcgcgacgggctcaaactgccaaaaattgtgcaggggtcaaatttctactcacacgcccctcgcggggcgcgactctgctccagtgcgtgacggccggacccgtagatttctactcacacgcccctcgcggggcgcgactttagtcacgctcctttctttattttcctgttgatttctactcacacgcccctcgcggggcgcgacaatggcaaattgttcagcatgtccgcccgggtttcatttctactcacacgcccctcgcggggcgcgactacatcaactggcattcaattcaatgacggtaaaatttctactcacacgcccctcgcggggcgcgaccgcaaaatcttgttgtttatcatgcaaccacgtccatatcttgacaagaggcggaaataatttgattctttcttcaaattatcgccgaaaaacggcatttttttaatctaacctcccggtatttttcaatcacttgaggttagcatcatataataattggtccttcgggatcatacccttttttagcgccaatgtgttcaacgcgtcgtttccaatgatttcccagataataaaatcgtaaactatctgttttctcatcgataatccggactaattcagccttcaattttaaaaaggcactgtaatcgagatccgcttcaaatactgaattttgaacgcgctgcgcatgtgcttcacatgcttttgcgacttgtctcagacgttttgtccctccagttgaagccgttgagacgtcgtaactgataatcaccatcatggcatgacctctattttaacaaatacggaatatattcttccgtttctcctcgaacgaattttgccagcaggttgctttgaacgtagggcaaaagaccgtaaggcaccttttctttgataattggatgcgtgattgtattgcgttttttctcctgccattttgtcaaaaatttctgcttccctttttgattcagccagactgccccagaaaattgtcggtcaaaatctttttctccaatcattttcaaattgagtaaagtcaaaacaaaccgctcgcataagcatcgaaattcttcaaccatatcgcacgccaacgagtctcgtccacttcgaagcgtgtgataaaatccgatgtaactatcaagcccgacggtttccagtgctgccgcacaatccgccgtcgccaatgtgtacgcaaaggaaagcagcgcattaaccggatcaagcggcggtctcttggttcgaaacaaaaaagtatccgctaaatcgttattcgtaatcaaactgctaaatgcgctaaaataagagctggcacaattgccttcaattcccagcagactttccagtgattctgcattttgcgccttttgcatgcctgtgttcagattttcaagcgtctggcagatggtgtcgtcgtttctcaattccggcttgtttttgagcgtttgccgaatggtttgaatattattgctgagcttcgccgtcacttgattttttgaaagtaataacccttgatctctaaaacagtcgatctgcgcgacccgcagaaatacgtttccctttgtctcgccacagacctttgcccaaaattttccagacggtgaaataaaattaatgggcacttgtttctcgacgcatttacccatcaatgcaggtgaacagcccaaataactgaaacaaaccacattttcgatattatcaaagggaatcttaacttttacctcaccgtcgactttgcataccaaattattgtcttttaacgtcagatacgcattttcattggtgacataaatggtgtttaataattttctcatggcgtattgattttttcgagcacagctttaaaatgctcgcgtctttttgttttcggcagacagacatcattaaaagagcacccccggcacttctgtttcggtggaataggtgggattttcccctctagcgtccaacggcgaatatcttttaaaatggcttctaaacgttcctgataaattgcgctgttttcttccaaaggcagcggctgacgacgcttttgatccgcataataaagcacgccttcgctactacagtggaaaatattatcgacgcaaagcttctgagcgtaaacctgaagcgcatcgtcctcgttaaacgccttattcttcggcgccctgggtttgtattcgacaatcgtcaattggcagggccccttaaacccttccacagtaatgccatttgaagattgcgtcagctcgatgcagtccgtcacaccgtagaggccgagctcgtcgtgatagaccggcacggacgtcattacccgtttctgcctggaaagataagcacgtccaggatcgtgaacccgcttgtgcagcagattgcctttggtcacataaacattctcagcccaagagcagtcgatattgatcagcccccaacgatgcggacagtacatataatgctggaggtttcggatactgatgctcagatcgtccattgctttgtattacttttcaatcaacgttacgccgttgggcatattttcatcaactgtgaccttataatcttcaaattgacgcggtgcgaccacatcatcttttaatttaactttcaccttgtctgccaattcagcaaaacgcgcattgccgagtacaccgtcgtgcttgaaaatatacagacctctgacattcatttcgcctcgtgccgcgcttcggtcttcttcgaacatgttgagcagcgctgtccatagcagatcgacatcttcttcagaaagatcagtgactttattggccagtgcggcggaaatatggccgttcattcgatataaaccgtatgggacgatgctcttattgcccatttcagtatctcccttcgcttgcctttcttcatccgtttttgcttgtctggttatcgaaacttcattgacaaaaataggcgatacactttctgagaagctgaactgaactggtcctctaacaatgccgcaggaattttttccagttgacatcaccgcgccaaacatccgcacatcgtaataatttcggcacatatatttcattgccttctgttctaccggcggattggttcccttttttgttttatcaatcggcaggtgttctgcgacatacgccgccttgaacttatcattaagcggctggtcatttttaatcagaatgttaaatccgggttcaccatctttgactagatcgacatagttacgcacttttcgtttcatacaaacgtcggtcacaaacccgatgcctgtttccggatcggtccgtggagcattccctgcgtcgggatcgccgttcggattgccattaatcacatcatagagcaggataaaatcgtatttgttctgaatcatttggtttcttctcctttagtttcttgatttgcctttttatacttttcagctcgctgctgataatagcctaaagtaaaacgtccctgatcatctaaatttaagacttttggaaattcatctcccattttttctataatttcattcaatctcttttgatcattaacggcccatcccggttgattgcgttttagtttggccatatgatgctgggacaatttcatcaatttgggaaagatagatgccggacgaacacaagctgagctgaaatatgcatcttcaatggttcgattgagtgtgtgcggttttgcggcatcctcttgaatttcctcaagtacggcaaaaagccgtccacaaagatacgcagggtttgtattgcttttatctagagacatcgcgatttcctcctttgttttacggatcagataagctttaatcaatccgacccgaacatcgttcattctgatatatgagctatcttctgtattgtgatcagtccgaatccttcgaagcatcgtgctaaaacaccacgttgggtagaccgttcccaaaataatacttttaaatatcgacgcaaacggcacatcattcacttcaggatgacttgtttttggggacgttaattcttttttcaactgccaaagttgaactggtctcgtgctgttgttaatctttaaatccctttgatgctttgcgatgttggtcaatagctttccaaacttttggcgataaataaatttaacctgaacccttgaagaatttggagctaagccaacaatataataatcagtattcggattaatcgcaccatacatagcctccaaacgctctgtcgtgatcatgccttgattaatgtcagctatgagcttatccaaagcagtatctaattggtcggcgttattatattgaggatcacggctaaataatttcatcacgagctgatcattattttgattgccatcttgtgaccaatagactaacgtcattccatttaagtaactgtggtttttttgactagccaaaagccaattcaacgcctgcgtataatgcttcatcactttatctgaaatgcaagcattttgaccttgattatgtgaatacgattcaaaagaatcacaattaaaattgaccaaacttggattaattccagcgtctcgaacgcctattccttttcccgatttaagtacatcatgaagtctggctattggtaacatttcgccgctgattgcgcattgttcgatatcttcttgtgttttcacagcatgatcttcttctacctgtctccaatgttccttgacctttttgtcattttgaagcaagatcctcgaatcacttgccaaacagaacgcgaattttgcggtgtttaaatctttttttatttttaataactctgaattttctgtttcatgttctggctgccaattctgtgaaaaaagataataggcttttgcaattggtgattgaatgaatttaaaatctttgttgacttcgcctaaaaaatcctgatgttgttttgataatttcgctcttttttcttccgttgctccttttgtttcaagtgaaagcgcttcgccttctgttctaaattctaatccaaaaatataaccgcctcgatgttccacatagttggtttttatgccacgaaaagtatttctttctggaaacatgaagggtttaggatttagcaaaacctttatttttccctttttatttttttcctctatttttgttcgaatatcagtaatgtgatctaattttccatcttctgtcaatgcaattaaataactaatatcaagcttttcatatcccgctggaggaagttcatttttttcaatgagtacatcgtaatattgatttaatgcgctgatcagcatattgcacttcctttgtatttttcaacgtcgatgactccgtcaatcatcatcggacgataaaacacactatcggcttcatcggaatacagatttttttcccaatcgtctttgatgggatggccatgatctttaaagcaaactttatatagcatgaatcctaaatctttttcccctctgttttcagacgaaacctgagataaatcaaaatcgtcaatcaactgtacgttcgcaggaaactccgcgcatcccaaacagggttctctaaaacattgcccttttttacatcttctgatgaagatttcattgtgtttaatcagcggattgccttcttctttttcgcgctcatttctcaatcccgttaattcaatatgaaattcgaccccataccgtacattttttaacacgagcgatgagcgctgcgtgcggtccgcgctggtataaattctcggatcggttttgattaatttttccggattcgtctgcgccgatttcgtttcattcatctgctgcttcattttctgaaagctgacctttgactttacttcattgcggcgtatgctgataaattcaatcggattaaaaactactattttgtcaatcacatatctcatggaaggcttccagtaaatggcttttaatagtccttccagagccccaggtgtcggcacgtcgtagctgaccctctccgctttcatttccggacgtgtaaaacacgccaagcctccagtaatcatgacttttattgatttcatataaaaatatcctctccttccgtcacaatgccaacatctctatggtagtagcttaaattagttaaaaccgtcacgccaaattgattagtttcaacgacaccctgctgtttgagctcctcaaattcccgacgattcacattacaagcagcacgctgcaaatgtctgtaatctttttttgaaagcgaagtgtactttgacttttcgattactttttgaatcttttctgtatttggaacgaccaccgattcatctaagctatcaataatgctgccgtcgtacgacgcaaatggaatactggtcggatcaccgccacatttcgggtggcgatacatcgcatttttcgtcatggcgtcttcattaaaataatagacggtatcgtaatactgcgtgatgcaccttgaatccaaaatattcgattcatttctaagcaaatctttagctgtactggtgcggatatcgtctgcgcgtctggtttgtccctctaatgaaaaagtaaaaacttgtcctttattcggatcactgccttcgcgattacaccgtccgccggtttggaggatgctgtcaagaccggtgtattctcggaacgcaatgtggaaatcgagatctacacccgcttcgatgagtgatgtcgaaattacaattaatggcgcttgtttcttttcgggatgctttcggatagcttcaagttggctttttatcgtctgaatcgtatcctctatatctatttttgtcatatgtgtcgataaatggtacaagtttttttgatcttttccgccgaaatcctcgtacaacgcctttgccgttttccggctgttgacgacaatcagtgccgatggcgcttgactagccttcccatagatcaattccggtgaaaccatccctaaatcgcaatattcgcatttatcaaaataatgaaaatcgctttggtcggtgatgaggtcttgaatcaccaaatctttgagtccgtaccgatgcagcagatctttatagtttggcatggttgcagtcaagaaaatagcctggcttccaaagtaccgtgttagataagcgacgctctccaaacacggctgaaagaagtcgagcggcatcaaatgcgcttcatcaaaaatgatcacgctgtctgccatattgtgcatttttctcagtctgctgcgcttattggaaaacgtcgtttcaaaaaactgaacagcagtggtaataataaagtcagcgtcccaattttctgtcgcttgactaaaccgcactttataaacgtcggtcgcgtcctctttatcttcgatgtcatacgtggactggtgtcttaaaatctctgcgtcctccccgaagatcgtttcaaattcttgagcggtctgatcgatgatagaattgtagggaataacatagataatgcgcttctttttttcagtaatggctttcgtcagtgcacattttgcgctgcacaacgtcttgccgctgcctgtcggcatgttcatcagataaacttctgcgtccttcataatgctctcgtaagcctgggcttgaatccgagaacgcgctttttggagctccgttgtacaaatgaagtggctaaaacgctgattaagccgagaaaggcaattttcaaaacggctggtcaacggttcccgcttaatctgatcacaaaactgttcggtatccaatgaatctgcatccaccagacaagaataacagtagcgaaccaaaaaagtaaatttatcaatgacttcttcttttgtgctattgaggaaattaaaataatgcattaatgcataattatcagatggcaagcaatgcacttcatgtttgtactgcgaccagtcatcaaaatcggtttttttcagcctcgcgctcaatgttgcagtttcactcggctgatccgctaagtcgccgccatctggaatccccgcatgatgtccggcgatgatgtattcaagaataagcgcttcgaatgcgtcaaagtcatgctctgctgtaatggcgccacaggtcgaatgatcgacacggatatttttcccttgaatgcgctcttgaaaggatttctgatatttccccacatcatgcaaaaggccgctatttttcagcaggtttttaagcggcgggatggcaaattgttctgccagatcagctgtcccttccaaatgctcgaccacagtttgagcggttccatcttcgcgtttgtgtgcgatcatttccatctgattattcaaaatctttctctcccttatcaatcgtaatccatttcaattataaagcatatacatgatttatacaatatcattttctctcatcatccaatcccatcattgaaattcctattttaatcgtataagataaaagaagttatttaaaaaggacaacccaaaatgaaaaaaccactcaactcagaagaaaaggcgctcctcttcgccgaaacgaaagaacggttcgccaaagaccgcttcgccacgaaaaaaacagaatgtaaactattagacgtcgcgccgggatacgccaaatgcggcatgccgatcaccgaagaccaccgcaacggcctcggcatggtcatgggcggtgcgattttcacattggcggatttcaccttcgccatcgcctccaacaccagccaaccggatacggtttccctcgacgcccatatcacttacctgaacccctctaaagggcacaccctctacgcggaatccgaatgcgtaaaggctgggcggcgcacctgctccttcctgatccacgtcaccgacgatctcggcaccaaaatcgcagacgtcacgatcaacggcgtccgcgtctgaaaatcattttgaacataaaaaaagggcggtgcctgcgcatcgcctttttgtgttgtgattaattttaaaggagtgaacggcccgctgggggagtgtgtggattggcaggccgccctagaatattgaatggatgttaaaaaagatttgtgtctggaatgttgttcgttaattgaaaggatattatggcttactgttcaaggatcggttcataaccttaatcgatttgaatgagcttggacgcttcgatttcttctttgcctttcttcggaatcgtcaacgtcagaataccgtctgtcatcttcgcgttgatgtcgtttttcttgatgtcatcgccgacgtagaagcttctgctgcagctgccactgtaacgttcacgtctgacataagcacctttttcgtccttctggtcactgctgtccgcttttgtcgcggtgacggtcaatgtgccgttttcaaatctgaccgacacatcttctttcttgaagcccggcagttcgatgtcgacagtataggcatcgtccgattccttcacgtcagttttcatcacgttagcccgtgatgtgtttccattgccgaaaaacttgcggtcaaatgctgtatcgaataaactatcaaataaattttctccaaaagtgcttggtaacataatttccaacctcctgttaattgtctaatttcatttatttggaaacacccgccgtttttccggctgatggatttttcttaatgcccatccggccaaaggagaccggatggctgaatactttgccgaattcaggttatccgcttacgcgttaaccttcaatcatgatctgctgttcctgatcgatcgctttctggtctttcttcggaatgctgatggttaataccccatcgtccattttagctttgatgtcatccttgtcgacggcgtcgcctacatagaagcttctgctgcagctgcctgcgtagcgttcacgtctgacgtattcgcctttgtcgttcttctggtcgtcgacctttttcgtttccgctgaaatgatcaggttgccgttttccaatttcacggtcacttcatctttgctgaagcccggcagatccactgccaattgatacccatcatcagattccttgacgtcggttttcatcatgtcgtgtcttgcggcatttctaaagaagccttggtcaaatgcactgttcataaattcatcaaataagttttctccaaatacgcttggtaacatgattcataacctcctaatttgaatttgatgctcaatccttcgggttgtctctctcgggggattcagcttcatgtctttgtcttggtgtctctctttcctttcgacaactgtattatagtccgatttgttagcactgtcaagtgttgagtgctaacaattatgtgttctttattttcttttaagttttctaatttatttggcttccccgaactattcacgctgcacccttctttatttttcttctttaatataagagaatttaataaccgttaatagggctgtttgattttccattattttataaaagcagggctgtccgatttatggtataatttttttatatttatacgagagaggaacgtttgtatgaatcataaactgacagaagtcattcaagcggccgttgacatcgacgcgggcgatccaaaacgcattcagcatttcttaaaggtccagtcctttgcggattacattgccagccgagaaaatgtcccagccgagcccgcctttctgctggaagtggccgccattctgcacgatatcggcatccacacctgcgaagaaaaataccattccaccgccggtcattaccaagaattggaagggccgccgatcgcgcgccgcattttagatgaaatcggcggcttcaccgaagcgcagatcgaacgggtgctgttcttaatcggccaccatcacacctacgaccccgaacagatcgacggcatcgattatcaaattctgatcgaatcggattttctcgtcaacctctacgaggatggcgcctccgaaacggcgatcgccaatgcccgtgaaaaagttttcaaaaccaacaccggcatttcactgattgaacggatgtttctaaccaaaacccattaattttcttgcaagcggccaatttgttcattataatattaaccatgcaatacttgaaaggagaatccctatgaaaaaatacgaatgtaccatctgcggttatgtttacgatcctgaaaagggcgatccggataatggcattgccccgggaactgcgtttgaagatctgccagacgattggacatgcccagactgcggcgtcggcaaagatgatttcgaagtcgtcgaataatttcctgtaattttctgaaacgaggaaagcatggccattaaagcccaggaaagagttcacaacaagcagatgtccggcaagacctcgctcgtgatctgcgtgattctcgtcgcctacatcaccttttactacgtgatgagcagaacccatcctgcaactgcccagcggttcagtttggtcacgacgatcgccttggctattgccctggtacttctgcttcgattcgacagcacgatgtacgatctgctgctgacccacgaacgtctggaaatcgaacgccgcgtgacggttttgtaccacaagatcgtcgcggaaattccgatttctcacatcatcggactttggcacaccagccagttcaacgaagacgacctcgtcaccggcaaaactttcaaatacactgtctctccaaaagagcttgacgatttgaagttctacacgctgctgtacaaccgcgacggcgaaacctgccgcgttgattttcaatgcagtaacagcttttaccgttcactgcgccgtttaatttcaaaataattcagatcccatccgtcttttctgcggatgggtttttctttatcggaggacgaaatgaaaatactgcacaccggagactggcatatcggacgggttctggaccagcatccgctgatcgacgaccagcgctacgcactccaggggtttttaaccatcgtccacgaagtgaagccggacgtcattctcatcgccggcgatctgtacgaccgggccattccaccgcgcgaagccctcgagctcgtcgacgagaccctcacccacctgattctcgacgaccacatccctgtcatcgtcatcggcggcaaccacgacggacgcagccgtctggactacggctcggccatcctcgcccgcaagggcctctacttccgcggtgcctacgacccggaggccggccccatcgaaatcaccgggcagggcgattcggtgcccacagccttttgggccgtgcccttcattaagccggtcgaataccacaccgctgccgaaaccgaaagcatccccgactacaacgggatgtacgccgacatcgtcgcccatatccggccgaaaatgaacctggaccagcccaacgtgctcatttcccacgggctgattctctccgcgccgcccactgccgacaccctcgacgattcggtgcgccccatcgaaatcggcggaatcgcctacgcctcctcccatttgttttccgattttgattacgtcgccctcggccaccttcaccgcccgcagaaggtcggcagcaaccgaatccgctacgccggatcgctccttaaatattcgttttccgaggtcaatcagaaaaaatctgctgccgtcgtcaccctcgacccgaaccggcaggcccttcccgagatcgagctcgttccgattccagcgaagcgggatctgcgcatcatctccggccccttcgacgatttaaccggactggccgcgtacacccaggaaaaccgcgacgactacatcaaggccgtcctcaccgacaaaatccgcgtcaccaacccgatggacgggctgcgtgaggtttatcccaacgtgctggaaatgacctacgcccacagccagaccgtcgacggcacggacaaacagcgcaggattaaagaacatctcaacgatccgatgacgctgttctcagatttctacgagacgattcgcggcgaagtcctgcctgaagaagaggccgcgctcgccaagtcccttttcgaagccgctcacgcggagagcggcgaaacgcagcacgcggcggaggccgccgaggaaggagcatcccatgcgtcccattagtctacaccttcagtgctttggcccgtttttggaccagcgcattgatttttcagcgctgaaaaaccacctcttcctaattgccgggcagacgggcagcggcaagtcgaccctttttgacgggatctgctacgccctttacggcgaaaccagcacaccgggcgaccgcccgatcgacaccatcaaaagcgattttgctgaccccggcagcctctgctgtgtctccttcgtctttcgtgtggggccgaaaacttacaaaattgaccggcagccccgtcagcaggcttttaaccgccagaacaccagactggtagccaaggccgctgaggcagccctctgggaatgcgacacctccggcaatcccgtcaccctgctggagtcctctgtcaaagcctgcaatgaagccattcaccgcatcctcggcctgagcgcggagcagttcagacagatcgtcatgcttccccaggggcagttcagccagctgttgaaggcgaaggacgccgatcgggtcgccctgctgaaaaccctgttttccatggctgggtacaagcgctttgagcatcaggtcgagctgacgcgtcagcgcagcatcgagacctctgaacgcctcgaggcggcgctgcgtatcgaaatcgaacaccttcaggtcaagcccaaatcgaatccggccaaaatgattgccgaggatgcgccggtgccgcacctgctccgcgccctcgaacaggacattgacaaggacgcgcgcttccgcgaggaactcgaaaaggaacaggcttatttcgacaaccgcatcgacgcaatcaaccggcagattgaaaaggacgagggcttaattgagcgcttcaatcagaaaaaatacctgctccagcagcagcaggccctcgacgatcagcaggacgccatcgaaaaaaaccgccactgggttgccctgagccgcaaagtgctccagattctcccggtttaccgaaatctgaagcgccagcagcagcgcgaggccaaatctcaggaagctctggccgaaatcaaggccaagcaggctgaagccaaacagcagatcgaagcgctgcgcccacagctcgaaaccgtcagctctgacgcctacgctcaggatctcaaggccaagcaggaccgcctctcccgcctcactggcgcaaaaatgaccctggcaaaactcaccgcagccagccgcaagctggctgcctgccgccaccagatgcagcatctggacacccagcgccagcagcgcgaagccctcgaggcacagatggccgagaaccaaaagcggatcaacatcctcagcgaaaaacgcggccgcgtacagagcgaactgatccaaaaaagcagtatccaaaacgacatgcgcgaaaggctgacgcatttaaaagagctcggcaccatctgcagccgcatggccgagcgccaaaaaaccgctgacgacaaccgccgccaatctcaaaacagcaaggcggaaatcacaaggctaaaactgcgggaagaaacgctgaagaacaaaattaaggcgtcagccgccggaaggctggcccagaccctgacggacggcgagccctgcccggtctgcggcgccgtgcaccacccttcacccgcgccaaacaccgagctggacgccgccgacaaagccctgcagacgtgccaggatcagctgaccgaggcccagcgcgccgccgacacggcccagggacagatcgacttgctgagccgcgaactggcggctgaccggcaggttctcgacgagcggatgtcccgacacgcttggatggcgccgcttctcgagggcgaaccggcatcggcgctcacggctatcaaagccgaacaaaaacagctgctggccgcttctgaagccaataaatcagcgcaggacagcctgcaggcgagactaacccaaatcacacgtcagcttgacgctctgaccaaggctgccgcgcagcacgacgagatcctggcccaaggccgagatgacgccgacaagcaggcggcgcttcaaagccagattgaccagaagaccggtgccatcgaccaactgaaggccgacatcaacgcggtgctgcccgacttcacggcggacgaccgaagtgcccgcctcgacgccgaaatcgccggccttcaaaagcgggtcaacgacgcggccggacgacgggacaccctcatggaaaaacagcatcagctcgaaaaagatttagccggcgcgtccgcctcgactacccagcttgcgcacgcagctgatcaggccaaggcggccctcgagcaggaccagcaggaattcaacgacgcgctgtcagtgaacggcttgacccgcgaggtcttccaggtgtatgaatcccacgacaccaagaccttaaccgatcagattcagtccactgaacagaaaatcgcgcgctacgacgaaaatatccacgccattcagagccgcctcgacgccgttgaggaagcgcttaaaggcaagaccgtacccgatctcagtcgaaatcagattcgtctcggccactacaaatactggcacaagcgcgtgtccgacgcgattgctgatctgaccctccgcgtgaagaccaacaccgatcaaatcgcgcgcatccgaaagactttgacccgtcagcagacggctgagcatcaaaagcggattatctgcgatctttacgataccgtcaagggaaaggtcaaggactgcccgaagatcagcttcgaacgctacattctctcggcctacctccaagacattctgatgtcggccaacaccttcctcgaagacatgtccgactcccgctaccacctcactctggccgatcagccggagggcaagggcagccgggggctcaccattcaggtgtacgacgattttaccggcaaagagcggccagccgcgtccctttccggcggcgaaacctttatggcggcgctgtcgatggccctcggcctctcagatcgggtacagagcgaaagcggcggcatccaactggacaccttgttcatcgacgagggcttcgcgaccctcgacgccgacgcactggacaacgccatgaactgcctggcgagacttcagcgcaacgggcgcatcatcggcatcatttcccacgtcagagagctgctggatctggtcgacgacaagatcatcgtgcgcaaaacggaagggggctcctacgtcaaagtcgtctcggccaaggcataaagccttaagtatttgcaaagcttctctgatttttatataatagttctgttaaactagaatttggagtatttatgaatcgcatggaaaaacccaataagtcctacctttccaaaccacggaaacggctcggtattttttctctcgttatggacgcggtttatgtcatcctcggtctcagcttttatcattacaacaacctgccgtccttttaccaaaacattctgtcctacgtgtggatcgctttgatggcggccgcgctgatcgcggcgctcgtcggcattttcacgagcaaggaatacgaattattccgaagctgcatgttcgaaacggtgatcctcgccgcccagggcgtgtggctcggcgcctcgagctccctgatgctcgtcaagaaccagacggcacccttcccaatgtattttctcatcgggctgttctgcatcctcgccatcagcctcttcgttcagatcgacgcgacctggttccgttcgatcatgcatttcatgatgaagggcggcgacaacatggtcgaaattgaaacgcagccgcaggcaaaatccgcgtcgacgcctcaggtcactgtgcaccagggcacggtcaccctcgacaccacgcatctcaagcgcagcacgatgcgccgtcaaaccaaggcccatccaaagattcaggtcatcgatcaaaacgaggcccgcaacgccgtgaaacaggcccaggccaaggcccgagccaaacaggtgctggccgaagatttcgaaaagcgcagccgcagcacttcgcgcacagcgcaccagtccgctgaaaaacgtacggcgcagccccgcagagctgaaaaacgcaccaccacacagagccaaccgagaccaaagcgcgaaccgatctttaccgaagtgaaacaggaaacaccggctcatcagccagaacgcaccccatcgcgtcatacgaaaccggttcaggttcaaagacaggccaccacaacacagcgtcaaaagcctgcacagccgcgggtccacgtccagcagcctgaaagcaagcggcgtgctgacactcagacaatccgtcaggcacagccggcacgccaaactgcgcagcccgctgccgacgcgactacgaaatgggaaccgagaaaagtccgtcaggctgaagcgtcagcgaaaagaacctcacagctcaaagctcgaaaatcagcgatgcgcacccacacgccttcggcctctgccgccgaaaccgcttctcatacggaaacgccgcaatgggccactcagcgcaaacgccggcccaaaacccatcattacacgaaccgttcctcgcgcctgttcatccgggacgacgacgacgaataagcctgcgattcattttaaaatcaacggtgccggttttgcagtttcgactgcttaaccggtgttttttatttcctttgaattttttttaaataagacttgatttttatttttgaactgctataataatcaagtaagctttttgagagcagatgcgccaatagctcagctggatagagcgttcggctacgaaccgaaagggcaggggttcgaatcccttttggcgcaccactttttttattttaagcctctcaaggctttatttttttgtctttttttgagaatttctgcttttatgctataatcaatcttaatcatttattaaatttaggagttattgaattttatggctattaaaatcgcactggttctcattttcttcgccgtcatgctcgcgatcggcttcacctgcagaaagcgcgcgacggatgtcaacggcttcgtcctcggggggcgcagcgtcgggccctggctcacggccttcgcctacgggacctcctatttctctgcggtcgttttcgtcggctacgccggtcagttcggatggaaatacggtatcgccgccacctgggccggaatcggcaacgcgctgctcggctccttcctcgcttggacagttttgggccgccgcacccgcatcatgacccagcacctcaattccgcgacgatgcccgactttttcggcaagcgcttcgacagcgacgcgctgaaaatcgccgcgtcagtcatcacctttatcttcatgatcccgtacacggcgtctctctacaacgggctgtcccgtcttttcggcatggctttccacatcgactacagcgtctgcgtcatcgtcatggcgattttaaccggcgtttacgtcatcgccggcggctacatggcgacggcgatcaacgactttattcaggggctgatcatgctggtcggcattgtcgcagtcattgccgcggtgctcgccagcaagggcggcttcatggcagcgctggacaaaatggcccgggtcagcgacccgacgatttccaagacccccggcgtcttcgcatccttcttcgggcccgatccgctgaacctgctcggggtcgtcctgctgacctccctggggacctgggggctgccgcagatggtgcagaaattttacgccattaagagcgaaaaatccatcgacaccggtactgtcgtctcgacaatcttcgcgttcatcgtcgccggcggctgctattttctcggcagcttcggccgcctgtttgccggtcaggtcgacgtggtcaaggacggctacgacgcgatcgtcccaacgatgatttcgggcctgccggacgttctcatcggcatcgtcatcgtgctggtcttgtccgcgtcgatgtcgacgctgtcctccctcgtgctgacgtccagttcgacgatcacgctggatttgatccgcggccagtctaaaaagcacatgaacgacgacaccctcgtcgccattatgcgcgtcttaatcgtcgtctttatctcgatctccgtcgtcatcgcgctgattcaataccactcgaacgtgaccttcatcgcccagctgatgggcatttcctggggcgcgatggccggtgcgtttttagcgcccttcctttacggtttatactggaaaggcacgaccgccgcgggctgctggtgcagtttcatcttcgcggtctgcttcatgctcgtcgatctgtttgccggcgcccacctgccgacagtgctccagtcgccgatcaacgctggcgccttctgcatgatcgccggcctcgtgatcgtacccgtcgtctcgctgttcacaaagaagcccgacgctgaacgcgttgaagccacctttgcctgctacggcaaaaaggtgctggttgaacagcgcgaagccctgtccgacagcgaagacgcgtaaacgcgcagtattgccgcaaaataaaagcgtttggctgagacaatggtctcggtcaaacgcttttttggtctcgctctgccttagtgatgaccgcgatcctcctgcggccgacaaattcctgaaattttgtcaatgtgtctatgcagctagcgatttatcaaatcgcaaactgtttctttatttttaattaaaaatacggtttcagtttatcaaataaattttgttttttttgacaaaataagttactattaaattgcgtataagcgatgctgatactccctcgtgatttttgtttttgggcataaaaaaacgctcaatctgagcgaaacaattaaatgtatagcgaaactttcaaaatacagtggaaccgcgttgaaataacaacttcatcgtgaataaattgaattatttgaaaaaaatcgtttccggatcttcgatctgcaaaatatcgatcattttctcgatttcatccgttccaaaaacacttttcgacatgcgcttagcgaattcattcggcgtcagaccgattgcaacagccagatcgtcgtctcgatatccctgtgctttcataattttacgcaatttaattgtgtcgaccattttcctttttgtttttgtttttgtttttaagtatcttcttagtgaattttattctctcaccttttcctaaggttgtcaagttataattgtattaaaatttatttacatgctataataaaaataaatcaaaatgtataaatgagatggataatcaatgaaaaaagaaaaaacaaccacaactcaaactaaagagccagtcatcaccaaaggaaagcgcattcgcagccttcggatgcagcgcggtttccgtcaggaacagttggctcgaattatcggtgtttccaaacagaccatgtataaatacgaattcgacatcgtcaccaacattccgtcggataaaattgaagcccttgccgaagtgctcgaggtttcgcccgcgtacatcatgggctggacccgcgacgccgatccaagtctgctgctccagaaccacctctctgaacctgaaggtctctacaaatataattgtctcgacgaacacggcaagctggctgtcgacacgatcttaaatctcgagtacgaacgctgcagcggtgacggtgatcccattcaggacatcaaactcggagaacaataaaattttattttgcattctacctttcactctgtgtcccgtacacgcccattgcttgtttttcaatgatattttcgctacaataaagggaaattgttgaaaggaatttcctatttatgcgcactgaaaaaaaagctgccgtccagaatggcgtcgccagattggtactcactgtcgcaattattgcactggagttttatttactatacgccgtttttgtcaagctctacaccgctttcgcctggattcacacctgtgtgcgcatcgcgtcgctgatcgtcagtattatcattttcggcgaacgccgcaatgccggtatcaaaatgccgtggatcattttaatcctgctctttccggaatttgggcttttgctgtacgccctcggcgggcggatcaacgtcaccaagcccatgcgcgagcgctacgcggccatcgacaagctgctgcacccgatgatggcgcaggatgccgccgttgccgagaagctccgggaaaccgatccggcgctggccaatatctgccactacgtccgccactacggcccctacccggtctacgacaacaccgctgttcggttttacgatatggcggaccaggccctcgaggcgatgaaggccgacctgcgccgcgccgagcatttcatctttatggaatacttcgcgatcgaagacgcagaagctttcgccggcatctaccacatcctcagacaaaaggttaaggaaggggtcgaggtgcgtctgttctacgacgatatcggcagcatcggcttcatcaaccagagctttatcaagaaaatggccgccgacggcattcagtgccgagatttcaatccagtcattcccttcctcaatgtgtttatgaacaaccgcgatcaccgcaaattcacggttatcgacgggaaggtcgcttactccggcggctacaacctcgccaacgaatacttcaacatcacccacccctacggttattggaaggacaccggcatccgcctcgagggctctgccgtgcgctccttcacgctgatgtttttcgaaatgtggaacgctgtcaaaaacaccgacacgccggacgaaatcgacacgaaatacttcgccccctgggaaccggttgatggcgccgagggctacgtccagccctacgcggacagccccttggactttgaacacgtcggcgaagacgtctacctgaacctgatcaaaaacgccaagcattatttctacctgacgacgccctatttgatcctcaccgacgaaatgtcccgggagctcggcctggccgccaagcgcggcgtcgacgtgcgcatcatcacccctggcgtaccggacaagccccttgtctacgcgctgacccggtcctattattcccagctggtgcagaacggcgtgcgcatcttcgaataccagcccggctttatccacgcgaagcaatgtgtctgcgacggcgaggccgcgacggtcggcacgatcaatttggattaccgcagcctatacctgcatttcgagtgcggcgtccagctgatcaaggtgccggtgattcaggacatcctcgccgatttcaaccacaccttcaccctatgccacgaggtcacccagacctatcagcgcgaacgcctgccgctgatccgccagttcgcccacgcttttctcagacttttcgcaccgttgctttaaaaccacaggagcgccgcacccgctgcggcgctcctcagactgtcgacaaagtctagagggaaacgctctaggctttgtttttttatagcagtcagtcatttttcacctgtcgcaatacaaacgtggtaaaatagcaataatagaaaaaccggcaggcattcaatttcgggccattagcgttgtggagataatttataattttgtgtctgattctatcaaagtataggtgtggcgatgttataaaaatctgattgatttcataattcatatatgattttttttgtttttttttttctatggtatcgtgattttttttctttagtttttccatattcctcttatgattgttttttttcttttttcattttcttttcgattttctatgtgttatcgatttgggagggccagtggggatttcttttactgtccggtcatttattcgaattttacctttggttgttatggaaaagtatgtggcttaagttttattcatggggttttttttttttttttctttttttttttttttcccgtccaagcatcgatcagttgtgttgttataaaattccctatccagtaccttacggcatcaaagtatgcgccaaaccataaaagaaattgaagtcaatgtcgcgtaccgctggtttctcggttagatatgcacgacaaggtgccgcacttttcccatttcagcaagaactatacccggcgtttcaaagacacagacctttttgaacaatctttgcgccttcctttctgaatgttacatcacaagttgattgatcccagtgaaatctttgtagatgccactcatatcaaagcgagagcacaacaaaaaagaaacagaagaagatcgcccaaaatgaagcgatgttttatgaagcacaattatgcaggaaattcaaagggacagagaagctcatcataaaaagccattgaaagataaagacaatcagcaagatgatgatgacgacgatcatcaaccgttatcaggaaagacacgagaaacaaagtcagcacaaccgatccggaaagcggatggtttcacaaaggggaacacaaacagttttcgcttacaccgcgcaaaccgcctgcgatcgaacggatggattttagcttatgacgttttcccggaaatctgcatgaccgtcggacctttaaaggcctttatgacaagataaaaaacaatcatccaaaaatcattgtcgcgacgcaggctacaaaaccctgcgattgcaagagctcatagacgatggcattaaacccgttttcccgatataaacgaccaatgacgaaaaagggatttttcaaaaaatatgagtacgtctacgatgaagcttttgactgttacaatctgtccccataatcaaatttaaaatattcaaccaccaaccgcgaaggcttcagggaatacaaaagccgttctgaaatatgtaaagactgtcttatctcagccagtgcacgcatagcaaaaaccacgtcaaagtcgtcagcgacatctttgggaaaattacatggaaatctgcgaagacatccgacacaccatcggataaaggacatttacaaccgcaaagaaaggaaacgatcgagagaatcttggaacagcgaaggaagcgcatggattccgatatacacaaatgtacggtaaagcccgcatgagaatgaaagtcgggcttactttcgcatgcatgaatctaaaaaaactagcaaaaaaatttatttagaaaaaaacacccgggaccgaatcgtcctatatttcgatttcaatttataaatctacaaattgcagcttgatattaaatcaaacgaggctctgagtattttctcagagcctcgtttgtctacagtctgaggagcgccgcacccgctgcggcgctccttttcaacttccctctttttttcccgctttgttgtgttaaaataaaagagcattattgcgattattttttatcaattagattacaaatcatggaggtcatatgagatacgaaaacgtgaaaaagaccgatcctgcggtctacgatatcatgcgcaaggaatggcaccgtcagcaggacggtcttgaactgatcgcgtcggaaaacttcgtttcagaatcagtgatggactgcatgggcagccacctgaccaataaatacgcggaagggctgccgggcgcacgctactacggcggctgccagttcgtcgacgaaatcgaacagctggccatcgaccgcgcctgcaagctcttcggcgctgaacacgccaacgttcagccccactccggcgctcaggccaacactgcggtttacgtcgcgctgctccagcctggcgacaccgtcatgggcatggccctcgaccagggcggccacctgacccacggttcaaaggtcaacctgtcgggcaagctctacaacttcgtcccctacggtgtcgacagggaaaccgaattgatcgactacgacgcctttgaagctcaggttaaggaagtgcagccgaagctcgtcgtcgccggcgcttccgcctacccgcggatcatcgatttcgaacgcatggccaaaatctgccacgacaacggcgccctttacatggtcgacatggctcacatcgcagggctggtcgccgcaggactccacccgtcgccggtaccggtggccgacatcgtcacgacgaccactcacaaaaccttgagagggccgagaggcggcctcatcctctgcaaaaacgaattcgcaaaggccatcgacaaggctgtgttccctggcacccagggcggcccactgatgcacaccatcgccgcgaaggccgtctgcttcaaggaagcgatgaccgacgacttcgtcgcctaccagaaacagatcgtcaagaacgcctccgtcctcgcggatgaactcgcggcccgcggcttccgcatcgtctccggcggcaccgacaaccacctgatgctcgtcgacgtgtcggcggtcggcatgaccggtaaggaagcggacgaaaccctcgaatccgtcggcatcaccgccaacaagaacacgatcccctacgacactcagaagcctttcatcgccagcggtgtccgcgtcggcacaccggctgtcaccacccgcggcctggtcgaagaagatatgcacgtcatcgctgacatcttcgaagacgcgctgatcaaaaaagatccggaagcggcaaaggccaaggtcaaatctctgaccgacaaatacccgctgtacccggatctgatgtctgacgactgatggacggcaaagattacaaaaccgtgctgaccgccgccgaggcggaacagacgatcaacaagtcctggttcatcggcgtcgtgtttcacgccgaaaccgaggacgacgtcgcggcggaaatcgcgaagctcagaaaaaagcatttcaaggcgactcacgtctgctcggcctacgtgctgggcaccaatccgccgcgggagaaggccagcgacgacggtgagccctcgggcacagccggccggccgattctcgacgtcatcttaagacggggccttaaaaacgtcggcgtcgcggtggtgcggtatttcggcggcgtcaagctcggcgccggcggattgatccgcgcctactccggcactgcgtccctcgtgctcgatcacgcacgcatcgtcgggaaaatctggtcggacaccgtcagcgtcgtcattccctacccgatgtacggcgggctgattcagaaactcaccacctcgggcaaagcctcgtggcagccggtgcagtcccgtttcgaagagacggtcaccttagatttcgaggtgcctgtcggcaatacggccgaatttaccgcatttttaaccgatcaaaccgccggtcaggcagtgatcaccacaggtgaggccaaatgggtcgacacgctgatttcagcgccagaaaagtaaagagaattgaaaacaccacagtctctgcttttacaacagcagaggctgttttttgtgtttgaattgggaaaaaatattcagctaaaagaaaaacgcgccctgattgttcagagcgcgctgataaacgtatcatgatggcatcgaaccggcacgaaattatttcagcaccatgttcaggaaattttgagtccgttcgttctgcggatggtcgaagactgcttccggtgggccttcttcgacgacaacaccgccgtcaatgaagatcgtccggtcggaaacctgtttggcaaagcccatttcgtgggtgacgacgaccatcgtcatcccttctgaggccagctgttccataacgcgcagcacttccccgaccatttccgggtcgagagccgatgtcggttcgtcgaaaagcatgacgtccgggttcatttcgagggcgcgggcgatggccacacgctgctgctgtccgccggagagctgtctcgggaaggcgtcagccttgtcgagcatcccgacgcggtcgagcagctcgtcagctttcttgtccgcttcttcttcactcatcagtccgagcttgatcggtgcgaaggtgacgttctttttgaccgtcataaacgggaacagattgaactgctggaacaccatgccgatgttgcgccggacgaggtcgatgtcgacattcgggtcggtgatttcgttgccgtccacgacaatggtgccgctggtggcttcttcaagcccgttgaggcagcgcagcatcgtactcttgccggagcctgacggcccgatgacgcagaccacttccccttcttcgacttcgagattgatgtccttcaggacctcgagatcgccgaattttttctgtaaatttttaacgataatcttaggcatctgctttcaacctcttttcaatacgtttggaaatggttgacagaatcatgatgatgatgaagtacatgaccccgacgatgatccacaccttgaaggattccagattgtcggcgatgatcaagctcccgatctgggtaagctctgccatcccgatgactgacagaatcgagctgtccttcagggtgatgatgcactgattgacgatagcagggaccatcgtgcgcaccgcctgcggcagaatgacactgcgcatggacaccccataggacaggccgaggctgcgtgccgcttccatctggcccttgtcgacggcttcaatcccgccgcggaaaatttcagccaagtaagcgccggcgttgagcgtcagcgtgataatcccagctgtcatcggttccatgcggaagttcagcgcactggtaatcccaaaataaatgaagaacgcctgaacgatgattggcgttcctctgatgatgtcgacgtatacgcgggcgacggcgcgggcccccacagctctggacacagagagcatcccgaaaataatccctaatatcgcggcaagtgccagcgatatcagggtggattccaaggtcactccaagtccctggagcaggcggggccaagattgtgaaattaattcaaagaaactcacaatgacctccaaaaattattgaacttgttgatgattcagcttagttgctgctcgttttgatgtacttgttgacgatctggtcgtattcgccgctcttcttcaagttcttcaagcccttgttgaacatcttgagcagcttctggtttttgcctttctgaacagcgaagccgtaagaattgccggcctggagatcgccgacgattttcagcggctggccctttgtgatggcgtagccgagaactggataatcttcaaagcaggcagcagagtgtccggacttgacgtcttcgtacatgttcgcgctgctcttaaaggtcgaaagggtgtagccgtatttgtcttggttttcttttgcgaaggacgcgccttccgtaccggccttaaccgcaacattcttgccctttaactgatcgtagctggtgatgctggaatcattcttgactgccatgccgatcccggagtcaaaatacggatctgagaaatcaaattttttcttgcgttcgtctgtgatgctcatgccggcgatcacggcgtcgctctggccgctttcaagagactgaactgcgccgtcgaaaccgagcgccttgacggtgtacttaaatccctgatcctttgcgatggccttgagcaagtccatatcgatcccgacgcgcttgcccttgctgttttcaaattcgaagggagcgaacgtggtgtccgttgcgatgatgtactcatcggagtttgagctgctggatgatccacaagcaccaaatgtcacgacagtgaccaaggcaagtgcaaaaatcaggcccaatttcaaaccttttttcataaaaatcctccaatttttattgtgttttgctgctccgttaagaaagcattaaaacagttttaaattacttttaattttatcatctttgtatacctggtgcaattcaaattattaaaaagtgcttaacttaaacagaaatttcctgttatttttcgtcgaatacgctgaatttatatacaaaatctgcatgttcctcttttggtggcacacacggcgtaaattcgtttaaccccttaagctttctaaggttgaattaaattgtatacaattgacttttacccatgcctttgctaaaatttataaaaataaataaattgtatccaaaattcacggctgcacgataaacatgcaaggaggttaagttcagatggcgaacgatccatttacccaggcttttattcgtaaatacgcgtcgcggaccgttgcgcgggatcagatcccgatggaaacctaccaggcccacaaggtcagtcaagggctccgagacgaagaaggcaacggacttgtggtcggactgaccaatatttcccgagctgacggtttcgaaagcgttgatggcaaacgcgtcccctgcgagggcaagctctggtatcgcggcatcgatattaacgacattatcagcggcttcacccagtgccgttttgggtacgaatccgctgcgtttttgctgctcttcggcgatctgccgactcaggatgagctcaacgacttccgcgatgtgttagacagccagcgcgcgctgccgccgcattttgtgcgggacatcatcatgcactcgccttccaacgatctgatgcgcatgctgacccgctgcgtgctctccctcggcgcctacgacgacaacagcgaagacacctcgcccgaatacgtgctcgctcagtgcgtaaagctcatcgcccagttcccgctgctcgtgatgtacgtctaccaatcctacaatcactacattaaaggcaattccctgtacctgcaccgcacgcgcccgaatatgtccacgtcggaaattctgctgagccttctgcgcccggaccggaagtacactgacctcgaagcgtgggtgctcgaagtagaattgatcctccacatggaacacggcggcggcaacaactccacctttgtcgaccgcgtggtctcctccaccggcaccgacacctactcgacgatggcggcggcgatcggttccctcaaggggccaaagcacggcggtcagattctgctcgtacccgaaatgatggaagatctgtcggaaaacatcgccggccccggcgacatggctggcatcaagcgatacctctcggcactgctcgaccgcaaagccttcgacaagagcggcaagatttacggcatcggcaacccggtctactcgatctccgacccacgctctgaaattctgcgcaagtacggcgaaaagctcgccgcagcgaaaggccagagcgacgtgttcgatttgtacgcagcggtagcggacctcgccccgaaaatgatcaacgaacgcggcctttaccacaagccggtgtgtgccaacatcgacttcttcagcgggttcgtgtaccgaatgctcaacatcccgccggaactgtacacgccgatgatcaccgtcggccgcatcgtcggctggagcgcgcaccgcatcgaagaaatcatcaacggcaaagtcatcatgcgtccggcgtacgaaagcttgattccggaacgcagacccttcgtgccgatcgaagatcggaaagagggcggaaaataatttacttgcttaagtcatgtaattttgaaagcatttacaacgcgaaaagccggagaaaatccggcttttttatttacaacatttttcatttatgatagattgtgcaatgtaatcaattgttttaattttcgagttacatttggtcgaccacttcttgaagcatttgacagataagccggtgcaactcaacaggaggtttaatgatggcaagaaaattatccaaaaaatccatggcatccgctgaagcccagaaggcagaagttaaaagcacgccgaaggttgaagtgaaaacagaagtcgaaaccgtcgcaaaggctgaaccgaagaagggcaaggcagaagcagccaaaaccgccgcaaagactgtggcgaaaacagctgcgaaggccgcgaagaccactgcatctgctgcaaaaaccggtgcgaaaaagaccgctgcacgccgcagctccagccgcggatacaagagcgaagtcattatccagcgcagcgatttcgaagtcacctcatccggacttgttgacgaagtcaaggaaatctggaccaaacagatgggcaacctggtccgcgatctcaaggacgtcaaggtctacgtcaacaccgaagaagcgatggcttattacgtcatcaacggcgaagtgaacggcagcttcgcactctaagcgtcatcgacgcgcagcggctcaggccgctgtttttttgtgcagatttttagagaatctctgattttccctgcgtctcaagccaaatcgtgttataatggagctaccgcgtaccggggagcgatgagctgagaggtgcggacatgccgcacgacccgatttacctgatttggataatgccaacggagggaggcggaagtgagatgttattttgtgtcgcgcttttcactgcagtgccctcccggcactgctttttttgttctccgtgcgcagaattttataacgagcaaggagaaaagtatggcactgaattacgcaacccaaatggatgcagcccgcaagggcatcgtgacgccgcagatgaaggcggttgccgcaaaggaaaacatggacatcgatcaattgatggatctgatcgcaaagggacaggtggtcattccggcgaacgtgaaccacaccagcctcgaccccaacggcatcgggaaacagctgaagacgaaaatcaacgtcaatctcggggtcagccgggactgccgggatctcaacgtggaattagacaaggtgatggacgcggtcaatctcggtgctgaagccattatggatctgtcgagccacggcaacacccagcccttcagacggaagctgacctcggaatgcccggcgatgattggcaccgttccggtctacgacgcggtgatccactatcagagagatttgggcacccttacggcacgggacttcatcgacgtcgtgcggcttcacgctgaagacggggtcgatttcgtgaccctgcactgcggcctgactaaggaaacggtgcgccaggtcaaggccggtgaacgcaagatgaacattgtgagccgcggcggcagcctgatcttcgcgtggatgtcgatgaccggcgaagaaaatccattttacgaatattacgacgaaatcctcgacatctgccggaaatacgacgtgacgatctccctcggcgacgcctgccggcctggatgtttagcggacgcgaccgaccgcatccagctcggcgaactcatgcgcctcggtgaactgacagaacgggcatggaaaaaggacgtgcaggtcatggtcgaagggccggggcacgtgccccttgaccagatcgccgcgaacatgaaggtgcagcagcaggtctgccacggcgcgcccttctacgtcctcggaccgctggtgaccgatattgcgccgggctacgaccacatcacagcggccatcggcggcgctgtcgctgcctacaacggcgcggccttcttgtgctacgtcaccccagcggaacacctggcgctgccaaaccgcgacgacgtccacgaaggcatcatcgcgagcaaaatcgcggcccacgccgccgatatcgccaaaggcctgccgggcgcccgggatcaggacgaccggatggccgacgccagacgcaaactcgattgggacgcccaattcgcggaatgcctcgatcccgaacgggctaaggcgatccgagacagccgcgccccgggggacgatcacagcgacacctgctccatgtgcggcaagttctgtgcagtgcgcagcatgaacaaggccctggccggcgaaatcatcgacattctatgatcaaagcaaaaaacagcatcaaaaaaactgcggtcttaccagatcgcagtttttttaatttaatctgttttcctgagcacataatcgcgctttgccgtaagtgctacatgtcgaatacatctgcatggcttccggtatcgactaaagtcaatgtcaaaatgtcatcttcaatcaaatagatgagcagccaatccggtttgatatgacattcatggaagcctgcgtaacggcctttcaaaatgtgatcgcggtgttttgctgcaagaggtcttccctgacgaagcgcctcaacaacctgatccaacaaagaaacatccagaccgcgcttcaaaatccgcttgtaacttttcttataagcagatgtgaacttaaccgtgtacatcagtcctgaagcagcgccgccttcaagtcatcaagcgaatcataacccggtgtgtcagggtcacgggagattcttcgtgcctcatccattgcggcaatcgtgcgcgcactgtatctcggacgttcaacttcaaaaggcaggccatcgtgcatgatgcactgacggagaaaaatattcactgctccggacatgtcgagaccaagatcgtgaaacaatgcatttgcctgttctttgacatctttatcaattcgtatttgagttggaactgtcgccatagaatcatctcctttcaagcacattatagttgttttaatttacattgtcaatcaaataggtaattttgtggcgttcgtcaaaaaaactgcggtcttaccagatcgcagttttttaattaaaatttttctctttttcacgaaagaattttcacctggcaggccgccatggtctgaagcgccgccgcgtggctttcgggtgtgaccccggcgcagcaccgcgcgtcgaccgtcaccggcacctccggcatgaacgccttgagcatcagcgcgttggagacgacgcagatgtcggtacacaacccgacgagctcgatttcgatgtcccgctccgccgcgattttggccatgcgctccgccagcgccaccgagccaaaggtcggcttttcgataatgtgatccggtggaatcatggccgcgatgtgcggctcgagagcccatcccggcgtccccttgatacagtggggcactggcagattggcgccttcctgggtgtccagataattgtccgggtgggtgtcctgagtcgcgtagacgttggccttcggcgctgccgcgatcttgtcgatcaccggctgtacgatggcttccgcttccttggttcccaatgccccgtcgataaaatctttctgcatgtcgatgacgatcaatatccgttccatggctcctccttatttaaaacaattcttacagcgcggccagcccccgtttaaggtcttcgatgatgtcgtggacgctttcgagcccgaccgacaggcggatcataccgccgtcgatgcccgccgcgacgagctgttcgtcggtgagctggcggtgggtcgccgacgccgggtgcagcacgcaggtgcggatgtccgcgacgtggacttcgttggacgccagcttcaagctgtccatgaatttaacggcctggggccgtccgccctcgacgacaaaggaaatgacgccgctggcgccgtccggcaggtatttttcagccagctgatggtagcggtctcccggcaggcctggataagtcaccgaggcgattccgtcggccgcgtcgaggaaggtcgccacctgcatcgcgttgtcgcagtactggcgcatccgaaccggcagagtttcgagcccgaggttgagcaggaacgccgagtgggccgccgggtagcagccgaaatcgcgcatcagctgcatccgcgctttggtgatgtacggcgcgtcggcgtacttgtcagtgtagacgatgccgtggtagctttcgtccggttcggtgaattccgggaacttgccgttggtgtagtcgaacttgccgctgtcgacgatcatcccgccgcactgcagcgcgtggccgtccatgtacttgctcgtcgagtgggtcacaatgtcggcgccccattcgaagggccggcagagcaccggcgtcgcaaaggtgttgtcgacgatcagcggcacaccgttggcgtgggcgatcttcgcaaatttttcgatatcaaacaccgtaagtgccgggttggccaaggtttcgccgaatacggctttggtattgggtttgaaggctgtctgaatctcttcctcggaggcctcttcgtcgacaaaaatgcattcaatgcccaggcgacgcagcgtgatattgaacaagttgagggtgccgccgtagaccgaaggcgtcgcaatgaagctatcccccgccgcgcagagatttaaaatcgcgagcagattggccgcctggccgctggacgtcgccatcgcgccgacgccaccttccatatcggcgaccttggcttccaccgccatgaccgtcgggttcgcgaagcgcgaataaatgatactcttcgtcggatcatcgaacacacctgcaatttcatcagtcgaatcgtaaacgtaagttgtgctctgcacaatcgggaccacccgcggatctccgtttttcggcgtgtagcccgagtgcagacattttgtttccatatccatgatcacacatctccttccaattacctagtgttttaatatgaatgttgactcatttactatgttttgattctagtttatcaaaaagcagacgggttgaaaacgccaaattggcaaaacctgttcgaactgactttacgcattaacttcacgtgacattttcttcttaaaagctgcgagaaaagcctcagcggcccgcgacaggatgcggtactttttccagacgaagacggcagcggcatacagaccagatccgccggtccaaccgacggcagccccgcccagggactgtccgccggcacgacgacatcgccggcatttacgaacgggcgtataaataatttatccttcctttgatctttctccaaaaccgggccgatctgctgtgcaggtcgacccggtttgcattttagctattttattttaagtaatttcatcttttcattatttctctatttgactgagcttccggcaggtattgacgagccagatccccgtcgtattcaaatcagacgcctgccatttgctcgtcttctcgcaggacggcttcaagcacgaagccgattcatctttgttgcagagcgaccagcaggcaaaactgataccgttgttcgtcaagagcgtcatccatcggttcgcattgtcgatgtcaaaaccgccgtttcccgacgcgtcgcagattccaaattctgaggcaaaaatcggcgttttgctgtcgaccgcctgcttcaatttattctggacatcgtctcggtgcgtgccggcgtaaaaatgaatcgtttacatgacgtttttgatgcccagcggcttcttcgcgacttcatcaacgtcctgagaccaggtgttggtcccgcacaagataatcgcgctgctgccgctgtcccggatcgtcttcgcgacggttttgcaataggtgtaaagatcccggccgctgccgtcataccatttcgtattcgtcggttcgttgcagatttcaaaaatcatgtgggcattgtttttgtatttggcagcgtaggttttgaaaaagcgctgcgcctgggacagatcctcgttgggattgtagtttaagacgtgccagtcgatgatgacgtacatgcccagtttgtcagccgctttgaccgccgttttaattttcgcgtccatctgattctgactgccctggaggtatccgccctctttcggatagaccgcaaggcggaccgtgttgatgccccattcatcgcgaagggagcgcatcgccgccttattcacgtactgcggaaaccactgaaggccgtgggtgctgacgccgcgaagctggacaaattttttgtgcttgtcgagaatgacgggctgtttaaaccctttcgcgcggccgacggaaagcttaccgtgccggccaaagggcgttttcgatttcgcgatggctgtggtccgtccctttactgaatagttcaagctgcttccgcttgcgtccgcctggaatgccttcgcggccgaaacgctggactgcttcgcggccacacggcccattcccccgaagccaaaggccgtgaagcttaaaattaaactgcaaatcacagctgccgccgtcacattgtgccgcattctttttctcatattaactcccccctgttgaagcaacaataattatattcattatatcatcaatcacagggaggcgtcttttcgtcaaaaaaataaaagcccttgcggacttttattttttgcttaaatattaacctagcacagcttcgcgccaaccaaaacgaaatcgtctttcgctagctcaccgccttattcatcaaggccttcaattttgtataatcccttacaaaggaatcgatactggcctggatcatttcgtcttgagaaatcattgaataatcgatcttgtagccagcagataaagcaagttcacggaaaaattcgcgctgtgttcttccattcccctctctgaacggatgcagtgcattaacttctccaaagaaataaacaagtcggtctataaagctttctctcgtcaggtcttttaaataattctctttcctcagctctgcgaaaatttccttggcctgttccggaaggaacatcacattgcaaaacacgtttgacttggcaatatcaaccgttctttccttccctgcccagtcgtagatatcctgaaagatgtacgcatgaatttttttgagatgctgataatcaaaccttccttggattagatggtcctgcagctgaatcaatcttctcgctgtcagatcacgttcggcattctgaagaagatccgcatcgtgaatatccagtttattcaccaaaacatccgtgcccggataacaataaatcgtatccgccattctattatccttccgtcttgtattgctccttcaaacgctggatactttcttcctgttcctgcggcgtcatcttatgaaatacttcgagctcggtgatctggtcttgggttaatgccatattttccattgccatgctcgcggcaacgctgctgactgcttcgtctttaggaagtgccacatcaaacgggattcgacgctgaagaataatctgtttgattgtcatattgagtaccgcggaaagattcgtgcccagttcttttaaaatcttgctggcttcttgtttatctttttcgtcggttctaatttgaatatatgtccctgccatacgctcacctccatataaattattataccacaatacactaacattgtcatattttatcttagaggagaccgcacgcttattatggtgttaagtcataaaaaagaggcacccttctcagatgtattctgaaaaaggtgcctcttggatttacgcttttatttaacctagcacagcttcgcgccggctggaatgtgatcgtcgagaatcagcaggtgaagcttttcttccccttcttcttcgtggacagcggagatcagcatcccgcaggattcgatccccatcatcttgcgcggtgcgaggttgacgatggcgacacaggtgcggcccaccaggtcttctggttcgtagaatttgtgaatgccggagaggatagtgcggtctgtgccggagccgtcgtccagggtgaactggagcagtttcttgctcttcggcaccgcttcgcaggccttgaccttgaccgcgcggaaatccgattcgcagaaggtgtcgaaatcgacctgatcttccatcagcggttcgaccttgacctttgaaaagtcgatgacttcgtcggaaccttcaaccttgaagctcggctgtttcttcggcttttcgctggccagcggcttcatcgtcgggaagaggatgacgtcgcggatggtgcgctgaccggtaaagagcatgaccagacggtcgatgccgatgccgagaccgcctgtcggcggcagcccgacttccagcgcgttgatgaagtccgcatcgtatggatgggcttcttcgtccccgccggccttcttttccatctgcgcgatgaaacgttccttctgatccgccgggtcattgagctctgagaaggcgttggcgcattccgcaccggagatatagagttcaaagcgctgggtgtagcgcggatcttccgggtccttcttggccagcggtgagatttccactgggtgcatcgtgacgaaggtcggctggatcatcttgtcttcgcatttcgcgtcgaagacttcggccatgatttcgccgacactgccgtccttgccttcgatgtcgacgccgaggtccgctgcggctttcttcgcttcttcgacgtcggtcatgtggtcgaagtccacgccggtttcttcctgaaccagatcgaccatgcgggcgcgtctgaagggttcgccgaggtgaatggtgtggccgtcgaattcgacgtccttggtgccgaggatttcatcggccaagtagtggtacaaatcttcgaccatgtccatgacgccgatataatcggtgtaggcttcgtaggtttccagttcggtgaattccggattgtgggtggcgtccatcccttcgtttctgaacacgcgggagagttcgtagaccttgtcaaatccgccgacgatcaagcgcttcagcggcagttccagggcaatgcgcaggtacatcggaatgtccagcgtgttgtgatgggtgatgaacgggcgggcgttggcaccccctgccaggttgttcagcaccggggtttccacttcgaggaagccgcggttgtcgaggaattcgcggatcttggagatgatgcgcgaacgggtgacaaagacgtcacgcacttccgggttgacgatcaaatcgacgtagcgctggcggtagcggaggtcctgatccttcagaccgtggaatttttccggcagcacctggagggatttggacagcagcgtgaattcgtggacgcggatcgacacctggccgcgcttcgtcttgaaggcttcgcccttgatgccgacgatgtccccgatgtcgacctttttaatttcgtcgtaatccggcagcaggtcctttttcaggtatagctgaattttcccggtgctgtcaagcaggtcgtagaagcccaccttcccctgaccgcgtttggccatgatgcgccccgcgagggaaagcacctggccttcgtactgttcaaaattgtcgttaatatctttggcgtgaccggtcacatcgtacttcgtgatttcgtaggggttcttgccttccgcctgaagggcgtgcagcttgtcccaacggaccttgatcacatcactcatcttttcttctgccatttttgctcctgttctctatttcgttccggcttatctgtgaatgtcgagaatggtgtacgtcaccgttccccgcggcacttcgatgaccacagtatcgccgaccttgtggcccatcaggccttcgcccaccggcgacgcgttggacagcttgccggccttaatatccgcttcagccgagccgaccagctggtaggtcatctggcggccgcctgtttcgacggtcatgtaactgccgatcccgatttcgtcagtctggacgtcgtcggcaaccttgacgttgcggatctgttcttcgagttccttgatgcggccttcgacaaagctctgttcatttttcgcttcgtcgtattccgagttttcggacaagtccccgtagccgcgcgcgatccgcagcttttcaatgacttcgtaacgggtgaccgtctttaaatgttccagttcatccttgagtttttgcagcccttcttttgtgaccactaattcctgttttttttcgctcatggcaaccctttctgcttgtatttcaatgcgatgtccaaaacgaaaaaaacacccgcgctgacgcgtctgtgcttcccgtttccccatccattttgaccattttcaataactttacatattatattaatgaccggcttaaaagtcaatcatttcaaggtcaaccgccggattttccgtcagaaaatgggcgatgccgtcgtggtcgttgtcgtaggcggtgaccacgtccgccgcggccttggccggcgcctcgccgttgcgcatcgcggcgccgatgccggcgtaggcgagcatccccgcgtcgttctgagaatctccgaaagcgatcatctctgccctcgaaatgcccagccggttctcgattgctttgaggcccgacgccttggagaagcccttgaaggtgacctcgaggtaatattccccgactcggaagaagtcgaacacgtcggcgaagggtgccgtgatctcgggggtgacccggtcgaggacgtcgccgtggcccatcacgaggatcttgcacagcgggaaatcgacgaaatccgccagcggcacgtgcttctcgatgggaatgccgatcacgctgcgctggtgctccaccttgtagccgtcggggtcgttggaaaaataggtccggccgtcgtcgacgaggaccgatactgggaaacgctccgcgttgcggataaaggcgcgggctgtatccgggtccatctgtttctcgaagatgacctgctgagtggtctggtcgacgatctgtgcgccgttgtaggcgatgaccagcccgtgataatccgcgagttttaacatcctgctgtaaaccgccgtgccgaccgccgggcgggccgaagcgatggcgaccctgccgccggcgcgctgaaaggcaatgagcacctccagcgtcctcggtgaaatcgtcttgtccgtcgtgagcagcgtcccgtccaaatcaaaggccaaaagcttgggtttcatcctgcacctccgtcgttttttctctatcttatcacaggatgcccgatcattggcgtctctcgctaaaattcggcccaccaaaaaaactgcctcagagagacagtttttctgggttgttttataagaaggtttctcttataaacaaatggtatttggtattttattattcaacgtccatgagcgccttcggtccttcttcaccagtacggaccttgacgacacggtgtacgtcgtaaacaaagatcttgccgtcgccgatatggccggtgaacaacgctttcttcgctgtttcgatcacatcgtcaaccgggatgcccgagacgacgacttccaccttaaccttcggcagcagggtcgaatcgaccgtcgcgccacggtaacgttcggctgaacccttctggatgccgcagcccatgacctggataatcgtcatgccgctgaccccgagttcattcagcgcgcgtttcaaggcgtcaaacttggacaatctgcaaataatgaccactttgtgagcttccaccggtccgccggagacgagttctggttcttttgatactttaaccgccgcgtcgacctgagccggtgatgccttttcgtaatcatcttctccgagatcagtattttcattggcttcgaggctcatgtccgtcacgtctgaaatcgcaaaaccggaataagctgaagtgaggccgtgttcgtgaatgtcaagaccttcgatttcaatttgcggtgaaacgcgcaggccgatggtcttgtcgatgagcttaaagacaataaacatgatgaccaaaacgtaagccgcaacggccaccacgccgagtgcctggataccgagctgatgcgcgccgccaccgtagaagaggcctttgccgacgccgtctgcgcctgttgagaacaaaccaacggcgatggtgccccaaatcccgttaaccatatggacagaaaccgcaccgaccggatcgtcaatttttgcaacgttatcgaagaattcaaccgaaaggacaaccagaaaaccagccacgagaccgatgaaaaaagcaccaaggggtgagacgcagtcgcaaggtgccgtgatcgcaaccaaaccagcgagagctgcgttgaaagtcatggatacatcaggtttaccgtaacgcagccatgtaaagatcatcgcgacgacagtagccactgctgcggccaggttcgtattcatgaaagcgagggatgcagacacagcgtttgcgccggtatccatcgcaaccgttgacccgccgttaaagccaaaccagcagaaccagaggatgaagacgcccaacgcgcaggccgtcatgctgtggcctggtatggcgcgggccttgccatttttgtcgtatttcccaatacggggcccgagcagtgcagcaccaaggcaggcgatgaccccgccgaccatgtggacacaggtagaaccggcgaaatcatggaagcccagaccgccgagccagccgccgccccaaatccagtgacctgaaatcgggtaaaccaatagtgaaatcgctgcagaataaacgcagtaagctttaaaatttgtccgttctgccatagacccggaaacgatggtcgcagccgtcgcacagaagaccgtctggaaaataacatagcaccagaggggcatgttctgcggcacgacgctgttggctgccgtgtattttccgaggatcattggatcgaaatgaccgatcaatgcgcctgtcccgccaaacatcaagccgaagccgacgagccaaaagcacggtgtcccgatgcaaaaatccatcatgtttttcatcaagatgttcccggtgttttttgcacgggtcaaaccggcttcgcagagcgcaaatcccgcctgcataaagaagaccaacgccgcacaaatcagcacccaagagacagtggttacactaaatttcatgatgcactccttcacaaatcacaacattaacagatatgaataaaagaataatgagtcctgatcaaagaaaaaaagcgccttccccccacgggatcccatagcggggggaaaagcgcctttgcttcaatcgcgatgcaacaagaacaaaataaaaagcactttgagagagaattctcaaagcgccgttgcttcgttcttattgatttgttatttacattctaagagcattttcagaaaatgtcaaggaattttttatattttttaagctgttatcttttattttatcaagccatcgggtatgatgagcttatctgatttttacctgatctctacaccatcatacaggaggccttatgacccaatcccatcaacctgagcaaaccttcaaaatcggcgacttatcccggctctttcacatcggcgcggactccatccgctactacgagcggctggggctgctgcacccggtccgcgacccgaagagcaactaccgcctctacaccctcgacgacatccgggcgatgaacacgatccgcgagctgctcgccctgggctttcacaccgacgacatccgccgcttcgaggccaaccgcaacctcgacgccgtgaccgacctgctcgagcaggagatgcagctggtcgacgagaaaatcgccgacctgaccaagacccgcgccgacctgagcgcccgcctcgccgccatccgcgacgatttgttccgagactgctctggccgcatcgtccgcctgaccctgcccgagcgcccgtgtctgatgatcgtggaggcgccgatgcccgacgagatgatcagctacgagctcgcccgggccagcgatgacttccccgaaaaaatcgcaaccatcggctgctgcgactgctacatcctcgaccccacagccctcaacgcggccggcaccgattatcggaccaagggcgtgttcttctactcgtcccacctcaatctgccctgcaaccacgtcctccccgctggggactacctgagcgtctgctatcgcggcgacttcagccagagcctcgatctcgttccgaaaatgtacaaagaagccgaacgcctgggccttgcccccgccggcgacccaatggaattctgccacatcgaccgcttcgaaacggccgatcgggccgaatacctcaccgagattcagctgcctgtcgccgatgcggcaaaaaaataaaagcggtcatgccgcttttatttttttgctgttttcactttacttccaaaccccgcgggcccttctgatcttcccgtacattttattttccatcgccatgacctcgttgaggggcacatgcttgaacaccggacggcgcatcttatacttgatccagaacaccgcgtaaacagcgagggccagcagggtcacgcctgtgacgagccagatcatgttgcgttccgccggatcagtggagatgttcaaaatcataaagacggttcccgcgataccgatgaggggcaggatcggcccgcccggcaccttgaaggtgcgcggtgctttcggcaggcggcgtctcagcaccagtacgtccacgtgagcgagaatgtagctgaccatccagaacaccgagccgacgagaatgaagaaagaaatcccgtcggaagaactgtcgctcatccatgcgaaaaagccgatagcagccgaaatgatcacgacgccgaaccagggcacgtcgtgtttattcgtcttcgcgaaaatctgcggcagcatgttcatgccggccatgccctggcaaatgcgcgacaggccgttggccgtcgagttctgggtcgagacaacggcgagggcaccgacgagggtcatccagaccttcccgacgttgccgaggagtcgttcgccgtagagcagatggggtgccggcgagttgagcagctccttccacggaatgtaattgtgaaagccgagcaccatgatcgactgaacgacgcagatgatgccaaggccgagcatcatgccgaggggcacgttgcgcttcgcgtttttcacgtccttcgagattggcagcgcgtattcagcgccgatgaacagccaaaaggccacggcagtcatcgacacgatgtcgccgaaattggtgtcgatcacgtagggctgagacaccttcgccccggtgcccatgccgatcatgccgatgatcccgagaatcgccatcgacccaatcaatagatacgagaccagatcctgaatcttcgcgaacatgtcgacgccgtagagattgacaatcatgatcagcacggtcatgattaacgaccacgcgattgagggaatcggaataaagctgaaggtttccgccatcgcgtaggcgaaaatcgacgcttcgaccccgcaggaaagcacgttgcagatgaggtacccgccaaccatcgagatcagcgtcgggaaaggcccgagcccagccatcgtgtactgggccaggccacctgtcgtgttcggcatcagcgcgttaagctccgacagagaggcgatcgtcgtcaggttcaacgccagcgcgatgaccatcgcgacgataaaggtcacgccgatggtgccggcaccctgtccgagggagacgagacagctcgtcgcgatgaccaggccgacggaaaccgaaacgaccgagcctaagccgagttttttcgtttcattcataatcgttccttatgtttttcagaaagttccgtaaaaccagctggtttaaagggcgtcgatcccttcgtcgccggtccgaatccgaatcacattgtcgagactgtagacgaaaatcttgccgtcgccgatgtgcccggtgtacagtgtcttcttgatgtcttcgacggtgtccgccactttttcggtttccaccacgaccgacacctgaatcttcggcagcagttccatttcgtaattttcttcgacctcgtattccttggtgcccttttcgacgccgcaccccaaaacctgggtgaaggtcatgccgccgaccttcaggtggctcagcaggcgcttcagcgccgcaaatttcgacatgtcgcaaatgacatcaatctttgacaatcctgtgctcatttttatttcctcgtttcttttatattttgtattttttgacaactgccttatgccatttccggtttatcccaaaggttgagtttgacaccgatgcccatttccacggctctgcggtaaacgctgcagccccaggccacgtcttccaccggcatgccgccgaccgagtacacaatgacttcgtcgtcggaggtccgccccggcgccttgccttcaatgatgtcggccatttcgatcaaatcttctggcttggatttgccttcgtggatcaaatcggtgaacttgcagccgatgatccccattttcggataagtcgggtacgggtattccgcttcccaggcttcgtacaattccttgttgtcgacgacgaatttgcagctggtcaggaagtcgtcgtcgaagcgggccgcgctcggcatcgaaatgaaagcgccgggcttgacccattccccgttgatgtaggggtaggtgttgaccacgttcgggtcgtcgtcggtcatcgccgtcgtcgtcagcgagatcacgtccgcgccgcgcacggcctcttcaatggtgtcgcagaccacgatgtcgtcgatctgcgggtattccgccttgacgaattcgacgaaggcgtcgagggattttttgccccggcccttgatctgcacccggtgcagcttcggacaggtcgccgcaaaggccgccaggctcgttttgcccatgacccctggcccaatgatcgcagcggtttcgctgtcttttcgggctaaatactttgccccgacccctgggatgccgccggtccgataagcggagagcaggttggccgacatgaaggccagcggcgcgccggtgtccttgtcgctcagcgtcatcatcaaaattgaccgcggcaggcctttttccttattttcaatattcgagccgtaccatttcacgccggccatctggtatttgccgccgaggtaagccggcatcgccatgaagcggcggtcctgggtgttgacgggcatccctgggaaggtcggttcgtccgggaacatgatcatgcagccgtgagagttgtggttttccccacccatgcggtaatcaccttttttaagaagcaacagcatctcttccatcgattcgatgcaggcgcgcatgtccttcacgccggctttgatcatatcgggttctgacaaatacaagaaatcaattttcgtatccatttgcgtcctcctgttttcgcttttcatcattatatcatcttccacacaaaaaaatggagccgacgcgccgcttttgcggcatttcagctccattgcgtttttcatcttttgttttacaagctctattttaaacactggtaatatactagagtcaaggggttttctcaatttttataatttgtcgttccagtgatcagcgccatgtcgtggtcgaagtcgtagcgctgaatcggcagggtgtccggcgcctcacctttttcagcccagtccgtcagcgccgccatcccgtcggctaagctcacggccggtccgctccagtcgagaatagagtgcccagcgtagggcatccggtacagccggcacgcgtcggccatcgcttcggcgctctcgaaatgtttggccatatcttcgacgtaggcgaacgtgttcacaaaaggcaccaccggatcgccggtgccctgagtgatgatgagcttgccgccccgggccgcaaaggccgagagatctgagcggccaaaatcccattcgggatgttcctggcgccgcacccacagggcttcaaaatcgtcgtagctcaaatcgtgaatatccatcttcggatcagccgtcagccagcgcagaatctgctctgcaattggcatcacaagcaggcggccgtcgggccggcgtctgaaatagccgtaaagcgggttgccaaagggcagaggccactggcgaatggccggtccaaaactgtgtcccatgcgcctgccgtcccgggtaaagggaccgcgccacgtcttcaccatgacttcgaaatccctctgtgtgatagggccagcagtggtggcgaccccgaccagtccattgagatacgctttaaaatccggatcgtcctcgtcaaaggggcgctcgccgatggcttgatctgcccgcgccagagcgtaggccgcctgatatttttcaaggggcacgatatgatgttcattttcctcgacaaccactggccaaaggctcgcaaataccacatcccattggtaaatcgccggggcgtcggcccaaagtccgtcgtagtccgccggatagcagaccccttcggtcagcacctgccggccgccgccggacgttccctgcagataggattttttcggcgcttcgccgtaggccagggtggtcaccgccttgccccagaccgttgtctcgtgcagcgcgcggccgatccagctttcaatgtgatgccattccggggtgccgtccgccttaaagccccaatcgcagttaagccgagtgcctgagtcgttgtcggacgcggcgcaggcatagccattcgccaaggcgaccggccagctcaaaacgttaaaccggccagaagtgtaccaatcaatttcattgttggtgccgccgccggcaatccccataaaacagccattccatttcgccggcaggtaaacccggaaggcagcggtgtggccgtcgccgacgtcctgttcaattcgcacctcccaaaaaggcccgagggcggtcagcggcgctttgcccggctcggtgtactgcccagccggataataggtcacgccgcgaaaggagagccccggcccatggatgagcagacggcccatcgcgtccgatgtcgcctgcgcccgcagcctgtctgagtaatctggcagccccgctacatccacccactgatacagcggatggccgagccacacgttgatgctcgagtctggttctttgacgagattcattttccgtttcatgttattccccctggtctgtgcctactatcgctattttagtctattatactgctcagagtctcgacttgtataggcagagaaatgccgggaaagggcaaatatccgaaaaaaccggtgtgctgtgcacaccggttgaaatcatcattataatgttgtcagggcttcgccttttaaagttcccgtcttccaggggatcagcgcttcgtggccgccagagcgccgatcaacccggttgatccacgccgcttcgtgagccgctttcgcgcgaagggagggattggacgtgtcaaggccattgaaagattggttgacgacccaccatttcacgccgatctgcgcgcgtttgagatcatcctccagccgttcggcctcgtataccggcgtcgcttccggcagggtcacgatgatgacttctgtctcatcgcttttgaggcgcggcaaaagttttttcacggcttccggcgttttcccctgggtccgcttcagttccttgtcgtagctgtctgtcgattcgagcagcagcagagtgtggccagtcggcgccgtgtcgatcacgacaatttcattttcagactgttcgactaaatcggcaaaagcacgaaataccgcaatctcttgcgtacacggtgagcggaggtcttctttaatatagtcgagatcatcttctgaaattcctgtggcgagcgcttcttgtatcacttcgctctgatatttttttagttcttccttttcgtcgatatgactcatgcgcacgccatcgttggcgtccagtacaaattttaaatgggccgccggatccgttgttgccaaatgcacctttttcccttttttcgacagatcaagggcaatggctgccgcgacagtggttttccccacaccgccttttcccatggtgaagatcaccttgcggtgatgggcggcgatgtcgtcgaccacatccgccagctggtacaaatgggaaacgtcaatcgtctgctctgcggctgccgcgtgatcgctcctcagcatcgcgcggacgttgtcgatccccgtgatgttgtaagtgcgcatcggaatctgggtggtgtccatgtcccgcaaggcttccggcatttccgcaagggcctgctgctgtttgtcgtacagcgcttcggataccgggtcactgccttttttcgcgactgcgttcatgacgagcacctgccggttgaggcccagctcccgcaattctcgggacgcccgagccgcttccttcaacggggtttcttccggccgcgcgaccagcaccaatgtcgtctgctcaggatccgccagtgtcgccaccgcctgctgatacacctgcttcttttcgtccaagcctgagagctgcccgagacaggacgcgccgtgcttactctgttgaataaagcccgcccaggctgatggcagctgcagcaggcgcagggtgtgccctgtcggcgccgtatcgaaaataatctggtcgtacttttcttgaaccgcagggtcggtcaaaaattcggtgaattcattaaacgcggcgatctctgtcgtacacgaccccgacagctgttcttccatattttgaatagctgattccggcaataccccccgatacggtgccactgcgcgctcgcggtacgctgcggccgcctcaaccgggtctaaattggcaacgaaaagattgggcacttccggaatcgcggtgcctttattgtcaagatctgccgaaaacacgtcctgaagattggacgccgggtctgtgctgaccagcagcactttttttccctgatcggcgaggaacaccgcggtggcgcaggccgtcgacgtcttgccgacgccgcctttcccggtaaagaacacgtactttgtctgcgtgaccgccgcaggattgaataatttcattttgatgcctccgatgttgtcagcagcagcagcctccgccgcagccacagcctgtgtccccgtcgtcgtctgaatccggcgcgtccgcctgcgggtcgtcgagtttcagccagccgaaaacttccgcgttgctcggatagcgatcggtcaaaacgaccgtgtcgtcgagcatcgtaatcggcagcgcctcggtcccccgaatcgccagcatgttcttgacggtctctgtctccgcaaaggcgtccggcgcattgtttaaattaaagcgttccacctcgacgcccgccgccttcaaatcgtcgatcagcgtcgaaatccgcagcagctctggatcgatcgaagggccgcagagccctgtcgagcagcacatagccggttcaaaaagttgcagttttttcattgtgtttcctcctgaatgtatattcgtcttttccgttaatgtttctccctgatttacctttcctttcggcggcacccaaggggtgtcttccccaaaataggtgatcgcgccgaccgggcagcggctcccgcagccgtggcaatgatcgacgcagcccacaggattgaccacttgcggttttggcgccgcgccgcgatcgtagaccccgtggccgcacatctcaatacaggcaccgcattcgcggcacgtttcccgatcgataaccgggtaccagttttcagccatgcttctgtcctcctcttcaacacattgaacgattaaattgatcgacgcaccgtgcttttctccttgaccgtctccgccgctcagccgcattgtcccgccgcacactcccgctcagccggcgtgcagtctaacgacgcgataaagcgctggaaggcgcggagggtgtcgcagttcagcgaataatagcaccatttgcctgcttttctgacgttgaccaggccgcagtcccgcagaattttcatatgatgcgacagcgtcggctgagagatattcagcgcttccagaatgacacaggcgcatttttcacagcccgacagcgtctgcacgatcttcaggcggttggcgtcgccaagggccttgcaaatcgatgcggtatcaatggtttccatcttgtcacctctcattcatttcatattgatattgatctatgtatagaagtctagcagacatattgatatttgtcaatgtataaactaaaaaaataacaggcgccacaccggtgcctgttatgctgttccttatccaaatacaacatccaagaccatcatcaccgaaaacccgagggcaaacatcatgacgccgacattggaatgggcgccgacggacatttccggcaccagctcttcgacgacgacgtagagcatcgccccggcggcgaagcccaaaagggccggcagtaccggcacgacaagatcggcaaagaggatcgtgagcagtgccgccgcgggttccaccgcgccggagccgaccccggagaaaaaggccttggtctttgaatgctccgccgcgcgaaggggcatcgaaatgatcgcaccttccgggaaattctgaatggcgatgccgagggaaagggccagcgcccccgaaaccgtcatgctcttcccgccgaggagcagccccgcgtaaacggcgccgaccgccatcccctctggaatgttgtggagggtcacggcaaggaccatcatcgtcgtcttggccaaatggctcttgacgccctcgggcttgtcttcatcgagatgcagatggggaatcagctcgtcgaggagcagcataaaggccgtgccgccccagaatccgccgaccgccggcagaaaggccatcttgccgaggtgggcgctctgttccatcgccgggatcagcaggctccagatcgacgccgcgaccatgaccccggcggcgaagccggtcagcgcgcgctgaaggccttcggacatctgctctttcatcagaaagacgcaggccgccccgagggccgtccccgcgaaggggatcatcaggccttggaaaataatcagattcatctttttgtcctttcgttaatttgtcttatttcttttttgtttcagccgtcgtgagctgctgatacatcttcatcagctccgcgacacaatccgattcgctcatcttcgtcgaaaagccgtaggcctgcatcaccgcgcggtcgttcatctgatgtgctttgcgaagttccggcggcatcgtcagcggatcgtaaagatcggctagggaactgtccggataaaggtcacgcgcatcgagaattgattgagctgttttttcgattgtttccttctgcttgtctgttggcgatggccaagggaaattattataaacaacacttccactataacgataatcgctttttaatcggccacaaacagttcgcatccatgccatatggacgtttgattctaatactccgaagccgtacaaaccagctccgcaaacaatcgagcacgaatccgcagcaatatattcctttggcataaatccaattggaatatatcgtctcctttcagaagagactctcggaacaatcaaaaaagattcgtcggtttgcggtgttgagaaaaatttaaaaggtgtttgtgccgatcgacgggtgggcgcagctgagctttgttcacgaaattcttttatcgcctgcagtcttctcataatttctttgttatttctataaactgaaggcgtaatatctttcaaccataggcaataccgtttttcgttattattcaaataatccctagcgccaatatatctgcggacacagcacttgatactcggatcatctgtaatcaatttttctttttcttcttccgataaaataaaattcccatgatctgtcggttgatttccctttgtcatttttcgtacatcacaaatcggttttgatctgctttttattaatatgttcggcgcattaactaagtagggatttatattgtcaacactacttacagtttcatcctcataaatcttcttatttttgacaggcgttgattgagaagaaaaaccgataataacgcaatgtacatgcgcttttaaattggcttctgaatcccatcgaaaagttcgatacgcgaaatcaattttaattttgtatttgtttaatagctggtcccacagtggttcgacctgttcgccctgcgtaatgctattcgtagaaacaaaagtgactttcacattcgtattttgtatcatgattgccgctttataataccagccgccaacataatcaatgctattcgataggtgaatttttccaacaatcgaaaccacttcgtctttttgagtttttgtcatcattgacgacccaataaaaggcggattccccataatatagctgagctctgacgctggcacaacgtcattccaatctattctaagcgcgttgccttccacgatgttggcgttagtggtcagcggcaggaaatcgagttccattttgataatgctttcggtttcctgcatcatctggctttcggcaatccacagcgccgtttttgcaaccgtcacagcaaaatcatttatttctattccatagaactggctgattaaaactttaatcggattgaccatactttcgcccatcttaatctgtccaaacacaccactgtctattgcgatgagttcttgtattacgcgattttcaagcttgcgcaatgacagataggtttcagtgagaaagttgcctgagccgcaagccgggtcgaggaaagtgagcgacgctaatttttgctgatacattttaagtgcattaatgcgctttttatttcctttagtattcagcacatcctctagctctgattttaaatcgttgaggaacagcggatcaataactttgtgaatgttttctctggacgtgtaatgcatcccgccctttcgccgagtttccgggttcaacgtcgattcaaacaccgcgccgaaaatcgtcgggctgatatcccgccagtcgaaattttccgacgcgtcgatcaaaagcacatcttttaattcgtcagtaaagggcggaatctcaagggtctcatccgagaaaaggcccccgttgacgtaagggaaggccgcgagatcatccgcgaggaagcggtcccgcttgtcaatcggcgtatcgagaattttaaacagctccttcagcgccatccgcagccgctgcggctcgaagctcgcgacgtaatcgtggaacgacgcccggtcgaaaatcccggcgtcctccgcgtacaggcagaacaccagccggacacacagcgcgttcagactcctgaggtccgcctcgcgctgggccttttcctccggcgtctcgtttttcggcgccgtctccggcaggccaaactccttggcgaaggcgtcgtaaagcttaccgacgatgttccccgcctcgatcgacaccttcatttcgtgggacacctttttcacgtcctgcttgatcaggaaatccaacatcgggtacttgtcctgcagctcgcccagctgaatcacaatcggtgccacatccttcgcgttcatctggttcatgtcgtaaatccagatctccgcgaaattgcaggtcacaatccaccgcgccttttcgtcgtaatcgaggctgtcgttgtagcgcttcgcttgatcgaagggcgtcagatcgacgccaccggagttgcggatcttttgatccagagccttgcccagactcttctgctcgatgatgaccttcgtctctggcaggtaggcgtcgatgcgcttcttgttcccgtcgacgtaaaccttcttttcaaaatcgacgtgctgcgttacgtcttccatcccgagcacatcgtgcaaaagctcaatccaataggaccggccgtcctcgtcctcgttgccccggcccttccatctattgataaactggcgcgccgcctcgcgctgttctgcgtctgtcatcgcggtccctccccttttgaaatcgatacttgttttttattttaccatattatggctgacgcgccgagacaaagaaaaagagggatcacctgtagaataaaatttcaagaaaaggacgctcctgcccatctagtggtaatcccctgatttcaacattctgtccatagtaaaagaccctccgtgatttagacattactttcacgaaaggcctggtcaattgtgattacatatgcactatattcataaacattacggatatcgttatctgcctgatctgtaatcttgatggtataactcatagattataatccttacggatatctgcaaaaactgcacttgcctccttcgttcttccagttttgatagccgcatatcctttttcaagttctgcattcaattctgcttctgataaagcaggcatatttacgggacgagaagatggaagcttcacatcaaatggaagtcctctttgaagaataatctgtttataaaacatattgattgcattggaagccggaatgcccagtgctgataaaattttttctgcctgttctttcacatccggctcaatacgagcataaagattcgatgattttgttgccatataaagcaccacctttcagatgttttcttaatctaattaagcttttatgtgcgtacaatagcaatacattttaattgatttcaaattttaagattattattcaattggtctaccatcgccatcagcgtatccgtcatgatctgcatcgtagacacctttgtagtaatccccatcatacccttcagaatcatatgaactattatctgaagagctatcatttgatgaataggaactcgaattagaagagctgccattggatggataggaactcgaattagaagaactatcatttgatgaataagaacttgaatcatctgatcttaatgaccctaaaggatcatgaatatcaacaattcttccggtattcatattttcctgataacaaacatccccctgatacacaatcttgaatacattagcttctgcatatgcctcccaattttcgttcccgtttccatcttcattgaaaaactttaagtctgactgatcaacactgaattttctacaaatacctttaaaagtgccacagagacttgatgcatactggctatcaccatcttctacaggatctggtctctgattataacttgaaccatatgaaaatgtaactgaaacagtatttccattaattttaacgtttgatgtttttggattttcttttgaatcaaaatattctttaattcttttatctctactcttttcaacctttgttttgttatgatgtgaatgaccttttgctgattgattacctattgaacatccactcgctaacattgaaatactaattaacccgataattaacccaattacaatatttcttttcctcatattcatttttatattctcctttatcagctttatatgcacgtgttttttattatttattatatgctttatacaccttatttactatatattttaatgtccttagatgataccttagggttattatattttgccacaacatccgccaattcaagcgctctcttccagaaaaaaaacagcatgactacttgcgatttacacaagtgtgtcatgctgcttctcttctcagttggatcataattgcatgcggaacagatgagccgcagcccgtccggcgtcaacatacggccatgtctcttatcatccagcagcttctgatattcttcatactgcttgtttgtaatcttctgcacaatcctaatccttttcgatatcagtcaacatcgattctatggtgtatttctgaaaaaccttcttcaattcattccagtacggcggaaatatattgctcccataatagttccgacgccttccaccagttaaccggattttcagttcccactgtgtgccatcgagtgtatatgggtccacatatcttctcttccaatcttgcagatataaccgcttatataaaacgtctattatctgtttccattcgctggtcgcaatctgtcttttttcaaatttcttgatatcaccgggaagccatcccgctgtaactacagcaccatcacggttccgtgaaatcgatacaacgtcaccgccctgaaaaaatccgcccacgcagaaataaatcgatgtcacgatatctctgtaatcctcggtctctccgctcttccttgaaatcagaatcggtggtttcccgaaatccttcttacagtcattacagtgcatcgacggcatgaccttcacctgcttaccattaatatcagcagtgcaaatacagcagccaccaagcactatcttgccctcgtccaacttcttctgcagctcatcgtcgtatacaggcataccatataatatttcagcgacatttttgcttccgcatctcggacatcttttcataagcaatcttcctgaagtaatctattcatcaaaaaagatatcatcatactgcatcatttcttcgatgctgcatgactgatttttctgttcacgtaacattttccgataggtcttatcatcaacctctatcgtgcgtgtctccataactgtcttcttaattccaaaaaggccgcgcttttctgtcgaaacttttacctttaccttgtgcttcatatatacacctcttaaattattggctgtatatgagcttcaatgcaagcacactattttccaactttgcaccatttttacagctttgcactctttatatacatcaaacagccgacggtcaatggcgacatcgtatttcatagctgatttcctttcaaaattttgattgattattttcttccatctaggacatattcgtacaacttgtaatctgtccaccccgtgtcttcatagtacatgttcaacgtatccatgtacttaaatcctaaaccggtgtagagcttttccgcaggtacatttcccgcaagcacatccaaccgaatagccttctgatgcgtgcaggccccgacttcaaacgccttgttgaccatctccttggcgtagccctttccactatacgcaggatgcacaccaagggcgtgaatgaccaagatctcgtcttcagccgcttcggtctgccattgaaatttgctgtacccctcattgcactgatgattcaggaccatcgcaccgacaatccgatgaccctcggtgcatagataaagtgcgccgcctgcgatcgatgcctttagaaacgccggcgccggataaatatccttttcccacccgatgtcgtattgtgaatcctgcatcgcgtcgatcagtgaatgataaaaacgcctcacatcttcatattggtctttattcgcttttacgattttcatcatgtttcatcttccgcataatcaaatttgccatcatttttttcttccagcgttttgatcaaatcataagcgccttccgcgtaagggacggcaatatttttcgcagcggctttcttcatcagcacaccgcagaacatctcaatttctgtgtggcgccccgcgtccaaatcctgaagagtcgaatagcggttgagcttgcggtagcccatatggggtctttcaaggggctccaggggatagccgtaagccgccgctaccgtccggacctcatcctcgagctttttggaataagccagcagatactcgctgtcttcataagcgccgatgccaacaccgagaatggcctgaggcagattcatcgaaatattgcgcgcgtatttcgtccactgctgtgtcataatatcgggcacgaaagtggtccgcacaggcttgtccgcgaaaaaggcttcgacggccgcacagcgttcggttttctctggcgtgtgcttttcaccgtacatcaaacctgttgtgacctccggatcaaaaacgacacctgcttccgtgcgcatcgatgagattttcatatacgcgttgacaatttgacgttccggaatggcggtcgcaatgatctcctcagaatccacgccgttcaaaaggctcatcacgatcgtatggtcgtctgtgaccgcttgaatctcaggcagcgccgatggcaggcctgcgtatttggtcgcgaccagaagcaggtccgcgccgtgcgcctgctgcggagtctgcacattcagcggaaaatgtgccccgttgatcaccatcccgtcgcgcaggaggcgctccctgcgttcaccttctgcgaccaccatgaaattgtcgcccatgcttttggcgagtccccagataaaatatccgccgatggccccggcgccgatcagcgctacttttttgatctgcatacaatttctccccatgattttttgctttgttttttattctaccatattgtgtgtgacgtgccgagacaaagaaaaaaagcaaacgcggagctgcgtttgcttggggtaaagcgatgattcatttgttattcccatatctgttcgcgcggatgccttcatgtacaatcacgccatttaaattttacgtctgatctttccattctcgaatcgcctttaaaatgcggtggtcaatatcaagcctggtctgtctgcattcctttggatatttccttgcggctttaaatgccagccgcacaaaaagatccgcacctaccggcagcatcgtgttcagcatgctttccgggaatacaaaatgcgtgccatgcggatagaccgccgtttccacggcgcaggtatgtggcgttctggcaagatgtgcttccatacgacgtatatatctcaatgaatatgtctcatcattcatcgcttcaggctttgaattccgtgtgcaccatgaagagcttgccccgcttggagcggatatacagcttggtgatgaagttgtaatgcacgccttcgaccgggtagccttcgagataactcttctggttgatgtggacgagacgatccgaccacgccggaagttctttttcggcatcgttcatgtagaaggtcagctggatcgcgttgtcggtactgctgacctgcccctggccctgcttcacttctttgtcgctgattgtgtcaaacacaaaggccgcccccggaaaacggtccgccatcgccgtgatcagacgcttcacctccagtttggagaaataatgcaggacaccggccgcgtagaaaatcgcccctttgtcgggatcgtaagggatctggtcaaaccaggccgcatccgtcagatcgcaggcgatgttccgctcattcgtcccaggtgcaatgtatttctctcggcaggcgatcacgtccggcagatccagattgatccacaggttgtgatcatttttcatctgcctgcgcagacaggataggcccgcgcccatttcgaccacgaccgcgtccggatgctgcgctaaatacccttcgatttcctttgaaaaatcgtactgtctgatcgcgccggcaaggcaggcgcactccatgtgatagaaaaccgtcggcggttgggtctctcccatttccttcagaatccgcaccgcgtcgtaatccggcaggatctgcggccgctttttgacagcgagcgcccggcaccaaagcggaatacagagcgtgcgttccacgctgttctttttcagatcgtcactcatctttgttctcctgtacctgtgtttctctaacagcttgtttaaattagtgtcgaaatttcatgaccgcgtcatgtatatttgctttttattagttaaaactaactgtattatacaatgtttttagacgttaagctattaaattaaaaacctgttagtgtttatttatgtaacaaaaaaagcaaacgcggagtagcgtttgctttgggttaaagatcaacagaaattattgatccgattttattctccacaaggcattcatatatcaacgacacagtgtctttatatcacaacttcacaatataattctccaatgtatgaaaaaatcccgcaagatacactgtttccttttctactctgtatatcaaaatataatcgtgatgctgcaatactagttttcgatatcctttcgctcgcaaataaggatcttcacaaaaagcaaaagacgctgctgtttttttgagctgattatatgcgtattctatatcttccataacagcttgcgctgcagaaggatttttcagcgtctccacaatataaccaatggattgatcaatctgatgcgctgtatgttccggaatgatcagcttataaaccatatttttccttcacctcggctaaagcctcccaggcgtctctggtttttccagctttgatctggttctcagaaatttccagctcacagtataacttttccttttgaatcatttcttcaaaggcttccatgctcatcagcaccatatcgccataaccattctttgtcacataaataggctcactgcttttatgacacatttctgaaatctttgccgtatctttcaaatctttaatcggtataatatgtggcatgtcgttccctcctaaaataatatgataattctaccatttttataccattatttatgtgtttttgcaatgcttttatttttcgaaacataccactttaaccaacgaagttaaataggtgtaaataaaaaacggacagcgctcaggctgtccgttacacaatgaattaatcttaccgatcgctccgccttctgcggaagctgtgccctttgtcctggtacatactgaagtctgccttcgtgagcagcgcgtcaaaatcggtcgtcttgcctcgggtgcaggcgtagccaatcgccatgctgatgccgttgttggccgctgcttggcgcatgtgctggatcaacagcaggatgtctcgctcttccacgtcctcggtcacgacgataaactcgtcgccgccggtccggaagacgctgtcttcgcccgcgcattcccgcagaacccgcgcggcttcgctgatcaacacatcgccggcgtgatggccctttgtatcgttcgtattcttgaggccattcagatcgatagagatgacgcccagcacgccgtccccctgccaggcccggatccggtgttccagcgcccgtcgattgccgacgccggtcagctggtcgatggtgctttgcttttccagctcgcgcatgctgttccggttgcgcaccatcaccgcgatgaaatccgtcaaagtcgtgtacaagacgctgccggtctggaagctttcttccgacgggttgacgactaaggtaaagccttccgtctgattctgcagcaaaagctgcccggacacaaagcgcctgaccccgtggatgcggaacgaaaatcccggatgttccttctgaaacgcttccatgtcatcgaccatcaccagcctttttgaaacgaactcgctgtacagcgcccgcagctctgtcctcggaatgctctggagctccgcctgaagcgggaccacgcccggcgccgtccattcgtgggtagcgctgacggtattgtcgtcccgttcttcgaaaatgaggaaccgctctggctgcatgttttcggcaatgctcgaaaccgtcttttcgatgctcttttcggggtcggcctcctgcattccgtgggagatcgcctcattggcccgcatttcctggtagaccagttcatgatccttcgccagcgagtcgatgtattcgtccaggttgaacgagatcgtcaccttgagtgtgcgtttttcccacatggtcagaaaggagcgcgttaacaggttttcaccggttttatggttcatacgggataccgaaagcgcccgatccatccgcagcatcaaattcgggcagtcccggcacggcgcatcaaaaccctctaacacgttataacagcggcatcctttcaggctggcgtccggatcgaggcctaaatcccgcctcgcggccgggttcaggtagacgagctcgtaagtattcgggtcgctcatgataacccgttccgaaagcgaatccaacacttcccgcctgacgtagatgcggtcttcggtgtagggtttatccccgtacaccgctttttctgcattgctcagccgccggatcagaagctggagcatttcatcaaggctcatgacttctgagccgtacgctgtggcgtgggtcagcagaggattggtttggctgccgatctgcttccacagcagaggaagcgtcccggccacagcattgagcttttcttccaaatcccccgtgttctccttctgacagaagcagaggaaacagcagagcccgatccgcgcgatcgcccagccgggcgtcagcgcttcccgaagggccgtcgaaattttggccagaatcacccctgcattctctgcactgtcctgtatcacctccgcaaaggcgggcacgtcgatcagaagtccggcgtaatcctgtttccgcaggcgataatggtccgcgtagagcagaccggcctcgatcgcgccccggaagcttaaaagcttcgtctctgggtcgacaagtcccagacgggatgccccatcttcgtcttccggcttgtctccgtagaccatgctcagcgtccccgcaatttctttttcctgataccacggcacgcggacgatctgaacttcccgaagccggccctttgccagcgccagctctttctccccggccgtctgttgtgccgcttccccattcaggttgatggggttgaagtggcagccgatttcgtccgtcgtctttcccaagaacgcggacggatcgtgacatccttccttttcctgaagccttttactggcgccgaggatccgcccgtctcggtcttcccaataaaacgaatagggcgacgcttcgcagagcgatcggaaaaggctgctttccgccaacgtttccgggcgcacggcgctggtttttgaaattccgaaagaccggcagagcgccggcagaagggtctcccggtcgcctttccgctcccagatgtcctcccgttcgcagagcaggacgttcttcgctgcgctcttgtagagcatcagcgcctcgaacaccgtccaccggtacgtgccgtccgctctccggatacgcaccacctcagactgaataccgccttctgaggttttcctttgaggctcagtgctgataaacgccagaaagcgcgcccgatcgtcgggataaactaaattttctgtataagtgtccataaacgcctggaccgtacgcggcatcttatgcagctccggatggctggagcggagcacactgaccgcgtccgccccgcggtcgatcagataaaacccttcgtaaagctggaagatgttgcgcagggtcttgtccagcgttttcgcctgctgaatcgacgcgtcgttgctgatattgtagagatgggcttcgccgacccagtaccgattgtccccggcgacccatcggacgctgacccgcatgtactggccgttgtccgcgtaggtcagggtttcttccgccttcgactgcagggcctttgtcaacagccgatggaatctgccacggaacggataccccgcgtccacaaggttggcattggcctcggccatatcctgggtgccggtgcttctcaattcccgcttgtaggcatcattttcggcgagtaagataatctccgttccgtcgaagctgaaaagcgccgtcggcgaatcggagacgacgttaacgctctctgcagcgtccattaagtgggcttcctccggtttctccaactgaaaatgcttgctgtgaataaaggaaaaggtatcgtcgtacatcatcggccgcccgtagtagtacccctggatgcgcccgcatccgatcttttgcagaaaagcgacctgttcctgggtctccactccttccgccagagtctgcacccccagcatcctggccatcgtcaccaccgaggtgatgatctgccggctgcggtcgtcgaaatggctgaaaaagcccatgtcgatcttgatcacatcgaaatgaaagttgtgaagggaattcaacgaagagtactcgctgccgaaatcgtccatccacacctgatagccagcctgatggaattggtgcacggtcctggacatgttcagatggttcctgatcatgacccgctcggtgatttcaaaacagaggacggctctcggaatctggtagcgctcaaccatcttctcgatggtgtcgatggggctggccacctcgaagtcgtaggccgaaagattcatcgagacggggaccagcggcaggccgttgtccagccggtcgcggaccagccggcagacctgcttgaggacgtagcggtccagccggttgatgagctgcgcgtcttccagcaccgggataaagacactcgggtaaagcatgcccagctcggggtcctcccagcgcgccagtgcttcgtacccgctcagcttgcccgtcagggtccggatcaccggctggaaatacaccttgatgtaatgtttgtccagtgcctcgttgaaatggcggagcacgtaagtcttgttggcaagggtttcgcccatcgaaggcctatagatagcgacacttcgattgccgtctcccttgatggtgtcgcaggcgattttggccgagtcgaaggcgtgccgcagcgtatccatcgagtccgcctccgtcggcttgtagacgcccaccttcagctgaatcccgtcgtcgtggatgtagccgttcacttcactgcagacctgttccagcttcgcctcgagatccgtcgacggcaaaagcccgacgaatcggtccgccgtcaggtgcccgaccaacgcacccggaaagactctggtaatagtttcggccatcttcttcaggattaaatcgccccggcgcataccgtacagcctgttgtattcattgaagctggtcagatcaaaactggtcgggcagaaagcgcgcacctccgggaacgttttccgcttctgcgcctcgctgaacgccgcctcgaagaaatcgtgcatacccagcaccccggtcttatccttgaccctcaagtcgcttgccatctgctccgctgaaacaaatagaagaacgtaagcccgcccaaaaggcgtatccttcagcgtgccgaccccttccgcctttcggaagtggccttttttggtctgataatggaatgtaatcgtgaaatgctccgggtgtgcaccggccatctgtgaaaggggcttgtaatcctcgtcttccatcaggtttcgccagcttgcagaaaaaaactgcaggaaatcctccgcatctttgcattcgtagagcgacgccgccttctcgttggcaaaaacgatccgctctgtaccgtccgcaaggacaaaacagaccccgccctcgatcagatcaaaataactctggcactgcgcctgccggtgatcctccgcctctgatctattcatcatgatttcgtccatgccgttacctctcgctgaaccatccaagttgataaatacgcattcatcttacctcaatctcaaagatatcgtctgcactctgattttaatcatttcttttggttttatattaccatattttctcttagtgtactaaaaaaagcaaacgccatttttgacgtctgcctttgttcaaaatcctccacatctgatcaaactggctcacccgctatttcctcaagtttttccgataacgtttgtctgagtttttcaaatgcctggataaaactgtcacgaatcataatgagcaattcgtcgatttcagcttcattgtagaagtgaactgacaggtttcgcttttttaacatcatcagccaaacttcggcgtcatcgacaaagccaaatttatatccaagctggagcatttctcttggcaaccccgtctctgcgtcggcaacgccgtgatctctcatgaccgcctgcagcgctttccacgcgagctcaaaagttaaattgaactgcccaaccacaccggtccgataaatctcgttatcatctgccattttaaaatctgcctgctgcaaaacggctaagtatttcgagaaattatcaaactttttcatagagaatgaccccgtcctttgtaatttcttttctcagagcgtctgttatgggctgattcaaatcaaccacatcaaacattaaaagagaatggtttttttctttaaggtcccaataaaacccatcgacatcaccgccggatacggcgatatcaatgtcacttctctctctttgtgtaccccttgcacgtgatccgaaaagaatgatcttttcaatacgatgatcctgggcaatcttcgtcaattctctgcgtactcgatcgggaatgttgtattgcatttctgatcacctccgaaccgaatttgtcgtatttaagtttattttatcacatttcattttgccctaaaacacaaaaagcgaacgcggcactgcgtttgcttgaaatggccatctaaccggccgttgctatgatgatctcgttggttttgacgtttccacgtcatgtaatcattttgtatgtatttatgatcccagtccggatcatagttttcgccgtttgctgtcatctggcagtcgtgatacaagtcgtctgccagaatcaaaatgacatccttgagctccagatgatccgtgaatgctgagggaatgccgcttaagccaaggaaggtgccaacgatattgcccgtcaccgcgccggttgagtcgctgtctccttcgtgattaaccgccgccgtcaccgcttttttgaaatccgtgctgtatttcagcgaacaatagatggcaatggccagcgtttcttccgcgacccatcctgcaccgagctgatgaatcgcatccaaatcatctaaattttcttttgaaagttgaacggccttgcgaaccagcttcgaaagcggtgctattgattttttgtcgggaaacgtctcacgcaatgtcgtcatcgcatcgtacacggctttgtctacagtggcctctggatcgtgcgccaactcagaaaccatatccttccggcgcgtatttctcagctctctctttattgaacgtcacttcgattaccgatatttttacttttcttagtttttcacctttcattgtctagcctcactatgattggattcatgtctctctattcgtcatccattcttttttctgccgccctatagatgtgatagatcaagacgatagacgaaatcatccatatagaaaccatggccgatatcattcttttcggcgcgaatctttttgaagccaagatgttcataaacctgacacgcaggattcagcttattgacattcagctcaatgccatcgcgtccgatctttttcgtttcctgaacaataaagtcgagcatctgatgcgcgtaaccctttccccgctcgtcgcggtaaagataaaatttactcagatacatgacctgccctttcggataaaacgcgataaagccgaccgtccgttcaccgtcggccacgaaaaaataacgatacccgctgtcaagctgtttcgcgatcgcgtcttcgctctgaaacagctgaagcatataatcgttctgcgctttgccaatcagcggatcaaaatgctctctgacaatggcggttgccattttggacatttccgcgatgccctgttcattatcagcgcacaattctttgaaatgcaatgtctgtcactcctattttatattttaagctatgtgatgggatgttgtacgctgtgctgccgcctctgctctcatcattttaaattgttacttaattttaccacattatattcgacacaccgagacaaagaaaaaagcaaacgccgagtggcatttgccttaattcatagccaagtcaatcattgacaacatgcagtttgatctttggggcgcggttattgcagctctgtcaacacttcgccaatatcaccgtcgagacaaatgctgcggccttcaatttctttgggacagaaggcttcaccgtaattgacacaggcgtacaccgccttttcgttcgtcatcgtcatctgccaaaacgggtatttgacgatcaccggtgtgttcgcgccgacgccaagctccagaaacagcacgtgaagcgattcgtgctggcgcaggaaatcggcgtacgcggccgaggcccgatgccagcccgcatcctctacaaaggactcatccacccggaggttcatcaccacatctgagccgtcagctgggcatttgggaataagctctgttggaatccgcatcgcgatcccgctctccggcacctggaagatgccgtttgcgtctttttcaaatccctgagccatcatggccttcgtgacccacgcttcattgtcgtaggtgtgctgattttcaaaatttacgctctggaacaggccgtaatcgccctgagtgtagaaaagccgctttttatcaaacccagcccgctgaaactggtgatccacattcgtcgtaacgacaaaataatccttatctttgaccaggctcaaaagctccggataaaccggcttcggcgcgtcgatatagcggttgtaataaatgtgccgtgcccaccacgcccagagcgtctcttcgtccgggaacggataaaagccgccggcatacatatcgcggatgccgtaggctttggcaaaatcgtagaaataccggttaaagcgttcgccgttgtaggtcagtcccgcagaggtggagagcccggcgcccgcgccgatcacaatagcgtcagcgttggcgatctcatctttcaatcggctgagcggttccgctctggtgccggtcccgtggccaatctggccgctgatcatccgcaccgcacccagtcccttttggatgctttcctggtagccgttgggaatatcatcgtaaaagtttttcataatacactttgtcctcgtctttaaacacattgaagatcacccgttccactgcgcctgggtgagccgtcatccattggtcgaccgtgtgcaccgcgatctccgccgcgcgctgatttgggaagcggaagaccccagtcgagatgcagcagaaggccacgcttttcagcccattttccctgcacagctcgagggtattgcggtagcagtcggccagatctttttcgagggtcgacgtcagcccgaaatgcacaatcggccccacgatgtggatcacctttttggccggaaggttgtaggcgtccgtcagcatcggcaccgcggtcggctgctcgtaatcccggccgtaccggatccgcagctggttcatctgccgattgcattcggcgcgaagctgcacccccgcgaaggtgtgaatgcagttgtcgatacaggtgtgcatcggcacaaagcagccgagcatctgcgaattggccgcgttgacgatggcatcggccccaagccgcgtgatatcgccctgccagatggacaggccgtccctaatcactggaatgtccgaaaggatcacaatccccttttcctgcgcccgcgccgacagataagcgtcctgcacgcgcagcacgtcgtcgggcacctgccgcggcatacggatattcatcagcgaacgcaggaaggtgcgtttaccttcatcatcctttggcgtttccagatctttatattcagcggagtcggctttgaacgcgtccacgaggaaatccagccgctgcgcttgagttgttaattcttccacagtgtccacctcccaaatctacaattaaaatggtgtgacttcaattacggtgtggcatcgcattgccagccacgtcatctttctgtaattttcttcattacatttaatgtgtctattgtaacgtcaatttgatgtcatgtcaataattataataaaaaatattacaaaaaaaagcaaacgacgatgcgtttgctttttcaatatatcgtaataatttatgcttcgctgaaatgtgcctttgcgaattccatatcctgaaccagctcgacggtgcccaggtatttcccgttccggtctctgaccgccgtgtaggtaaccagcatggttctgccgttcttttccatccagactggcacgctgtccttttcgccggagcggaagctgtcgaggatggcgcgcaccatcggttcgattttcggcgggtggcaggagaagacttctctgtcgatcgccgcttgcgggcgtttgaacaccttcggcccttcgttgaagaagcggttgatgttgtccgcgtcgatgaagctgatttcgagaggaatggtgttgagcagcgcggtcagctgttcgacggtcatgtggccgcccggcatcacaacttctccatctcttggcagcacgtcggtcaatgccggcgcctgttcggcttcgtcccaggtttcccgttcaacgccaaagaccaccgcgtagtccttttcgtcctgataaattgagaaccattcggcctgggtgaagttcaccgcgcagatcgggaaaaggatgttgctttccttgtagatcatttcttccgcgcggacaatcaccttttcgaggcggtcgcgccacgcgctgtcatgtgcttcgatttgagcgagttcccctaattcgtcgcgaatttcatcgtcgacggtccacatcacatcggatgggccggaaataccgtagttcaccttcaacagcgggtagatcaaatcgccctttttcgcgtagtgcaccgaaatttcccggagctgcgcgaacaattctggtgtcaggctgtcgtccgcgagggcttcccgcaccgctgcgatgattttttcgagggcatcgttttcccgtttgaactggcgcattggatgaccggtaatcccagccagagcccgagcccgttcgtttttatccacgcctttgaggtcgggcgccgccgccgcggcgtttctccgatccatcgacgcggcgacttccttttccgcgttggcgatttgttcttcgcgggtcgcgccgtggaacaatgcagagtgcacgtcgcagagctgctgcacttcctgaagcggggttccttccgcaaggagttcctgttccgcttccatgatttcagaggcttccacgtcgctgaaatgggcgacgaaatcggcgcggacactttcgaggtcttcgccgtcaccgagacgtttgaggtagccctttaacatcgccttccgttcgtcggacatcggggatgccgccttcgcggacggcttcgcacccggtgcggcgcccaccgccggcatgtcgccggccggttcgaagccgttggcaagcagcgcccgcgctacatcgatcatcgaaatgtgcttcatttttgcgcccttcgggatcgtcatgaccttgcctacggagttcagcatcgcctttttcgtcacttccgtaaagcccaaatcggccatgatgtctttgagttccgggtactgtttcacgagggtgtacaccgactgatttaaatcaatttgctttgccatgattttgctcgctttctaaaacccttaggctgtcgtttattcaagggtcagcagcagtgccatcttgaatttttccgtcgcttttactgaatgcaggccgcccttggcgaagtggaagttttcgcccgctttaatcggatgatcttcgccttcgtagccgatgaccccttcgccgtcgagggcgaaaatcagcgcttcacccggcgccgcgtgttccgagagggctgtgcccttgtcaaaggccatgacgacaaatttcatcttatcgttgtggacaacgtccatgttgacgatttttccgtcctgatagggtaccaattccgccaatttaaaaacttcacctgcgtgtactgcctgattcattgtatcctccttgtgaatttcaatttctgtataaaccgcgccgtctgctgtgcgcataccgatgggctgatccgtcggcgtcaggatgccgtctccggctgaaagcccgcggacaaagccgtcggtcccgtaaacctcaagactgccctctgcgactaaaatcaatttgtaatacggaaagatttccgcgctgatgtctgttcccgccgcgagagagaaaaccacgaccgcgttcccgccgtcgtaaacggacttagaaatggtgcatcccggcaccggttgattgtccttcgcgatggcgaaaacttcaccaactttttcgttcatgactggcatcacagtcaccgcctttctgaaattttgatatttcgttttttatttactctttattgtgctttgattatgtcacatctgtagtagacggtctgtggttttaacaacattctaaaaaataatttgaccgctctgacaaacaaaaaacagcacctgacttttttcgagtcagatgccgttttgttatcttaatccacacaagccacttgatctttgccgcgccgtctcgccaagtgcatggcctggtatgcgcggtcgatcattttctgtccttcggcagccttcgtggtgtagccaagggaggcagtcaaggtcacctcttcaccgcgatccaaggccacccgggtctgacgcacgatttccaaaagcgtcgttgcggccttttggatgtcctgcccttcgtttcgacttaatccgacaaaggttttaccggcgtaacggtaaaacttgattttgttctttgcgccaaaatccaaaaagattttccccaatacccttaagacctgatcgccggccgaaaagccataagtatcattgactttattaaaatcgtcgagatcgagcatcatcactgccttgaatggagctttattcagcgcgtcgtgcaagtctagacggttgtttaaccccgtcagactgtcaaaataccggtaataatcttccggcgaagccaattccccggccttctctctttcgatttccagctctttgatatggattttttcttttgagatgtcgacgccgtaaatcaaactttcgatgtggccattttctggattgtcaatgagctgcgccgtgatccttgaccatcgaatcgagcggtcatcgtaatacgacaacgtttcaagaatgatttgatattttccttcagcgtaggacgttaattgcttttcccggttaaaggtctcaaaaaaccgcttttgcctttcttcgtccggcacaaaagagccgatcatccgaatcagcgtatcgacgtcctcgacattctgcatattccgcgcgttttgtgccttcccgccggagctcagccacttgtcagccgtcaaatcgacgtggaaaattccctggccctccggcacattttcaattatcgaccggatatggctggcgtatcgacgctgatccgatttcgtcgctgtgacgtcccggccgtattcgatgaagaccttccggccgttccatttggcgtaccggcccttcaaatcgaaaatatggctgccgtcgtccacttcaatgtttttttcggtttcaccggccatttgtttcatcgggcaatggccgcagggcgcgtcaaaaccgagcatataccggtaacatttctcgccctggtagggcttgtctggatgcccggagacctgccgcgtcatcgcgttggcaaagaccatcgtgtaatcttccggataacagacttggataaactgcccggagtggtcaaccagatcgaccaggttgtcaaaatcaacttcctgttcctgtgggagatgggtgggcaaatcttcctgcgcgatttcgtcctggttggacatcagataaccgaaaaacgtgtcttcatccatgggcttcgcataataatacccctgaatgtaatcgcaatgatggcgctttaaaaagtccagctgttctgccgtctccaccccttcagcgacggttttcagcccaatcttgtggcacatctcaatggttgaggtgatgaccgcccgcacagttggtttgctcacgatttgatcgataaaggatttgtcgatcttgacaatatcgaagggatagtcgccgatcatgcccaacgaggagtagccgctgccgaaatcgtccagcagcaccgacgcccccatctgctgaatctgcttgagcaggtaggcgcagttctgccttaaaacggccaccgacgtttcggtcacttcgtaattgacggatcccctcgggaacgcgctgtccctcgacaagttgagaatgtcgttcatcaaatactcgttgtaaaaatcctgccgggacaaattcacagaaaccggaacgaaagccatccctttgtgcatcagcatctcctgaaaggcgtagacgtgtttcaaaacgtaccggtctaatgcggtgattaagccgcccttttctaaagccggaatgaaaagattcggccccacaaatcccatttcgggctgcacccagcgaaccaaagcttctgccgagacgattttttcatcccgcgtccggacgatcggctgataatagactttaaaatcctgattgcggatgctgttctgaaaactggaaatgatttcggcgtgatcgatgtaggatttccgcattgtttcattaaaaagaacgacgttgccgtaccccttccggcccgcaaattccttcgcgagaatggcccactcgatcatgttgtgcaccgacacctgccggttttcaactttgtaaacgccgcagcgcagatgcagatgcaccgtacggctgtcattgtgccactcgatgttcagcatgtcgttcagacttttcgattcaatcttttcttttttgaccagaaagacaaaccagtccgattcaactcgagccgaaatcacaggctgaagccaactggttctcaacgtttcaaaaacgtatttcaaaacctggtcaccgccctcgaggccaaaaatatcgttgactgccttgaaattgtggatgtcaaacatcacaatggcgtaaacagtttggtcggcgtttttgaaaaggcgctccgtctcccggataaagcccttcctggaatagccctcggttaaaacgtcataatactcctgctccaacagccggtcgagttcagcctgtgtcttcggcagcttggtcgcgatcatttcgctctcgcccacagtactgcagaccaaggcatgcccgacttgtccgccgcccaaatccatttccactgcgtcgacggtttcgtaaatgccgcggatcgggtccaaataagtctgcgggccgtaaatgtgattcgcgaccggacagggcggacaaggcgcgtccagattcatcagacattgatggcattttttgcccttttttaactgcgggtacattgctttgatcgtctgattataagtgacgatgttataatcctgatcgatgacgtacacgcctgaggattggtcgctcatatttttctctctcctattgaaattattctcatagtcatgttttttattataccacatcggcagtcttttgaaaacgatcacgacaaaattacaaaaaaatcggcggcctctcgtctttcagacggagaccgccaaatcatcaaactgcctttattccaccgcgtccagtgcgtcctcgatcggcgtgtccccgccggtcatgtagatgaccttgcggaaggtgttcggtttgtcgagcaccccggcgagcactgccgcgacgtccggaatcggattagacgtgccgcgttcaggattgatttcgattctgcccgtcgccggttcctcggtcaagacgcatggcccgacgatcgtgtagtcgaggtcggtgttgcggatcagccattgatcggcaaagaaacgagcgatgtcgtaattcataatcgacgcgagggagggctcttcctgccatttttcaggctggatcgagtaaatcgagctcagctgcacgtagcgtttaatcccagccttttcacaggcctgcatcagcttgacacagccaaaggcgtcggtctgaagcagatccttgcctctggatccggcgagaaagtacacggcgtccatgccgtcgatctgcgccgccagcgcatcgacctctgcgtgaaggtccaattcctgaggataaatatggtcccccattacaatgtggtccttgtggcgcgcgccggcgtaaatgtcgtgtccctggctcgccagaatgcggatcgtttcggtggccactctgccgctgccgccagctacaaatattttcacaatgctcacctccgtgtttgaatattaactttaaatatatcaaatcccgtaggaaaagaggcgatgttttttcataagtacactttgattaaggaaagtgccagctatctcacagcccccgcagccattccggcttgaaattttgattattttgaaccgtttgaatcgcgtcgagcatcttcgggatgtcggcgtccagggttccgcgcaggttcagataattgctcgcgtgattgccgcggaagacggtgccgggcgacgtgacgttttgcaaaaacagcgccatctcctcgaggtcttcctcgggcgaaagcatcgcgaaggcgcccgactgcacgtccttgagcagcggcgcccccggttcaagcattagggtgagggccccaaggtaatccggccgaattttcgagacgacccgtgcacttgccaccgcgtgttcctgccacagcgtttttccgccgaggccggcgatcatcgtcagcgaaagggccatacccgcagccttgagccgttttccagctgcggcgatttcttcggcgctgacgcccttgtgcacgcgtctgagcacctcgtcgctcccggattccatgcccatgtaaatcatcgaaaggcccgccccgcgcagtgcagtgagtgccaaatcggatttgcccagcacgtcggccggcgcgccgtaggcggtgacccgctccgcggcgggaaaggcgttttgcagcacgtcgagtatccggagcagctggtccgtcggcaggatcagcgcgtcgccgtccgccaggaaaatccgccggacctgattgccgtaacgcgcggccgcctcccaaatgtcccgttcgatctcgtccatcggccgaatccgaaagcgcttgtccttgtacatgctgcaaaaggtacaggtgttgcgcgcgcagccgatcgtcacctgaaaaatcaagctcccagcttcactcggcggtcggtaaagggtgccttcgtaatgcacgatgtcctcctcgtctttttccgctttttgatttatgtcatttcttcaagattatttttgccaaaatctgcagtttcttcaaaacttttttctgctaaatctgtcgtttcttcaaaatttatgattaatctcatgaaaaaggcgaacgtcaatgcgttcaccttgtgtgcgtgttgcgttttttaatgaatcaaatagccgccgaaaaagacgcagagcacgaccagcggcagaatgtaggtcagataggtccgcgtcatggcagtatccggcatccgcagcccttccccttcgttgacttcgtggatgaagccgtcgtagccccagcccttctttgtcatacagaaaagcaggtagaccaacgagcccaggggcatcagattgttgctcaagataaagtcttcaaaatcgagaatcgtcgtgccaacgcccatcgggtgcacgccggagagcaccgagaagcccagggcgcagggcagggacagcaggatcatcgcaatcgtgttgatcaaacaggacgtcttgaccgacacgcccttcaaatcggtcatgtaggccacgatgttctggaacaccgcgatgaccgtcgacatggcagcgaaggtcatgaacaaaaagaacagcgcgccccagatctggccgtggggcatgtggttgaacacgttgggcagcgtgatgaagatcagagacgggccggccgtcggcgtcacgccgtaggcgaagcaggccgggaagatgatcaggccggcaagaatcgcgacaatggtgtccagcgccgaaatcgtcactgattcgccgaacaggcgcttgtccttgtcgatgtaggagccgaagatcgccatcgacccggtgccgatgctcagcgtgaagaaggcctggcccatcgccgcgaaaatcgtcttgctgatgccgtatttgaccatgttgtggaaattgggcttcaaataaaagctgatgcccttagccgcaccgggcagccgcgccgagttgaccgccagcacgaccatcagcagaatcagcgccgtcatcatcaccttgacgatgcgttcgacgccgccctgcagcccgccagcgcagatgccgaagccgatgagcacgacgagaatcataaagccgacgcagagcatcggattggccgtaatcttcgcgaaagccgccgcgatctgtgtggcgttcatgccgttgaaatccccgcgcagcattttcaggaagaacagaatcatccacccggaaatcgtcgtgtagtacatcatcagcaggtaattgccgaacatcgcgaagtatttgtagatgtgccacttagtgcccttgggttccagctgctcgaaggacagcgccgtcgagcggcggcttgcccggcccaccgcgaattccacggtcatgatcggaatgccgagaatcaacaggaaaaacaaatacaaaattacgaaagccccgccgccgtagcgcccggtgatgtacggaaagcgccagacgttgccgaggccgatggcgcagccggccgaaaccagaataaagcccagccggctcgaaaacgtctctctttttttatcagtcgccaaaaacttctatcccctttctgacttagtgaatcaggtagccgccaaggaacacgcagagcacgacgaagggcagcacgtaggttaaatagcccttcgaaacgccgccttcgggcatgcgcatgccttccccttcgttgacctcgtggatgaagccgtcgtagccccagccctttttcgtgacgcagaacagcaggtaaatcatcgagccgatcggcatcaggttattgctcaaaataaaatcttcaaagtcgagaattgtcgtgccgatgcccatcgggtgcaccccggaaagcaccgagaagcccaaggcgcagggcagggacagcaggatcacgactacgccattgatcaggcaggcctttttaaccgacacagaggtcaaatccgtcgcgtaggacacgatgttctggaacaccgcgatgaccgtcgacatcgcggcgaaggtcatgaacaggaagaacagcgcgccccaaatctggccgtgaggcatgtggttgaacacattgggcagcgtgatgaagatcagcgacggcccagccgttggcgtcacgccgtaggcaaagcaggccgggaagatgatcagccccgcgagaattgcgacgagggtatccagcgcggagatcgtcaccgattcgccgagcaggcgcttttccttgccgatgtaggagccgaaaatcgccatcgcgccgatgccgatgctcagcgtgaagaaggcctgacccatcgccgcgaaaatcgtgttgccgatgccgttcttaaccatattgtggaaattgggcttcaaataaaagctgatgcccttggacgcgccgggcagccgcaccgagttgaccgccagcacgatcatcagcagaatcagcgccgtcatcatcaccttgacgatacgttcgaccccgccctggagcccgccggcgcagatggcaaagccaatgacgacgacgaggatcatgaaaccgacgcagagccacgggctctgggtcacctgggtgaaggccgcggcgatctggttcggattcatgccgttaaaatcgccgcgcatcatcttgacgaagaacagcaccagccagccgcagatcgtcgtgtaatacatcatcagcaggtaattgccagccatcgcgaaccacttgtagacgtgccatttcgtccctttcggttcgagccgttcaaaggacagcgccgtcgagcgctggctcgcccggcccaccgcgaattccgccgtcataaccggaatgccgagaatcaccaaaaagaacaggtacagcagtacaaaggcgccgccgccgtagcgtccggtgatgtaaggaaagcgccagacgttgccgagaccgatggcacagccagccgaaaccaaaataaaccccaatcggttcgaaaaggtctccctttttttctccataaaaattaattctcctctacttaaatttttttatcttcaaacggatcgtgccgccggctatcccaaatagccgccgatcatgatcaccgcgattaaaattggcagcaccacacccatatagaaccggctgccccgtccttcggggaagtacaggcccgttccggtgttgacctccgacaaaaagccgtcgaagccccagcccgctttggccgtgataaacagcacgtaaatgatggagcccaccggcacaatgttgctcgagacgaggaaatcctcgaggtcgagaatcgtcgagcccgcgcccagcggctggataaaggacagcaggttaaagcccagcgcacaaggcagggacagcagaatcaaaagcaccgcgttgatcgcgcagctttttttgaggggcatgtccgtcacatcgcggaaatttgcgatgatgttctggaacacggcgatcaccgtcgagagcgccgcaaaagtcatgaacaaaaagaacagcgcgccccagaaccggccgtggggcatgtggttgaacacgttgggcagcgtgatgaaaatcagcggcggccccgacgtcggcttgacgccgtaggaaaagcacgctggaaagatcaccaccccggcgaggatcgcgatcaccgtgtccagcgcggcgatggtcaccccttcgccgaagagccgtttttccttgccgatgtacgcgccgaaaatccccatcgagccgatgccgacgccgagggtgaacaaagactgccccatcgccgcgtaaatcgtctccggcagcgtcttcagggtcatcgcgccggtattgggcttgagataaaaagtcatgccggccttggccccgggcagtctgatggaattgagtgccagcagcaccatcagcacgaacagcgcgaccatgatcaccttcgtgatccgttcgacgccgccctgcagaccgccggcgcagatcgcaaagcctacaaccacgatgacggccatgaagacgactgaaaccactggactggctgtggtcgccccaaaggcctgagccacaccggcgcttttcagaccgacgaaatcgccgcgggccgtcttgaagaagtacagcagaatccagccggcgatcgtcgtgtagtacatcatcagtaggtaattgccgaccatcgcgatccatttgtagacgtgccactttgtgcccgccggttcgagcacgtcaaaggagcgcatcacgctcttccggctggcgcgcccgacagcgagctccgccgtcacgattggaatcccgagaatcaaaaggaacaaaatgtagatcagcacaaagagcccgccgccgtacttccccgtgatgtagggaaaccgccagacgttgcccaggccgatggcgcagccggccgaggtcaggatgaagcccagccgactcgaaaatttttcctctgaatttgtttgatttgtcatatccgccttgcctttaaatggattttaagataaatttaatacaaagatgtttattattctatcatatctgccggcgatcgtcacaaatgattaaagccggattaaagttattttcgatagaataggaaattgcctaaaataagaaaagtcgcgatcgacacgatcgctcaaggaggtcaatacatgagcgtactcaccattacaaaggataattttgaacaggaagtgctgaaggcggacaagccggtgctcctcgatttctgggccagctggtgcggcccgtgcaaaatggtttcaccattggtcgatcagattgccgaagaacacgacgatttcatcgtcggcaaggtcaacgtcgacgaagaaccggacatcgccaaggattacggcatcatgagcatcccgacattaatggtctttaagaacggtgaaatcaccaaccgtcaggtcggcgccgtcccgaaggaccgcatcctcgcgctgctcgactaattttaaaatctgcacagcaaaacggccagccgaaaaattcggctggccatttttttgcccgaaacatgaattttaagatggcaactgggctttcatttcccttttcatctgccggttcatgtggccataataaatcagcgcgacgatcacgccgaacaccgtcgaggccggacacgccaaaccgatatgggtcagcgaagcgtgaggctgagtgctcatgatgtaggacatcggcagccgcgccaaaaacgtctgcagaatgccgcagatcatcacaaaatgtgaacggtcgtggccgttgaaataaccgtaaaggctgaacagcagagatgtcacaatcgcttccggcccgaagccctttaaataatcccagctgttctggatgaaggcctgccgggtcgtaaacagcgacgacgccgcgcctccaaatcggaagaccagaatcaaaatcacgacgccgacgcttgcgccgaacaccatgccgatgagcatggccttgcgcgcccgatcttccttgccggcgctgacattctgggaaatgaaggccgacatggactgcatcatcgagctcggcaccagcatgatgaagctgatcaatttgctcgcgacgccgtacccggaggaggcttccagccctagccgattgataaaggcgcagatggccatgaacgagatctgggtcagaaattcctgaagggccagcggcagaccaattctcaaaaaccgccgcacctccgaattgatccggaaatgggatgccttcagggtaaagggcagatcctttttgctcatgatcacgagggacagcacgacgctgatggcctgggccatgatcgtggccagtgccgcaccggcgacgttcatgtgaaacacagcgacgaagagcagatccccgaccacgttgcacacgcaggcgatggcgacgaaaatcagcggcgtcttcgaatcgccgagccctcggaagatggccgcgatcacattgtaggcgacgatgaagaatatcccggcgccgcagatgcggatgtactgggccgtcaagtcgagggcctccggcggcgccatcatcagtgacgcaatgcccttggcccaaaccgtcatgatcacgcacagcgcggcggcaatcccagcaaaaacgagcactgcaccgccgatcagcgggccgattttctcgggcttgcgttcgcctaaatcgtgcccgatcacgacggtgactcccatggccaacgcggtgataacaaaggtgaccaggttcagcacattgctgccggtggagacgccggacagcccagcccgggagccaaagcgcccgaccacgagcaggtccaccgcgccgtacatggcctggagcaccagcgcgccgaaaactggaatcataaatttaagcaatttgccggcgattcggccgtgggtaaaatccgactgattctgttctgccgttttctccattttctgatctccttgcatgacatgttattatttttttatttattgcgcaaaatttttacttttgtcaaaatctgcaaggtattatatgcattgtctgtctcgatttcaaggccatacctgaattttaccgtcgtttcccgggaaatcgccgcgtttcggttcagtttcgttttattaacaatacaatgataaaaatatcagtgcgaaaccctattttgaaagacaggcaaaataaaaaagctgtccgtgatgaacagcttgaattccgtctgcctcagcccgcaatggcgcggaccgtattttcgtacacgtccgccagcgtgtgatggcttaaatcttcctcgaaatgatggtgaaccgattcgagggcgtcgtccagcgcgtagtgaatgttgcgccccaccggacactgcggattcgggttggcgtggaagcggaacagcgcctcttccccgtgggtttccaccgcgcggtacacgtcgaggaaggtgatctgatccagcggccgggtaatggcgatgccgcctgggccgcgcttcaccttgatcagccccgcctttttgagctggcccatgatattccgaatgatgaccgggttgctgcccacgctggccgcgagaaattcgctggtcaccttttgatccttagaaaaataagctgtcgccgtcagcacgtggatggcgatcgtaaattttgtcgaaacctgcatttctgcctcctctatctcgatcttctgcgctttaactgtaatatatgcgatttcatcgtttttgtcaaaccctatttaatttttcattaaaaaaggaccggggatccggccctttcgtcccatcagcggttgagaatttcggccgcttcttcgccagtcatgccgtcgtggacgccgagggccttcgccgccgcagtcatccccttgatcgggttgtgcagcaccgcgtcaaaatccgcgccgccgacgagcaccgccgcgtcgccaaatttgtctgccgcgtccagattcaggtagccgcacatcaaatagcccttggcgcactgaatcagaatcatgttcgggtggccttcgccgccgggagactgaattaaaaggccgtcgctccttttgccgtcaatttgaatcgcatcgatcgtaatcatggtttcacctcaaatttgttatttgttttgattttaccctcactggccaccggtgtcaatgcggcagcccttccccgtgtgttataatggggcaaaccagaaaaaagggggaatttttatgttaggtgcagtattcggcgacatcgccggctctgtctacgagggccatcctgtgaagacggtggattttccgctgctccccgacggcgcgcggttcaccgacgacacggtcatgaccttcgccgtcgcaaaggccatcatcgaagcggacgctcaagacgaggcggtgctgaaaaaagcggtggtccgcaacatgcaggccatggggcaggcctacccgcaccgaggctacggcggctatttcagcaagtggcttcacgccgaggaccctaagccctacaacagtctcggcaacggcagcgccatgcgggtctcgcccgtcggctggattgcccgttccgttgaggaggccgaagccctcgcaaaggccacagccgaggtgacccacaaccatccggaggggatcaagggcgcccaggccatcgccgtctgcatcctcctcgcgcgtcagggcgcggacaagccgacgattaaacgcaccgtcgaatcgcggtacggctacgatctctcccaaagcctcgacgccattcggccgggctacgcgatggacgcgacctgcccgggctctgtgccggaagccatcactgccttcctcgaagggacggattacgagcacgtcatccgtctggccatttccctcggcggcgacagcgacaccctcgcctgcatggccggcggcatcgccgaggcagccttcggcatgccggcggttctccgggaaaaggcttacgcgatgctcgacggcaatctccggcggctggccagcgcgttctcggccttccgattcggaaagctcggcgcgtgatggcgaacgccaagcggggcttcgtccccgaggatcgccgcaatttttcctcttccgccctgcccgtactccaggcagcgtcaagcgacgtctgccacctcctgaaccgcggctacagcctgagcccgaccctcaccttcgtcgccaaccactaccagctctccgtgcggcagcgcctcgccatcatgcgcagcgtctgctcaaccgagcagcgagaacagcgcacccgaaaaatcgtcgaccccgccgctttaaaggggcagaccgtctggatcgacggcttcaaccaaatcatcacgctggaggtcatggcctgccgctcaccgctgttcctcggcatggacggcgccgtccgggatctggccgccctccgcggcacctaccggctgattcccgaaaccgcttgggcggtccgctccctgctccggtttttaaaatcagttgacgtcggcgctgcggtgatcctgctggacgcgccggtgtccaactccggacggctgcgccaggcgattttcgaggccaacgccgccttcggcctggacctcgccgtaccgctgatccgcggcgtcgacgccgagctgtccggccacaatttggtgatgaccgccgactccgccgtgctcgaccgatgcgccggctggatcaattttaccggcagcctcgcccagcaacagccctatccattgattcaggtttggcaataatgcatctatttttttataaaaacaagtgaaaggacacgttatgacaaatacgaaaaaatgcgcgttacttttccccggcgtcggctacagtctcgaccggccgctgctgtactacagcgccaagctcgcgagggcggccggctgggagatccagtccgtcggctacccagaattcaaaagcgccgcgatcgccgacatgcgccaggatcaaggccgccgcgaacgggccttttatcaggcactgacctcgatccaggggcagcttcgcgccttccccgattacgacgactacctcttcatcggcaagagcatcggcacgattctcgctgcctacctcgcccacgagcaattcaccgacaaaccggtgcacctaatcgcctacacgccgctgaaggaaaccttcgacttcgcccgagacggcggcggcatcgcgttctacggcagcgccgacccgtgggtcggtcaggagacgatcgtttccggcgccaaggcgcgccacctgccgctgacgatctacgccgacgccaaccattccctcgagaccggcgacacccttcacgatctcgacatcctgaaggacgtgatgacacacaccaagcgctacctcgacaccctttgagcctttattaaggcaaagccgattttttacagatataatcaaaatatcaacaacaatcaggaggcataatcatgagtttaaaagacatcggcatcaagccgattttattcccgcagccgacgtacatgatcggcacctacaacgatgacgattcggtcgatgtgatgatgatggcctggggcggcgtctgcgcccgcgacatggtcgcgctgaacatcggcgcgcgccacaaaaccagcgccaacatccgcaaacgcggcgccttcaccctcgctgtgccgggaacggacaccctcgccgaatccgactacttcggcatcgcgtcagccaacgacgtcaccgacaaatttgcgaaaaccgggctgcacgccgaaaagagcagccacgtggacgcaccggtcatcaccgaatacccgctgaccttcgaatgtgaagtcgtggaaattcaagatcagccctacggccagagagtcctcggcaaggtggtcaacatcgtcgcggacgactcggtgctgaccgcagacggcaaggtcgacgctgaaaagctcggcgccttcgccttcgacggcgaccagaacggctattacgccatcggcgaacgggtcggcaccgcctggggcgacggcaaaaaatacatgaaataattttgagaatcacgcaaaaagacgcgccgaacagcgcgccttttttaatggattttattaaagattatttttttgcttgaatcgatggatttaatgtcacttccgccaatgccggcagctccttcttaagctcggccgcgtcgaagggcgcgccgtgtcccggataaatgcgttcgggccggacgtcgatcattttctgccagcttgcgcggtaggcgtccaaatcgccgatccaaatcgtcgttttaagcggccagtccgcccgattctgggccgcgtcgccgcagaacagggcgccatcccacaataggccgatgctgtcctcggtgtggccgggcagcgcgagcaccgccgccccgggcaggatctccccgatcgtcccgtcctcgacccaaagaaagcgggaaagcagcccttcctcgatcgccggaaagcggtgccggccgtggccgtcccggatcatctgccggcacacggcagccgcgtcgtcgtcgggcacgccgccgcccggtccgttctgtccccgccgaagtcccgtaagcgtctttctcgaggtgatgactttcagccccggcaccgcctccatcacgtcgttgacaaagccggcgtggtcgtcgtgggcgtgagtcaagaacaagtaatcgagggccgacggatcgagatccaccgttgccatccggcttaaaaaatggggccagtcttccgcgtagccggtgtcaatcaacaccgtcaggccccggttctggactacccagctgtggacgaaatccgtcccgcaatcggcaattttcattttttctatttcctatgtttctcgttcttttaaattttttcttataagtaatacacgtggggaatgatcgcttcgtaatggccatcgtccattctaaagccccgttcaatggtcccgagctgcttgaagccgatgtccttgtacagcttcagcgccgcctgattcgtcgcgaccacggcgttcagctgaatgatgccgtagcccaaatcccgagcctgggcgatcgaatcctctaccagcagacggccgatgtgctgcccgcggacctcccggtcgacggcatagctcgtgttggcgatgtgcccgcagcggccgacgttgttcgggtgaagaatgtaaaggccgacgatggcgccgctttcagtgtcgtaggcgatgccggtgtaatcctgcttcgcgaaaaaggccttcccttcttcgtaggtcaaaaggttcgtctgcggaaaggccttgccctcttcgacgatctgattccaaatgcgcacggcgcttcccacttcttttacggtccatttcttaactgcgattgtcatgattgcctccaaatgcgtcgtattttcaatgcgattggtcattgaatatgctttatttaattaaattgtatattttcattatatcacaaccgcatcgcgcaaaagaaaaaagaatgtaaatccaaatgaagaaaaagcgccgttttgtaacctgtgaaattgtactgaaaaaagaacaaaaaaagataatattttgtgattgccttgaatttccgcgtcaacccgcgtaggatacgggtaaatccacttagggaggtaaaaaacatgactgctcttaaacgccatggcacgttcattgattttctcgtgattgtgatgctgcttttggcttggcccatgggcgtgattttgatgtgggcgtacaccccgtggtcgagatccgtcaaaattgcaatcaccgtttgtctcgcccttctcacgatcctgaccgtcaattcagtctgttatttccgcatcatgccctcttaactattttctgactgctccgccgctgcctttcggcagcggtttttatttttccgaggtcttttcaaaaatcggactggccagcagatcgtcgatcagctgtttggcgtctgccatcgtcgcgtcgctgtccctttctacgccgctggcgaaaatgaacccccacagcccaaaggtcaaaaaggcgtccaattgtcccggatggtactgcgtcttcagccgatccgcgttgatctttccgaacattttcaaattcttcaggacaaaatggtagtacatcgaaacggccgggctcgcctccgtttgaaccgacgctttgacaaagggcgtcgtcacctcgatgagcaccatcagaaaatgctggcaggaaatgttcagccgatgttcgggattgtccttttccaattcctcaaaccgcgccgtcgcctcttcttgaatatcctcaaagcagtgctcaagcaggtcgtacttgtcgctgtaataggtgtagaaggtgatccggctggtgttggcccgcttgcagatttccgtcaccgaaatcttttcaaagggtttttccaaaatcatctgccgcagggtattttttaaatttttttgagttttaatgatccgcttatccattttcccatattttttatctagttaatctacattaattaaacgcatttcacaaattgtaattgcgaaaaactgagccaatgattataaatagatttagtcatgttaattaacatcggtttacaaaatgtgacttaattatacaatcatccaataaactttacaagtatataaataactattttacacgcattaaagaaaggataaatgaagatgaaaatcgtcatgatcaccccgacaaccgcgctgcgccgacttcctttctaccgctggggcggcaaaatctacggccagtccaactccattactggcccgctgatcctcggcggcatcttaaaaaaagccggtcacgaggttgccgtttacgaggagctcaacgccaatatccacgtcaaccgcctcatcgccgaccccagcgtcgacgtcttttgtttttcgctgatgacctctaacgcgccgcggggctacgagctggccgaccgcatccacaaggagagccgcgcccgggtcatttttggcggcatgcacccgaccgcgatgcccgaggaggcgttgaaacacgccgatcaggtggtggtcggcgaggcggaaaaggtcatcgtcgacgtcgtcgagggccgcagaaccgagcccatcgtccaggggattcccctgacctgcctcgacgaggtgcccttccccgattattcgattctcaagacgccgtgcgaggcggccaacgtcatctcgacccgcggctgtccttaccgctgcaccttctgcacgacctcccggatgtttgcgccctaccgtcagcgctccgtcgacaacgtcatcgaggaaatccgcatgtacaaaaagatgggcttcaagtacatgaattttgaggacgacaatttcaccgccgacaaggagcgggcgaaggaaatctgccgccgcatgatcgccgaagggctgactttcaaagagaccttcttcttcggccgcaccgacttagccgaggacgaggagcttttgacgctgctccacgacgcccacctgacccgggttctcatcggcatcgaatccttgaatcaggacgccctcaacgacatccacaagggacagaacatcgcaaacatccgggccgcggcgaaggcctgtgagcgccaccacattcggatgatcgccagcgtcgtcctcggattggacgccgacagccgcgaggacatccaccgcagcgtgcagttcgccaagcacattcacgcctaccagctccagcccgcgatcctgacgccctaccccggcacgccggtctacgaccagatggtaaaggaggggcggatgctctcgaagaactggagcgatttcgacatgatgaacgcgaccttcctgccgaaaaacatgacgccctgggaattgcaggacgccttttatcaggaatcgacctatttctacgatttcaagtccgcgcgggaaatcggcgcgcggttcggctctgagtacaaatggcgccgctacggtctggcgattctggcgcgcctcggcggcttcggcgcccacctggcctcccgcatcggcaagggcagcgtctattacaacctgcgccattacggcctgacccccaagcccaagcgcggccgcctgcggcatcagccccatcacgcctgaatgcgcttgccttcattctgaaataatcgacctaaaaatttgaaaaaaagaaaaagaccctttataatagtatacaaaccagtttgatcacgcagaaaggagtattcgaaatgaactcaaaaaaatttcccgaacaatccaaagaatccgccaccatgattgaagccgcgaacgatctgctgaccgaaatcaccgaattggccaatagtctcgacgatgttctggaccgctacctcggcatgtacgattttgaggccatcgaagattccttttggagcgacgccctcgagggcatcgacgtcagcaagaacaacttgatcaacgatctcgacgacctggccggcagcatcagtccggtgctcggtctcgaaaagggcaccgtcgactacgaaaccaaagacgaaatagggagatgagcattgtggcatcacgactgaaacgtaaatggcaggccttcctcgaccgcctggctcagcagaacaatcagacctttgatggcggcaagccttcctgctgcagcgacactaacaaaaaagtgacgccaaaggaagtcgctcaaaatcactaattttgacaaaaattcaataaatttcacaaaaacagccatttttggctgtttttttcttgcggcctttgataaaatagacccacttaatcgagtttaaatccaactttgcgccgcggcgcatttttaaatttacaatttattttaattttcaggagtcttacttgcagtcaatagatttaacgcaaaagaccatcgctgagctgaagcagatggccgatcaattatccttatcctacaaaagcaaaatcagaaaggccgacctcatcgccttgatcgaaggcgcccaggccgaacagcggaaaaagcgcgaaaaggaagcgcaggagcacaaaaagaaagaagcggcccacattaaaagccgctacaagctcaaggacaacctgagcgactcgacctattccgaagggccggtcaaaattctgcccgccggctacggcatcatcgagcgggacggcggcgccctgccggtctacgtctcctcttctcaagtgcagaagttccgcgtcgaaaccggcgacatcctcggcggacgggtgcgctcgccaaaacggggcgaaaagtacgcggcgatgctcttcctcgaaaaggtgaacggcgtcaaaaccgccgatttgatcaagaagatggaaaagctgatgaacgcaccgaagaacaaccacgcggaccgctacgcgaagacgcagacgggggtgctcgacgtgaatcccgagggctatggctttctgcgcatcgaaaagaatttctacccaggcgacaacgatgtctacgtgccggccaacatcattcggcgctacaacctgcgcaccggagatctgatcgccggccacctgcgcaaatccgacgagagcgaaaagcaggacgccctcctctacgtcgaaacggtcaacggcgccatccccgaatccatcgtgcaccggccgcgatttgagcggctgaccccgattttcccgagagacaaaatcacccttgaaaccaaccgtgacgcgatctcggctcggatcatcgacttattcgccccgatcggcaagggccagcgcgggctgatcgtcgcaccgccgaaatccggcaagacgacgctgctcaaggccatcgccaacggcgtgcgccagaactcgccggacatcaagctgatgatcctcctcgtcgacgagcggccggaagaagtcaccgacatggaacgctcggtggacgccaaaatcatttactcgaccttcgacgaatcggctcaccgccaactcagcgccgcccagatgaccctcgctagggccaagcgcctcgtcgaacagggccaggacgtgatgatcctcgtcgacagcttgacgcggctcgtgcgcgggaacaacctcgtcatcgaaccctcgggccggacgctgaccggcggcctcgacccggcgagcctccacttcccgaagcagttcttcggcagcgcccgcaacatcgaaaacggcggcagcctgaccatcatcgccaccgccctcgtcgataccggcagccgcatggacgacatcatctacgaagaattcaaaggcactggcaacatggaactccacctaaaccgcgacctcgctgaacggcggatctacccagcaatcgacatcaagaagagcggcacccggcgcgaagagctcctgctcagccccgaagcgctcaaaatgtcggccaatatccgaaaggtctacggcaaggacggcgccgacgaaatggccgaaaaaatcattctgctgctcacccggacggagagcaacgcggtgtttttaaaacggattctcaagaattaaacaaaaaattcaggcacccgctcaaatcgatgagcaggtgcctgttttttaatttaaatccatatggtagaaagttttgtacagcttcatttcctccggcgtgtcgatgctggaccggaagacgacaccgcccgggccttcctccggcattctgagaacaccgcgtttcgccaggacccggcgcagctctctggcggtgccgcggccgccgtcgtagagcttgacgtcattgccgagcacccggcggatctgctttttcacaaagggataatgggtacagccgaggacgaggctatcgactttcccacggtagggcccaagaaaccgttcgagcatcgcggccagatccggtgcgtcgaggtggcccgcctcgatgcgtttcgccagccccggacaggactgggacgcgcagtcggcgtagcccgcataccgttcccacaaatcgtgatattttttaagcgacaaggtcaccggcgtcgccatcacgaggacccgatggctgctctccgccgtcgccgccggcttcagcgccggttcgatgccgacgatcggaatcgtgaacgtggttctcagcaaatccgccgcggcgctcgtcgcggtgttgcaggcgatgacaatggctttcacgccgtcgtcgaccatgcgctgcgcgatcgccatggtcatctgctggacccgttccaccgacttttcgccgtagggcgcgttggccgagtcgccgaaaaacagaaaccgctcgtccggcaactcccgggtcatttcctgaaggacggaaatcccgccgagcccggagtcaatgaccccaacgtaattgtgaaatgctggtcgcataaggccctccttgtcgtgttgtaatcttttgatattatacgtcattttttatttaattgaaagagtggtgaacaagtaaaatttctgtgttataataatccctacacgaattcaaacaaaagaggttcagtgttaatgcgactatctattcaaatgattttaaggacaagcatcggtttcgctgcggtgcttgttttttgttccctgtttgcggtcggtgcccgcgcagcgagtctgaattcctacgctgcgtacgtcaatgccaccagcagcctgtctgtttttgacgccggcgagacatcgcccgacgcgttgattcccggcgaaaccccagggcgtgatacggaatcgaacaaaaaaatcgtctacttgacttttgatgacggcccatcggaaaacaccgacgccattctctctattctcaggcagaatcacatccacgccacgtttttcgtttcgggcatgtacccccagtaccgccatctgatcaaaaaggcttacgacgaaggcaacaccatcggcctgcacaccgaaacgcacaaatacgacatctaccgctcggaagacacctattttaacgatctgaatcagatcgcccaaatcgtcaagtcggaaatcggatttgtgcccgcctacgtccgcttccccggcggctcgtccaacacggtgtcccggaattacgcccagggcatcatgggcaaactggcggcggaattgaacaaacgcggctaccagtactacgactggaacgctgattccaccgacgccgcccacagcgaggacgcggtggacgacctcgtcaagcacgccactgactgcaatgataacaacgtcgtgctgctgtgccacgacgctcccggcaaggggacaacggttcaggcgctgcagcgcatcatcgacaattaccgctcccggggctataccttcaggggaatttcccgcaattcttacgccccccatcagcccattgcaaattaatgaaacggagaacgatcttgaaacacctatcccaattattcgaacgcgtttttaccaagtctctcgaaaacagcgaccgcaccgtctacgacctattcgactggcaaaccgttgacgtctcattaaccgactaccgtaccggccaaattgccttcgaaatgaaaggcctggaattcccgaaggcctactcccagaacgcctgcaacatcatcgcgagcaaatacttcagaaaagaaggggtgcccggcaccggccacgaaacgtcgatgcgccaggtcgccgaccgtctcgtcggcttctggaccgacgcgctgcgcgaggaaggcctcatcgacaacgacgcacagtggcagatcgtctacgacgagctggtcttcgctttcttgagccagatgtgggcgcccaactcgccccagtggttcaacaccggcatcaaacgcaattacggcattgaagccgaatcggacaacctctattactacgatgaaaagaccggcaaagtcgtgctgtccaacgaccgctacacccggacccagtcctcggcctgcttcatcctctcgatcaaggatcagcttttaggcgaaggctccatttccgatcactacgtctccgaaacgaagctgttcaagggcggctccggagtcggcaccaatttctcaccgctgcggggcgtgaacgagaagctctcctccggcggcaaatcctccggcatgatgagcttcctccaggggctcgaccgcaacgccggcgccatcaaatccggcggcacgacgcggcgcgcggccaaaatggtcatcgccgacatcgaccatccggaaatcgaagcctttattgactggaaggcccacgaggaacaaaaggttcgggatctgggcaagatgggctacgacaccagtatggacggcgaagcctatcagaccgtttccggccagaacgcgaacaactccgtccgcgtcaatcaggattttatggacaaggtcatgcatttagacgacgacccggacgccaccctgacgctgaagggccgggtggacgatcgagtcaatcgcgacgtcaaggtccaggatctctggcacaaaatcaaccaggccgcctgggaatgcgccgatccgggactgcagttcgacgaccgcttcaacgcctggcacacctgcccggctggcgaggacggcaacgtcggcgctaaatacaaccggatcaacgcgaccaatccgtgctcagaatacgccttcctcgacgacaccgcctgcaacctggcgtcgatcaacgtgtaccgcttttatcacggcggcgtcttcgacgtcgagcgcttcgtccatcttgtgggattgattcagctggtgctggaagcgtccatctactgggggcagttccccaccgaagaagtggcccgcaagagctacctcttccggaccaccggcctggggctggccaacatcgcctcattggtgatggatgccggctacccctacgattccgacgaagcccggaacatcgccgcggccctcgccggcatcatgactggcgcctcctacgcggtgtccgcgctgatggctgaaaaggtcggacccttcccgtgctacgccgtcaacgcgccctacatggcccgggtcatccgcaaccacgcgagaatcgccggcgcgcgcaccgacgcctttgaagatctgggatacgatccctacatcgtcgaccacccaattctgaaccaaatcggcatgtccaatctgtccgacaccgtcaaacaggtctggcacgacgcgatggatctgggcgaagcctacggctaccgcaacgcccaggtcaccgtcatcgcgccgacaggtacgatttccttcgcgatggactgcggtgccacctcgatcgaacccttctacagccaggtcgtgctgaaaaaactcatcagcggcggcgcgatgcagatcgtcaatccggtgctggaaacggcgctgcaccatttgggctactccgacgaccaggtgcaggcggtgatggattacctgctcgaaaccgacgacaacggcatgctgaagcacgcggggctgaagggcgcaccttatatcaaagaaaaggatctgccgattttcgactgcgccaacgacattcggccggaaggccacgtgctgatggtcgcagcgatcacgccgatgatctccggctcggtcagcaaaaccgtcaacatgccgaacagtgcaaccgaagccgacatcgcgaacatcaacctgatggcctaccgctcgggctgcaaggccatcgccacctaccgcgacggctgcaaggcggcccagccgctgtcaaccggcggccagcaggacggcaagcgcaagctgacggacctgagctacgacgagctcatcgatttggtccagagcaatgccaacgtgctggaacgcaaaaagccgaagggcatccgcaacagccgcacccacgcggccaagatcggcgacatcgagctctacatcaccgtgtccttctacgacaacgaccaaatcagcgaaatcttcgtctcaaccgaccgggaaggcaccgtcgtcaaggggctgctggcgtcgctgtctaagtcgatttcccacatgctccagtacgggatcccgccgaaggacatctccgcgatgctccgaggccagaagtacgaaccttcggggcttgtgctgcgccacccctacatcaagagcgcgtcttcgatctccgatttgatctccaaggtcatcgacatcgaatgcggcgactattcccgctgccaggtcaagccgacccaccactacaagcgctctgaattcgtgcccaaacaggtcgacatgtcctcgatgtccgggatgacagagctcgacgacggcgaatcgtccgccgatgacgccgaatccggcgaacggatttacggcgaaatctgccccaactgcggcagtgaccggatggtgcgcaacggcacctgcaaggtctgcctcgactgcggctccaccactgggtgttcctgattatttgatgatatagtttttacagattttctaaaagtcctgaatccgacgattcaggactttttatttcgcaacgtttgaagtacattttcttataataatcaaaagtttgtgcacttgattgcaaaaaactttttacttttgaaagtttatgaaatacagaatccctccgtccaagtgtgtcttaaacgaaggcgatttgatacctaaaaaggattttttattgatttttttcaagccaagatttttcaaacttcttcaaaattatcgatctcaacaaatcgataactgtccctcttttctttcgcaatgattccttctgataggcactttcttaaaaaatcggaagccccgttttctgtaatatgaaaaagttctgcgatattcctccgattaaatgtatattgatagcgataacgatcaaatagcatacgaatttggttgatggttttttttcgaaatttcttttttattctctttaaaatcacatcattaaaataactcaattcccaatcctgtccgtaattgagttttctcggagataattgagttttctcactagataattgagttttctcactagataattgagttttctctgctgcatatgtatcgatactgccgtttccagccatacttcgattgggcaatgtcactaaaaagatgtattcgtccgaatagaagattggtttttgataacattccatataggaattaataattctaccaataccgctgcctcttctgtccatataattcaatcttccgaaaatatctgaaattacttcatttctcttaatagaaggcacatgtttcagatccatatcctgtatcctcccaccattaaacatccctccaggagaagtgatttccattcgatcatcaaacatatccacatgaacttcagtaccaatgatctgataatctcgatgcatcaaagcattcaccaaaacctcacgaacagctttgtagggataatcgcttttctcctcccgccgcatgccgcgaatcgtccatgcatttttggaattgttgcggacaaaaatttctgcactgtttaacaacgtaattaaactggcgtccgaatattcctgatcgtccaatgcatctccgtcaacagaacctttttccgttcccttccatctggtgcagacaattctcgactgctttaaatatccctgatcgcataagagcaatccggcattggtgacaatttcatcttcaccaacaagcctcaaagaaacgagatcccttggaaggataaaatcatcaccggtttcttttttataagtcgcctggagaagcgtaaaactgacgtcagataaattatatcggcttggcaatgtgtcgtaagtcctgttctgccctttcaggataagattattgatctctaaatctgtcgccaaaactgatctgtctccatgtctgacataagcttcccgaactcgatcatgcacataataatatggataattcggcccacaagaaattttcaaatcaaggcacgatctcccctcggtattagactcggtttcaatcaatgcataccgaacgcgaggagaaattctcgcctcaatcaattctgatatcttgctggctgttaattgcgtatttttcattcctattgcttcatgtgtatcgttcgtgtatccaaaatagatatgaccaccttgagtattggcaaacgcagacactgatttaagccagctttttggtttctctgtttcaagactaagcttataatcaatttgcgtcgactcaactcccttttttattacatgattcgccatatttaactcctgctatttgttattccagtctcgagaagaatttctaaatttattttagtataacatttagaaaatagttttctcaatttcgaaattaggcaaatgagcaaatagataggaaattattccagtgccctctttcatccaattttttcgctcaaacgcagggcgctaatgccaaaaatggatgatatattattaggttgtttttaccaagccgcacgaggtccagtcccagacttttgacagcggtacggcttaattaaacacaacgcctctacggtgaagtgtgccccaactgcggcagcgaccggatggtgcgcaacggcacctgcaaggtctgcctcgactgcggctccaccaccgggtgttcctgattcgattaagttacaacccataaataaacaaaagccctaaaccacacggtttggggcttttgtttataatacatcatcttaataatcaatatattcgtatcaataaagaccttcaccattagtcctcatttcgcacagacttcaccatttcaacaacgtcttgttcgttcttaatgtctgctttgctcgcttcacctttaagactatcctgcaacatacgcatcgcgtaaacagcggcattcacaactttgacctcaccattgttaacgataaaactaatgcggtcgccactatcgacaccaaggacttttctaacgtctttaggaattgtaatttgtccctttgatgttacttttgcattatcgacaaatacatctgtgtccataaatataccttctttctaaatcacataaatttattttccagatattcgacgtatgaattccttacttttcttattttcattatactcgcatttctaaaaagtgcaagttaaagagcgctatttaatccaccgaaggataaaatgatatttagagaaattttacaaatttgaaaaataaatcatgatacaaaaaaatcgtctcaaacaagtctaagacgatttttaatagccacagcattataacgctactttcgccgtccgcccgcgctgccagttctgatcgcaccaccgggcggcggccgcggccgcgctgtccggccaggcagcttcgaaagtcagggttttgtgctgccaggcccgcagcgtcacgggggcgacgtcctcgagcacaggcgtctcgctcaaaacccggtccccttcgccgtaaaggacgagggtgaaatctgagaggaccgccgtgtcgtaggacggattctcgagccgcagccgaaagcggacttcgtgcccgttttcgggcttttcagcgggataaacattcagccgaccttctgcccgaccgaagcgcatccgtcccgaaatcagggctttgagcgcttcagatgggctgccaatgaccgcggaagccatcagtcctccagcgcagcggcgcagttttgcaagtcagcgataatcggcaggtgctgagggcaggccctttcgcattggccgcaggcgatgcagtccgaggccttcccgaccccggccgtcgcgttggcgtagcggcgcttggcgtcgtcagtctggctgtagaccatttcccggttcatcgccgagaaaatattcggaatcgggatctgtttcgggcagccggcaacgcagtagcgacaccccgtgcacggaatcgcatcgatggcggcaatcgccgcctgagcttttcgaatcacggcttgttcgctttcggacagcggcttaaaatcgctcatgtaggacaaattgtccgccatctgggcttcgttcgacatgccggagaggacggtgagtaccccgggcagcgacgccgcgaagcggattgcccaggatgccgcggacacgtccggattggcctcggtcagaattttctcaaccgacgccggcggctgggcgagaaagccgcccttgaccggttccatgatcacgatcggcttgccgaatcggcgggcgatgtcgtaacactttctggacgccactgccgggttgtcccaatcggcgtaattgatctgcagttggacaaattccgcttcggggtgatcagtcaagagtttttccaagagatccggtgtgccgtgaaaggaaaagccgatatggcggatcttccctgccgctttctgcgccttgacgaaatcccaaaggccgtattcgtcgtattttttataattggtgagcatcaacgaatgcagcaagtagcaatcgaaataccctgcgctggtgcgctcaaggctgatctcgagctctcgttttgcttctgccgcgctgtttacgccgatggtggcgtgcagcttcgacgccagcatgaagctttctctcgggtagcggtcgaccagcaccgtcttcacggtctcttccgaaccgcccttgtcgtagacgtaggcggtatcgaaataccgcagccccgcggccatgaacgcgtcgaccatttgcgtgaccgcgtccagatccactttcccgccgccctgggtaccgggcagacgcatcaagccgaagccgagcttcggaatgtcttgggcccattctgttttctgcatcgtgttctccttctttgtttatcttctttgtttattttgtattcttgtcttttcttattatgccacagcatgagctatttcgggcacaaaaaaagcggcaattgccgcttttttatcgcagtttaatagcgatcccgatgcacctttgaaaagtcgtaattccggccgtcttcgcggttcggctgtgccggatagccgatggatgcgatggcgaaaggcaccacatttttcggaatgtccagcgctttttgaaggttttgaatacggtcttcaaagggggcgatggcaagccacaccgccccaagctccaaatgcaccgcttcgatcaggatgttttccatcgcggcgctcatatcggcgtcgaagcagtctgggaagcggcacgtcgtcggatccccaacgggcacgatcagtacgccggccttcgccgcgcatccggcgtagggtgaagcggctgcggcctgttttttcacttccgggtcggtgacgacgacgaattcccattcctgctggttgcccgccgtcggggcggccatagcggccttgatcagggtttcaattttttcttcttcaactggccggtcggtgtactgccggaccgagtgtcgggtaaataatgcgttcatacattctccttcgtgggtttgatcttagtgccgatattttatcctgtctgccccaagaaaaacttaaataccccatcaaaaatcactgcgctttgcgatgtcaaatccagccgaaatgggagagggctgcagcgaccccgtcttccgagcacggcgtcgtcacgtaatcggcgcaggccttgacgtcatcggtcgcgttgcccatagcgatgccgatgcccgcgaaggcgatcaggcttttgtcgttgccgccgtcgccaaaagcggcgcaggcttcccggggcaagccgtaagcggccaggactttttccgcccccaccgccttatcgctgcccttcccgacgatgtcgcaggcccagtcccaccagcgcagaggctggacgcctgcggtgccggccagcagggcggcgtcctggtcggcccacgtcccggccatgacctggtagatgtcatcggccatgaggtgctgaaaagtctcgcggtcaacaacatggttcggatggcctgcaaaggacatgtaggtttcgaggtttttctgataaaaattgctgcccatggtctttgcgcctgccagcagcaccggcacacccatgcgttcgctgttttcagccattcgcctgatgtcggttttggcgatgggggcagagcaaaggggtccctttcggtcgaagccgtaggccccgttgaaacacagggcgccgtcgaaagccaggcctttcaccttcggcaggagatagggcggacggccgctggcgagaaagaccttggtccctcccgcgcgcaggcggcgcagcgcgtcagcgacggccgggctcaggctcggcgcgtcgaaatcgatcagggtgccgtcaatatcaaagaatgcaattttcgggttcatcgtatgtcctttccgctgtgtttgcttctattataagagactgtgttccgaaattcaaaggctgcccgttatttcgccatgcgattatttcccgggcaataaaataaggctcccgaaggagccttgaatcttatggccgtatgaatcgttattctgcgtcgcgcagccgtttgacggtgaggacggtgaccgcgcccgctgcggcgatcagcgcgatgagtccgccgatcgttgtcgggtcaccggtcttcacgccttgtgctatcgtctgggtcttattgttgttggtagtggtcgtcgtagttgtcgtcttcttatcggtcatgttgataccgtcttggacgtactgatcgatcccgacgatatctttttcctccaccttaaaggtttcgtctgctgctttttcgtagccttccggcgctttgagttctttcaacgtgttaggtgtcgcctgcgatgagcttcgcggtgatgcgatgggctgtgccgtctgtggtccagctttcgatgagcttgccgtccttgtcgtaaacagccaggatcgcgcccttcaccggtttgccgttttcgtcaactttggcgatttcaacattggttgcggtttcgcgccagcgcaggaactgcaccgcaccttcggtttccagttctgccgcgccgttggcgttcgagatcattttcttggtgccgtcttccttgaggcggataatcgccggattcgccgtccgctgataaccggccggcggcgtctgttccatgatcgcgtagatgcccggcgtgatatctgtattactcgcgctatccgctttaatttcaccattggcgtctgtatcacttgatacgatttctttccagccattggctgcggtgatatccgcccgggtcaggtctctgaaccgtgcgtacggatccttctgatcagctgccgctgtcgttgcaacgtttgatactctcagtgacgcgctgagcaacgcattatcttgtgcgtcagctgctgcgatctggcctgtccatctgaacatggcgtagcggctgccgcggatgcgcttgttcgtgtcttttttgtcgatgttttcggtctttctcaccttgagggcgtattttttagttgtttgattcggcgtatacgcgtctttcaaatcaactgtaacatttttgtttttttcaacagttgtaccctttgacgtaacggattcattcgtcactaacgtatatccgtcgaccttatctgcattgttttcagtgaccgtatatttccctaacgttaagtctgttaatgtctttgaataggtcccatcgttctgcttgatttctcctaaggtgaacgttttactgtaattattcggaccggttacggtgaaactgatattgcttaaatctgctgccttgtgatgttatcctcgccccgaacgtcttttgtaaacgtcagcgaacctttttctctgttggcggttctggctattgggctgataattgtcgttcacgcaattgtcgccgtctttgaggttgtggttatatgtcgtttcgcctgatgtgattgttccttcttttacaagagagtagccttcaacctgatctgcattcttttcagtgaccgtatatttccctaacgttaagccctgttaatgtctttgaataggtcccatcgttctgcttgatttctcctaaggtgaacgttttactgtaattattcggaccggttacggtgaaactgatattgcttaaatctgctttggtgatgttatctccgccaaacgtcttcgtgaacgtcagcgagcctttttcttctgtcggtgtattcggcgttgtgcctctcgaatcgtctctgtgagattctgccttgacataaatggtgtctgccacgcaagtcccattgagattctgattcaaattgaccgtggcacctggtgcgagaatcgaaccgatcattaacttcgcgtcaatcgtcatgccgcttggtatatttgtaaagttccaggtgataaagttttcgttaaattccgtaacttcgcgattgtttaattcttgaccctttaatattgttttgcagtcaggtagactcaatgtcccgttcgccggaacttggctgcagtcgacattgatgacaatattgttcccattgcccacatcaatgttaagcggtgcatcacttgcaatcccattaaggccattgcttgtcgcggtcaagtttagaaaactaccggcctgattaaccgtaatcatttgattattgcgttcagaaaaatcagtggttacgctatcactagttgaatggcttttataattatttgaaacagcttgtgtctttgccttccaatccgctaaatcgataaagttttctgatttaatgatgtgcttaattctatcaagcttgctcccgttgagcatgatcgcattgccgccatcagtcgtgccaatggtattatttctatctcctacaacaagtatgtcatcttcaccagcaccggggcttccgcttgtaaaatgcttcgcgtaattgacttctgaaccgtaattattagtaccgttattggaattggcctgtaaatcattggtcgcgaaatttccgttgcagtgcgcattgagatgcaaagtatcaaacgctaccaaatggaaactccccactggcccgaggatgctttctgcctcgctatcatgatactgatcaaaagccgaatccgtaaatctagccgtcggtgagtcctctattttcaccccatccgcccagaccataatgatcccggccatacacaaagcgagcagcgctgcagcggcgatgataatcactcgcttgatattctttcccgctctttccatcatgtcatcattctccttcctgtgtcacgtattgtgatcgtttttttgttacttctgaagtcatttcatctcttgtcgcgcatatttccacgtttacaatgttattctattcttttttcctaattctgtaaataattttttaagatattttcattattttaactttgtcaaaaatgtttatattttcttgaagctttctaaaatactttattatagaataacccatacacgcggcaatttgaacatcattcggcgccaaaatcgatgattttgcgtcaccagtgcctgccttctcattttcatgagaaaaaatgtaaaaatgcgcgttttcagacactaataaaggccccaggtatcgatgatgcctgaggcctttgtatgtctcgcacggttgcagttcctaatgatctgagccgctgatcttatttattgtgctgttttctccgcgccaggatgatgagcccagccagcgcgatgccgcctgctacagcgggcagagccgcgttggtcggatcgccggtcttggtgccggtacccgtcgtctgggtgttcttcggtccagagggctgagtcggcatgcccttgtcaatttgagacctcttctcggtacctttgagacctgcccttgatgtagagattgaacctggctataatgaaatcatgttgcattatttgtaaaaattggagggcagctatgagccaaatcaagtcgaaaaaacagcgaaaaattgaaatcatgcgcaagaatctcctgaagcaccctgggaaaatggaaaaaaagacggaaacctccgtcaacgaagcggcctcgagcgcggcgcagatcgctttagacgaagagaacgccggcgatctgatgaccttgatggaccagtaccgcgacggtaaaatcgacaaagccgactacgaggcgcaaaagcgccgcctcctcggccttcaataagcgcgcataaaaaaatcccgctgcggtcaacagcgggatgtgaggtccaacatgtaagcggaacgattgaaccgttcccgaaaggtcagtcccatttttcgtcgaggttttccttgtcgccttcttcgaaaaagggtgtggttgtcacggtgtacacacagggcgcgtcgaaatcgttgcggatcatgtgcgcttcgcccggttccatgtggatgaaatccccagggccagcgtcgtggcgcacgccgtcgatgtaaaaggcggcctggccttccaatacgtaaaaatcttcctccatcttgtgatggacgtgggggccgaaggtctgtcccggcttcacccggacgatgccgaaattgagccgcggcccgtggataaagtatttgggaccgctgtccccgtgacggaatgcgcagtcccgttcgttgacaattttcatcattagagcagataaaccggaagatccgcctgttctttgatgtgctgtttttcttccgcttctttacgggctttttcttccgctgcagctttagccgccgcttccgccgccttgcgttcggcttcggccttttccgccgccgctttggcttcagcctctgctttagctttggcttcggcttctgccttagctttcgcttcggcttctgccttagcctttgcttcagcttctgccttggccttcgcttcggcttctgctttagctttggcttcagcttctgccttggccttcgcttcggcttctgctttagccttggcttcggcttctgcctttaattttgcttcagcttccgcgtttttttcgctggcttcagccatggcttccgctgccttcggctgttccttcacttcttctgtatgactttgtaacattgattttaatttgtttgtctttctggccatgatttaaaatccccctttggctttaatctcatcgtacagcgcctggtaatcctgcgcgccgttcgctttgggcttgtactcgaaaatcgactgcttgaacaccggcgattccaccagcgccacatttttccggatggtgtgccgcatgaatttgtcgccgaaggcgttttccagattttcatactgaagctggttgatgttgttgcgcttgtcgtgcatcgtcgcgaagatgatcgaaatttccttttcgacccccagcgaatcgttgacgtactggagcgtctcctgcagcaggtgaaccccgtccaccgcgtagtactcggtctgcaccgggatgaagattttgtccgtcataacgagcgcgttggtcgtcaccaccgaaaacgacggcgagcagtcgacgatgcagtaggcatagtcgtccgcgatttccttaaggcgccgcttcagaataaattcgcggccgaccatccccgacagccgcgggtcgatcgtcgccatcaaaaggctcgacgggatgatgtcgacattgtctctcaagtggaagagcgtgtccgcaaggggtctgtctccagtcatcaggtgatagatgcacggccggtcgtaatccggctccatcagagaagtcgtcagattcgcctgcatatcgcagtcgaccagcaagagtttctggtttttttcggccaaatccttcgcgagaagatagcccagattgatcgcggacgtggtcttgccgcatcctccttttaaattaaaaaaactgattaccttcaaccttcaggcttcctcctctctacactgtgccatctgttaaacctttagatgaaatgcttaacacatggcacaaataaaagctccgaagggcttgcgccctccagagtttccatcaatccgattgactgaaattagagaatcagcttgcgcacatcctgatgcggcgaggcgatcacagacgtgctcgtgatgacaccgtattcgcgcattgcgttttcggcggctttcacggcctgtttgacaggagagacttcgccggtcatgatgacgaaggccttcccgccgagcccgcgggccattctcacttcaaccaatgtaatatttgccgctttaacagcggtatccgccacaacaatcgatgaaatggcgttgatcgtttcaataatcccaatcgactgaacgttatcgacatcgacattggccatcaatgctgggaaaacagcttgatggatgtttggaatcacatgggattcgatgacgaacattcccccgacaacttcaccattcttgacagaggatctaactgctccaacatcgccagaaatgatggtgacatatttcccaggacaaatcggtgtcgctgtcaccaactcaacatttccggatttgagcatttggtcagtggattcgataccgatagggatacttttaaattcgataaatcctattgcgtttttcaaatttccactctttctttatgcatcgttcaacgcaaatctcatgccttgacggtgaccacaccgttttcgaccgatgtgactttgccatcaatgcttgagaaaatacgtgcactcaaagccccttccggaatttctccgaccagctgaccccgtttgacttcatcgccgacggcgacgaccggtgttgccggtgctccaatgtgttgagacatctggagatggacttctttaaactgcttcttgcacggttccatcggcgcgtctttgtcaaattcgtccaggcctaaacgcttggtcaggcggtgaacgttgaaacgacggtcttcgatgaacggattggccgatttcggctgttcgtgatgcgggtttttgatcccgtttttcttcaattcccctttgaggaattcgttgaccttccaaggctggaggtccatcacgcacgcatactggcataatccgcagtcgcagcacagataggcgttcgtcggcaaggcaacgttgtcgcatgtcgacgcgtaagccgcaatgcgcatcatcttgtgcggttccagatggtggccgagattgtgtctcgggcagacttccgtacacaggctgcactgcatgcagtaattcgcagccaatttcaacgagcgctctaagcttctcgttttcgagtggatcagatagtgatctttcggtaaaacgatgagacccttcgttcccttcgtgatgtaagaatcttcggaaacgattttccccatcatcgggcccccattgatgatgacataatcactgatggtcggtccgccggccagcgccagcgcttctcttaccgtgatccccaaaggcactttcgtcgtgatccggcgtttgacgttcccggtgaccgtcaagtatttgtcgataaccggcttgtcttcagtgacacagtcgtgaagattgagcaaagtttcaacgttcatgaccagtgcgccgactgccagcggaataccaccttcaggaacgatcttcccggtgcattcgtagacgagggtttgttcgtcgccggccgggtagaaattgttcatgatgtgcagtttcagtttcggatatttcggcaaaagtgaattgagcttattgatcgccggcacgtattttttctttaagccgataatgccttctttggctttcgtgtgttcgacgaccatgttgagagcttccagtaaatcggaagctctcaaatccatcaattgttgatcaactcgaagcagaggttcgcattcagcaccgttgacaatgacgacatctgccgtagcatctattttgacgtgggtcgggaaagtggccccgcctgcaccgacaatgccggcgctttttactttgtcaaccaagctcatatgcaactctcctctgattatttaatgttgaaggcgtcgcagagtacgcatcttcttcttcttgcgaatgtctttgctgaggttaagccttcaccggtcgggccagcgatcgtaaaggtcggatagccttcgccgccaatgccgagtcctgcgtaggaaggaccgttcttaacgaagatggtcgatgcgattttcttagacatcttggacaaggcgtcgacattcttggagtgcatcgtcgcagtgtggcggttgccgtgttcgagttcgcaagccaggtcgatcccttcgtcgacgttgtcgacgcggacaatcccgaggatcggcatcatcagttcgatctgaaccaatggatgatcagccggcagttcaccgatcaaaactctggtgtcagccggtacgtcgatgccagcagctttggcgatgtattttgcgctcttgccgacatagtcgcgggaaacgcggccgtccggtgcgaccatcgcagccagatcgtcgagaacttttctgtctttgatttcgaatgcgccgttcttcttcatgttgaagatcaggtaatctgcaacctggtcgacaacgacaacttctttttcagcgatacatggcaggttgttgtcgaaggtgcagccatcgatgatgtcttttgctgctttttcgatatctgcagtttcgtcgaccagtgccggtgggttgccagggccagcgccgatggctttcttgccgctggacaacactgcgtgaacaacgccagggccgccggttgcgcacaggagtctgacatcaggatggtgcatcatgacgttagcagattccatggtcgggtgttcggtcgaaacgaccaagtttgccgggccgcctgctgcttcaatggcctgattaaccagtctcacgcagtacagtgaagtctgcagtgcgcctgggtgtggagcgaaaacaattgcgttcccagcagcgagcatgctgatggagttgttgacgatggtttcattcgggttggtcgacgggcagatcgcaccgataacgccgaatggcgagagttcaagaagggttaagccttcatcacctgtccagcagttggcctggagatcttccatcccaggggtcttttctgcacagcaataagcttttgccagtttatcttcaacattacccatacccgtttcttctacggccatattaacgatagtttcgacagtttcctttttcgtaaaggtcttgcgaatttcgtcaataattttgtagcgcagtgacaacgggcgcatcttgtagtcgttccatgctgcctgagctgcggcgatggcatcttccatatcttcaaaaatgccgtctttgcccttggcatcctgggctgctggtgcaacaccgttagctgcgtcgatagatgtcatcacttttttaacgattgcttcaataccagctgtatctatattcatactgccttcctcctaaaaattaatcattttgttgaatcaccgcaaggcctgccttggcaatggccatgtcttcgtcggcagtgccgccgctgacgccgatcgcgccaatctgcttgccgtcgacgatcaacggatatcctccgccaaaggtcacaatgcggttatgatttgtgaattgaattccgaacaacgggctgccttcttttgccagttcctggacagcttctgtcgggcatttcagcgcgttggctgtaaaggccttgttttgagaaatgtcgatgctggcaatcagcgaatccttcattcgttcgtaataagctaaatttccgccccgatcaaccgccgagaagacaatgggcacgccaagttcccgagccttgacccgtgagccagcggccgcgcgcttcgcgagcaccagcagtaattcgttgtcgtcttcggacgtttcaactggaacgtttgcttgattctgatccttcatacctttttccgctacatcccgaatatcctgttcaaattcttcaacccgcgccagcgtgaacagcaagtctgacagacggttgacaaatttggcaacttctggtctgaggtccgggtcctgcgcttcgtaagacacgatccgtctttctccccttcggacgacggcgcgcgcagtgtgcagggcggacgatgcggggtttctgcctggaatgacaaattttgtctgtttgccgacaatctgcagataatgatcgatttgctgttccatcagatcaatatccgattgttcgactttttccgtcagcatttttctcccacgatcatcgctggccagttcagcttccagaatgtagatcttttcttcaacgtgcagaaggatgtctcgaatttcttcgtctttggtcagggacgctgccataccgatgaaggcctgggcttcgtccatggtcccgtaggcttcgatccggatgtcgtctttcgagatccggctgccgccaaacaggcccgtcgtccctttgtcccctgtgcgggtgtagacattaggcattctgttctcctctgctatagtgttttcttaacctccggtgccgatgtttgaatttcatcgacgatcccgacgattgtcatgtccacaggtgttgtcttgtcgccgtaaacgaaacgggcggtactcccgctcgtgatgatcacggtttcgccgatcccggcgccgacggtgtcaactgcgacggatgtcgacgagctcgaatacttttcgaattcgcccttttcgtcgattttcttaacgatcatcaacttacatcccatcagatgtggatccttttgggtagagacgatggtgccaactacttttgcaagccgcataccattcacctactctctaactaatttcatcccaaattcttcagccgcttcagcagcaaaggcggtaatgatcgcgtcttttctgactttaacgactttctgtcctttgcgggacatcaaatccttccgactgacaatatgggaaacaatgacgtcaccttccgcaggtgcagctgccggtgcggcaggtgatgctgcctttggtgcagccgctgcgggcgattcactttcgctgactggcttttcagcacagacttcgtacagatcagccgccgcacacagcgtccagccgaatgtgccgagggtggccagattgtcgcgaagcaccttgcggtacccggctgggaccttgcccatcccgagcttggcgcggacttcgtcgtcgggatccgccccgtcgatcgcgctgataaagtgcttgccggacataatggcctggctgatcgtggtcaatacaggtgtgtccgcaatgccgtgggcaatttttgctgccgtgttgatggtcagcgtcggcagaataatttcatcggccgtcttcacaaattccttgagttcggccgcgttgtcattcgtgtaaacctgatcgacatctaaagtcttctttattttttcaagatcaaggacttttttcgaactgtccgtcactaagactttaagctgccatccatctttgcgaagcttttccattgccttcaggccgttggtgtagccaatcgcggcacctgtaaagcaaaccaatgcggttttcggttgattgtttaaccgtttgatgacttcatcgatgatccgctgaaccagaagatcaaacacttctttattgttcaccaaatcctttaagtccaattgatcaccacatttctaattcattaaaacttcaattctatacgcctcagaccttgcagttgaacgcaatgcccaatggcgtgaccagtaagggttctacaggtttgacggttttgatgccgatttcccgttcgaagacgctttcgaattttttgaattcgcaagccccgccgacgacgtaaatcgtgtcgacattgtagccgtcgatgtagcgccggacgatttcagccattttttcgaccgtgggcttgatcagcgggaagattttgctttcatcgtcatggattttcatctcttccgcttcatcaaaactgatgtggtaggccccggcgatgactagactcatgtgggtcccgcctgtcggctcatccgcggtgaatacaacttttccatgatccagaatagaaatccctgtcgttccgccgccgacgtccactaccgcgccgttttcgatgccgagcaccgtagcggccgctgtcggttcgtcgagcacgttggtcacgttgaaatcacaggactctacaacattggcaatgattttggtattgccttcgatgattcccggaggaatggccgtcgctgccggcgcattgctcagatccacaccaatccggtcttcaagctgacgcttcaggtctttgacgatgtcgaccgcgccgatgtagtcgacgacgatcccgtctcggacgacgtgggcgccctgggtcgctccggcgaccggtttgttgttttcgtccaccacagccacaacgatattagccgtaccgaggtcaacgccaactttgagtctgccttcgtaaggagccacccgtttttgtttgatcaattcgtcaaatgctaatatggtatcgttgccgcttttccaatccattaatacgctactccctgctattttttaataatgattttgacactgctgccttttttgaggcctgccgctttcgcttcgtcaccggtcagcatcaattcatgccggccgtcttcggtgacgtggacgaggacattttcaaaaatcgtgccgtcgactcctctggaatcgactgagaccgtgtctttgtctttgagctgcagctcttctgcgatgtaggtcggcaggtttacactccgtctcggaatgatcgcgcccttttcacaggcgactgcgccggccggaccgacaattctgcaagccgccgattgataatcatccttcgattcgcgcaccggcgcgtcgacgccgatggcttcgctttctgacctggacaattcgatgaccggttcctgatcatcatcgagcagcggcccgaaaatgtaaccgtgggttgaacccttcggcccgctgatggcgacgccttcttcataataaaaagaattcagatccttcgcccgggttaagacggcgtgagatccgaaaagctgttccaccgttttctggctgcagtaaatgtgtgcgctggggatgcccagcgtgatgagctcaggcgattcttcgcattttttcgccttctgaaaggcttccaaaatgatctgaaccatctggctgatctgttgttcattgtacatatttcggctcccctttcttgtttgcgacaagtccagattgcttaattcttcttgtctactggatcgggcatttccgttttcgttccccgagagggttcgaattgacttccgaaggtcggaatgttccagtaatacttcatccagtatttgtcccgcacgttcgcgggatcaaagccttttgtctgtgtattgtagaccatcggcatcagtccgtctgagggtctggcgatgacgatagctgactgacagccattgcctttgtcgcaggccgcttcaccggcagcgaccgctgccttgcaggcgccgacgtctcccaataccttgacaacatgcatgccgccgcctcggctggactcaatgcccaatagacagacattcgcggccttgacagctgcgtcagctgcctcaatggctgttgcaagtcccttggcttcgataaagccaatagattggcgcattgacttctcctttctttggcttaaagcatcacgcgtctaaagatttaaacggcatccgcttgatcaagcgggctgcattggcaccgatggcccgcagcttttcttctccggcactcggcgctacggtgaacagcggtttgccgcctttcagtttgataaaatgaagggcgatcgtcttgctgtcgatcccgatgccgacgcccagatgggaatcttctgccgctctatacgctaaatcttctgccgaaattttatctgttttgtcttcgtgcttataaggcaagccttcttcttcgatcccgaggatgacttctgtgacgacgtccttcggcaccgagcccttaatgctgtatacgacaatttcaggttttggtgcttctaatccgggattcatattactctcctttgcaatatgagagaacaagaccggttgccacggcgtttctcggaccttccgtccctctgatattcgcacgtccggctacgatggagtagcgcgacagcgcgtctgtgatcagctgcgggatttcaaagtcgagggatgagccgccgaccattgtgacgtattccatgtcgcgggcgttccccgtcgggctgacacgttccaatgcgcggatggcgttgacaacgaaaacctttttcttcgcttcctggcggaccgttttgatccgttcaactgtcaggttgcctggcagcggcaccatgccgtctggcgtcaggatgaccactctggcaaatacagttggtggaagctgattttcaaagaattctacagaaccgtcttcgtgacgaatgtggaacaggctttcaacctttgcgaccggatattttttgatatcttctgcggtgtgcatatcttcgatgccgagctcagaaccgatgagcatcgtaaccatgttgccggcgcctgccaaatgaatgaaatgaattttgtcttcgcggttgatgatcgcggcatctgtcgagccggcccccatatcgaggatcgccatcggcttatccgcacccggtgtggtcaacgcaccgagaatggccatctgcgcttcgacgccgccgacttcgaccttgacgttcaattctttttcaagttcttcggcgatcatgttcatctgcagtctgtccgctttgaccatcgcggccagcccaacggcgttttccattgaaaattcgttggccatcccgcctttaacggcctgagggacgaaggtatctacagccagaatatcctggatctggattttatccggcgattggttggtcagattggacatcacctgacggactctttcgagcatgccgccggcgtttgtccccggttccccggtcacatcttccacaggctgaacgcttctcagcgcttccatgatttcttcagcacctgagtcaacgggtacttcggtcttcttgttttcgccctgaatgatgattttgccagccgggatctttctttctttaacatcccctgctggcgttttgatgataaccgctgaacggtttccgattaaggcacgtgaaatcggcacgacctgcttcgtttcttctggatttaaatcaaaaacggtcgcaatcccgtaagggttcgacagctgttcgatgaccttaccgggttcggcgacttctacagccgcccgcatgccaatcggcaccttgtcgattaatgcgacttcatctacaatcggtatttttttgtttaagcggttgttgatcaaaacaccatcgtcgcgctgcacaatcgcgccgttgacgtgaacgccgcgttccacagctgtgttgatcatcttcgacgaggtttcaaaatcaacttctctcggaatcaccacaatgaccgcttccccagcattgacctgggtcaagttgcggatattgatggtttcgccgacgccggttcccaatccacccggagtggatggattgtgaccgatcatcgtggattctgtgataatcgtttctgtgatggtttccatcgccacatcgccgataacaggagctgcttcgttaagacgaatcagctccacatcatcaagcgttaaattggctttgtccaaggcttgctttaaggaggcgaagacaccgtggatgttctgccgcgtccccttgatcccggttgtcgcgacgatcccactggctaagaattcaggtttgttgtgatcaactcgcgccaatgccgtttcggtactggcgttgccgatatcaatccctgcaataatcatatattcctccaaacaatcctatttgaaacttatttaaattctttggttctctttctcttgtatccgatgtaagcagcttctctaacgagctgtgcgcagacctttgcgctgtattttgtttcgagttcgtcagcgatagcttccagttcttcttttgttgaacgatacggacgcagtgcgttgtagatttcgagaacgcgggcatctggaacggcgatcagttcagccgcacgacgcaggttgatgccgaaagcatcacggccgacagagtcagcaacctgagcctgaagttccagagtcttcggattgattcttaagtcttcagctttgagggtgccgtccagaaccttttcaagggttaattctttcagcggaatccctgtggctgatgtgattaattcaggtcttttttctcccaacggataatcagcatcggttactttgacgtcgcctgccggtgcgctggcttcagtaccggaggacatcgatgccattacctgtttgacaatttgttctaacatttgttcttgtgtcatctgtgcacctcccgattatttgtaggaaactttcatgttgaccggttttttacctaagacaacagactggacttcttttaagtagagaagtgcagctcttgcctggtatgccgggcgagccatctggtcgttcttgaccggaactggttccgggctttcgcctttagcgtagcgagccgcattcttaccgatctgacgataagtgtcaaggtcgatcagcgggcactgcgggaataattccaagttccctaactgcggcaggtctgcctgatggatcaagcaagtcccacgagactgaatgccgattgcaataccggagcctgaaagttcagcgcagtcatgtccgataaccgcaacgtcacctgaacgatagactttgacgacacgagctttcatgccttcttcttcgataccagcgatcatttctttcatgatctgtgcgtgaggaacaccgatgatgttggtctgctgttctgcaccgaactgtgcggaaacaccgatgataacttcatcagctgcagtgcccttctgtgcttctccgtctggtgttaatactaatgtttcagctgggccttcatctacaggagctgctttcggcgcttctgctggtgcatcagctgacatttctttaacaacatctgcgatgattgattttaacaattcttcgttaacagccattctatacacccctctcactaaattgtttctgggtcatctgcccaaggcagatcagcaatctgattccaacgttcttcagaaatctgatacccagttccgacaccatggtagtcgttcttgtagttaactgcagaaatgacttcccagtcagaagacaatttagaagctgtatgcaggtagtcaccagcgcatttgatgtactggatgttaaagatcgactgtgcgacatcgtggaagccttctttgtcgagcgctttgatgaagtcaacagcagtgacgcctttgttcatcatgtcttcgatcgctttcaggtcagcgacaacgtcacggtccggcatatctttggagccgtctgcgtatgttgctgcttcgacttcttcatcagtgatttccggaagtcccatgcctttgaacaagccctgaatggctctggcagctttcgcacgtgcttcgaccaatgcgtcttcagtgattggctgtaagccagcatcgattctcaagtcacgctggataacgttccagtcatcgtagtcgtgagcatcccagttggatcctgcgaacatgttatcgtagttcggtgttgatgagtaaccggagcagatgtagtctgtccctggaaccatctgcatcagtgaacgagcgacacggcgtaaatccgagtgtgtgaatgtctggtcgtttgatgatgcacattcgaggtcgaggcaggcagccagcaggttttctgccaagatttcacgaataccgccaggtacagcagccggaacaccaacgcaagaaacagaaccgttctgagtcccctgaacaccagcacctcttgtgacgtacaagcagcgggcttcaaggtacagcatggagtgaccttctgcataacccatctgaacttctgaaccagaaccagatgtgaaacgcattttcaggccgcgtgatgcgtatgcggatgccaagaatgcttttgaatacggagtatcgtcaccatccatgaagacctgttcagtaccgtaaacggaaatggtttctgcgtaagcggtgaagcctctcatacccatatccagttcggttgcttcttcaacagagcactgagtcaggatacctggacggccgcagtttgcaccaaccatgatccctaaggcgttgaatggtgcgtaacgtgcgataccaacagtagtttcctgttcgtcgaaaccacggatagctgcttcagcagcgtcagccgcgatctgaaccatgttatctttaacgtttgtgacgtggcactggtttgatggcattaaacgtgcacgcattttgttctgagccatcatcatttcgaggacactcatgtatcccaaaacttctgtcatcttagctggggtcacagctgttgtgattttgatgatgtcttttcttggcacgtggatgtcaacgagtttgtttgcaatgtcaattgaaggaatagccattgcttcttccgcgtcttcgatgtggattgcgtggtcagcgatgaactgatcgagcatgtcgaagtcatctcttgccttgccgtccatttcaacaatcttgccgtcttcaactttgatgcttggctttggatccaagtcagagttcatggcgattaagccaacttcaggccattctttaacgaaaccgtcttttttaattggacgagcttccagagcttcaaatctttttgatctcatttagtcattcctccttaaatctctttgtgtattagtgtgggtctaatcacattaaatgtaaggagttgttgctgatgggcaaggtccgcctaatgctgataatgcctggatacctgcatcacgggctgcacggactgcctgacgaactgcgccagcgtcgccgtaaacattgatgaagccttcgtttgaagcctttgtgccgtgatctggtgagcagtagctgatgagttctacgttagctgctttcagagcgatatcggaaatgaggataccaataccagcaggagcgcctaagatcagagcgtatgcacggccgatcggtgcgccgaatgctgcgttgcaggcgaaggaagcacgtgcggtgtactggaattccaggtggccagcgtcgttgccgtaaacatcgccgaagtgtctttcagtttcaaccaaagcaacttcaacagcgcgtttcgcatcggaaacatcttctgcaccgaagacaaccagtgaaccatgtcctgcgccgcccttggtatcacgagccatttcacagataaccatttcggtgttggtcgctttaacagcttcatcagctgccatgatctgcgggccagccccagtacggccagaaatgataccgattgaacgatacttcggatcgatttccattgcttcgtgtaagttaggatctacgttagcgatgaccagaccaattgtatcccccatggtctgtcctacgtattcagtcagtccacaagttcctgtggcttcagagacggtacccgtttcttcaacttcgtccatcttcttcatgacttcttccatcaatttgttcataacatcgtctttcattaattcacacctccactatttttataaagttggtaacattttttccacatcttgatgtggtctcggaatcacatgaactgaaacaacctggccaactttgtcagctgccgctgcacctgcatcaacagctgccttgaccgcaccgacatcgccgcgaaccatggttgtgacaagaccggaaccgatcttttcatagcctgtgaacgtgacgttggcagatttgaccatggcatcagttgcttcaatgcatccgacgaggcctttggtttcaatcatacccaaagcttcatttgtcataagcttttcctccttttaggttatctgactaacaatattgtaaaccatttgcacagataattacttgtgatattattataaaaaaaccactttcccctgattttatcagtgtttccttgtgtctttaaattttgcaccacaagatatagtctgacgcatgattacgtttttagtataaatgatttttgtaaaaaagagctgagattttgacaaattcttctggtaaatttgtcacctctcagctctttgatgctttttatttattatttttttactgatacaaaggcatcgaccttttcccaaggcaggccttcttttccgaaatggccgtaggccgccgtctgtttgtagatcgggcgggccagtcccaggccgtcgatgatgtccggcaccgcgaaggacacgtgctgctcaatcatttttttgattttcccttcgtcggccttcgccgtcccaaaggtgttgatttcaaacatttccggttcttcccgtccaatggcgtaggccagcgccacctcacagcgcttcgccagtccgcaggcgacgacgttcttcgccagataccgcgccatgtacgcgccagagcggtccaccttggtcgggtctttgccagaaaaggcaccgccgccgtggtggcaggccccgccgtaggtgtccaccatcagcttgcgcccggtcagcccagtgtcgcccaagggcccgccaatgacgaaccggcccgacggattgatgtgcagctgcgtgtccgccgtgatttgatcggcgccgatcgtcgcttcaaaaaccggtaccaccacgtgccgcaccaaagcctgctgcaatgcctgcagctcgatcgccggatcatgctgcgccgacaggacaatcgatttgacccggttttggccgtcgagggtcacctgagacttgccgtcggggcgcagccagggcagggtgccgtccttgcggaccgccgtcagacgcttcgacagcgccgtcgccagcacaaagggcagcggcataagcgtcttggtctcgtcggtcgcgtagccgtacataatcccctgatcgccggcgccgacgtggcggaccttgtaatgctcgccgggtgctctgtcctccggcggcagccatttgcagcggaccttgccgccgacccacttcgccgtttcaatcgtatcctctttggaaaccgccgcgttgatgtcagcggactgggcgttgacgttggtcatgacgatgcagttttccgcgtcgagcccgacgtcctctgaggtatagccgatctccgccgccgtctttctcgcgatcgcctcaatttggattgcgccgctcgaaagaagcgccggcgaaatttctcccgccagaaagagcatattttttgacgccatcacctcgatggcggtgtggctctccggatcggccgcgagacaggcgtcgacaatgccgtccgcaatctggtcgcagagcttatccggatggccttctgtaactgattctgctgttcttttcattttttatcacttttattgtacttggcttgcgccttcttcttttcttcccgaaccattttcttgtaggctgaaatggtcatcttttcgtatttcttaaagagcttgctgaaataagagctttcgttgtagcccagccgataggcaacgtcggtgacgctgtcgctggtgacgcagaaataccacttggcctgcatcatgcggcacaggtggatgtacgtcatcacggagatgccgagggttttcttgaaaatccggctgaggtagccctgggaaagcccgctgttttcccgcacctctctgaggccgatgttctcgccgatgtgttcatctatatataggaaagattttttcatcaccgggtaaagggcaatggccttgtgcctgaaaatcaaatccaaggtcgcgtagagcctgaattccagccagcgctcaaccggcagcatcttccccgccggtcgattgacgtaattggtctcttcgagacagccgtactgggcgaacaatttgttttcaatcgtgtaataatagtcgatgatttcgtctgtcgcgtcccagctttcctgcttgatattgtcgatcagctcgggcagcgcgtaatacatcgcggcgtaatcgctgctgtccacaatgccgcagattttatcgaaggtggcgttgcggcgctgcttcagcccgcggaagttttccagcagccgcttgacccgcgaaaagctcagcggcttgagcaggtattcgtcgacgccgatgtgcacagcctccttcgcgaaatcaaaagtattgtaggcggaaacgaggtaaatcgtcacgtggggcagtgcctcacggatcttcttggcggcctgaatgccgttttcgtccggcattaccacgtccataaagacgatatccggccgaaagtccttcaccttctcgactgcttctgtccctgttttggcaacggtgcagacttcaaacccgtcgaccatgccgatcatctgctcgagggcctcgcgcatcagcggctcgtcatcgacaatgagcacctcatacatcgctgcggcctccttccggaatgctgatcacgaggcggttaaggccgtcctctgtggtgcgggcgatgtgatagcccgtgccgtaaatccggcccagcttgtcgcggacagcttcaatgttggcttccaccgagtaatgctttttcgcttccgtcggcagctcggccacttcctcaggcaccacattgtcctcgatctcgcagatcagctggccggattcttgggaaatgcgcacaaggatctgtccgtcctgattctgattgaccagcccgatggtgctgtgttcgacaaaaggcacgagcatcattctcggaactctgcacttcatcatattccgcggcacgtcgattttgtactgaatgcggtcgccgaagcgcaccccctgaatgtgcagatagcattccaccgcctcggtctcctgcgcaaccgtccagtaggtgtcgtgctcaaacagcgtatctctaaggaaatcggaaatcagcgtaatcatctcgttggtccgcatcgcgccctcgatgatcgccagattcgcggcagaggtcagagaattgaaccagaaatgcatgttcagccggttttcgagattttcctcccgaggctgactgtcctttctctcgtaggcctcaattttccggtactgctgctcgatgatggtggcgtcctgtttggcgtgcgccctctgctgatccagctgattttccaaatcgatgcgcttgccgagccacattttgaccaattcagccgcaccctttaactgcactgcagtaaaaactggcatcgcatcgatcagcatctgattgaccttgcagaacgtctcagcctttttatccaggtccttgtcataatccgcaaagccgtccaggccgcgctcgacgcgcaccggcccaccctgaacggcgccgaggtactcgccatccttctcaaaggggaccacaaaaaaagtcaattgcttcaaagtccggtaaatgagcacgtccccgtcggtcaccgcctgaatgctggcttctcgagctgatttttcaagcgtctttttgatctcgcgccaattttcgctttccctcaaaatcggggcaccctcgttttccggcgccagcgcgcgccccttgtagtcgatcaagcggcaggcggcaccagttgcttgttgaaaggtctgctgaatttgtttaaattcgtccgatcccgcccatttttcaaattccgacatgttccgtcctcttttctctcaaattgtttctttttttcctattttaagaaaaaaatgagaaaatttcaacacataattgtttgactattcaaattatagtgttttatttttcaattactttatttgaaacgcctccgacaacacacagcgtctgcggtgagtgaaatgtcttgccgaaatcggcccttcaccggtctgagacgcgatggagaaggcgcagggcacgtccacgccgaagccaatcgacgaaatgaacggcgcgtttttgacaaaaatagccgtccgcatcgctctcgccgcttcatctaagcgttcgatgctgcggctgtgaatcccagctgtgtgatggtaattttgttcaacctgcgatgccgcggtcagcgccgatttaaagtccggcatccgaaccattggcacaatcggtatcttgacctctttcatcacgagcagatcgttcagacgggcctcgcccaccgcaagcttcgccggataatggtacacgacgcccgcgcggtccaagatttctttcaagggccggccttcgtaccgtctggccacgtcgccgtcggcattgaacatcaggcgctctaccttttccatgtctttgctgtcaagcacctgaacgcccactctcgcgaaagcggtcaaaagcggctccgcgacgcagtccagcgtcacgatggctttttccgacacgcacatcaaattgtaatcaaaggccgcggattccgcgatagccgacgccgcgcggtcgagatccgccgtttcgtcgacgatgaccggcggattggccggtcccgcgccgatgacctttttgtcggcacgaaaagccgcgctgaccgctgtactcgagcccgtcacgacaatcatgtccacatcgggatgattcatcagctgttcacagacgtgatgacctgtcgtcggcagcatcgagaccaaatgatcgataccaatcgcttctttaatgctcgcgttgatcaattcaaccgccgtctgactgctgtggaacgctctcggatgagggcagtggatgatggcgttgcccgccgccaaggccgaaatcgtcgtgttgatcaataccgcgatgggattagtgcacgggtgaaccgcggcgataacgccgcaggatgaaagctcagtcaagacgatgccgtcgtcattggtgagcacctctgtctgcaaatcctcgacccctggcgtcttgtcgacggccagcgcaatttttctcgccttgtccacggaatgccccatgccggtttcacgacaggccatttccgcgagattcatcacggcgcccttcagccctttccgaacggcttcgatcgttcttttcctatctttaagtgtgcattgtctgtacgccgtgtaggcttgtcctgaagcgcagacaatttgtcctatcgcatccattgttttcctttctgaatttctttgtatcatcgttgttcgaatggcttgtctacttataaaaatagggcccgaaaatcggaccctgaaatcaaaaccgatcaagacatcctgagatcaaaaagaatgggctctgaaagctcgtatttcggccgcgtcaccccacattgtgacgcagcctgatagataatttgtcttgtcgtttgttttgattattgaacggcaatcgatttatcgaccgccgattcaaccttaatatttggctatttaaccttgttttaatcaaccatcttttgtattaaccgccgattttgcacttcaggcctgccgcttcgaccatgtctttgaaatgattcatcgtttcccgagaaggggttttggtctctggcatccggtaaggaatacccagcagctcgtatttgttttcgcctaaagtatggtagggcagcaaatgtatttcgtggacgccctgcagcgatttcgcgtattcgataatttccgcgatggtttgatcgtctgcgttgacgcccggaatcgtcggcacgcgaataatggtttcgcctgcctcccgcgcgatgcgcgccgcattttttcttatgacttgattgctgacgttggtgaatttcttgtgaatctcgtcattgggtgctttcgcgtcgagtaatgccaaatcaacatgaggcagcaccagatccagcgcttcctcgttggtcgtgtaacccgtcgtttcaatcgtggtgttccacccctgatcctttgcagccttgagcagttccgccgcgaatttgtactgcatcagcggttccccgcccgacagggtcatgccgccgttggttctccggtaataactggcgtcttttttgacttcccggatcacctgctggacggtcatctttttccccttctgaaccagggcgtccgccggacagacagctgcgcattcgccacagccgttgcacttatcgtaatcgataaaatgcggattgtccggcgacagggcccccggcaccggacaaacctttaaacacgagccgcagtgaatgcagttttcagcttgatacaaaacaacgggctgaagcttctgagattccgggttgcagcaccacaggcatctcagcgggcatcctttcaaaaatacgatcgttcggatgcccgggccgtcgttgagagaaaatcgctggatgttgaagacactgccttccatcccataattgatattatcatctgcaagcaacgcggcttctccttccgtttagattattattattcgaatgtctgttcagttctcgcgatgatgtcatcctgaacgtctttagccagaacgacgaactgtgcggagtaaccggcgacacggacgatcaagtctttgtgctgttccggatgtttctgcgcttcgagcagagttgcacggtcgacgatgttgaactgaatgtgatagcccttgtgatcaaagtatgctctgaccaatgccgcgaagcgtttcagaccttcatcgcctgcaacggctgacggtaagagtttctggttcaacaaggtcccattaccgaagtcgagggcatcgatggttgcggatgatgcgttagctgcggtcggtccgctgacatcacagccatgacgcggtgaaatgttgtcggacaatgcggtctgtgctaaacggccatctggcagtgcgtcgacagcgcggcccatcccaacgttggctgaaacggtgtagcagcctgcgtggtaaatcccgccacgcgggttcttcttgccgtggacgttgctggagtagatcttcgtgatccggcgtccaagcaagtcgacttctggaatatcgttcccgaagtgcggtgagttaagcagcagctgatggatcttttcccattttgccaaatctgctgcggtcgggttcttcttgcagccttcgccgcacggtgcggatgaagcggatgccgattctgcgatcgacgcgatgtcgacattgctgctgcccttgaggacagactggacgacatcccagatcttctgttccatcgcggaacggccagctgttgaagtggcgctgcctgcgccgccgctcggggaaacctgactgcggtctgcgccgctcggtgcgccagacggatcgacggcgtaaccgaagttgttgtcgacggcttccatcatgtcagccatggtcatggtcttgtcgtcgaagatgttcttcttgactgcgacgaaagagtcgatgacgtcagcggtcccgaaggcctgcggcccggtgaagttgtagatcgcggcaccttcctgaacggttgcgcccttgtccatacagccgtcaaccaaggcggattcgaacggcagggtcatgttcatcatgtgggcgtagtcgacgcagttgtcggcttcgaccaaataatcgatgaagaatttcatctgttcttcgtaagctgcgacaaaatcttcaaaggtcttgaagtcggtcatttcgccggtctttggcccgagctgttcgccgcggcagcggccgttgtgcatcgtgatatccaaaaccttgcagcagttgaagaatgcggcatcgtgccagccgtctgtcttgtgctgcggctgcggttcaacgcatccgattggcagccagtcacgggcatcttccagtgacacaccgtcgttttcgagcattgggatggcgacttcgtcgttgtacatcgccggcaggccgtgtcctaagcggaccacttcgcatgcgcggtataagaattcgtctggcgtgccgtcccagtaacggatggacatggatggctgcggcagaccggtgtgggcgatggcatccagctgcatgtaggaaacgtcgttggttgcgtcaagaccttcaggggtctggccgccggcgcacatgttctggaaaatcgcgtagcccgcgaacaattcgtcggacaccgcgtcacgggttttgtttaagtcgttgagtttgatgaagatgcagtcaaccaattcctgcgcgaaatcgcgggtcatgttggcatcgttcttgtagtacggatacatatactggtcgaaacgtcccggtgagatggagtgaccggaagattcgatctgcataatcaattggacaaaccagaaggactggcaggcttcccagaagttggatgccggtttttccggtacgttctggcagttctgcgcgatgaccagaagttctttctggcgctgcggattgatttccttcttcgccatatcgagggccatttcagcgtaacgatgggcgtaattgatacatgcgttgtaggtgatgatgacggcatcgtagaactggcgttttttgatggtcgccggatcgttgggatcgagggctgctttcttttcagctgcttctttgatgatgccgctgaagccgactcttaaaactttgccgtaatcgacgcagacgtggccgatcccgttgtagtaatagttcccaacggtgaagacaccgagatcctggcatttctggcaggtgtcggacatcagtgagctggccagttcggagttggttctgcccggccaatattcaaaaactttttccaagcggtgcttggtatcttctggaatttcaaatgggtcgcatttacgtgtggccatcgtatcgaattcagccgctacccaatcgtaggaatattccgggaagagctggcagccgcggtctgttaacgtcgcagacccgacaatcagttcgtccgggcgaatcgtaattggaatattgtttaaaatatgttcattcgcgtgtgcaatccgcatgaccggcgcttctttttcgtgtgcgcggtacgcttctgtaaccagttccgcacgatccgcttcgacggttggcgtcgcgtcgataatacgctgttttagtcgtttgactcgatcggtcggttcggtgaatcctttagcaattcccataatagcctcctctataagctttcatatcatttttattgcgtcgcactgtttcacacacaccagcagtgcttacgatttcattataggtcaatttacgtgttgcctaataatacagagcaaaccaaaaaaatgtaattttaaatttcacgcttcagtgctgaaaacttcaacgccttcaaaaaaggcggcgtaattcaccggctcatcttgaccgatactcgggtcgtttgcgtgcagactttcgatcaggcggaccgcccgattcacttcgtcttcagactttccattggcggtcattacctggatgaacattgcttttgacatggttggttttgtttccattgtggcctctatcctctttttattttccaaatttcgcaataaactgttttaaaatcgcgacattgcccggccacgccggtgccgtcactaaattgccatctgtcatggcctgatccggcggcaattcaatgtattcaccgcccgccagcaccacttcaggcccgactgccggataggcagtcagttttcttccctttaagcaatctgccacagccaaaatctgaacgccgtgacaaatggccgcaaccggcagcttgttggtcatgaaatattggaccatttcaacgactctcggaatcgtcctgaggtattccggcgatctcccgccggtcagatacagcccgtcgtaatctgaaaaatctgccgtatcaaaggacgcgttaagggtaaacaaatggcccggcttttcggtataggtctgatcccctaaaaaatcgtggaccgcggttttgatcgtgtcccccttttgttttcccgggcagacgacgtcgacatcgaacccgcagaccagcagcgcctgatacggcaccatgacctcgtaatcctctgtgaagtcgccggccaacattaatatttttttactcatgctttctcctctagatgtttgatttgcgccaaaacgctcagccgcttaacgggcgtggtagcgggtgtgcagcagaaaccttgccaattcgctgcccggtgtctttagaaattcccgatacaattcttgaacctcggggttgtcaagagaatttctgcgcgtcaatctttcgtcctcccgatacaagctgcgcatgcgttttttcctcaaactgtccggcggcggaatgatgtgcccttgaggctgccccgcgccgctgatgcatccacccgggcaggtcatcacttcgatgaaatgaaagtggttgaaggcttcgctttcaatcaatttttcggcgttggccgtaccaaaggcaaccgccgttttaatcgtcttgcccgcaatggtcacttctgcgctctttattccgctcaatccccgaacgggttcaaaatcgagcagggtatccggtgccggtttcttttccagcagtgtatacgcggcgcgcagtgccgcttccatgacgccgccggtattgccgaaaatcacaccggcgcccgtgcccttgcccagaagcgaatcgaagggcgacggctggagcgcgtcgtaatcgacgccctttttcttcatccaccaggccagttcctttgtcgtaatgacgtaatccacgtcccgcatctgagggcagcagcccgctgcacccgccgcgttgagctccggtctcgaaatttcaaattttttcgcggtacacggtgtcaccgccacgtgcacgatgttctgcggatcgatttgattttgaaaggcaaagtaggttttcaccaaggcgccctgcatcccgatcgggctcttcgccgacgagatattgggcagaatctccggatgaaaggtttcagcgtatttgacccacgccgggcagcagctggtaaactgcggcagcggaccgctttgatctaaaatccggctgagcagctccgtgccttcttccacgatcgtcaaatctgcgctgaaggtgacgtcgaggacgtaatcgccgccaagggcgcgcagcgccgcgaccattttgtcttcaacatactgcccatccaagcggccaaaggcatcacccaaaccgactcggacagagggcgacgtggaaaacaccacgattttttctggatcgttgaccgccgcttcgaccagagggacatcatttttcggcgtaatcgcctgttccgggcaggccgccgcgcactgtccgcaattcagacaggctaccttttccctgcctgcgacgccgttcgcttcctcacaaaccgcgtagcagtgcccgcaggacgtacacaaatcgttatttttcacaatggccggattgtccggtgccacgtaaacgtaaggttcatgcatcagaggttcagcccctttctcttatcatcgataatggcgtccagctctgccgccgcaatggccgcatctggttcgatgatcagctgcccgccggtcatggattttaagccttcagtcagcgtttcgacaatgacgctgctgccggttacaaagggcgccaagcccaaatggaggggcagccctaaatccagtgcgaagactccgtcagccaaagcttgttcttcgagccactgcggtgcggagaacaccagcggcagctgtgggatatcgacgttcatttcccgggcaatatcgccggcaaccaattccatccggccaatagccagacacgggccaaaattcaataccggcggaatgcccagctgtttacagacggctttgagccccggcccggccagctctgccgcttcgcgggtcatcaatcctgtgttttccagtccgccgcaggtgcagcctgcagacagaaccaaaatattccgtttaatgagttcttttaccaaatcgacagtcaaaacatcgtgtccgcctgctcgcagattcgagcagcctaccacacaggcgatccctttgattgttccttccgcgatcaatttaataagcgcctgataattgccgccgaggaaatccttcagcgtcacttcggtgacccctgtgatggattcggcgtagccgtgggccttcatcggattgtcacggcccgcgccatggcggtcttgatacgctttgatggctgtcgaaatgatgcgcccagtaatttcattgcgcttttcgtaggtgtacacatccatttccgcggtggctttttttgccaccgggtcgatacacagctgcggaatgttcagcttttcacagatcggttcaatccccggaagcgtgcagttgaattcggacacgaccatatcgacgcacccagtcattaaaaccgcttcgctggtgtaattattgcccgcgtggccgcagaaggcatcgctcatggatttcgaacgcatctggaaatcttgaccgacgcaggtgcagcccaccaaacgaatgccgctggcgccgaccatctgcgccatcttctgaatttcaggtttgcccagcgtttcgtctaaagtttcaaagaatgcgtgctgatgccctgtaaccatgatgttaatcgcggtcgggtcgatcacgcgcatgccgaccggttcaaaggcgatttcactgccgcccatgatcacatcgttgatcaaattggtcagaaccaatccgtacacgccggtgccgattcccatgcgcatcgcgtggaccagcaaatccatcggatctgaatttaaattggtcgaggttttgattaacgcctgaaagacttcgtccttcgcaccgcccggcatgatgcccagcctgcgccaattgtctacccgcatcggatacgcaattttggagaccagcgtcatgtggtcatccaccggtctgttgagatccgtcagtaccgcgtcggcgaccgcttcgcattttgcccatgaatcaccgtcctgaatctcaaacttgtcgcacagattgtccagagcggtttcgtttttgattttgccgtgcgtctgcccaattttcttcagctgtttcgccgcgttttccacaacatgcaggtaacaggccgaccctgccgcaatctgtctggtgaaattgcgtgccgcaatcgtgtccgcgtctgcaccgcagacgccgcgcggccgcgtataagaaagccggcaggggccgttgctgcacaatttgcagcacacgccatccagcccgtatccgcatttattggtttgatacgccatgcgttcgtgggccgtttcgcatcctttcagctcgcgaatattcttttccaatacgggatccgcgtctcgacacattttcttcacagccattctttttcctcctactttgtactgctcccttttctttgtctatcttttgcagtcttatttttattatatttcccatgttaaacattttcaggcaagatcaaaacgtcttttgtataaatttgacatcaaaaaaacgcccgaatccgaagattcgagcgttggcgttttaattgatttttaatctatttaattattcaaccgtcaccgatttagccaagttgcgcggctgatccgggtcgaggcctttgccgacggaggtgtaataaccgatcagctggcagatcacggcggtttcaaagacagtcaagtcgtcgggcacgtctggaatcgacaggtggacgttgcagatcgtcgggtcgttgatttccttgtcctttgagatcagaatgacaaaggcattccgcgctttgacttcccgaatattggaaataaccttttcgtaaaccctctgctggttggcgatggcgatcaccggcacgccttcttcgatcagcgaaatcgtcccgtgcttaagttcacctgctgcgtaggcttccgcgtgaatgtacgaaatttccttgagcttcagcgccccttccatcgccacgcggtagtccagaccgcggccgatgtagaacgcgtcctgggcgttgaccattcggctggtcaattccttgatctggttttcgtattgcagcacttcttcgatgtggcccgggatagccttgagcgcctgtaccttttctctcgcttcgtcttcggtcaggcggcctgtcgcaaggccgagcttaaagccgaggaggtacatcgtcgcgacctgaaccgtgtaggccttcgtcgaggccaccgcgatttccggacccgcgtgggtgtagacgacgtaatggctttctctggcaatcgacgattccttgacgttgacaatcgacagcgtccggtcagtgtactgcttcgccagcttcagcgcttcgaaggtgtcgatggtttcgccggactgagagacgacgatgacgatagaatttttgtcgatgaccggctgagaatatctgaattccgacgcgatcgaaaccgtcaccggcatttttagatgattctggatgaattccgcgccgaccataccggcgtacatcgcggtgccgcaagcgacaatcgtgacgttttctgcgcctttgaagaagtcgtccggcacctgatcaccggagaaatccggtaaatcgttcttaattctcggcgtgatggtccgcgtaatcgcggccggctgttcgtggatttccttgatcataaagtgcgggtagccgtccttttccgccgccgtcaggtcccagtccaccgtcatgatttccggcgtcaccgggtggccttcgagatcctcgagggcaatgccttccggcgagagggatgcgatcgtgtattccggtacgacgaaatagcggttggtgtgttcgataaaggccgtaacgtctgaggcgataaacgcgccgatttctggatcgtaggacgcgaccattgggctgacgttgcgcaccgcgtagatttcccccggatgatcttcgaacaaaatgccaaaggcgaaagagcccttgatttcagcgacggctttgcgaatcgtttccttcggatcgtgggtttcttcgtaaaaatgattgagcagtgcagccccgacttctgtgtctgtttcggactggagctcatccgccaaattgaatttattggtgatcgccgcgtagttttcaatgatgccgttatgaatcagcgcgaccttaccgacgcggtgtggatgggcattggcagtcgagacaccgccgtgagttgcccagcgcgtatggccgatgccgcaggtcgacgggttcactttgtcacagaccgcgcgcaggtccttcaccttgcccgctgtctttcttagtgaaatatgcggctgattttcacggaaataagcaatgccggcgctgtcatagccgcggtattccaagcgtgaaaggccgttgatcaaaacattttgaacctctaattttccggtataaccgataatgccacacataatcgtttcctttcttgtcgcaagatgcgaaatctataatttaaacttacagcttaaaagttgctttatagttgattgaccatttaatttattgggatagtttaccacaaaaaaggaaaaagaaaaagcactatctggttgatttgccggtcacttccgcgcagccattttgaagggtgatcgtccccttctgtgtggcctgagccttgccgcagcgcgccacacaggtgaagaaccagctggtatcgttgagctgatcgacctcaattgtcaccctgccccgtttttgcgtcagggtttcgccggtataagcggcattctcctcgatctggctcttacattgggcgacgccggagtccagcagcacgaggcacgcctcgtgatcccgataacgggccgccgtctgaagctcctgcccgtgaaaggaaaagagcgacaggagtggcacgacggcgagcatcatcaccacgagaaccagcggcagcaccgtcccccgctggttgagccgcctataccgattgtgttcacggcgttctgactgtgacgctctgcgcgtgctttggcgcgtaaatttctgtttcataaacattgggatctccagcgtactgcattttgagtctaaatctgccgttcggcgtatcgccctgccactccggcgccaattcaaaatcaacgacttccgcgtccagctgactgcgggagccgttgtcgagggggacaaagttattgtagtatttgtcccgatacaagatatgtgtttcttgtctcaatgtgtacaaatcataatacagtggggtttccatgtcctgcacgtagacatcatccccgtcgatgacgacggtatccgccgaacggatcgtcttttcgataaacagatggacgtgtctgaactcctgaacgtgggaacgggccgatccggccttcggtattttcgtcgaaatggcggcaaaactcggcagcagtccggctgccaagccgatgatggccaatgtcaccaaaagctcaatcagcgtcatcccgcgctgactctgtattttcgtctgtttcagctgaagtcgatgccgcataaatcacttcctgataggtttctgaacgcatgccctttggcgcgaccgtgatgtccacatcgtaacggctgccggttcttccggtcacgttgaaccgataggtgatccggtcgtccgatatgtcctcggcgacgtcccgcagccgcgcattggccgccgcgacgtccggatggttcatcgccgcgacagccgatgccgcccgatgataggctttaggcagtccccgtccttgggcgttgaggccggctgacgcgtttttcaaaatggccagattgcccagcagtgagatcatcagcacagacaacagcgccacgatcataatcgcaaccaagctgtcgaccagcgtgatgccacgctgagaggccatcttttttctcacgcattttatcatccgctgcctcccgtcaatccgacagccgaatccggcccgtgaccggctgaagcaccaaattgcgcttcagctgtcccggacctcttaataggattgtttgtcccttgttaatggtgcccgttggtaaaaattgaacgcgaatatatctccttgtgtcaatagttccattagcgaaagaagcttgcattttctcaaaatacacgtatttggagtaaaacttttctttctggtcatcccaagtcttaatctcgtacctattgtagaagatctccacaatgacccctcgattagcgtcctgcatcaacgctcggtcccgcgcgtcgttgagggcatccttcagcgcttcacactccgcgtcgaaggcttcccggttcgccatctggacaccggccgtcccgatgacggccacgccgccgctcaacagaccgatcaaaatcagcacgacgagcatttccgccagggtcatgccccggttattctttatccgcgacagacaccacaccttcaaccttgtcgtagacgaagaccttgtcctttgccttcgcgctgtaatcattatctgcttccttcttgaggtatttgttggtaatcaaaagctgaacgacttcatcgtacgcggcattcgtattggatgctgccgtgacagtcggcagcgcaccctgatcggcttcgtacagggtgaccgccgaggtcacctgcttagcgttggccttgtcaacctgggtcctcgatcggttgacgatctgcggcaccgcgacaatcatcacgccggccaacaccccgatgataatcagtgtaaccagcatttccgccagggtaaatcccttttgattgctgcgctttttgatttgctttgatttagtcatcgtgtcgcctcctttattttgaactttacatcatcgctgcgtagccaccgtaaatggtgtagagcagactgataaacgaaataaccacacagcccaccagcacgccgacgacgacaatcagcgccggttccaacacggctgaaaaccgcgcgaacatccgatcgtactgtttgcggcagcgtgcacctgcctttttcagcatgggcagcagcgcccctgatttctcccctactttaatcagccgctcacctcctttgtcgagcaggcccgtctgcgctagtcccgccgacagcggctgcccgttgctcgccgcctcgggcagtccgtcgatctgtgacttaaaataagcgttggtgacgggttttccagaaacaaccaatgcggtgatcaaatcgacgccgctttccagcgccagcaccagcatatccaaataggccgcccaaagttccagacggcgcatccgcccaaacagcggcgattctaacagcagacggtccaatccctttcgaaaggctgtctgctccggcaaaacctgatggagcacccaaagcgcaatcagcgcggccgcaagcgcgcacagtatatcggccacggcgccatttaagctgatcaacatccgcgtccccgccgtcatcgacagatcgagactggcgagggtatcgatcaagtttggcagtacgcttgtgaccagataacgaaccactgccatcgccatcgtcaggacgatggccggataaatcataatttgaatcaatttatttttctgccggctcagccggtcgtaatacttttccagacgctccagcactgaaatcagccggcccgaggtttcccccacccgcagcgtttcgatcatcagctggggaatgcccagcccgcaatcggccatcgccgcgctgaagggtgcgccttgttgaatcgcgcgcaccactgattcgatgcctgccttcaaaggccgacggggctcgccatccaagaaggtttttaaagattcgaccaagtcgaggccggaactcatgagcaccgctaattcgccgcaaaatgcagccaatccctcgtcgtttaatttccgccgccgcctgttttgagcggcctcaaaggaaaaggtcaacgtcttcataagccacactcccggttttcaaatgagccaccgcgcttttgcgaaaagggcggctgtgcgcatttggcgtgtccgcccctgcatccactaaatcaaacagcccgatgcgcccgaatttccctgtctgccggcaggccgggcagcctctgccgacgcgcagcttccccggacgtttcaagtttaagcgcttagcctgcgccgcgttcatcgcgacggtttcgccacatttcgggcagatcttcggaaccagccgctgcgccatcatgccaattaactgatcgtccgccatgtaatccggcacgccaaaatccaaaagccgctcccggcagccccaggcgcttctcgcgtggatcgtcgcaaagcacaagtggcccgtcgccgcagcgcgaatggccgcgtgggccgagcggctgtcccgaatctcgccgaggataatgacgtcgggatcctgcctgagcaccgcgcggacgcccttttcaaaatccatatcccggacgccggacagcgacacctgagtcaccccggggatcaaaatttcggccggctcctctaagctcacgaggtgcaccccttcacggttcagacggttcgcaatcgaaaacagcgtcgtcgttttgcctgagcccgtcgggccgctgatcaaaatcaagccttcccgccggctgaccatcgccgtcagcttcctaatgtccgctgccgtcagccccagccgagacaaatcctgaatgtaataccggctgtcgagaatgcggatcaccatgtgttccccgtgcaccgtcggcagcaccgagacccgcatcggaatctcgtgaaacacaaaggcgccgtcctgcaccgagcgtttgtcgctgatatccatctgcgccagaattttaattcgcgaaatcatgctagtgtagtcttctgacgacaaagaagtgtagaaaaagagcgcaccatcaatccgaaaacgtacgcgaaaagtgtctgacccgatcggctcaatatggatatcagaagcccgtttatccatcgccgcggtcaataatctctctgttaataagacaatcccatcgccgtgtttttgattcatggtgcgctctttggtcgcacgatttgtatcagaagagtgcttatttttaaaaaaattcatgttaagctactctctttgatttgaaatttttcagagtatatcacgatattttgatttttgcaatcgtttttagtaaattctttaaatgattataatttgtatgtgcttataaatgtaatgtaaaaattaacaatgaagattgtttgaaaatcaatgcgacttttatttagcgccccacgaatagaatgaaaatactttgcaaacagactgaactataatgggatccagaattgaataattctcaaatgcaagcataacataaacgtcaaagagcagaccgtcatcgaaacgatctgctctttttataccattcttctatatctgtcataaatacggagtctcttaccttacgcccaaaatctttttatactgcttaattttgagcgccgcttcagcttcagactgttcgaaaacgcggatcaccctgacgtcggcctctccgtcccgccctggaacggtcacaaaatcgcccggtttcacatcaaatccgtcacagatataatcgtaatttcgttcgtttccttcgaactgaacgctcacgaattgatgcgttttcttcgcgcctcgtgacttctccgctttcacattccagacaagctgatctacgctcatcattttctttttatggtaataaaaacaaatcacgtctttcttgattttaatgcggtcaacgtaaaatgtccgctttggtgcccacacgtccactttggcgctttggtctaaaacaaatgacgtttctgtggcttttttgcagtaagaaatcaaaggaagtgtcagcagatacggatacggctggacgatgttccctttccccagcgtccgcgcaaggatgattttgtaccccttctttttctttttaacgacgactttcatttccgcgtattccccaaacatgaatttctgaataaaggactcaatgtcgacgccacaggtcttttgctgacaatattcgcccagttcttgtttcacttcataaagccctgaacggatgctggccgagactttaccgaggccgaagaaatccgagtgctgcatccgctcatcgatcgccacccgagcaatcagatagtacgcgtaggctgtcctcaaatctcggtcagtccctacgccgtgctggtagcaactcgcgatgcgcagcgcgagatcgctgagcacaccgtcaccgcactcgataaattccctgtagctgtcttcgtaataccgggtataaagattgaaagctgccttttcgtttttataaatgcccctgccgtcgcggagcatgtccccgactttgtacgtcgcctcgtaatatccaaaaaaggccgcgagcgaaaaatatttatatgccagatcatactgcggctcaccaccgctacatcgaccataataataaatgtatccgagcgtgttagctgactgcgcctgcatatcatcatcgccgatctccatcaatttgagaaagcaatccctcgatttttcccaatcgcaagaatacagcggatgatcgtcgccgtaatgcgcgtagccaagggtctgaatcgcgtaggcgttaccctcacccgccaactcttcgagatattttttgtagagcagctgtacatcttcttccgcgtctgctaaattattttcgttgtacactgagatcaaccgttctttttgagcgtgggtgcagatccattcgcggtggggtcttccctgattaattttaaaattgtcgatcatgtctgcgagatcctgaagggcttcataacattccgtctgattgtcctgataataatcacagtcatttgcgagatcaacaagtctgtcaacgacatatttcgcgagatcactctcagaattgtaaaaaaacaagtcttctgcaaacccgttttcgagaaaatcgattgtttttccgtcttcgccaatcatttttggtaagtggatcaaatcgccgaaaacccaatacaaattgtcccaccattctgataatatttcgaaagcatcccgcctctgtgccatctgcgtggtcaatgcctcacggatatccattagactgatttcgtagggtttatcacaaatacaaataaatgtaatctcatccaaattctctaaatcctctaattgactcgttaattcatcaaatgtgatcgtcccatggataaaagcgatcagatcgtcgtactttatttcaattagtttatcagtcattgtgtacctctttctctgaatttatctatcaaacgattgtttgtctagaaaaaatcatcaacatacatgtacatatgctgtcctctaccgttaatggcctgctcttttatatattccccgccgctttatcctttacgaccccaagcacttctctaagcatattgttcggcaggtacagcggtgtggacggcgcggcaatgccgtacacgtgccggtagccggcctttttcgcaaggctcagcccgcggtagacgtgaaaattgttcgtcacaattccgatgcggtcacccttgatgtcgatcagctcagctgaatatcggatattttcgacggtattctgcgaccggctttcactctggatccgattcggcgcaatgcctttttgaattaaataacggcgcatggccgacgcttcggtctctggctcgttcgggccgcgtccgccggagacaacacactgtgtctttggattagccttgaggtaatccgctgccgtgtccagccgataagccagtacccggctcggtcccgtcgttttgacctgcgcgccgagcacgacgatcacgtccagccccttcggcgccttcgcgcgaaactgtgtatggatcagcgcgcagaccgccacaatgctcaccaccactgccaacagtaccacgtcaaccgcaatccgtgcaccgatgggcatccgcgcccaagcgccggtgtgcacactgacggccgcagcggcgaagagcgcgccgatgccgaaccacacgcaataaaaccgcgtgccggaggcgatgctgagaatcagcacaccgtagacgcacgacagcgccgccagcgcgctcaaaatcaccacacttttttccatacgctcacacataccattccggccgtctcatccctgtgtaaggctttgcctggcgccgagccgtggcctgttccaactcgatttccgcgtacagcatcgcctcgtccccacctgccagagccaaagtttcgccgtcgggccccgccacaatggatctgccggaaaaggtcatgtcgtcttccgtgccgacccggttgcacatcgccgcgtacacgctgttctgaaaggcctgcaccttaatttcccactgaaacagctcgtccggctcgccggtattgttcgccgtcggaatcaaaatcaactcggcgcccttcagcgcttcggtccggatgctttcgggataatgccgatcgaaacagacgacaatgccgattttcccaagcttcgtctcgaagacctgaaagccgtcatccgccggcgtgtaataatcctgctcgtaaaatcccgggcactgcgcgatgtgcaccatcttctgcgtgccgaggatggcgccggtgtcgtcaatcaaaaagctcgtgtcatagcgcccgccgtccagagccatataaaaattgggtgaagcgaaaatgcggtgcgccgcgcacgcgtcctgcactgccttcaggtacgggctgtccatcgtcatgcagtactgggaggcgtcctgtccggggtgcttggggaaaaaggggctgagctgaatttccggaaagagaatcaggtcggcgccctgcgccgccgcttcctcgatgtgtgccagtgtacgatttaaattagcggtcatgtctgccgacatgcgcatctgcgccattgcgattttcataagtgcttcctctcgtttcgttttagccctatcataacacagggaaatgaatcgctgcacatttttagagaaagccgctcacataaaaaagactggcttgatggagaacagccagtctcggtttgtattggatgtattaaagagaaggagaagttttcatttacgcgtgaatgcgccactgcgtcagcagatgctctgtgccggcgcgtaaaaatccatgatttcgctgcggccctcgtccatttcggaaatagcctccatgtcggcagccgtcagctcaaaattaaaaatatcgatattctgctgcattctttccttgtgtgtggatttggcattgattgaaatcccgcgctggatcagccatctcgagatgacctgtgccggagatttgccgtatttcttcccaattgcgatcaagatgtcgttctggaacatccctcttttgccttcgccaaagggcgcccaggcttccggctggacgtgccatttttccatattggcctgcgccgcaatctgctgattcattggacagccagattttcgtcgtgataaaaatgtcttcccgcttcacgccgagttccttttccgcgcggcggaggccttcgccgacctgtgcttcattgaaatagctctgtgccgtatcgattttccggtagcccgacgcgatcgcgtcgacaaccgcctgggctgtctggtcttctggaatctgataaacgccgaatcccatctgcggcatcaccacgccgttgtttaaggttaaatttatcatgattggttcctccatttgatttatatcttatttgtattttcctaatccattaccgtttggtctgggctctgccccatcgtctgagcgacgccttggacgcgtgttcgctgaatcgtctgcctttcagccatttgccatttttggctctcccagcgagctgggtgccgctgtccccgagaccgctcgacatcgaggtgcagaacggaatcacggttttgccccgcgtcgacgaaaagaaaacccgattttcacctcatctttgctgatttcattttaatgtctcaacgcgtcgatgtacaatgcttaggattgaagttggtataactctaagttatactccggatttactgtgcgccaaaaagtcaattagcggcttcggtaccaattgtgcaattttgtatgcattctataaatagactgtgtgcactttttcataaacagcacccaaattatagaaaattttataaacttttgttagaataattttttttacagacagcttggaacctcaggaggtgaccttcatgatcgaaatttacttattagagcagctcgccgcatttgccaaatacggcacactgtccgccgcgtcggaacagattcatatctcccagccggctttgacccgctcgatgaaaaaaattgaagaagaactggatgtcaaattatttatccgccagaaaaaccgcctgattctcaacgaaaccggaaaactggcggctactttagctgaacagctggtcaatcaggataatcagctggttcagcaggtgcgcgcctttgaccgaagcctgcgcaccattgccttgggctcctgcgcgccggttccgatcctcgaaatttcaccggtgctccagaccattttctcccaaatgaccatttcaacggaaattcacaacgacgaggaccttcaaaagggcttcgacaatcaccttttccagctgattgtcacccacgaaatgccggaggacgatgcgctttttgcggtccccttcggacacgaaaaactgtttatcgcggtgccgccggcccacccgctggccggcttcgatgaagtgcgctttgccgatttagacggcgtgccgattctgcagtactcaaaggtcggcttctggtacgatttggttcacgaaaaaattcccaacgccaatttgctgctgcagacggaccggcgcaccttcacggaaatcgcctcagcctcggcactgcccactttctgcaccaactacgttttgaaggatcgtgatttgtcaaatcgaaaaatcattcccatctcagattccgaagcgtctgtccattactttatcgtctgccggaaatccgatcggccgcgctttaaacccttgttcgatcatctgccaaaatggccaacctaaaataatatccgaccaaaataactaaaatgttcagtttcttatccgtttactacaagaaagaaacgattacagatgttataatgggataaaatcaaattgcaatcctttaaatttcattaaaaggctgcatgaggagggtataatatatggcaaatcgttttattttaaatggcgcttcctaccacggacacggcgcaatcgaagtcattccggatctcgtaaaaagctacggctggaagaaaattttcgtcacctctgacccagatttggtcaaatttggcgtcactgcaaaggtcaccgatctgttggacaaagcgggtatcgcgtacacggtatactccggcatcaaaccgaacccgactattcaaaacgtccaagacggcgtcgcagctttccgcgaagctgaagcagattccattatcgccatcggcggcggctcttccatggacaccgcaaaagcgatcgggatcatcatcaataacccggaacacgaagatgtccgttccctcgaaggggaagtgccgatgaaaaagcacgcagtgccgaccatcgctgtcccaacgacagccggtactgctgctgaagtcaccatcaattacgtcatcacagacgtcgaaaaagaaagaaaatttgtatgtgtcggcccggacgacattccggaaaccgctattatcgacccggacatgatgtcctcaatgccgaagggcttaaccgcttcaaccggtatggacgccctgacccacgccatcgaaggctacaccacaaagggtgcttgggaattgtccgacatgttccatctggaagccattaagctgatcgctcagaacctgcgcggtgccgtcgacaacacgccggaaggccgcgaaggcatggcactcggccagtatatcgctgggatgggcttctccaacgtcggtttggggattgaccacgccatggcacacaccctgtctgcacactacgatatgccgcacggggtcgcctgcgcgatgctcctgccgatttcaatggaattcaaccgcgattatgtcggcgaccgtctccgcgacgtcggacgcgccatgggcgttgaaggcatcgatgatatggacgccgaagccgcaaaagatgccgctatcaccgcagttaaacagctgggcgaagacgtcggtattccgaagacgacggacaagatccgcgaagaagatctcgatcagatcgcagctgacgcgttgaaagacgcctgctatccgggcaatccgcgtgaagcgacaccggatcaggttaaagaaatgttccgcatgttaatggcttaagccgattgatagttgtctctacttattaactcataaaaaaacaaggtgtctaggatgtttcctagataccttgttttattttgaattaatatctcgggtcagcgtagccaaaaatatctgtcgatgtttgataatttccacgattaacgcggcgcacctgactcctgctgttgccttcaatcgtaatcaaatcgttgtgcttaatgctttcaacaaagccgatgtgatcgaccactttatcgccattccagtcaaagatcactaaatcgcctgttttagggcgataactgcctcgccaatgccagcagcctctcgtctgataccattgaaccgcagaagggacgtaagcattacgcatgaaattagatggtgctcctgccgcttcaccgcaccaggaaacaaacataaagcaccaattttcatggctaaaatcccatttacgttgcgctcccaagtactgattgtaccagacgccatattttgtatatttattgttccccgcatgataaccgatttgagatctagcaatttttatggttttcgaccgcgcatttgacacgtaaggaacataagtgacacctggagaaatgcccttcggctcaattacaatttgaagggcttccatgcggcgcgaaagggaataagtccctgcggtttcaccgttctttgcccaatctagccagccgtaaccttgcacatgcacgcgataataaacatcgaaatgtttggctatttccccagaaagcctgattcgaacggcttctactcttaaagatcttcctgatgttccagcgttctcgccatttttcttccaaacatttccctgccagccaatattctgaacatgggcttggtattcaatatttcctgtcatgcctaaattctgtaaatttgtcaatttcaattgaagagcttccaaacgtagtgcgcggccttttgtcccaaaaatctgattttcgttatgctggcgctgccagccaacattctggacgtgcgtctgtccttcaacaagatagcctaaataaggtgtctgaagggcagaggccgtatgcagcggatcattgacctgagcacccttttttaccaattcgatctgcaatccttcgattctaagcgatcgtccgatggtgcccgcgtactcaccatctttcgcccaattcagccaaccgatattctgtacatgaacgcggtaataaatatcgtattgatctgcaagtgttttgtccgttaaatgaatttcaatcgcttcaatttggagactccgtcctgaagttccggccattgtgccagcgctgactgaactttgccaaccgatattctgaacgtgaactctgtaggaaataccgccattggcaattccattgttttttaaacgcacccaaaaagcttcaactcgaagaccttttccggtcgtccctgccaattcgccgtccgatacttccggctgtgtgccgatattttggacgtgtgtcttatacacaacactcggtgtgtcctcctctggctgctcttcctgattttcatcggtcttcggcgtcgacgcctcagcactttccgtttgcgtctgtgcagccgcttcagtcgaactagctgtattcgttgtattttcgcttgtctgtgctgtggcaaaaacagcgctgctagccagtacgccaaccagcagtacaatcaaaagcgatgagaatattcttttaattttcacttattacctccttttatatataacgatcaattacgtccttttttgatcagttttgctatctttagtagaatccacgtacaaacgaaagacaaaatcagaacgataaaaatcaatcctacaaagcccgcagcaccataaatatatggattgaagcccaaaacctgtgtaaaggctttgataaaaatgatatgaatcaaataaatcccgaaagaacaggaatcgaattccaacaggaaacggtggagcgcatccggtgctttatttttaatatttaaaaatatattgaacaccgcgcacgatgcgacaataactacaggagaggaataagtccaaagcgctgtcaatgacttaatattattgatccatcgcaatgacgtgaagctaactattaatatcgtacaaacgaccacgagtagaacgcacattttttgatttagcttaatgagctgctttctgattgcatatcccaaaaatagataaaagggataaatcgatgcgatgtgtatcgtaaaattgatataaattccaaaccctgacaaaacaggaaagatcgaaagaaaaataaaataaatacctaaaaaatatttaagttccagctctgaacaagcctgcgcaatttttcgatagatcggcagcagcagataaagaccaatcagcatatagagataccagagcggtttccagctggtccctgtaaaaatctgcgcaatgccctgaatgaccccgcggcccgtgatgccactagggctaatcatcatgtcgaagaaccgataaaccatcacaaaaatgactagtgctctgaacactcgcaataaatattttcggtatatttttttaatcgaaatctcgcgagacggatctaaaagcaaagctccagtgatcataataaaacagggaacggcccacatcatacaattggtcaccgcagatgttgccgaataattaaaaagagaaatgctgttctgaaattggtacccgcaagcgtaggtcgcgtgcaatacgataattgcaatgcacgcggctacccttaaataattgaagccaacaatttgatgttggcttcgatttaaatctgttgaattcatattaatacatcgctccatcgccgacgcatccactactggatgatccagaagaagttgaagaagagttgctcccacccgaagaagctgatgtgcttggtgtcgtccgccgtacagttgttcctgtactgcgggaagcagtcccagaggattgcgtacgccgtgttgatgatgtagatgaacgcgacgatgttgaggatgaacgtgtagacgccgccgaggatgcagcagactgctgtgcagccgctgcctgtgcttgagcttgctgctgagcctttgccgccgctgcggcttctgcatcctttttaatcttcgtttcgtcgcttaatgtacttactttttcttttgtcccttttgaaacgtaagttaaataggctaaagactgatcctgatcgtagtcgatttccatgctcttgatatcatcaaacggcacattgtgcagctcaatcgtgctgttgtcgtcaaaggtcaattgaattgaaaacgaagcgttcagttcttttgtcgattttttactgctcttttgaatggccatcttcgcgttgtaatacaaccgacgtttctggccattggtgaatggctttttcgtcgtgatcatgtttttgggatacgcatccatcgacgaatctttgattgtaaagcccgtaatagttttgcccgttttattcgtcgtattaatcgcatatacgtattttccgctttgcacttttcctattgccggcagactgcttttctttgtcgcctttttctgcaccgtctgactgctgccgcatcccgctgctgccaacgcaatcagaacagcacatatcaggaccagaaacagtttaatcttgtttgaaattcttaattccatcaatattctccaatttatctaagcttcgtgcgatgatatttataataccgccaggttttggcttttccgtatttgaaatgaaaagccggcagatgcaattcattggtcaaattcgggtcatacacccaagtgccatctttttcatcgatttccacccaactgtgtggtgcatcgccgccgccaatgtgtggcacgaatccgactacttgatgtgcatcataacctagagcgcgtgccatttctgtaaatgtcgccgccatgacgtagcaattcccacgatgctgcgtgaatccaatattagcgtaccagcgagttcccatattcggagaatagtactgacgccaataggttaagcctgctgaccagttatatgcagcccgcaaatttcttcctatatgattgagcacagcgtttgcctgtggatacagattcacgtgtatataatgacgggcagtcgatcctgacgcgccttctgatttaggtcttaacaccacctgcaccgcttcaatacgcagactcccattggaagtaccggcccattcaccattcttggcccatccaagccatccgtaattctgaacgtgaacccgataccagacatccattgctccagatgcataaccattcaacttcatttgaacggcttcaactctcaagctcttgcccgaggtcccgctataggcgctgccattccggctgtcctgccatgcctgctgattgccgatattttggatatgagaatgataagtaatgtacgaattattagccaaattatcttgtaccgcaacacggtaaccttcaattcttaagccttttccagtcgtaccgctggttgcaccatttttactccaatcggtccagccaatattttgtacatgcgtctgataactcacaccaaggttatctttaaacatcgccttggtcagctcggaatgtgaatctcgtccattattactcggcgctgcttcaccctttttcaccagcttgatttggatcgcttcgacacgaagtgccagaccttctgttcctgaagattcaccgtttttcgcccatgccagccaaccataattctggacatggcacgaataatacacatcatactgattggcaagatctccgtccaatttaatctgaatggcttccatacgaagtccttgtccagttgttcctgcgtacgcaccgttctttttccaatcctgccaaccaacattttgaacgtgcgcgcggtaatcgatattgcccgatgtacccaaatattctggatcagccaccttaatcgctatgccttcaacgcggagagatttgcctgtcgtgccggcaatttccccatcagctttccagctctgtgtcccaatgttctgaacatgagtatagtaacttatcgtatcatagagaaaagccttgctgtttgcagatggcgtattcactggatcattcgttggcgtttcaccctttttcaccagcttgatctgcatcgcttcaacacgaagcgatttgctaacagttcctgcaggttctccgtttcgagcccaattcaaccatccgaaatcttgaacatgtacacggtaaacaatatcgtattgattcgcaagatcgccgttaagtttaatcttgatggcttcaacgcgaagggcttttccagttgttcctgctaactcattttgattgtaatctttccaaccaaggttctgaatatgggctgaataacttaatttgctattgcccgcattttctaatcgaacgcgaaaggcttctaaacggtaaccctttccaatcgttcctgccaatgcgccatcggccacttctgattgtgttccaatattctgaacatgagcactgtaaatgacgctcggaacactttggccttgctgttcaacttgagttgtattttgagcagtactgtctgtcgtctccgaagttggatttgatgccgattttgaagcattttctgattgcgttaccactgctgctgtagatgaagttgaattaccagacgcttcgtctacacctgctgcggaaacacccacacacgcaaatattccaatcagtagaaaaactactaatgatgaaaatactttttttaatttcattgaaatattaatcctcctgtcttactcatttcatcatctatctattaaatcatcttaaagaaatctttacagctattattataacgctactgagtcaatttgcaatttatttttattttaatttagcctgttatctttgaaaaaaaagtaaaaaaaagagcggcgaaccgctctgaaaaaagatataaaattttataaattcgactcactaaaaacaccgccagcatttccgctgacggtgtttgaaaatccaagcaataaaaaaaggcttcgcaacgatctatcctcccaggcagctgcccgccaagtactttcgacgtgagagagcttaacttctgtgttcgggatgggaacaggtgtgtcctctctgctatagtcacgaaacctatttaactaagtgattattcaattgtttgaggtcactcaaaacaacatagagttttttaagcgcttaacacgtctttggatcaagacctcggccgattagtactggtcagctgaacacattgctgtgctttcacctccagcctatcacctgatcgtcggtcctaaggtaggcgaaattccttgtcaggtaagttctgacccgcacgaaaggcgtaacgatttgaagcactgtctcgacaacacacccggttgaaattgtagtactcgtgaagatgcgagttacccgcgacaggacgaaagaccccgtagagcttttactgtagtctggcaatggatttcgatatgtcatgtacaggataggtgggaggtgagaaagttgtgcgtcagcatagtggagccgatgttgggataccacccctgagatattggaattctaaccaaagcgctgtgaaccagtcttcggacagtgtcagatgggcagtttgactggggcggtcgcctcctaaaagtatcggaggcgcctaaagttaccctcatgatgggtggaaatcatcaataagagtgcaaaggcagaagggtgattgactgcgagacagacatgtcgagcagggacgaaagtcgagcttagtgatccggtggtaccgagtggaagggccatcgctcaacggataaaaaagctacctcggggataacaggcttatctcccccaagagtccacatcgacggggaggtttggcacctcgatgtcggctcgtctcatcctggggctgaagcaggtcccaagggttgggctgttcgcccattaaagaggcacgcgagctgggttcagaacgtcgtgagacagttcggtccctatccgtcgtgggcttagaaaattgagaggagctgttcctagtacgagaggaccggaacggaaggacctctggtgcaccggttgttccgccaggagcacagccgggtagccaagtccggaagggaaagtgctgaaagcatctaagcacgaagccccccttaagataagatatctcatcccttaaagggagaaggccactgatagacga

SEQ ID NO: 16 - DNA, 3286 bp, Unknown
  Metagenome-assembled genome
ccaaatctttatactcatagtgcatcagtaaattcctccacattaaacatagacgattatctatattgtatcacatgaataatgaaaaagattgccgttcggacgaaattagattttttactattatggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttagaacgttggtcaaggttacgccgttggcgcacgccatgttcaggcaaatcatttaaagaaaactcaatttttccttgatttaaccaattataaattgatttagtcgctagtttaaattcgtgagcaatcattcctggtgaccagcttagacgtaaatggttgagaattttttgttttaactcatcgctcagcttagttttccgaccacatcgtgatcgcttgtattcggcatctgtttgggctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccttattggatactaaatattacaggttccagaaaattttcgtacttttctaattttagttattctgccaattattaccatagctattcatcgggtggtggtgatgatgccgcttaatcgttgtccgttgccgtagttcaatttgaatttgctcgagggtctttccctgagtttctggaacgaagctataagcaaagaacaatgagagaatgttgcaggtaataaagaaggcaaacgttccaacaccaccccagtgagccatcataattgggaaggtgaacccaaccataaagttagcaagccagagacaaaatgtcgaaatccccatgccaaggccccgtaagctttgcgggaagatttctgagagtaacacccaggtagtcggtgagacacaagactggaagaaggcaagaaaacacatcgtcatcgaaataactacgtatggtaagacgatggttccctttaaccaaataattgccaacgtcaacatcgccattgaactaccagttccgataattccggttagtaacatccgtcgccggttaacggtatacatcaactgcattccgaccgccgtagcaataaacgaggttaatccattaccaatattagcaatcaaggctgctcgatggccaaaaccaaccttcattaaaatgctggtaccataatacatcatgatgttaattccaacaaactgttgcacaattcctagtccgatcccaatcagtactaagttgcgcatccaaggatgggataagtcacgaaaatgggcgcgtttaatatctttattccgtttcatgacgctatcaacactttgaatttcctgcaagctttgttgatggctggaccgaatccgttgcaatacttctaatgccgacttttgtttgcccttcatgaccagccagcggggcgattccggtacccgccacataccaataaagagcataattgacggaatcatcccaaatgcaatcatataccgccaaatattgccgacctgcggaaagcatgagcctaataaggcattgacggtaaaggcgagtagctgaccaccagtaatcattagttcattttgagtaactaatcgaccacgtgttgaagccgtcgcaatttcagctaagtaggcaggcacaattaccgatgcaccgccaaccgctaagccaagtaaaaagcgaaaaataatcattaaaattgcattgggtgccattgagcaacaaagagttccagcgaagaatagtactgctagtccaatcaaaaggtgtttacgcccataccgatctgctaatttaccggcagctagggcaccgagcgctgcacctaacgtaatccctgaagtaactaatccctcttccgcaggggttagatcaagttgttgcggtgaggccatatatgggatcgccccattgatcaccccagtatcaacaccgaaaagtaatccacctaatgtcacaattaacgcaattttccttaatcgtcttattatctgactcctaataaaagatcatcctccttaaatttagggaagacaaaaagcacccatctgcaacaaagcaaattgaggggctttgttgttgagggaattgctttccactctcctaattaacaattttaggataacacaaacaaccattacgaatgctcactggctaacaaaacgagtagttgacttaacacgattgcttttagtaagtcgatttagcagtaagataccgagaatcttaaaattcatcaaacatgatttgttcctcaacaaaccggtcaaaaaatggcaacataaattgcacatagccataactagccggcataataatctgatcatcaattaacttgcgccgataaacagaaatataacccggcttctgccccatttgatgaccgatctcctgtgctttcaccttgggatgccccacctttaccattgcttgcacaaactgacgttccttttccgtcatttcatgatagaccttataatatacgtttcgataaaggtcactaagaagctgtccaagatctatgatttttgatatacttctatgtaaaaagcgagtttaagctatgaaaaattatcccagcaatattactcggcaacaatttgaattaattcgaccagctttagaa

SEQ ID NO: 17 - DNA, 7382 bp, Unknown
  Metagenome-assembled genome
tacccgaccctgcaaaagccactggaacagaaaaagaaaaactacaagcctttagaaaagttcgaaacaaaataaaagataatctattcgaacttgtacaaaattataaatagggtccatttctaacaaataacccctcgaaaaccttgttaaaataacccccaacatctatattatagatgttgggggttatttattttcatattataaaaataacttcttttattcgtcattttttcgataccttttagcacgattttgaccaggaaataaacgatcatgtgatccgactcgaatgccaattaagactagttcatctttatcaatcgtataaaccaccaggacatcgttagtttcgcttggtgttttgtttttcggggtatctcgtaagtgaaattcattatacccgctcattcgccgattaagctcatgatcttcaaattctggtggtaattgttgttgctcaagcaacaggtcaatggctgctcgaacttcatcaataatagatttgtctaaactggctaaccgttttagatcagcattaaaggttgcacgtggtttaaatcttagttttttcattatttaaactgaccccaataatcatcatctgattcaacaatttcatcgtcaggtaaaacatggcgtttaattaactgatcacgtgcaattgcatattctaacgaaccttctttcgcttttaatgctctttctagccagtccattttttcttgtgaaacgatggctactgcgcgactatttgaacgagcaatataaacggtttcgtcttcgtcattaacttgatctaaatatttttttaggttagcgcgaaaatcgctctgtgttagtgctaatgtcatatttaccaccctttcattgtacttaatattgtactctaatttgtactaaaaatcaattttttaaggagctaaaactatgcaacaagttgtcttacccatcaaagattctaacgttctcaaagaggttcaagataccttactcaacaattttaaagctggccggcgtaactatacagtttttcaagttggcaaagcgacactgttgcgagtcagtgatgtcatgtgcttaaaacagatcgacatttttaatctggacggtacaattaaacaaaatgcgttcattcacgatcgaaaaacgggtaagcctaataccttgtaccttaaaccagttcaaacagagctcttattgtatcgccaatggctacttgatcatcagctggattctgaatggctctttccttccattcaacaccccgaacgccatatcacggaaaaacagttctacaaaattatgagtaaggttggcgagctgttaggcattaattatctagggacccatacaatgcgcaaaaccggggcttatcgtgtctacacacaatcaaactataatattggcttagtcatgaatctgctcaatcattccagtgaggcgatgactttagcttatttaggcttagaccaggctagtaccgaaacgatgctggatcagattgattttggttaggaggttgtccttatggatttagattttaaaaccaacaaatatgagctgtttgatgattggcaccaaaacaagactaaacaagaatttacacaaaagttgcagcaacaagctcaagttgaaaaaacacagctaccacaattattgtcgcgtgaagacttaaaaattcgttggcagatgaactctcgtcaaagtgttcatcaagttgctagtaaacctgatttcccacaacctgtttttgcttttaatcatggtaagacgccactttacttagcaactgaaattcaaatttttgaaattaatcacccctgggttctaactcctagtgctcggcttgcttatagttattggattcttcacaatgtgattagttaatctttagatttagcgctaggttcttaatcgttggcgctagccttctaatacagataatccccattttgttggggattaaatctacccttgacaagtgtcaagggtgtaagtgcgcattgacctcgtttcactcggtctgctgatttcccatcactaattttagtgtcctttatctaatatcattactagacctgctttaaacacactctttagccataatagctctcattgattcgttattagttttaactagataattaaaacaattaacaacatgagatacactgaaaaatggccagatgagtatctttttacaagaatatcaagcttatatatttcctaaattatttcttgtctttatcctcattcttaactggaaaagcgccaattccaaaacctatagtaacagcaagaacaatccagtcaaaatcatgtttatcaaatattgcactataagctacaaacaatccaatcgccaacaaatatcgtaaaatatacacccaaatttttttgctcataaccctctcctcctagaacaagttgctcatactcagtttaatcaatattaaaaaattattcttgctaattcatgtagctaaaaaagagcatagttccccctggagactgctaagcgtatttttaagctagactagtcaagcagtgatcatttaaaatgattagcccgctgattcaagttggctaagccggctaaaattgcccgttgtttgctcgtataagcaattcaatcgctaatttaataaaatatatagtccatcgctaaaacggctgagaaacgattttagagctaattaaaaaggggtgcttgctggctgcttgtttcaggatgttcagcttgatatttagcgttggcttttttgttccagtaaatgctaaacagattttgcatggtgccatacaagtaattctctacgttcttgatatgtttctcgttgcttctcagggcattgaagtagcgtcttaatgtcttggtcattagggactttagttcgggatcatctaaagtaatccaaacgccgaggtctttgtgggctttttcaatggcatacttagcatttaagataatgccaatgaagcgacgcatttgttgcggtgttcggcaccaaaagcttaaaagttgaacagctgacggctctaaaaagagctggcctgtgtcagcgtcggttaaaaagtcgtaggcatggctaactaaatcgtggttttgttggttaatttctgctggtgtgtaattagctgtggagaagtccaactggtgagtatctatattgtatctatctttatctctttctttaggttctttatctagatcgtgtctattttttagactttcgctcgtagcaagggtttgcggggtgtcatcaacggactttcgcgaaggtctattttttagactttcgcttgtagcaagggtttcaacggtctcccgcgaaggtctattttttagactttcgctcgtagcaagggtttgcggctctttttggccatattcaccgcgtaaatagacgtccgttgatcgcatatctagttcggccaggtaaagtcggttgggttcatttttccctgttttgggattaaaatgcatggctttttgataaagcaagccagctttttcgagttctttcttaacggtggctaattttccctttgaacaattgaatagatccattaattcttgattggtaaaaataaagtagacgtggccttcctcatcaacccagtgattgcgtaaggaatactcgagccgatctttcagcaccatgtaggccaatttggcttcactacttaaataccgatattgttcgccgtacatcaatactttgggaaactgaaagaacaaggccccataaacgttgtcagcttgataaaacttgaaatttgtttgatccattataaaaactccctttctatactcgacccatgctggctcaaaagagagttgctaaaacatctgacttgttttaaaatacaaatctgatatgctctaactgaattacaaagcattcattggttgtgagggctttgtgattcatcagcatggatttcttttcttggttgcccaatcggcaacttttttaatttctaacaacaaaataggactaaatagccgttggctacttagtccatctttaatttcttgtttgttattatctactcttgtcccgatttaagggtatgaggtataatgaatacaagcacagaaatcaaagttcaaacattcattctgccaggtctgaatgtttggactaagtagctggtctctagctacttgctaagaacataaaatctcgatctcaatcggatcgggattttttcttggcttgatttttatttacttttattttgttgtcagattagtttcagtttagcacaccgctttcagtgcaacaataactatctttacagattccagttgtactttgaatcgattaacctcaaaatagaaaaaaggacatttttaatttaactaggtggtgattgacattggcaaaaacaattaaacaacttgcagatgaattaagggtctctaaacaaactattcaataccactaccaaagactaccaacaaagaaccgacaaaaagatagtcaaggtaaaaacgtgattagccttacagctgaaagaattattagaggcaaggtagcaaagactttggtagcaaatagccaacaaacatataataaaaaggcgacaaagactagcaaagaaaataatgagctaatcgctactataagaagagaagtagcagatttaaagtctcaacgtgaccaacaacttgctaccaaagaccggcaaatagatcatttagcaaaattgatagatcaacaacaacagcttcaattgacaactgtagcagaaaataaaaaattaaaggaccatatgcagaaactaagtagattgcttgaagctcctaaatcagctcgaaatcaacaagaaaatgacaagaaagaggacatacataaaaataatcccaataaaggttggtggcatttttggtagtaagtctttcctttcacccaataattagttatcgaacgcaaaagcagctacaagcatttgctaaaaagaatccggaaatcaaacaacccgatcttgaatctgatcgaagcatgaaacgttagccagtttttaaaggacatgctataatgaagacagagaaagaaagccccgctagaacaggacttcccatgtagagccgttaaagacggtggcagattttaacgatatttaataaccgctagctgagctaaggcggttatttttttgctgacttttgatcagctcaacaattaatgcgatccagatatctaaaacaggcgaaccggcacatatgccggaaaattcagaggttgcttttaaaattggagatgtccgtgtttcgaaataagtaactaaatacaacaacttattgttacttgaatatttttgattggtctgctagcacaataaaaggtatcattaaaacatgaataaataaatcggttgacgtaagctcaaggatttctctttcaggggtgtggaggaggtatctgggtttacgttttttgtatgaggaggtttttatttggaatttttaggtaccttggtgatcatcttgattgcaactagtctgtttggccatctatcctctagagttggtatcccagcagtggtcggtcaactatttgttggaattattcttggccctacgttgttgaattgggttcactccaatgatttcatccatattttttcagagattggggttatcatcttaatgtttatcgccggacttgagagtgatcttacattgcttaaaaaatatttgcgtcctagcataattgtcgcgttgttaggggttttgattccgatggtactgatctatccaattggtattgtttttggcttgacacaatttgaaagcttgtttttgagtgttatttttgccgcaacgtcggtttcaatttcagttgctgtcatgaaagaactaaatttacttgatagtaagagcggttcaacagtcctcggtgccgcggtggttgatgatgtgctagctgtcgttttacttagcattatggtcagtgtaataggtacaaaggccggtacggatacccagataccgctagctctgacttttttagagcagctaatttactttgccgcaatttatttcgtgatgcgttttatcgcccctctcctcgctagactaggcaccaaattattgaatccagtgggacctactataatggcgatgattttgtgttttggtatggcatatattgcggatctgattggactgagtgcagtgattggggccttttttgcaggaattgcgattgcacaaactcatgtagcccatgaagttgatcaaagtatcgaaccaatcggttatgcgattttcattcctgtattcttcgtttcaattggtttaaatatgtcactagctggcatagaacacgatttgttattaattatcgtattgacgattgtggcaacactggcaaaactattaggagcgagaagtggggctaaatgggccggattcagttcgaatgaagcttacctcgttggtgcggggatggtctcgcgtggggaaatggccttgattatcgctcaaataggctaccaatccaaactaatcagtgatgattactattcggcaattatcactgccattatcctaacaacgttgttggcaccattactactcaaacatgcggctcgtcatataaaccactaaaaaatcttatagatttcatcgagatattacctagtttaattaagcactaaattatataatattggttataatggaggattagttatttgatacagcttgtaaaagaaaaatttgacgttactcgtctgcgatttgttttactcggcctgcttgtgggtttaatgagtggcactgttgttagcttatttcgctattgtattgagatagggctgcactatagtcaattggtatatggacacttacgaatcgcgccgtttgtttggtgggaatgggcattattgattggtgtcaaccttggtgtagcgctaattgtggcgcgacttctcaagagagaaccttatatcgctggttccggaattccgcaagttgaaggtcaattggctggtgaattggaaatgcactggtggtcaattctatggcaaaaatttgttggtggtattctggcgttgggacctggattatttctcggacgagaaggaccatcgattcaattaggtgcgtcagttggtcaaggtttcgctgctgggtttaagttatcaggaactgatcgccgactgctaattgcatcaggcgccgctgctggattagcagcggcttttaatgcccccattgctggaactctatttgtcttagaagctgtccaagatctatgatttttgatatacttctatgtaaaaagcgagtttaagctatgaaaaattatcccagcaatattactcggcaacaatttgaattaattcgaccagctttagaa

SEQ ID NO: 18 - DNA, 8510 bp, Unknown
  Metagenome-assembled genome
cgttcggaataggttatactagacaaaagatcagctcctaaaagatgggtttgtggtaaacaccattttaaaggaagctgatcttttttgtccgaacagcgttcggattaattttacaatctaccatccaagcaacattagtgctaacagtttaaccagactactttaaatatgccaatattgaatattcttttgccagcgttgtcgcttaattcgccctaattggcgtcgaatccgccaattggtaattttccgccaaaggggactgtgataagccgtttgctgataaaattgacgttgccaataggtaatgtctttgctaatttgttgttgactccaccaaacataattatgagtcaaatatccggcaacttggacataaggacgttcggtccagtaggctgctcccatcaattgacctcgtgtaattggcaggcctctggttttaaaccaagccattttataaatcttctgaatcttgccaactcccatgggtggttgttgctgatcagtgtaaggagccaaaggaacgacaatcaatgcttgtaaaatttgctgggggtgcgccgtttggtttaaggccaattgtaaatcattagaaaagcgataggtacgctgtttagttgtcaattggatcttggcacaccagagcttagtcatgttaaaccaccttcatttaatttcagagtatgccacatgatgggcaaaattggcaacttttgtcttatctggatctttacgagcttctttatcaattagctactttaatttggtcttccgctcgatacttttcgatccgatagagggtaactggggcaatccccaacatccgcgcgatctgacgtttggttaattcttctccctgttcccggcgcgttagcaaacgacaggcttctttataaatataacgtttctgtcgattcggtgaatgtggtccatattcacggactttaccatgatattttccttgccgtttagcaatttcaatcccttgtcgctgtcttactttgattgtctcacgttcttcttgggccatatacttataaagctcaataatgatattggtaatcaagttacgtaagttaggatcttcaatactattaaagctcggtaaatttaaaatgtttaaggtggcccccttatggcgaatggcttccataatttctgttaaatcggctgaatttctacctaaccgatctaaacttagcacaattacctcatcatcgtcacgaagataatccagcatggcttgaagttgtgggcgggcagcattttttccagaaagtttctcttggaaaagttttgtcactcccgctgcttgtagttgttcaatttgccgggctagattttgctcacgagtactaacacgtgcgtaaccaatttttgtcattttcagaacgcctccggaacacttatatgtaactaatgataatccaactttcggatgaatacaatagggtagaccttaatgttatttcttcaatctatgcattttcaaattagaaatatcttcaccaacgtagacgtgaccatgtttagtatataaggtattaaaattttctttgggattatacatatagaaacgttttgaacttttatctaaacttttatttttagcaacaataaaatgaataaagccatttttttcattccatgttcttgatttatttgtttcataataatctgtataataaatagtgtgccgatttttaacgtacattaaaacgtatctatgaccatataaatgatgatcccaaattcctagatagtgtgtgggaagtgtggcagttctaaaaccatattttaaattcttggcactaacgttatttggattaacaataaatagtgtgaataatgaaactacaaacaatattgatgcaaataatttcttcacaacgaacccctcttattacaatattttaatcttttacaaatacatgataagattaaataaacgcttagtaaaggaggtttaataaatatatggcgacaataaatgaaatagctaaagaattaaatgttagtcgtgtaagagtttaccaaattgttgcaaagcttcccgaggacttacaacctaataaagtcaatgggcactaccgaatagaagataaaaatgttaagtcaattaaagaatactttacaaagagttctttaaagcttaagcaagacaataatggtgagaatgaatataaaattgcaaataaggctttagaaaatgaggtgcaaactcttaaagaacagttaacaaacaaagatgaacacattaaagacttaacacaattgcttgatcaatctcaaagattgcaattagatgtccaaaacaaattgaataaattagaaaataaggaaataaaatcctctgagagcacttttaagagcgataaaaatgaagataatataaatactaatcaagaatcagaaagcccctctatggatacaagagaggcaaataatgaaaagcgtagtaatttttggagtcaattatttaggggcaaataatttgcaactagatgtagagcaaatttatagaagctgcttttttgttgattctttgccggtagtctttggtagtgatattgaatagtctgcttggagacctttaattcatctgcaagttgtttaattgtttttgccaatgtcaatcaccacctagttaaattaaaaatgtccttttttctattttgaggttaatcgattcaaagtacaactggaatctgtaaagatagttattgttgcactgaaagcggtgtgctaaactgaaactaatctaacaacaaaataaaagtaaataaaaatcaagccaagaaaaaatcccgatccgactgggatcgagattttatattcttagcaagtagctacataacagctacttagtccaagcattcagacctggcagaatggatgtttgaactttgatttctgtgcttgtattcattatacctcatacccttaaatcgggacaagagtagataataacaaacaagaaattaaagatggactaagtagccaatggctatttagtcctattttgttattagaaattaaaaaagttgccgattgggcaaccaggaaaataaatccatgctgatgaatcacaaagccctcacaaccaatgaatgctttgtaattcagttagagcatatcagatttgtattttaaagcaagtcagatgttttagcaactctcttttgagtcagcgtgggttggatatagaaagggagtttttataatggagcaaacaaatttcaagttttatcaagctgacaatgtttatggggccttatttttccagtttcccaaagtattgatgtacggcgaacaatatcggtatttaagtagtgaagccaaattagcctatatggtgctgaaagatcggctcgagtattccttacgcaatcactgggttgatgaggaagaccacgtctactttatttttaccaatcaagaattaatggatctattcaattgttcaaagggaaaattagccaccgttaagaaagaactcgaaaaagctggcttgctttatcaaaaagccatgcattttaatcccaaaacagggaaaaatgaacccaaccgactttacctggccgaactagatatgcgatcaacggacgtctatttacgcggtgaatatggccaaaaagagccgcaaacccttgctacgagcgaaagtctaaaaaatagaccttcgcgggagaccgttgaaacccttgctacgagcgaaagtctaaaaaatagaccttcgcgaaagtccgttgatgacaccccgcaaacccttgctacgagcgaaagtctaaaaaatagacacgatctagataaagaacttaaagaaagagatactaatagatacaatatagatactcaaaagttggacttttccacagcccatttttcaccagcagaaattcaaaagcaaaaccatgatctcataaatcatgctaatgacttcttaactgatgaagacagtggcttaccggttttcttagaaccagaagctgtgcaactacttagtttttggtgccgtaccccgcaacaaatgcggcgcttcattggcattattttaaatgctaagtaccgagttgaaaaggatcatcaagatattggggttctaatcccgcttgacgacgaagaactaaaacctttgatgactaaagccttgagacgctactttaacgccctaagaagtaatgagaagcatatcaagaacgtggagaactacttatacggcaccatgcaaaacctatttgggatttggtggaataaacaagcggctagagaatatgcggccaaacaccctgaagaacagaacactgacaatgagcgtgcttggaattaaacgtcatattagctcatttaagtcgttttaagtgttgcagtgcataattatattaaaactgttttaaaatcgcttagaagcaaaaataggtgccttaagtggccgaattgacgatagctgagctagaaaaacgggataggagctttttaaatgaccaaacccagcaaagaaatcgaaacaattgatcaattgctggctgacccctgggcagtcaatattcaagacatttgggaacaagcagcacataatcaagatcctgataagcgcaagttgtttgacgcgttacacacttacctcttagataaacgccaagagaaaattatcaacgaaaagcatttcgtgatttaacatgagtgagctaaaaagatacctcatcgtagctggtataaacggcgctggtaaaagcactttatatcgcgcgagacccgaattatttactcactccaaacgattaaatgccgatgaaatcctacaaaaaatgggtggcgattggcgtaaagatcgtgataactttagggcaatgcgcgaagaaataaaacaattccagcggctttagatatcgggcggagtatccatgttgaaacaaccttggctggccagggtagggcgcaattgaatttaattgatctggctcaccaaaatggttttgaggtaacacttttatacgtggcgttataaaacgaaaaagtaacaattaatcgagttcatgaacgggtcaaaaaaggtgggcacggggtaccagatgaagttgttaaaaaacgctataatcaatcaaattataatttagcagcagttgcattcaaagctgataacgtcgtgatctgcgataatagccaaaaatttgtatcagtttacagaagagagcatgaccaggtaattaaaaataatttgcgagattttccttgaataaaccccaaaatcacctttgaagcatccgttcaaaaacaattaaattcctttgttaaaaataattcagatttaaaaattagaaatcccatgaatgattcagaaaataaaaacgatcggcctagttattaggctgatcgtctttaaatttattcggtttatgggcattaacgtaattggcaaatatttttaaaagttcttcggtttgttcgaccgataggttatcagcttgaaagtatttttcgagcaaagcccctttttgaattaatcggcgagaacgggctttgcgggcttgccgattttcgtagtatttagattgccgtaatttaaaatcttcccgctcaattttttgttttaaacgcgcttgctgctcaactaatttttcatattgattaggcatagtcattaccacctaactattattggttattttgagcttgatttaaaaaggcggcaacttttttagcaatcattttaatctgcggagtggtaagtgtcccataatccaaattggctgatctaatgatttgcttaccgaggttttgttcaatcttatttttttcagctttaatcttttgattaagctgttttaatttagcttcttgtttttctaagttactttgagacataacgatccctccaatcgtattaaaaataattaccgacactatatcattcagagaatgttaagtcaaaggatagaagttgaaatagcgaagcggaaggcatacactaaaagtaaatttaggagaatcagcaggccgagtgaaacgaggtcaatgcgcacttacacacaacaactaaagttggttgtgttattgtactaaacacttgtattagaagtcgccgttggcggcaacaaaatcaaacccataaacccaaagaaaggtggtgactgacatggcaatttttcacatgagctttagtaatattagtgctggaaaaggaagaagtgcaattgctggagcaagttatcgaagtggcgaaaaattattcgatcaaaaagaaggtcgaagctatttttatgctcggtcggttatgccagaaagctttattttaacaccaaagaatgcgccagaatgggcgagtgatagagagaaattatggaacgaagttgaaagaaaagaccgtcgagcaaactcacggtacgctaaagagtttaacgtggctctaccagttgaattaagtgaagatgaacagaaagaattattgacaaaatatgtacaagaaaattttgttgatgaaggtatggttgccgatgtggcaattcatagagatcacccagataatccgcacgctcatgtgatgttaactaaccgtccatttaacccagacggaacgtggggattgaaaagtaaacgagaaaacatattagacgaaaatgggaacaagacttatacaggaaatagtcgtttcccaagatcaagaaaggtgtggttagttgattgggataaaaaagaaaaaatcaatcaatggcggcacaattgggcggcaagtgtaaatcaggctttggagcaaaaaaatattcccgatcggatcagcgaaaaatcatttgtggaacagggaatagctgacacaccaatgcaacatgagggaatcaatagtaagcggcatgaaagaaaagaatttaaccaacaagttaagaactatcgtaagtccaaagctggctataaaaacaaccaagaaaaagtaatcaatagaggtcatttagatagcctaagtaaacacttatcgtttaatgaaaaacgggtagttaaagagttaagccatgaactgaaaacttatatcagtttggagaacttagatgataaacggcgcatgctatttaattggaaaaacagcaccttaattaaacatgcggttggtgaagatgtgactaaacaattattgacaattaaccaacaagaaagctcactcaaaaaagcagatgaactcttaaataaagtagttgatcgcacgactaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggaagttattaatgcaacaagaaaaggaagtcaaaatcgagcttaaatatacgctgatgattcatgatgatagcttagaaagtctagaacacgttgatcaaggtctactagaaaagtattcaccaaccgagcagcaaaagattactcgcgcagtcaaagatttacgaacaatcatggctgttaagcaagttattcaaacccaataccaggaagttttaagaagggcctttcccaaaggcgatttagatggattgccattgattaaacaggaacaagcctatacagccgtgatgtactatgatcctgttttaaagccatgtcaggctgaaacaattgaacagtggcaagcaaatccaccacaggtgttcagtccccaagaacatcaacaaggactagcttatttatcgggacagcttagcttagatcagttagaaaatcatcacttacaacgggttttaaagcatgatggcactaaacaactcttttttggcgaatgcaaagccgatccgacgattaagaacagtcagatcgagaaaatccaaaagcagttaaaagggcaacaagccaaggacgaccagtatagaaaagtaaatattggacattatcaaccgctaaattacaagtcagttagtccaagctactacttaaagacggcctttagtaacgcaatcatgaccgccctatatgcccgtgatgaagattacgaacggcaaaaacaggcgcaaggtttaaaggagactgagtgggaaatgacgaaaaagcaacggcaacaccaaactcgaaaccggcatgaagatgggggcatgcacttgtaatctaaatgtaaaatggcgaattgtcaaactaagtgcaacggtttgtcaaaaaatacttcatatggggtttcatagtttaacactttgcgaggacgttgatttaactgcttttggcagtgctcaacgtcctgttccgtataattatcaatatctgttcgcttgggaaaatattcccgaattaatccatttgtattctcatttgttccacgctgttcaggcgaatatggatcgggccaatagacagtaacacctaacctttcgctgatttcatcaagatgaagaaattcggtcccatgatctggtg

SEQ ID NO: 19 - DNA, 6066 bp, Unknown
  Metagenome-assembled genome
atgggaacggggcaaaaatctcacctatcagctattagggaccaattacaagtctcggggaaccaaactcgggcttgattatgaaaaggagacgatttttaatgagttggcaagccgacaaacccaatcaagaatcaaccagcaacccaaacgagccattaacgcaacaactgacccaactcaatcagaccctgaccgaactccggaattaccagggcactcagattcaactacaatcaacagccaaaacgtccctcgatcaacagcttcatcagatcgaacagaccgcccgacaagtcaaccaagagtttcagatgaccttaaacaacttagacagcaacaacgccagctcgcaggcccaattaaaacagaccttacaaaacgcctacgcagtgttccaaaagcagaccaacctgatcagtcagcaaaacctgaccgccctcaaacagattcaaaccgagcaaggccaaaacaaccagcgcctcagccaactcagcgaccaagtgaaccagaccattcaagagacgatggaccaagtcgctgatcaagtggatcagcagttacaagccacgaaaaagcggttctcgtggtatgaaattaagaattatttgttagcggtaatcccgactggcatactaacgggcctggttttctggttattaaccaggtatttcagttaattaacagcaattttgcaggattttatgatctaaattactgataattttatctcatggttaaaacgacttagatctctatttgcataaaatcaggtctttagaaccaattaactcatttttttgcttattattggccgtatttatagtttcttagccatttcaaaccaagcttggtgtatttatctgtcagttagttaaaacggctgataaacgattttagagccaatctgaatgagcctcttgctctttgaattcttcggggtgtttggccgcatattctctagctgcttgtttattccaccaaacgccaaatagattttgcatggtgccatataagtagttctcaacgtttttaatgtgcttctcattacttctcaggacgttaaagtagcgtctcaaggctttagtcatcaaaggttttagttcttcgtcgtctaatggaattagaacgccaatgtcctgatgatccttctcaactcggtacttagcatttaaaataatgccaatgaagcgacgcatttgttgtggggtacggcaccaaaaactaagtagttgcacagcttcgggttctaagaaaaccggtaagccactgtcttcatcagttaagaagtcattagcatgatttatgagatcatggttttgcttttctagttctgctggtgagaaattggctgtggaaaagtccaacttttgagtatctatattgtatctttttttatctctttctttaggttctttatatagattaagtccattttttgaacttccgctcgtagcaagggtttgagagctgttgtcaacgaacttatgcggaagttcattttttgaacttccgctcgtagcaagggtttcaacggtctcccgcggaagttcattttttgaacttccgctcgtagcaagggtttgagggctgctttgaccatattcaccgcgtaaatagacatcggttgctttcacatcgagcttggacagatataagcgattcggttcattctttttagttttcgggttaaagcccatttgtttctgaacgagtaatccgattgattccagctctgcttttattttgatgacttttccttttgaacaattgaacaagtccattaattcttgattggtaaagataaagtagacgtgtcctttactatcaacccagttgttgcgcaaagaatactctaatcggtctttcagtaccatataggctaatttagcgtcattgcttaaatgtttgtattgctcgccatacattaataccttaggaaactggaaaaacaaggctccatatacattatcggcttcatagtaattgaaatttgttgattttgtcataattaaaactccctttcttgactgacacacgctgtctcaaaagagagttgctaaaacatttgatttgctttaaaatacaaatctgatatgctctaactgaattacaaagcattcatttagcggtgaggctttgcaaattcatcagcatgtgtctgtttgtgagttgcccagtcggcaactttttttaatttctaacaacaaaaatggactaaatagcttcagttagctacttagtccattgacttcaatttgtttttaactatccttaacttgtcctcggggactggtttgcggtataattaacctacaaattaagaacaatgttcagtcgattttaacttggcggtgaaaatcgactgaatctaagtagctgtcctatagctacttgctaaatccaaaatccctgattcctcgtgaatcggggatttttctacttagcttgatctctttattcggttgttaaattaatcttagtctagcatagcgcttacctagcggcaactttatttggtcttgtatattttgccagcttttggttgaaaccgtaggcgatagaagataccagtaaatattcaaataatataaaaacactaaaatgcttggctgtattaatatcaaaagcactaaacacgaggagcataagtaacccgcaaaaatacgtgataaacagagacattatctgtaaaattcttacgacaatacgacggttaccgctgattcgttcaaataatagctgtaaccaatactgcattggaaataaccactgtcgaataaaaaagcggtcatctaccaggtgattttttgcaattccaatggctgggattatccaaaagacaataaggctggcaaacaaaaatataacacttagaacctgtctagtatctgctgaatctggtagaattgtggaaaaccgactgaggagtgtgtcatgccagattcagcagatactagacaggttcttatgatccttctcaactcggtacttagcatttaagataataccaacgaagcgacgcatctgttgcggggtacggcaccaaaaactaagtagttgtacagcttctggttctaagaaaaccggtaagccactatcttcgtcagttaagaaatcattagcatggttcaccaaatcctggttttgcttttgaatttctgctggtgagaaattggctgtggaaaagtccaacttttgagtatctatccgggagccttttttagtataccaatttctacttcacataatggggcttattccaagtaaccaccattcaccctgataaaacaacgatccgttatttggcctttgtgaaatttgacggtagaggagtggtctagatgaaaaatcccaaaaaaatcagtaactcactttgtgaatttaaccgcctaaactcctagaccattgcgccaatcgtgcctgacaccagtccaaaaaatcccgttctgaaatcgttggtgttcccgtcaataacttttttgtgatgggctcctcacctaaagccgtctcaattaacccaaccactaaataatctgtctgtttcgtaacccaattttgtggtttcgccccaaagactttcgccaaactaaaagcttgatcccgagtcatggtagttagacgtccggtaaaagcaatctcacaatctcttaaatcaagcattttaaatcatcaactttcttgattctaatgttggttttgacttgacgggttatggttttccattcagtttagagggagtgacgttttgagcgcagaattgttccctggaaacagttatttggaataactgaaccagagtacaattctactactaaaagtttccccttagttcgtcggtcgttaacgcccgtcgcttgtctgtacaattgcggtattgctaccaccactcattataaacctacgttttcggtttagcctactaaaaaacgccctagcaggcgttggtaatacgtatttacgtttgttcgatcaccaactaatcagtggcaccaagccgaagcttcgttttaccacccgcgccgttaatggtcgcgctcaccattcaccacccagccgtacagatgaccttgttgtggtatagccagacttattgaagtcgccctggcaaacgtgtccccttggatttagaccccagcttgtcccctagggctttaaaaatcgcaccggccatgatataatagtcattaaacaatgatgacttttttgtggcgctcaccgattcccgttggtgggtgtttttttatgttctattttatgtaaccaatattactcgttgtttggtgataaatcaacatttctttttatgtatccttgtatccttgtatccttgtatattcatatccttgtatctaagtatccttgtatccttgtatctaagtatattaggatacttgcagtcaatcttaatttaacggcttttgagaagaaatgtatccttgtatccttgtatctttgtatctttgtatgttatcatccttgtatccaagtatccttgtatattaggatacttaattggaggtcagtataatgggtgaagtaattacttttggaaattttaaaggtggcaccggtaaaacaacaaatgccacgcttgcatgcctggcactagctcgtgctggtaaaaaaacgctattaattgatttcgatcctcaagcaaacgctacagatatttactttaaaaccgcggctaatttaggccacgatgatattaaatttaatcaaaccttgcttgcatcaatccaagaagaggacttatcaagatcgttggttactttggataaaaacattgactttattccatcaagcgcagatttttcattgtacccacggattatggaaaaaaagtttaaaaataattataaagatagagttacatattttagcaagctacttgcttcactaaaagaaaaatatgattttgtggtatttgatttgccaccgactatttccttaatttctgatagcgccttatacgcttcagattgggttctgattatccttcaaactcaagagcacagtcttcagggtgccgaatcgtttctaaaatatatacaggaacaggtaatcgatgaatacgaagcacctagtttgaatttactcggtatacttcctgtgctattaaagaatggggcgcctgttgatcacagcacattagaagtagcagaagaagaatttgggaaagaaaacatgttaaaaaccctaattcgtaatatggaaagaatcaaaagatattcaatcagaggtgtatttctaaaagatcagttcgataaaaaaataattagattatacgattctgtggcacaagaaattattgaaagggcggactagcatggtggaacttttacacaatcctaactcaaataaaagcaaaataattcctagaaaatcggcgccccagccccaaaaagaaatttccatatcttctctaaacgaatcaaacaaaacgaagtctaaacaaatagatggtgttacttttgatactacgctcagaattgacaatcatctaaaaaactttatgaaagctatggtaattttagggtatagctcaactcaacaaaacggattagcccaattacaaaaaactttttttgaatcgttaactgattctgaacaaaatacgcttacgactcaaatacagactttggaaacaggcgatgctaacaaagtaaaaagtaaataatcacgtgctctcagacgacacgttcaccttttagatgtatacttgtccgtttaaattaagcagaatgcacacaaaaaattcctctattatgcggaatagagggcttttctgaaatcagtacatacaggctttgcttaggagcgttgcttgtgtccatttaggacatacacaatcatataacaatcaatcaatgctgtcacttaacttactcaaaaaagccacccacctcgtgatgagatgaatggctttttggttgtgtggtagattgtaaaattaatccgaacgctgttcggacaaaaaagatcagcttcctttaaaatggtgtttaccacaaacccatcttttaggagctgatcttttgtctagtataacctattccgaac

SEQ ID NO: 20 - DNA, 16427 bp, Unknown
  Metagenome-assembled genome
ggaaccttgattcaaaagcgggcgttaaagatgtgctgtggtttgggccgatgggttagttggtttgggatgaaggcttgaatcggcatttccctaaagccaacgacaacgtgcctggttatgttgggcggaatctgtgaacaaagttgcgcgaaaagacccgcaaggccgtgatcagtgacttgtacaaacaagttcatcgggcgccaaccgcgaagcagccgaactgaaactgaatgagttcgccaacaaactggcatcagacctatcccaaattaataaagatctgcttaaaaatgccgaatttactcacttttcatggaccttccaccagctatccggcaatactatactccactaactggattgcgaactttaataagcatctcaagcgcacccaccacacaaagaacaattcacaacgacagacttcacccccatggatgattcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctaccgatttattataactatatgttttcatcattatgataaaataattttgaatttaaatgtttaaggaggattttttcctcgatttaaaattgaagtgcaacacctgctctactagaccagttctttattcagactagtcaaaaaggccatgaagacctattcttaattcaccacaaacaagaaagaggtatcttcatgacccgaattaagaatatcatatctaatcagtatcaccaactcaatttagctgaacgtggtcgaattgaatccctaagggacttagattggtctatccgccggattgcccaggcccttcatcgtaatcccagcacgatttcacgtgaattaaaacgtgggacaacgacacagattaacgctagtactcatatctttgaacagtcatatctggcagaaactggtgaagcaatttatcgtaagcaccgactaaatagctgttatcgtggactctttgatcattgtcaaaccttctgtaatgctttggtgacagctttaaaagcgcgtcccaggatgcatagtgtggatacttttgtccaccaattcaagactgatcacccaaggcttgtctgcccctcaacaccgacggtgtaccggtatattgatgaccagcgtttagctatccgcaattcagacctaccagctaaactacgtcgccggattaaatgccccggggcaaagcatcatcgaatcaataagaaaaatctgggccattcaatcgaagagcgtcccgccatggttcaagcgcgtcaagagcttggacactgggaaggtgacttggtcaaaggcaaacgggttgaatctgagccagcattaatgactttgactgaacgtgttagtcgcttagagatcatcgttaaacttcccaattatcatgccgacacttgcttgaaagccctccagaataccttatatgactatggaactgagcactttaaaaccattacttttgataacggtgccgagttctcaagcttgagccaagtggcgggaacggacatctactttgcccatccttattcaccatgggaacgcggaaccaatgagaacactaacggccttttgcgcgagttcttcccgaagggtagatccttggttttggcctcactcattgatattcagctggctcaggataccttaaacaaccggctgcggcggtcattaaactatcgttgcccagccgatctaatgcctgaactagcttagcaactagaccacttctaagaatagattcttagtgttgcacttgatttgacaattgaggaggaggatttttttaattatgaaaggaataattttagctggtggatcaggtacccgtttgtacccaatcacccggggaatttcaaagcaattgattccggtctatgacaagccgatgatctactacccactatcaaccttaatgttggcgggaattaaagacatcctcattatttcaacgccggagtatatgccactgtttaaagaactgttaggtgatggttctgacttaggtttgaacttctcctacaaggttcaagaacatccaaacggcttagcggaagcatttatcctgggtgaggactttatcggggatgactcagtagcattgattctcggtgacaatatttactatggtgccggcctgtcacagctggttcaggatgccgccaaaaagactgatggggcgactgtctttggttatcacgttaatgatccggagcgttttggggttgtcgactttgacgatcaaatgcacgccttatcaattgaagaaaagcctgctcacccgaagagtaattatgcggtcactggcctctacttctacgataacaacgtggttgacattgccaagcacattaagccgtccgcacggggcgagttagagattactgatgtcaacaaggaatatctccggcaaggtaagcttgacgttaagttgatgggtcgtggctatgcttggttggacaccgggacccacgactcaatgctggaagccagcaacttcattgcgacgattgagcatcggcagaacctcaaggtggcttctctggaggagattgcttaccggatgggttacattgataaggataagctggtcgaattggctcagccgctcaagaagaacgactatggtcaatacttgttgcggttagcaaagcagaattaagggagtgcaaaaaaataatgggacaattaacggtaaagaatacgaaactacaggatgttaagattattaccccaaaggtctttggtgataaccgggggttctttgaggaaacatactccgattgtgattttaaggaagccgggattgacttcaacttcgttcaggacaatcaatccctgtccagtcgggccggggttctgcggggactccacttccaacgtgggaaggctgctcagacgaagttgatccgggtcgttactggggccgttcttgatgtgattgttgatgttcgcaagggttcacctacgtacaagcagtgggaaggttacattctctctgccagcaaccaccgtcagctcctggttcctcgtggctttgctcacggtttcctgactctgactgataacgtcaacttcctctacaaggttgataattactacaatgctgaagccgatggtggcttctcctttaagacaccagaattaggtattgactggccaattgaattcgataaggccatcacttccgaaaaggacgccgcacagccaacctttacggaatttgagaagaacaatccatttgtctatggtgaaatctaaaggagtggcattagcatgaagaaagcattcaaaaacattattgtaaccggtggttgcggttttatcggttccaacttcgttcattacctggttaacaaccaccccgaggttgaacacatcaccgtcttggataagctaacctacgctggtaatccagttaacatcgctggcctgccgaaagacaaggttgagctggttgttggtgatatctgtgacaaggacctggttgacaagctggtcagccaggctgacgctgtagttcactacgctgccgagagtcacaacgacaactccctaatcgacccaacgccgtttatcaagaccaacatcgaagggaccttcaccctgattcaggcttgccggaattacgacgtccgttaccaccacatctccaccgatgaggtttacggtgacctgccactgcgcgaagatttgccgggccacggtgaaggcaagggcgagaagtttacgcccgactccccataccggccgtccagtccatactcctcatccaaggccagttctgacctgcttgtccgcgcttgggtccgttcctttggcctgcgggcgacgatttccaactgctcgaacaactatggcccataccaacacatcgagaagtttatcccacggcagattaccaacatcctgagcggtatccggccgaagctctatggttctggtaagaacgtccgtgactggatccacaccaatgaccactcccgcgcggtttgggacatcctgaccaagggaaagatcggggagacctacctgattggagccaacggcgagaagaacaacaaggaagttctggagctgatcctggagctgatgggtcagcccaaggatgcttacgaccacgtcaaggatcgtcctggtcatgacctgcgttatgctattgacgctactaagctgcggaccgagctcggttgggagccggaatataccgactttaagaccggcctccagcacactattgattggtacaccacgcatgaagattggtggaaggacgagaaggccgcagttgaagcaaagtatgccaagaacggtcaataattaggtagttgatttaaccaggcagctgatggttgcctggcttttttggagggaataatcatgacgaagattttaatcactggtgctaatggtcagttgggcaccgaattgcggaacctgctggatgaacgtggcgttgcctatgatgcctttgatgctaaatatatggatattactgaccagcaggctgttgacgcgaagttcgacgccttaaagcctgcggtagtttatcactgtgcagcctacacggcggtcgacaaggccgaagatgaaggcaagcaggtcaactggcgggtcaacgaggacggcacgcgcaacgttgccgccgcagctaagcgggtcggagccaagctagtctacatcagcaccgactatgtgtttgatggtaccaactcggacgagtaccaagttgatgatccgacgaacccaaagaatgagtatggtaaggctaaactggctggtgagcgggccgtcaaggagaagacggatgactactacatcatccggacgtcctgggtctttggaaagtacggtaagaactttgtctacaccatgttgcggttggctaaggaccatgacaagctgacggtggttgatgatcaatttggccgaccaacctggacgcggaccttagcggaattcatgacctacctggtcgaccatgaggaaccatttgggacctatcagctctctaacgagaatagctgttcctggtatgaatttgccaaggaaattttgaaggatcaggatgttgaggtggcaccagtgccatctgaggcatactcgcagaaggcttaccggccacggcattcgattatgagcttgagtaaggctgaggaaaccggctttgagattattagctggcaggaagcgctggcaaagttcctaacggtgatcggagaataactttaagaatcggtaaggaaacatgttccattagggatgtgatgaattaccgttttcttttttagattatctcgaacctacgttccgcgaatgatataatgtcattaaccgaaagatttggattgaagtgttggttaagtttatctgtcaatacgtaatcacgtccttacgaaaaaaggcaggtgcttttcacacccgcctagtcaattttaagctgaccattttatctgattaactgtagttacaaatagcggaagagataactgaaggtttcgtctaactctgtttattattaggggtgtatgtcgtgcaatttatagtattgaagattatcattaagaactgaggatgataaatttgctgcatcgtgaaaatcaaattaaacaatatcacaccagctcagcggctgatttgcttaaagaagtgatggactactatgacattacccaggccgatcttgccgagcgtataggggtgagccaaaaaaatatttctgatattcttaaccgtaaacgttacctaacagaagtcttagttatccgcatagaaaaggttatgggaatttctagcaaattgttattatcgttagactctaactataagcttcaactagctgagcaagattctaatacaactactgaaacttgaaagcacccaaaagaaccaaagctccgttaactccggcttttctttatcgaaattaggtaagtaatcaataggtatcgttattaactgtttacagtctaatcgggttaaaaagcaacacaagcgaggatggcgaaagaaacacaaaaaagccgtatccaaatagatacgactcaacggagaacttgatcatgattgccagttcgaattagatcaaggatgtgcaagtttatttcattattgattgtggatttgataaacgagcacccaattatcattatactgacggtcaatatgtaattctcaaagaaagtgatatttaccggataacttatgatctttgtgcttggttcttagctcattagttttaccggcaactagcaattcaatgacatgtttaagcctactcatatcgtagtgctttcgtttgagacgcttgtagttgcgtttgaatgaatatagattaggagaataaagtaagatggacttaagcatctgtatagtggcttattataattatgatagtataaaaaaagcagttgaaactttagaattatatactcctagtgatataaaaaaacgaatatatatagtagataatagcataagcaaaaatatatgttcaaaatttagtaattttatcaatcaatatgatgatgtggtatatatatacttagggaagaatgtcgggtttggtcgagcaaataactatataattcctaagcttacttctaaatatcattgtattatgaatccagacattctctttagtaaagatgtctttacatctatcatatcttatatggatcaaaacccatcggttggaatggttataccaaatatggtagatagcaaaggaaaacgtttacctgtctatcgtaaagagttaactatattggatatgtttataagaatgttttgtagatcattatttagaaaaagacaagcaagacatacgcttcagtataaggattatagtaagccatttcaagtaccttttgctcaagggagctttttagtaattagaacaaacttattaagagaacttaagggattcgatgaaaattactttatgtatatggaagatgctgatttatgtaaaagagtaaatatgatttcttctttaatgtactatccaaacgttagtgttattcacaagtggaacaaagggtcacataaagatataaaattattcttttatcatcttaagtcaatgcattattactttaaaaaatggggttacaaatggttttaaataaatagaatgtattaactattattaatggagataatggagatcttgattatgcgttgtaaggctaaagttgctatcttaatggctacttataatggagaaaaatatttaaaagaacaaatagaatcaattttaaaacaggattttaaaagttgggaactttttatacatgatgattgttcagaagataagacattaggaataattaaaaagtattgccaaaagtatccagaaaaaatccataatatagaaggaaatagtactggatgcgcgaaaaataattttttctttttaatgaattcgatagatgcagattatataatgttttctgaccaagatgattattggcatagtgataagatagtaaagaccttcaacgaaatgaagaggcttcaagagaaaagaggacctaatattcctcttttagtatataccgatttaaatgttgttgatagtgaacgacatgagatttcggcgtctatgagtcattaccaaggatttaacattcataagagaaaaataactgattttttagccgaaaatactgtaactggatgtactattatgattaatgaacctcttttaaataaatgtaaaaatttaaaagatacttctaatgtaataatgcatgattggtggttggctttagttgctgcgaaatatggagatataagctttttaaatgaatcattaattgattatcgtcaacatggtaataacagtgttggaactaccaaatacaattatgaatatatttttagaagattaaaaaagggaaggtctattcgtaaaagaataaatagtactagaaaacaagctatgtgtatggttagatcattcgatatagaagatacaaatgatgttgtgtatagatatgctactattggatctcaaacaaagataaggcgattatttttttatataaataatggtattagaaagagtggcattagaagaactataggtctatacgtgtttggttaggagagatacatgccatatctaattttaattataatggttatatatttattatcgtcattaccggatagaaagatagtactttcatcaggtaaaaatattaacctatctataagctcgatggtgctagtagtttttttatgcctcaattttcaagtcaagtgcaacgatgataacgaatccttgatagtggtctaggttgttaagccatgcgtcggtagtaatcgcatggtcgaagatagttcagaatacgtctgggacgatggttcagtgctgattggactgcttggacctcaaccagcgtaacgtccctgagagactttcccttcgggaagtactccctgagtagtccgttggtgttctcgttagtgccgcgctcccaaggcgagtatggatgagcaaaatagatctgggttccaacgatctccgacagcttggcgaactcggaaccattgtcaaacgtgatactctcaaactccttggcaccgtaatcgttgatcgtgtcctgcaaggctttaaggcaggtgtccgcatgatagtcaggtatcttaacgatgatttcagttcggctgtaccgttctgtgagcgtcatcagccgaacgaatacctttgaccaagtcgccttcccaatgtcccacgcctgtacggtcattcacggccgcaggacgcagctcgattgagtcgccgtatatcttcttgttcttgcgtttgtgggcgttcttatagcctttgacgcggcgtcggagcttcttggggagtgtcatgttgtctagttcaagcagcccggcatcgatgtagcggtacacggtagtcgttgaagggcaagacttaccctggtcgcgatagaagtgtacgaaactatcaacgctgtgcacgcgaggcttgcgggtaagctccttggtgagagctttgaagaacgcacggccggttttgagaaaggcgtggtgtccggttctgtcgcgtttgcggtcgtgtatggcttgggcagtttccgcaagatagacttgatgcgagtgacgcttcgagtcgagctgagttacagatccacgcgtgatttcccgtgagattgtcgctttactgcgatgaagcttctgtgcaatcacggtcgcggtgtcaccagtagcccgaagggcctgaattgtagcacggtcgctaagactgagttgttggtagtgcttgtgagtgttaatctgagagtgggtcataaagattcctgctttcttgtctggttgcactaacaagaataggtcttcatggcctttttggtctagtcgctaaggtgttgcacttgaattgtaaactggggaaggaattaaagatatgagatttccaaaaattaatctgttgttgttaggcaattcattaatattaagcgtcataataatatttttactgtcttttcgaatttctaatggaattatagtagtattattattggctttcatgacatatcaattagtcttaatttttcgtaacagcaaaagtccttttgatatggattttgtctttacgctagtatggttcacatctatgtctttatcagttttacaattacatccagttcaaataaattggagtataacatcatggatttgtttccttggggcatatatattttatttgattggctcattaatagaaatgaatttacatcaagttaaaaatagcgcttttgtgcttaataaaaataatactaagagttcaatctatttattactgatgttgatatctgtaccatttataattgaagtattgcatagtggtattccagcgctttcaggctcaatgtctgcatataaagattttggtattcctgtaatacactaccttacagtttcatgtgttttattaccaccatttataattttttattttgttaaatttgagtcctccttttttgataacgttcttgagccgtataagggtcatagtactccttgtagtagcagtaaaccttaccgttattcgactgtttggacattttggtgaccattcctcgcttaatctcacgatcaatggtcccgtgagcaacacctatatactgggcaatcattcggttagagtattcaagctctttaagcacagagatcttaacacgatcatcgatcgtcaggtgagaacctttagatctagtagaaacattagtgtctgtcgtgatatcatttaagtgcgtcattgtacgtatctcctcattttggttctcattctacaattcgccattatataatcagaaagggaaaagtatgatttttattactgtttttgggttagcgatgtttttctttgttagtcttataaagaaaaattggactaatgcaattagttacattactattggtataactttacctttgatgatgtatctattacaatggtctgctttaattacgcctactctttcaaaaacatttgtccatatctttgttgttttctattttattctttttatttatgaatgtttcacttataagctaaagcctaatgaaatgaagaaaaatgataaggtagttcttacagaaagtggtaagataatcgtaccaattataaatatagctttttttagcttttattttttagaaaattatttggggagtgggacattcgtacctgccttaaagggaatagatattcatacatattctgcttcattaattagctttatcactggagttccaataattacaatatgtgttaattactattcatttaaggctacgggtaaattaagatatattttacttcttttattagtatttacggtacctgttgtaacacgtggttcaagaatggctgttgtttccgcagctatatgctttattagtattttcattttctttgaaaatggttgggcaaaatatagtatagaaaaaatgagaagattcaggcttattaaatttattcttttatggcttattttaatagttggtttatatattgtgtattatacaactataagaatgaatcattacggtcagtatagtatgaagtatgacgatgttataaaatatacgggaccacagtggctaagtttcttagcaccttattacgggtattttcctttgtcctttaataatcttaatattaatttattatggcgctctgttcatcataattactatggactttattctttcagctgttggttttttggtgttttgcatttacatacattttttaatgttgatcaattaggggatatctctggagggcttatcactagtgtgtctgcaacagtgccaacaggattttgggactattactttgattatgggatgttgttttttataccaattattgttgcattcttcttgtgttggatctttctaaataatgcacgtaaagaaaaatatacgttaaataagaggaccgtttatttttggtatgtttcactttggttcttaatgtcattccagaacacaatgtttagctctgttgttatagtttcaggacttatactaaattactcaataaagtatagttttaaagtggtgcagaggtaatccaatgaattcaaataatgagagcggaaaagttataaaggctggtctaggatatacgattggtaattatttaataaaagggctttcttttctaactttgcccttatttacacgactaatggatactagtagttatggtatctataactcttttagtgcttatagtaacctattttttgttttagtgggttttgcgattcattcaagttacagaaatgcaaaattaaaatatcaccctttggaaaaatactattcttatatttcctcaacaatgatacttgttctacttagtttattgatttggggaatattatgtataccatttggtaaatatattggtaatctactaggacttagtaaaacaatggtgtacattttagtactatattccttttcacttgctgtaattacttgttttaattcctactcaagtgttgaatataaatataaagcatttttactaattgctggagctaatgccgttggtagcattgttctatcaatattattgattttatttgtattcaaaaaatggacatatatgggaagaatactggggacggcgattcctagtgttcttatttcagtattgattattgggtattttttcaaagttgctacgcccccaaaaaagaatattaagccgtttttgcgatggggtgttaggtacagtttaccaattattccccacggtataagtcagcttgttttagcacaatttgatcgtatcatgattttaaaaatgataggttctgctgttgcaggtgtttacagttttgcctataatattttttcaattgttactgttacaacgacttctttggataatgtatggtcaacgtggctatatgaacaattgcatagtaaaaataatagagccataaaaaaatacagttctatttatgctttgggaatattaatataccttatcttattaatgttgattagtcctgagttggttaaattgcttgggccttctgtttatgcacattctgtttatgcggttgttccacttataacaggtggttatttttcatttctgtatactttgcctgcggcaattgagtattattatgaaaagacagcatttattatgataggtacgattcttgcggccgttcttaatatagtcttaaatttaatttttttaatcaaatacagttatgttgctgcagcgtatacaacattaattacttatatagcttactttgtccttcactatttcattgcaaaaagtatagttggcaaatcgttgttttctacaaagctactgttattactttcgcttattgtaattattatgaatttttttgtactagttacattgaaaatggttatactaagatggatattagctactttaatatttgttgtagctatgtttgttgaagaaaagtatttaggcttgattaagcaaaaattactaaatattctcaaaggataattaaacagaggtgtaattttaatggcagaaaacatagcaaagccagtttcaaaagatgaaattcgaaatgtttcattaaagatttttgaaaaggtactgcaggtatgtgacaaactagatattaatgtttggataatgtatggaacgttaataggtgctgtaaggcataaagggtttatttcttgggatgacgactttgatttaataatgaagagggaagattacgataaattcattgcctattgttcaaaaaatagaagtgctctagctccttattatgttgaccattttacggttaatccggactaccctttttatattgctagaatatgtgatcctaattacgtattaaaatttgataatatggattatacttctggtatgtttatcgacttgtatccttttgatggcatgggaaacaatttagattattggagatctaagaaagactctaataaatatacgaggaagattgagctaattaaggcattaatttggggccacaattttaagaatccttttatcggttctagcttacctaggaaaacggtacgtggtttattagggttatatgctaagacaagaccaaataaacattggatgaccaaactagacaggattgctcgtacgtttacctggaacgaaagcagttatgtagctccggttggttgggataatcgtgttagaggattaaaacgggaatggtttgagggaacaacatggttgaaatttgaagacattagggttcctgttccagcaaaatataaaaaaattttaaaagaaatatatggcaattatatggaacttccatctaaagataaacaagttgctactcacttctacacagcttacagaaaataacggagcttagtcgataatgaatagataccaatttgaagtcatggcatatattagtaagtgtcaatctatagggttctgccctataaaaagattgctgatgatgttaagctttctcaaagcatagtcattaaaacattaaaagacttggaggaaagaggagatattaagataattaatggcaccatagaactgacttcttgggtactagaggctttagagccttatcgcgttaagcgtgctgtaatcatggatgccggttttggttcgcggatgatgcccgctacgaaaaattgtcctaaaccgatggttaagattaatggcaaacggatcattgaaacgcagttagatgcgcttattgatgctggaatcaaggacattactatcgttcgcggctacagaagggagaagtacgatgagttactgagtaagtacccatttttgaaattcattgataatgatgattatgataagaccaataacatttcttctgttataaaggccttagaccggattaaaggcggtacctaccttaacgaggccgacctgtatattaccaattcagatgttattactaagtaccagtatacgagtaatatcttgggttcatattcattggaaacagatgattggagttttcggatgaaagatggcggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagcagcccatttttcattctgttcaatcattagtgctcccattagtcgcaagacgcttagatcattcgggaatatccggattacacggtcacgacgacggatttcttgattaacccgctcaattgtattattcgtccggagacgcttccttagctcctctgggagctggtaaatcaccattaattcgtcaaaactattttctaatttcttcactaccttagggaactcggtctgccaatctttaaccaattggtcacgccgttcaaccgcttggtcgtacgttggagcattaaataaatctttgagtcggttagcaacttctttacgatccttgagtgccagaatacttgtacagtcattactaaaatgaaattgacatctctgccaaaggctaccctgaaattgcgtagtgattgcatcctttaagccacaatgagcgtctgaaacaaacatatcaacgttggtaaggccccgctgtttaagttcactaaagaagtccatccatgcagcttttgattcactatcaccgatatcaaaaccgagcacttctcgacgaccgctagggtcgattccaatcgcaacgagtaagctattacttgtcacaacgtgaccacggtgtaccttaaataaaattgcatcggcatacggcagattgtaaaatttaagttgaacatttaagtggacagaaaaacccatcaaggtctttaatggtgttaccacacaatccattagaaagaaggaccttgatgagcaccactattttatcattccagaaccgtgttgtcattgaaacgcttcataatgaaggacgttccttgcgatacatcgctaactacttaggctttagtaagaccaccatctttaacgaacttcaccggctaaatagtgagtaccaggctgggctagcgcaaactgactttgaacgaaaggttagtcaacgggggcggaagtcttcgctcactaaaaaccttaaacacttgatcgaggaaaaaattcaagtccagaagtggtcccctgaacaagttgcccatgtggtggggattgcctacaagacggtctataactggattgatcaaggctggcttgatatacagttgcccgatttgcctgatcatggaattcgtcgtcatcgtgctaaagaaaagcgtggtacgttcaatcacggccgctccattgaggagcgtcctcataaagtcgaaactcgccaggaattcggccactttgaagctgataccgtactttctggtaaacgtaaaggtcaagctgtggctacttttgtggagcgtaaaagtcgcctgacaattgttaaacggctccatggtcgcgacagtcagtccatgactcaagccgtacttgaactagctagtcaacttcaagacgcttaccgtagaccatggtaaagagttcgctaactatcagacaattgaacagcgaactggtacacaggtttattttgcccatgcctattcaccacatgaacgcggcagtaatgagaagctgtctaaaatctcttaagtaatagtgctaaaaacgctaaaacgaccatttgcagactggtggttaattgacgctcacaatttttccaaagtcgccgacaattctctagccaactaaaagat

SEQ ID NO: 21 - DNA, 6410 bp, Unknown
  Metagenome-assembled genome
tttctaaagctggtcgaattaattcaaattgttgccgagtaatattgctgggataatttttcatagcttaaactcgctttttacatagaagtatatcaaaaatcatagatcttggacagcttctaatactttgtccttatcatgatgatcccagcttttagtatcaattgaccatatcactgccggacggtccatataggataagacttccttattaattgaaccgtacggtggcctaattaccactggatgtttgcccgtaatggtctcaataacttgatctgttttctttaattcattcttgcctttttcaagcgataccttcgttaaatcaacgtgatggtaagtgtggttaccaattgtaaaaagtggatcagctgcctcttcctttaatagttctggatacttttcggcatgctcaccccaaatcataaatgctgctggtgcattatatttttttaggacttccaagacatgtggtgttgtttcctgccacggtccatcatcaaacgttaacgagattttcttcattacttatcccttctttgtatgctgcgttacaccttgattaagcacgaacagtgcagacacaaaggcccccagtgcctggcaaagccgagcactgggggcctttttgtgtttgtaagagcgtgagcgtgaagtcatcaatgacctctgccatgctccttaaatttaattaaaatactttaatagccaactcctggttgtcaataaatgctccagcagttaccttcacaccatcgcgatggttaccgaagaaatcagtatcaaaagtaatcggtgttccgtcagggttttcatacttttcttcaggctcaaaggccatcgcaattgtgttagtcgaaataacgccatctgtcttttgcggcaattcatcaagcaagttggtctttagataaagaccatcgtccttcttctcaagtttaatttgaacttccttatcagacataactgcgtccttctcgctatcacatggttgtgcaccattaaagtagatattacccttcgtccagattggcagatggttgtaataatgatcactattaggtgcatagatcccgcaatagccttcaaactgtttcttccattcttcaaatgtcgggtatccatcaaatggtttggtaccaaccgtgaagttatagtcatcccagtcatccggctcgtctttcttaagctccgccagcttttgcatttctggacgcaacttttgctgaataaagacgttgttataaaacttatcatcaccatgttgaatcgtcatgaagcccattaccttagtaccatggatttcgtgataaggagtaaaccgattcgatggtaggttaacggaattattatcagttccgcgaccagtagcagtaaagctcccggcaattacattatggacaaaggcaattccttgtgcagcaaaacgaatagcccgttctgataagaataagttattatcaatcaacgtcggaccatgtgaaacttcaatccacatatcctcaccaagtccggacaaaacatcgccaacattgtctttgtcaacgctaaagccttctggcagactgttgtgatcaaatacattttgggtaactcttgtcccctgtgcttgccaatcaagccataatccccgggtacaatggtgaatatggttgtgacgataaacaacatcgatagcggcgtgcatcttgataccaccaatctcggctccggccaagttttggcgaacattgatgtcatgaatatcattatcttcaatcagtgagaatacgccaccgaggtgcccaacaatcccggtctgaccacaatcatgaatgtgattatgacgaataatatgagaacctacatgctctttatcccagccctcataggacgcttggcaaataacatcccgttcggtctgcgtaccatccttatacttccactttaaccatttattatcattatttggttgcaaatacttaccaagtgaaattcctgaacactttgagtgtgaaacatcacaatactcaataatccagccttttgaccagtgcggaccaatcataccttcctgataagctgtcggcggtgcccactgagtagccgctttagtaacaccaaaaccagaaagagtaatatagcttatcccttcagcctgtggatagaagcaattctcacgaacgttaatttcaacgttttctttattcggattacttccctggaagttagcatagataatcgttgtatcctggtctttattttgttcagtataccaagtgtataaagtgttctctgggtaccaagacttgttgttctttactggtttcttcacctcatccaaggagttaacttcataaagagccacatcatttagataaacttcacctgtgtgtgcaatgattcgggcatcgaaccagtcaccaagtacacgggtcgtgtatgggttataatcgccaaaaatactgttggggatttcaacctgccatacatcgccgtcagtgttctcccaagtgtcaaccttttcagctcctgagataacagctcctagtggcttaacagatttataagtaatccgggcatcagcagttccggcatgctttggattaacattctcacgataagttcctggagcaactaataccgtatcccccggcattgcaatatcagccgcagcttgaatagccttaaacgggtgttcctgggtcccatcaccatttactggcgcattaatatcaacataaattttcatgaaggaatccctctttctatattaattacttagttttcagcatttgctttccgactattttcaatttcatggttaatcttgtcaacttctggatcactcaatgggtacttgctaataatccacatagcaattaatgcgagaataattggtacccaaatcattgaaatagaaatacccgtcaatgcggaagctgattgtgttgccttagtaccatcaaaatgacagaaggcattgatgtaacctggaataataccaccaagtgctaatccaatcttaaagaacagccccatgatagagttaataattccggcaacccgcttctttgaatgccactcaccataagaaataacttcaggaaccagtgaccacatgtaaccagtagcagcagtaattccccatgtcttaacaaatccaccaacgtaaccaagcgcaatattattcttaaatgctgggaatgaccatacccataaaattaatgttccgataataaagattcctaagaataggtagtagaaaccttttttaccaatcgtcttacgaactaatggccataagaatactaagaaaatacctggaattgatccaattaaactaatagaagcgttccattcagagtggccaatattatattgaaggtagaatggccatacagtgttaccaaagaacataaaggtaaagcccaacaggaagaaccaacctaaaatctgcaatggcttgttattgattaattcattccataaatcagagaatttaacagaagcagtctctttctctgttggtaaaacacgttccttaataccaaaatacgtgcaaagcagcatgataaaaccgataatcatgtaaatgctcataaccttaaagtaggcacctgctgcatgtggtgatgcatagttacctaaattcagcttaattccaaacatcccaatactcttcagctgcttagcaggagaagctaattgaacaaacaatggcaagaaagtataaactaaaagattacctatattagcttccgtcatccgaacagttgtcaacgttgacacttcatcattatcacgcgttaaagaagcatttaaagatccatatgggatattaacaaatgaatagattaacgcagtagcaagatatgtgataaagatataaataacattaccacggaccgctggaattggtaagaataatagtgcacagcaaatagtcagcggaataccaaagtaaattaagaatggccggtacttaccaccgtgcttaaaatgactcttatcaactacggtcccaacccatgggtcccagaaaacattaatccaccgaacaattaggaagattgtagccccagcaactgctgaaattccaaaaaccgttgttaggtagaacagcaacatagaaccgattgtaccaaaaattaagttttgtgctaaatctccggcaccgtagcaaattcgctcgcgccaagataatttggcaaattcatctacatgtttagtaggtgctttatccatttttatcatcccttagaattatttttacaagataagaatagtaagttagttgtgtaaacaaagcaaccgcttcgttatttcattgtatgcggtttcaatgtttaaaaacagatcataatctgacagttatttgtcaaatcatgatctgctataaggatttgttattgttaattactactcaaaatatcctactttatttttagagcgtacggaacgtttatggataacttgctttcggtactctgttggtgaatatcccgaccacttcttaaactgcttactgaagatcgacatattagctgcaccggtcatataggcgatctcttcgattgaatttccagagtactctagcaaccgctggaccttctcatacttttccttatcaatgaaatgcagtggcgtaatcccatataccttcttaaaaacacgatggccataaccattgctgattgctagctccttgcagatatcgctgaaattaaaagacggactactatcatcattgttaacccgattttcaattgccatcacaatatcacggccaacttttgcttccttattggtataaggcatcccactatctttatagtcaacctctcccatcagacgattcagatcacgtaaatactttaaaagagcgatttcgatattcacctgggtatcaaaatcattttgttgtttgcaatcacggctatattcaataattttatccagcatttcgtatgatcgcctggccaacggtgtttctgcagcgtatttatgattaaccaataagccaatcatccgtgaacgaatttgtgtatcctcaaaatcaaagtgcaagcacatatacgtcatcttagaagttgcactagcgttacggttagtatgataggttcctggtgcaataataattgcgtctcctgggccaaggtcaattggttcatgatcacggatctccgtaatttggtgtccattaactattaccattaactcaaaaacctgatgtttctgctcaaaaaaggaccagctcccgttaacagtatgcttatgaccaccaaacatgtataggccggattcaattgttgggattgaaataaaactttgcatcagccccacccccctaaaaataaatgtaaacacttttatatatattgtccaatttaaaatttactcttgttagttctatttgtaaccataatttgttattttatgatctaagtagtgaaatatatttgctcttttgtgattctcttttgtctaaaaggcgaatttacaattaaaatgcaacacaaagtaaaaaaataaacccataccgggtagaatatgtttaacgaccaaatcaaacaattcgaggtatccggtatgagctataaacatcttactataaaagaacgtgaaatgcttatgtttttacgagctaaggggttatctatccgggctgtggcgttacggctggggcgaaatccaagcactatttcacgagaactaaaacgttgtgtaggtaattattccccaagcaaagcagaaaatgactatcatcaaaagcggcagaattgtcataagaagcggctattagacagccatccacaactacgccgtcaaattgttcattacaccttagatctgcactggtcaccagagcagattaccgctcgctttaataaggaacatcaatggtgtgttagctataacacaatttaccgtcatatctatcaacacaattcaggtgagaagtactcctcacgtggtgataccggtattcagcgccatctcagacataaacatcggactcgacattcaaagaatactagacgacatcgagaagtacagacggactatatctcaattcatgagcgccccggttttatcaaccagcgtcaacgtataggtgactgggaaattgatactgtgattggtcgaacgggtcactccatccttttaacggttgtcaatcggcttagtcggcttacgcttatcaaaaaggttgcgcaaaaggactcgcaggggataaataaaggcttagttgaactgttaggggccattcctaaagaatttgttcattctattacaccagatcatgggaccgaatttcttcatcttgatgaaatcagcgaaaggttaggtgttactgtctattggcccgatccatattcgcctgaacagcgtggaacaaatgagaatacaaatggattaat

SEQ ID NO: 22 - DNA, 11360 bp, Unknown
  Metagenome-assembled genome
tagccacgtaattttacctgatctagtctcaatccaagttccgcaagttctggctttacaaatggcagaactgattattaaacgaatcagtaataaagagaaaacgggatcaggattgcgtgtccctaggtattaaaaataactccagtgatcagagaaaggcttgatacgaccgtaagaaaaagccatagttggtatccgcttaattccagtatttgaacatatccacatacaagtgcggcgaaccagtcctagtgctataagattttgtcaaagaaatttagcggatcataaaaacgttactaacctatacaacgaactcaaaaattatttgaataacaatactgatattaaagtcagtgaaaagagattgtcagaacttggtggcgctaaaggctattttcaaccccgcactaatgaaatcgtcattggtggcgatgagcccgacaatgctttgaaactaaagacgttatatcacgaatatgcgcatagccagctacacggcctaaaatcagcctttaaagatcgcccgcgagcctatcaagaaacgcaagccgaagcggtcgcatatgttgccatgcaaaatattggcgttggtaccagcaactactcactcggttacgtggccacctgggccaaagataaagccgtaatccatagcgctttaagtgagatccagcaagtgagcaacaaagtgattgaacttagcgatggcttaaccaaacaattaggcttacaagaagccccaaaagagcctgcgcatgatctaaaaaagctatcagcccaggatcttaataagtcctatcaaggcttgcaacaacaagttcagcaagcaactagtccacaacagaaagcacaatttaaaaaacagttaaacgatgtgcaccaagaaatcagtgagcgaacacagaagcaactgaaatcctttgccgaagaaaatccgtcaatcaaaaaaaaagattctaaaccagatcaaagtctgcggtgttagtcagcccttaataagaatgctataatagaaaaaatacggaaaagattgttttgtgatagctataaaattatgtgaatgtaaaaagtagttcgcataaaatatatagcttaagtcgaattgcttttttgcatatcaacccgatacatctaatgataataggcctaataccatgactgaataatgattaaaaatgtttttcttaatcttttgacagtatattgacaacgggtttagtttgatagagtgttgtcgtatcagggatattagtatcgtacacctgcttttcgttagtgggtttaaagtatcaaactaattttaaaaagtcaattattagttaattaagggggttctcatggctaacagatcgtatggatggatacaaaatccaggaaagtttgatagcttgcaacatgtagtccagatattagattcaaattctgtacagtataagttattaagagacaagctagtccctgaactaatttttttcaaggatattaaaagtgaattgttgtctaaattacaagctaacacaagcacatttacatattcagaacttgttggaagtgcaaaggataagtatggaaattcagtaagtcgttccggtgttggtcggaagggtgcaatggcagatggacttatccaagtaacaataccttcgcaaaacaaatcaaagccttggaccgacaactggacttcagatggatacttacgttgggccgtgtctttaaattttgtaaagcccgatgaaaaatcaagtgaatttgaaatcactccattgggagctttgttttcaaaagctcatactgaaaaagagagggattccattttggcacgggtgtttctctcctatccccctgcaaccagaatattatccatactgtctcagaatatagatcattcattatctaaatttcaattgggacataagcttggtttttatggagaacctggttttacatcatattcaaataaattgatgcaacaatatctaaagtcggctcaagaaaaaaaggaaatttctaagataaagtcagatattgagggtactagtgataagtatgctcgtatgatttctaagtggctatctaaagttggatatgtagaaattcatggaactaagatcagaaatgattatgacgaaataatatctggctttccaacgtactcaataacgggtaagggtttgcatgccttaaaccaatcgattggaaagtcaaaaaacaatcgtgtttcaaaatttgttaggtgggagttttttgcaactacaggtaaaaatagggactatttgaggtttagaagagcaaaaattattaagatattgatgcacacgcctcgaaaatcactgcgagcattaatggacaatttaaaagcaacaggtattaatgattcgattgatgtaattaaaaatgatgttttaggtttgtcaaattgtggtatacgggtatctatagatggaaataatattgagttaaaagataaaattcaagatttttcaattccaacattgaacattaataatgtactgaaagataaacatttagagaaaataaaagaaaagtttttggaaaatacatcattagatccgcgttttatttctttgattgaaatatctcgagataaaaaacaaaaccgagcttttgaaataattacagctgagctatttaatacatcatataacctgtctgcaatacatttaggtggtggaaggcgaccagacgtattagcatacaatgataactttggaattattgttgatactaaagcttataaaaacggttacggcaggaatgtaaaccaagaagacgaaatggttcggtatattacagaaaacaagattagaaaacaagatatcagcaaaaataattggtggaagtactttagtaagtcaattccaagtacatcttattatcatttatggataagcagtgagtttgttgggatgttttcagatcagctcagagaaactagtagtagaactggagaaaatggtggagcaatgaatgttgagcagttattaatcggtgctaaccaggttctcaataatgttcttgatccaaaccgtttgcctgagtatatggaaaacaaagaaattatatttggaactttataagatatcgagttagctgaaatggagcacccggaatttttgggggtactccattttttatgtcctttatttttagaaggcatagataataataattgtttgtgctagaatgttaatcaacaaggatgtaataggatgtgattatttgagatttatcggaagcaaggctcatattttaaatgatattaatgaaatcttggaaccacatttggatggcactgaacatacatttgtggatttgtttgctggctcaaatgttgttggtcagttctttaagcctaaattctccattattagtaatgacaccatgagtttttcaaatgttattgcgaaagctactattgaattaaatacaccaccgacatttaataagcttagatccgcaggaataaataatccatttcaatactttcaatctgtagatgttaataaatactcaggggattttgtaacagaaaactattctcctgcaggaactgccaagagaatgtactttactattgataatgctaaaagaattgattttgccagaactacaattgaaatgtggaaatgcaaaaaattaattaatcgtgatgaatattattatttgttagatgctcttattcaggggataccttttgtatctaatacaactggaacctatggagcatacttaaagcactgggacaaacgagcatataaaccattagaattgatacctagcgaaattatagataatggtcaaaacaacaaagcatatagggaagatgcactaaaattaaaagaatcgttatccggtgatattgtatacattgatacgccatataattcaagacagtatattcccaattatcatgtattagaaacaattgctaggtgggattatcctaagttgcatggagtaactggtcaacgggatacgagtcgagaaaagtccagctttgcaatgaaatcaaaagcaaaagaggctatgaaagaattgtttagttctcttaaattcaaacatgtcgttgttagttattcaactgatggtattgttccagaaaacgaattaattgatatattaagagaaaactctatagataaggaggttgaggtgaaacgaatcccctacagaaaatataaatcaaaaaaagtaaatcctgatacatctgtcgaggaattattattttattttaagtccaaaaattctattaaatatgtcgaagccaaacataaccctactatttacaaccactctagtatcagtaaagctagaaaacgtggggcagcgggatttattaagagtccattgaattacatcggtggtaaatataaactacttcctcaaatttttccattattcccccaaaatattgatacatttttagacttatttagtggtggtggaaatgttgggataaatattaatgctaaccatattcagtttaatgatataaacacaaaaataaattcattattccgctattttcaggggaaaaacccggaggatttgataactaagattaacagacgcatcaccgaatatggactcagtaaaacaaatcaagcgggatttctaaaatttagaagggactataataataatccgaatccattagatctgtacgttctggttgcatatagctttaactatcaatttagatttaataacaatatggaatataataatccatttgggaaaaacagaagtcatttttctgagcaaatggccgataacctaaggagatttgtaattcatctgaatgagattgatgccgtgtttactgataattattttacagaagtagatactagtcagttgacccaaaaatcttttgtttatgctgatcccccttacttaataaccactgggtcatacaacgatggcaatagagggtttgtgaattggacagaaaagcaagaaaaagaactatataaatttctagataatttgaatttgcgtggtatatcatttgcattatccaacgtgatgttacacaagggaaaaagaaatgctatgttatgcgagtggtcgcagaactataatatccattacttgaattatagctataaaaacgcgtcccataacactaaacattcaggaagtactgaggtactgattactaactattaaccagaataataagcaaaatttacattagaggagtaacaatatgattaaattaacagattttttagcattccctgaacccgctgaagcaaaaattaaatttaacatgaatgctggtgatattacaaaaccagcctgggacttactgttgaatgatagtaatgactggttgactatgaacagatggaaaactaaacaagctaacaataatttaggaaaagcaggttatttattaacttttgctcaatattatccatatgggcctgaatactttatttttggtggtttatataaaattcaaagaatacagccggaggtatttgagacagctgggtacaatttgactttaaaaccccaatatcaagattatataaaaagattgatcatcaaattaaaacagcctattgggagaaatatctactgtcggcgctatgagaatatacaggaagggatgctagatcctgaggtatatgaattagctccagataccaagattggaaattttactggataccaaaacgttagtttacaacaaaaagacctccaaaccatctggaaaaataatgagcctagttggaaacaggccttatcctatgttaaaggagtttatgtagtaactgatataagcaactgtcgattgtatattggttctgcgtcaggaaactctgacggaatatggcaaagatggtcagcttatgctaatcccaagcaccttacgggtggcaataaggaatttgaaagagttttaaaagaggatggcattacccatattactgataattttagatactcaattattgaaatctttgatactaagaccaaagaagaaaccgttctctctcgcgaaaactactggaaaatggttttcaatactcaaaactctttattgggaatgaatcgtaactaacgaattaataataaaaatcaaaagaaaatctatcaaattagaatttacccgcactaatcaataagttgtgatgaactataatctttctaattttacaataattgcaaaattccgactacatatcttgctaaaaagtgcgctattaatgaaagtacttggaatatattcatctgtcatgggctgtaaaatcttgctgagactttcctcatatttccataaacttcgccttgtaaggaaagctcattggcatttttctaactaaccaagacaaggtcaattcctaaaaataaagatcacctcgtaattaaacgtaaatgtgaaaacatggagaattctactagataaagtggtaaataaatcataaagaagggcattcaaacgatgcgtattaatcatgtatggatttcaggatatcggaatatcaaaaaaactgattttggaataaacaataaattaattttaataggagaaaataacagtggtaaatcaaacgttcttaaagctataacctctccgttatctcctggaggagaggggtattatacacaacctatgacattgcgagatgtgaatgatgaagaaaaaaattcgtattataaatacattaaagaaaattttgatcaacttatgaaagaaaatagcgaagttatcgcacaaactgagttcctatcatatattccgaaggtcaaaattagacttcaatttgatgttgatgatgattcacggttttattttgaaaagttaatcaccgaggatactgagggaaacattgtttatcaactcgaatttcaatatcaaattgatgatcctacaaagttactagatcatttaaaaaatgttaaaagaattgctagtaatgatgacgaagaactttctcgtatccaagttaatctcctaccagaagatttatataaatcacatcttattgtccctggtaaaaatgatacagtatcctatgatctatcaaagaaccttaaatattactcacttattgcagagagagacggattttcaacaagccgctcaaaaatgggttcatcagctattatcaaactattgaatagaaatattgacgaccaaagcaagatcagcattgaacaaggatataatacattttttgatgaagttaaagattcaactaaaatggatgaagtattcaactgggctaaatatgcatcaaattacaagaatgctcaagaatttttcggcgaaatatcaattcttcctaacatgcctccaatgaattcgttgcttaacagtgtacagttgggttatgctgaagaaccattggcacaacaaggattgggataccgaaatttagtttatctatcggcaatggtaaacgcgctcgaacgtgatgatgaaacaccatttgctgttctgtcaatcgaagaacctgaagcacatcttagcaacgaaaatcaaaaattactgataagtttcttgaattcaagctcagaatcagcaaataacttccaattaatgtattcaacacataatacaaattttttaccaaaactggctcttgaaaatgttgtcattatgagtgagggaaaggccacatctttcaaaacggaaatgaatgctgaagatttaaattatctaatccgaaatccaaatcttgatgtgtacaaacttttcttttcaaccaatgtaattctagttgaaggattatcagaagaattattaatcaagtcatatctccagtcaaaaaaagatagtctcaataatattgaagtgctttcgtttcataagggattttgtgcgatcattagactttggttaaaaataaatatcaacaaccgccgtaaattagccgttataagggattttgacaatcaaccaagggccaagggaaaaattgaaaaattagcccgaaaaaacaagatttcaattaacactacaaatggttatacactcgaagatgatattgtgaaaaataattttgaaatactacgacctttttttaaaaatcatttagattggcctgatgatgtatgtcaggataaacagaaactggctaaatattgggaaaatacaagtggagccaaaggtgccgctatggcagaaataagcctagcaataaatactcccgagttagaaaactttaggcttcctgaacatattatgcaggccattaatttttttaaggatacaacaaatgaaaataactaatgccggtgctggagctggtaaaacagctaaattagctgatcagatattaaatcgctttaatcaactttcatgcccacacactcatatatttgttatcgcttacagtaattatgcgattagcgtaattaccaatcgaatcaagcaaaaacatggttcaattccagacaatattcatctatcaactattcattctttcctttggaattatatcatcaaaccatactattttttgctttttaagcaacagtttaccgaaatctctaatcagaatattattgataagccccaatatcgtgcaaaaaagttttatgaaatgagaaataatggaatacttcatgttcaagaattttcacgtgtatccaaaaaagtattagttaaaaaagcgcatgatacaaaaaaggttacaaaaaaaaggaagcatattttatacaatcttggacaattcattgattcaatatttattgatgagtcacaagatatggatatggatagtgcctcttgtatttctgctcttgatgcatcaggaattgagtgttttttggtaggcgatgaaaatcaagatctacattcaagaggaggattttcattcttaataaaaaaatattttagtcaggtttgtgtggatagtgaaaaccataggtgtcctcaaacacatgtgttacttgccaatagattctcaaaagttaaacaaatatcaaccacaggagaactgggtaacattaaatatatacttgaaacaaagtgtaatgttaaccaaattgttaaagaggtaggtgatagccttgtatttatcaataaatcgactcattctcttcgtgtccacaaaaagaatcgagaaaacattaaacaattagaatatgttataagaaaacttcattgtcaatctccggggttccaagatatttcatctactccctcaaaaaaatgggcatttgatgtaacacgcaaaatagtagacgaagttcggaaaaaacaaaaaagtccctctgtcattacaaataatgtcataaatctaatgaacttaagttatgataagcgaaaatatgcagaactaatacaaagcattaaatctataagttcacattgcaaagaaaacttgaattttcctcttaattcaatagagtctgttaagggaaatcaatgtaatgaatgtattttttttatatcaacagatctttttgcatatttgataggagaaaagactaaatctaatgcgacaatgaacgctttgtatgttggactaacaaggtcaaaaaattatctgttattaatctttaccaaagaggtcactgaaaagtataaagttgaatttattgaacaaaagatgagagatctgaatattgaaagattttgaataatttatcattaatcaatttatttagataaactcctaataatagagtagattcaataagggctttagaataatgtgcttattgggattctaaaaacagtttcaatcactatgatatattcaattgaaagcctacgaaaatgaatgccattagggaatttaaaatttatagtgtgtattatatcaaaacttaaatttggattatttgtattttacacaaaatgaggtgcatcatgaatggaaaacaaagacagtttaatttaggtgtgacaaaagctggcaaaacaaacgttgggtttgacaggaagtacactaatcctagtaaaagagaagatcagcctcatattatgcacgctcatcatggtattgtaattgatgataaaaaacaggcagtcaaaattcttcaaagggtaccatatgatttactaatatatccaggtttaaaaatttggtattctaggtccccaaatggaaacaaatttatgcaaggtacaacaattgaagaactgtatgagttatataaatttgattcctttatgaaaggtaaaatactagaggtagttcgatcatttgaaaatatgtttttaggatcattagcatatcattttgaatacgagtatcaagaagcagcaaataaaagagaactttttcaaaaaaaaagagttaggaagcataatatggggtattcaaaatcgggtgaatctaaaggggaaggtaagatcttttataaaatggtacctctatgggatcaatttttttctgataattcaaatataacaattaatgatgaaattgatatatggaaatctctaaaaagaaatagatttcttaagcgtataaaacaaaaaaatgtcgaaaatgtttacaaggatcggcttaatgcaataagatttgatacacgagaaattaatttcatgagacaaaatgtgggatttaaaagtacaactgttcagcaacaatgtatagtagatattattagattttcttgtgtttccaatacaatctggagaaaagatataggtgcaaaagattttgagtatttattagacactattcgacaatttaggaatgcttctgcgcatcctggatatattttaaacaaagtgacgacttggaacggacccattgaaaaattacccacaaaattaaagcttacagaaaatagggtaccattaaacatatttattaaaaccttcgtttattttcttccaaaagatttaattaattcttttacactagcagtcagacaagagttgttttcattaaattctaagagaaaaattgggccaaaacatttaaaaagattggaagacatcattggtatcaaaatgatgagttgagactcttacaagctactaaaaatatgttactgactgatcttataactcaaaaaatataaaatcatgttgaattattaaaacgttattgaaatcagggagtttaaagttttttgtttaatttttaattataggccattagggtataccctagtggccttttttgattctgtgctatactaggaattacaaatgttcattagaactgtccaaaaggagaactggaaatggctaaaatcggttatgcgcgtgtgagttccaaggagcaacatttagatcgacagttagcggctttaaaagacgttgataaattatttacggataaattaagtggggctaacactaatcgatcggccagaactgcaaaaattgctgagcatatatcgtgagg

SEQ ID NO: 23 - DNA, 18772 bp, Unknown
  Metagenome-assembled genome
tcaagatttaacgacgacgttactccaaattaaccagcgaccgcttaaaatactcgactggcaaacaccgtatcaggttatgctgacaaatttgtccaaaaattcggattaaatttgcaatctaccaatttacccaaaatcaatttggttcaacatgttttctgtacttgcttgatccaagcctaaataagctaaagtcatggcttcacttgagtgatttagtaggtgcatgactaggccaatattgtaatttgattgcgtataaacacgataagccccagttttgcgcattgtatgagtacctagataattaattcctaatagatcgccaaccttactcataattttggagccattcgggtaattggggcatagtgtcacgtccttagttttggtgtacggtcgttggtttgagcggtttaacgttggaatttgggcggtcacgtaaagctcggagtgcccaaagaatcgaaaccgtgtcaacgacttcttgaagcattgcgccgaagagggccgggatgatcccggtactggcaatcagcattagaatcgtacagatggcgatcccaatccaaacggcctgcttagccacttgcatggtgtctttggcaatttgaatcgcggtgaccacgcggctgaggtcgtcctttaaaatcacgacgtcggccgattcactggccgcggtggaaccgtgcgcccccatggcgatgccgacgtccgccacggccagtgatggggcgtcgttgaccccgtcgccgaccatgataaccggacgttcatccttagtaacggcctttaagtgcttgatcttgtccgccggaagtaaatcggcagccaccgtatcgattccgacggcttcggcaatgttgtcggcaatcgcttgttggtccccggtcagcatcatcacgtttttaacgccttcagcgtgcagggcttgtaacgtggcagcggcttctggccgaacgttgtcgataaaggtcacgtagccggcgtaacggccatcaacggcgacgtaaatcgccgtttgtgcgagtggtgccgtcgtggttgctggatcgacgaattttagcttcccgactttaacgacggcgttgtcgaccgtggcggtgaccccgttaccggtgacttcttcgaggtcggcgacggggctgaggggttggtcgttggcaaatttaactaaggaacgggctaaaatgtggctggaattttgttcggcactggcggccaagtgtaaaatctgatctggggtaaaaccagcctggggaacgatgtcattcacggttagttggccgctagtgatcgttccggtcttatcaaaggcggccgatttggcagtcgacattttttcaagcatgtcaccagttttaacgacgatcccgttccggctagtgcgactcatgcctgagacgagggcgactggtgcggccagaattaatggacacggtgaagctacgaccagaacttcggcgaaccggtgcggatcaccgctgatgagccaagcgatgcccgcaatcacgtacgcaactaaggtaaacggaaccgcgtaccgatcggctaaccgtacgaacttggcggggcgtgattcagattctttcaccaacttgaccagttgctggtactggctatcggcggcgagcttgtcaacgatcatcgtaacggcactatcgccgttgaccgctccggacattaaatcatcaccgacggctttttcaaccggcttggattccccagtcagtgaagattcgtcaaacatggcagtgccatcgatcaagtgaccatcgacgggcaccagttcgccaggcttaaccactaactgatcccccacgaccgcgtcttcgaccgcaatatcggttaactgttcgttctgaatgcggtgtgcggtccgtggtgaattatcgagcaaagcctttaattcggtgttggcacgcttagcagcgtagtcctccaaagaatccccaccggtcagcatgattaggaccactaggccggcccaatactcgctgacagccagggtggcgacgatggcagtgattgcaagtaggtcgacgccgtacttaccggaccgtaacgttttgaccatctcaaccagcattgatagggccataacggagccccacaacgtaataatcagctgggcagccagctgttggtgaaagccaaactgaagaattagcgcaatgatcccgacactgaccgttaacgtgagtttataataatggcgcatcgaaaccccctcctcttgtgttatgtaactgattcctctatgattgttataatcctaacatgaaatgcaatttatttaaacagataagaatgattctaaataaaattctaatagttacgaaaaattataactattttctgaaataatgaccgcttttggaatgaaaaaggcgcgcttaggcttaacctgataagcttaaacgcccattaaacaagcgattttacttctaatactagtatacttatacatgaacactagatatcagaaaaaatactgaaatcagcatttgtataagaccaggcgcgctgtacaggtggtaatccgttacccttgttgcgtgtttttttgtaccatggacgccattttaaacttgctgggcgaactgagtcactggtcggacttatctggtgtatcaagggggttatccattagcaagataaatgtaaccattaatcgttacgtggtgtgtcagcgtggtcgcttgtcaatgacaaggcgagtaccattagaaacactaatcagcgctaaattgtagatcaacaccaatgcgattaggcaatgtataagtcacttttcagtatggcgttcggcgaattcaaccaacggaaagaaggaaattctgctactgattttgagttagcacaaacagaattcaacggacaatgccgattaaacctgatttagtcagggtgctgagtgcttcgaggaataactcggaggaatgtaccgattgctagtcggaaatttacgcgtggggactacccacaaaggtaggaagaaccacgaattaattgttatatagagtgtatatactcagtagcaggtttattatttggcagattgcaagaaataacttgaacgaatttaatgacgtaaattaagcaagaagatctcgattggtgtatgctaattaagacatttaagtggccgtgaattcaaataccaattaatttgaaccaattggtgatcacttagttcttcaatggcttggcctttgggaataaagcgccgcaaaactcggttacggttctcattactgcctctttcatgcggtgaataggcatgggcaaaataaacctgtgtaccagttcgccgttcaattgtctgatagttagcgaactctttaccatgatctacggtaagcgtcttgagcttgtcttgaagttgactagctagttcaagtacggcttgagtcatggactgactgtcgcgaccatggagccgtttaacaattgtcaggcgactcttacgctccacaaaagtagccacagcttgacctttacgtttaccagaaagtacggtatcagcttcaaagtggccgaattcctggcgagtttcgactttatgaggccgatcctcaatggagcggccgtgattgaacgtaccacgcttttctttagcacgatgacgacgaattccatgatcaggcaaatcggtcaactgtatatcaagccatcctcgatcaagtgtttaagttttttagtgagcgaagacttccgcccccgttgactaacctttcgttcaaagtcagtttgcgctagcccagcctggtactcactatttagccggtgaagttcgttaaagatggtggtcttactaaagcctaagtagttagcgatgtatcgcaaggaacgtccttcattatgaagcgtttcaatgacaacacggttctggaatgataaaatagtggtgctcatcaaggtccttctttctaatggattgtgtggtaacaccagtaaagaccttgatggttttttctgtccacttaaatgttcaacttaaattttacaatctgcctaataaataaaacaaggtaaatacaggcacgtttgacagtaccacgattcacatagggggaagaccattgaaatccaccattttactagtcgaagacgaggtgggcttagccgactcactcaaaaccgaattcgagctcgagaacttcaatgtgctctgggccaatgacggcctaatcgtgctggacatgttccggcaaaacgaggcccagattgatttaatcattttggactggatgctgccgcacctggacggcttcagtgtgctgcgccgcattcgcaaaaccagccaggtgccgatcatcatgctgacggcgcgcgattacatcggcgataaagtggccgggctgaccggcggcgccgacgactatgtcaccaaaccatttgaaatggaagaactgattgcccgggtcgaagtggccctgcgccattcgcagccggcggccaccactgccgccgtgtatactgctggcaatttgaatgtggatacggacaccaaacgcgtcacccggggcggtaccatcatccccctcacccagcgagaatacgagctgctggtggcgctcatcagtcatcaaaacgagccctgttcgcgggaagatttactggacacggtgtggggggtcgattttgacggccagccaaacatcctggacgtctatgtccgcaatctccggagcaaaatcgacactcccaaccaacctaagctgattcacactgtccgcggcgtgggctacatgctttccgaacacgtggcggaataaggccctaatatgaaaaaaaacaaacaatctagcgcagccatcatgctacgcagcatgatgcgcttcatcatcattgtcaccttgctgcttggcgctgccatcatcatcgccgtgggccatcagctgctggaagatgttcaaaccaccaccagtcatatcaccgccagtctcaagcaaaccgacattgatggcgatgatgactgggaaagctggcgcaaaaacagcaccctggacaccagcgctacttatgtttatgtccacaacaagcgcgccgatgccaaggtcagccaatacttctccccgcacgcggaaaaagtcttaaaagtgacccccactaaggtgccgtttttaaccaatgtctattatcgcccaggcatcgggctgctgtaccatcgcatggtgcacgcgcgcgggatttactacacgttgtggcaaaacacgaatccccagctggcggtgctgctgcgggtgattgaagtcactgccatcctgctggcggtgacgctgctggccacgccgctgtacattcgccagctgaccaagcgactgacggatcctctgaccacgctgtctcacacgacccagatgattgccggcgccaaagaacctggcacgatgcggctaccggtcccggcgcaaccgactgaagtgacggaactcgcgggtaatttcaacgagttgctgagcatgttgaatgaacgccaggagcagcaaaaactgttcgtgatgaacgccgcccatgagctgcgcactccgattgccactattcgcagccacgcccagttgatcgaacgtcacggcaaggatcacccggaaatcattaccaagtcggtgggctacatcaccgaggaatcccggcaaatgcagcacttgattgatgagctcctgcaactttcccgcgccgaccggctcgcgcttgacctgaccccgcttgatctcagtgccacagtgactaccatcatgcaaaaaattgctgggaccttcgaacaaaccgtcaccaccgagattcagcctgacatccatatcaccggcaacgaaagcgcgattgagcaaattttggtcaacctagtcaccaatgccgcgaagtattcgccagcggccagccaaattaccgtcaccctcacccaacaggctaatgaggcggcggccctggcggtgaaagatcaaggtagcggcatcagtgctgaagataaaagccacatcttcgagcgcttctaccgcagcgccgatgtgcgcggcacggtagctggcaccggcttagggctagccattgccacgcaactcgctcagctcagcaatagtgagctgacggtcgccgacgatcagccgcagggcaccattttcacgttgattttctccaccaaataaactttttcatgccgctcaaaaatatttttgagcggtttttttgcgccgaatattagtaatctgaatatttttcagctaaatcacccttgatactggcactgccgcggtgaaagctgaagattattgagtttcgggttagttttcatgagtgggcgcaccgcgggattgttgttatgctgggttcatcctgaaagttcagtcaagggggaacacatcatgaccgcactcattacactgctacctaaccttaatcaattgttgccgcagctcatcagtcaattcggctcactcatctatcttggcttgttcgccatgatcttcattgaaaccggcgtcgtggtgctgccctttctgcctggcgactcgctcctatttctctgcggctcgctggcggcgatggccaatcacagtttgaacatctgggtgctgttcggcctgctcagcgtggccgcggtgcttggagattcgcttaactttgaaatcggtgaacacttcgggctgcgcctcgcgcacagcgccaagctcagccgcttcatcaaacccgcctacctcgaacgttcgcagcgcttcttcgacaagcatgggaaagccgcgattttccttggccgcttcatgccgatcatccgcaccttcatccccttcaccgctggcgtgagccagatgcgctaccgcgactttgccgcctacaacgtacttggcgggatcacctggatggcggtagccctcggcgccggttacctgttcggcaacattgctgtcgttaaaacccatttcgaactgatcatgctggccatcgttgtcatttccttagcgcctgccgccttcatggcgctgcgccatcgcggaggtgccgacgatgccgactaaaaccaaaacattgctaggcgggctgagcctgattgtctttgccgccttagccctcggcgttatcacgcatgccgcctggcttgcgcaattggatgccgcggccagcactttggccacgcgcgccattgatccgacgaataccgcgattttcaaagtcgtcgccacccttggcagtcctgccaccgtcatcggcctcactgcgctgttgtgcctgtggttgtggctcaaacaaggcccagtcatcagcctgtggttcgctggcctgcagctgggcggctccgccatcacggaaggcttcaagctgctgattgaccgcagtcgcccgctccatcagctggtgctggatcacggcgctagcttccccagcggccacacgttttgcacggcgctgctcgtgttcaccttgtggacgctatgcctaccacacattcaagatcaagaaagccagctgattaccatattgattggcattggctggattgccatggtggccatttcgcgggtgtatctgcgcgaccactacctctctgatgtgcttgccagcgtgtgcttagctggcggttggtggctgctcgtcacgcctgttcaagcctttattcaaactaaaatgcgtcagtttttaccggaaaggatgttgaaatcatggccacatcaaaattaacgattgtcgttccagcctacaatgaagaagaggtgctgacctcctcggtgcaaaaattactggccgttgaagaccaaatcgccgcgcaagccgttctgggccagcgcgccgacatcctgatcgtcgatgatggctccaaggatcacacctgggaaatcatcgaaaacctgcacgccgcgaattcccggattcggggactacgcttttctcgcaacttcggtcatcagtcggcgctgatcgccggcatgagtgaagccgtgaaaaccgcggacatgattgtcaccatcgatgctgacctgcaagatgatcctgacaaaatcgtcgacatggtggatgcctacgcagatggcgccgatatcgtctacggtgtccggaataatcgggaaaccgacagctggttcaagcgcaccacggcccaaggctactacaaagtcctgaagctgctaggggttgaactggtgccgaatcacgcggattttcgcctgatgtccaagcgcgcggttgaaaccttccttcagtacccggaacgtaacattttcattcgcggcctgattcctaagcttggcttcaaaactgccgaagtcttctacaagcgcaccccgcgcatggcgggcgaatccaagtacccgctgaaaaaaatgctggccttttcctgggacgggattaccagcctgacgattgcgccggtgcggttcattctcattctgggtaccttgtcttgcctactggcggtgggcatggtggtttacgccattgtcatgacaatgctggggctcaccgtgcacggctggtcggcgttgatggtgtcgctgtggttcgttgggggcatccaaatgatcagcctcggggtgattggtgaatacatcggcaagctcaccaccgaagttaaacatcgcccgcgctacacggtgcaaacgattctggattaaggtgagggtatgaaaaagattaaacccgcctttctgccagcaattttaatcctctgcctgctcattggcagcatcggtaacctgaccagtgtgctcggggtgccggcgctgttggtggtagtgctcctgggcgcggggctttacttcggggcgccccgacttgaccatttgtctacaaggcagctgcgctggggcattggccttggcttactggcgatgctgattgcccaggtggtcgtgttgcacgtgatgcccaacaccgtttaccacgatccgtaccgggtactgtcgcaagccgaccagctcgccgccggccacatgacctgggatatcacctacttctggcgctacgccaataacgtgccgctggcttatctgctctctctgtggttgcggctgacgcaactggtgggcttaagcaccaatctttcggtgcacctgctgagtatcttggtgttggacagctttattgccctggcgctgcatacgatttggcagctcagccagcgcgccagcctgctggtcgtggccttcggttttttcgccttgacgccgtttgcctacacctactacctgcaagtcttctactctgacttgccaacgatgctggtgctgctcatcatcatgcggagtctgctgaactggtcgcagaaaacgtcgcgccagcgctggtttgccggcagcggactagttgttgccgtgatgctcggcgccatgctcaagcctaatatggtggtcttgttgccagctctgctgattgtcggcctgattctggcccgtcagcacctctggcgacaagccaaactgaccctgcccatcctcttgattgtgctgggtttcgggctgagtctgccggcgaccaaagtcattgacgtggcagccaattatcaaccccgcaccgccttttcgttcccggcgaccaactggatcttgatgggctacaaccagcacagcaacggcggctactccggcaaggatgtcggacgtgccatcaagcagcccagccaagccgcccgccagcggtacaatttgaaaaccatccccaagcgcatcaaaactctcggggtggttggcgtcatccggttgtgggtagtgaagttaggcatcgtgctcaatgtccaaggcattcagcgctggtacaacggcggcttccgcgccgcacctagttggtacagtaatcatgctggcttctatcagggactgaccgtgattggctatgtggccgcgaccctgctcatgtggggcgcactgatgctgaagctcttacggtggcggccagatctgaccgacccgcatcaaatccttgcactgctggcggtgaccactgcccttggctacctggctttccacaccctactgtgggaagttgaaccgcgctatggtcaagccattttgccgctgctctgggtggctttggcggccatcccgcgtcaggccagccagtcgcgtccccgctgggcgaaccaagctagcctcctcaatggcgccactgctttactcgtcgtctttggggccgctggtgtgcttggcgctcagctgccacaaaagcaagtgattgccgcccagcgcagtcagctatccgtgcagtatcacgccaagcccaaggccgtgacgccaggcaccgtgctggcagaggtggtcgatgtgaacgcgccagcgaactatttttccgttcagattcatgctggtagtcaggtgcaagtcaccctcactaaccttgccaccgggcaacattatcggttaacgatggctggcagtgtggcccgcctgcaccaccagctcgccgctgggcaatatcggattaccgttcaaaacctcaccacccgcggccagcaggtcgatgtgacccacacctaccattatcagctcgctgctcacccgctaacggtgaacggccaatcacagcccaccgcctcgttgatttatacctgcatgcagcgctgagaaaggagcctttttatggaaaaaccaatcactaccctttacagcaaacacggtacagccttgcgctacctgattgttgggggcttcaccaccggcattaatgtggtgctgttcttcggcctgactcaccttgcgcggcgcgtcactgctggcggacacggcgattttgttcatcggcctcaccttaatgcacggttcgccgctgattgtgaagctgatcgaccaggtcgtcgtcatcgtgctcaattacggcttcagcaaactaattttcgcttaacgtaaaaatggtcccagcagtggaaactgccggcatccgccagcgctgcgtcgaccacgttcatcacagccagcgaatgcgccatccgctgcttggcggcagccaaatcgtgatgcgcaatcatcgcttcgaacgcgacgaactcttcgtacatgcggtgccggtcaactttgacatcaacggtttccttggtcccgtcattcagtccctcggtgaagccagtcagcacattcaccggcccggcgatttgaatcgacccgcggttgccttgatgtctttcttttttagttggcataaataaatcaatgaccttatcaccaaaactcatactgttgcctcctatccattaaaaattgatcaagttctttaaaatctcttggacttcttgactagtcaacactttggccgtcacatcaaagtccgttaacgcattttcaatatcccgtttaacctgttcgatcttttcgtctaaatgagtgaccgctaggtttaagctcttaacacttttgtctttaattggcaccttaacgattagcagatgttgcttagttgtcatgtttttggattcttggactttagtaaagtgatccaagtaactggctatgagctggattttgaactgttgctccgggtggcctttttgtaaggcgaaataccgccgtttgagaccattaagataagccgtcatattgacgagaagtagaagatttaaagtctcaacgtgacaaacagcttgctgccaaagaccaacaaataagtagcaaagaccgccaaatagatcatctaacaaaattgatagatcagcagcaacaatcaaacgacaaggacgatgccttgtcgaatagtgaaaaacaaaaaagaatgcataaaaataaacccaataagagttggtggcatttttggtaaaaattaaagtgtaaattcaaggcataaaataaaaattggtacttaggatagaaaaatttctatcagtaccaaatattatagaaccaaaatccgtctcagtttatttatcggcgggacttatgtcccagcctctttcaagtttcagtaaaaaattgctttaagctaaatttaaggaacaaccggcaaaatttcatatattatatttagatataattatatctagaggtgaatacaatgaaaaaatttgttgtggggatcttgaccttcgcgattgtgacagccatcatcatcgataactactttttatttattagaggaaagcttagttctgatgctcaaaggacgtctcaatcgagtacaacgaccacatcgtccagtcccaactctaccagcaagacttcaaccagaaaatacaaggatggcacgtatactggctcaactgtcagtactcagtggggcaacgtgcaggtccaagcggttgtgaccaatggcaaattgactaaggttactgttctgaaatatccaaacgttaatcgtcgcgataagcagatcagcagtcaggcattgccgacgtataagtctgaagcaattactgcgcagagtgccaatattaagttggtttccggtgccagtgaaacatacaagggcttcaccggatccctgaaaaacgcattgaaaaaggcggcgaatgaccaatgaaaacttaccagcagacaattgaatccatgacaatgccatttaccattatgattgttagtgaacccgacagcttatcagaatcacgttggcatacaacagttactcttattcaaacatatctcgatcatgtggaccatctattttcaccatttcgctcagattcgctagttacccaataccaacgtcattcactcgccgttactaactttaacgctgaatttcaggaagtttttgctttgacagtcatcgcggaagaaatgacaagcggggcttttaccgcaaactttagtggtcaatacgaccccaccggcatcgtaaaagggtgggccatcgaaagagcatttcaaacttacctaaaaccgttgcttaataccggagccatcgcggtggccctaaacggtgccggtgatattcgggttggcgcgctggttgacagcgggtacgaatggccgattggtatcgaagacccagaagatactggccaaatgcttcgggagatcaagatcgccaatggcgcggtggccacttcgggatcgtcaaaaaggggcgaccatattcgccggcttgattcggcaaataccctgacccaagccacgatcattgccacaaacttaattgatgccgacatgttggccacaaccgcaatttccatgggccaaataccgtttcaaacctttgctgaaacgcacaagttgaacgctattttgctcacagcagctcacaaattgatcatgattgacggtgaccagtcatgaaaaaaatgaccgtatggcaaattctgacttggggcgtgatcctctttgttattccactgccactggttcaagccatggcagtagaactgcccagtctatacaccagcacgtcccttgcaattcaaataggatcgatcgcttatgtatggatgctactggcggtatatttggcaaccaaaccgaaatggcttgacagactaattggcctacccagcatctattttatccacggtgttctcagcatgcttgcgattgcattagcttacttacacaaggaaggcacaagttcatatggatggattaaaaccactggcaactgggcatttgacctcttttggggattactggtttattctttggtatttatggccggctggctaacaagtcggttcaagccgttgctatggttgaaaaaacaattggaaatcttgtttaaacatgagttatccgtatggattcacaggctaaatttgattgcagtgcttctcgttttcatccacgttcaactgatcagctatatcactaatatgaccatttatatttggttgtttaatggctacaccatttttgtgacgggtgcctacctactacaaaagttgcgcagtcgatacggcttagcccaaggaaaactcacagccattcaacccattgcagctaacttctatgagctgacgattcaattcaagtcgcatcatgcactgaaattgtatcctggtgactacgtatttattaattttcctaacattgaccacctgaaagaattgcatccattttccattttgaacagcgtagtagacggaaccattacgctggcaattcgcggagacggtgacttttcccgagccgttcaacacgccaaggtagggtcaaaggttttgatcgatggcggttatggtcggtttaaccccatcataaaacaacatcctgatgacgagttggttctagttacgggcggtagcggtatagttccaatgatttcattaatgcgtgggctgccaaaccgccgtatcactctgtattattccgcccatagcaaggcagggttgatctaccaacaggaaattgaaaccttggcagcacaacgaaacaatttaaccgtgcacattcagcaagggcggtttttccgcagtgtaccgcgtgaccttattcgacccaatgtaacctatctgttgtcaggcccgctagcgctggggcagagttggcaaaaacaattgctgaataatgggatcaatgaggaacgagtatactatgaggagtttagctggtaatgatcgcaattctaagaagctgtccaagatctatgatttttgatatacttctatgtaaaaagcgagtttaagctatgaaaaattatctcagcaatattactcggcaacaatttgaattaattcgaccagctttagaaaattttcgtaagcgaactaagcctcgaaaatatgacctctacgaggtcttctgtgcggtcctatatgtcttgaaaccggttgccatggcgtcaagtccccgggattttcccagaatggcggtcagtttacaactataacaaaatttggtcaactaaagctgagcctacggctgattcttttggaacaagttttaaaaaattgtcttactcggcaacttaccaaggacgttcagctttaacttccttattatcgttgacgctcagagcgtcaaaaacaccgctactgcggaaaacaaaggttacgacgctggtagaaatctcggggattaagcgcaatctggcagtggatatcaatggctttccgcgagccattcacatgacgcgagcgaacgtctctgatcgagacggggccagtgcaatgatcgctttacatgccatgcatttacgccaggttcaaaatgtcttagttgatggtggttattcaggcgttaattttcagctcgatgtagccgtaatttaaacgcaaccgtgcgttgcaagcgcaatgagttgcatcgattcgaagtcatgccccaacgttgggtctcgaacgatcttttagttggctagagaattgtcggcgactttggaaaaattgtgagcgtcaattaaccaccagtctgcaaatggtcgttttagcgtttttagcactattacttaagagattttagacagattcttaacagtgcaaaagcgtatctaaacaacgcttgcaataacgatatgagttcagacgatcgatataaatttatcattgtcgaattggcgactttgtattaccaaaatagaggagtattaacgactgtaaaagattttccttattccttgcgttgtgtgattaatcagttaaaatacaattaaccttctatttatttggtattggcacatatatcagaaaaaacgtcattcttaattgagtggcgtttttttgttgtattaaaaaattaatcagttacaataaaactagccgactttctatttattcagatctttatgccaattgcatatcaaaaagcactactcattaatttgggtggtgtttttttgtatctaataaaatttttattttataacgtgatataaacgcattctactgcattgtttgtttatacgtgcgaataattcattagtattcagattgagtcaagaaacatttcagaaataattcagaataatgatataattctattgaggtgattaagatgaattcagaattattcacgatgtctcaaatttcacgcaaattaaacgttagcaagagtagcgtatacagaagtataagtaagctgaatttaagagaaaatagcactagaggaaaagcaaaactatataatcaagaagcattccaaaaaattcaaaaagacttatcagatttgaacagtaaacagttcatcaacaattcaaagaacaattcggaattaattcaagaattaaaaatggaagttaagcgttggaaaagtgaaaccgataaaagaaatgaacaaatagacaaacttacgcaattattagatcagtcgcaacgtctacaattagatgttcaaaataaattgaagaaattagaaagtaacaccgtacaaatccgtgagaacgattctaaggacgatagcaatgattcagatacaaatataagcaagcaaaacgaaaagccctctaatgagacacaggagagcttttggaaacggttatttagataggttgtgaatatttttcgagtagtatataataaggtcaattaaatacgagtaaacaaaaaaggcactgattgatagaagcccttcgacaaacttctactaatcagctaacaagtgctagagccacttgatagcctttagtgccaatcttattaacatatttttgaaagaagtttcggaatacaatttcctacttctttcattatatgaaatgagactggtaaatgcaagatacatagttgcagactaaagaggtatcaagttgaggatgacttgttatctcttttgttttctctaaataaagggagatatgtaattatgcaatttttcaaagtaaaagaaagcaacttaaattcagatttaaagggtggcaatgagattctgatttattcattgctagaagaccgtatgcaagcaagcactaagaataaagattttttcagtaaaaagtttaatgattattatgttatttacacacgtgatgagttagcaatgaagctaggcgttaacgtcagcacaattacagaagtttttaaacgattagtaaaaaagggttatttagttatgaaacaccaattcaatggggcaactaaactattcttaccaaaatttgagaatgaaacaaatccagaagccaacaatggcaacgtaaaacgggaaatccaacgtcctgaaattggaaaacctaattctagtagaacacttaattcaaataaacaaataacagataatacaaatgatacgtgttcacggactaattctccaaaagattccaatatcactcaaaaaccagtggttcaaaaaccagatcagaacaaagttatcaagcaagctgaattagatgtgattgctaacagtctagtgacgaaggttcatttacctaagcaagccgttaacatcatgaaaactttctcttttggcgatcccaaaaagctatatgcctatgccggtttattatttaaagctaagtcagcagtcagtaaacaagctaagagcattcagaatgcccaagaagccctatcatttgaattaaacacggattatcaagaaaccctagacacggatttaaaacggattattgttttagccaataaaaaaactagtcaaccagacggctatatgatggcttcgctcatggatatgtttcaaaataaagttaacgactattgcagtcatgacgttcaaagcgtgattggttaaggtgaatcaattacgggtaatttaagaacgtcgctggaacacttaattgtaactaatgaaatcagtcgttttcagtgattacattagggtaggccctagctaaacaacttgatatcaatatacgcaaaaagcccgcccatagggtgatgagcaggcaaattacgcatattttaccgagataaattttgtacactcaggtgtacaatggctattataaaaggcttagttaataaataaaacctcttccgttaagaagagattttagccgtcaactatatttcggtgaaataacttgattggagttataacttgagtttatactggtcaatttaaaaaagcaaaaggttaagttagaagggtaaaacatgttcttttcaatttttttcggtatgattttattagcaatggggatcatattagtagccctgctattttctttgagagcttatatttaagggttgaaaccagcctatcccacactaagcaacgacattattaacaaaatggaggtctttttatgaatcaagggcatcgaattgaaactgtgattaacggccatcatgtgaacaaaaatcattattttagtcttaaaagttaccaatggcgagttcgccatcacaaaaccgtggggaaaaagaatcttgcgattggtcaattagcttgggtagaggtgactggtcaacctaaaccggttttagtgatcattaccgggattcacacgttaaccgagcctgccgatcgccaggtcgcacggcagttaaagaccgtcaagacgattacaactaactcagttaaagatttggacgccatcactcagaataactttgagcaatacttggccacccactcccagggagaccctttttatcaacctcagcaataaagcaatcgctaaaattattagctagttggagcaaggaaagtcattgctgactatatcaaataattcacaatgaaaaaggcctttttcttattgtgaattatttgcttgcaaagtataatgtaagcggatacaaaaaagaaaatggaggcgcttattatggcagaaaaagtagcttttgttacaggcggcggtcaaggaatcggtgaagcaattgcaacacggttacacgaagatggatttaagaagctgtctaaaatctcttaagtaatagtgctaaaaacgctaaaacgaccatttgcagactggtggttaattgacgctcacaatttttccaaagtcgccgacaattctctagccaactaaa

SEQ ID NO: 24 - DNA, 8435 bp, Unknown
  Metagenome-assembled genome
ttggctagagaattgtcggcgactttggaaaaattgtgagcgtcaattaaccaccagtctgcaaatggtcgttttagcgtttttagcactattacttaagagattttagacagcttcttagagaagattaacgccttcaagtcagcatttgggactgtgatgtactacactgacatggacgttgttcaccgctttgaaaacgacttcgcactgtatgcggacaacttcgccgactgggcagaacaagcccaaggcaacgcccaatttgccgtttggacatcccttgccgaaaatggtattggcgctaacttgcaacattacaacccactaatcgatgacgaagttaaggaagcatttggcatccctgacagctggaaattgcgtgctcaaatggacttcggttcaattgaagctccagctgatgaaaaagaatttatgagtgatgaagatcgcttcaaggttttgaagtaatttaattccaataaaaatcggggccatcattagtcgattctgtgtgtcaaatcgtgacagctacggtttccccccttatattgacaaaacttggtacaaacggctgatcccggccatttaacgcactaaaggccctcattccaaaacctggaatgagggcctttagtgcgttaaattctgggatcaaaacgcctttcgtcccaatcttatttcttcaattgagccttcacaagttcatcaccgtgactaacgacctcttgctgcgtgtaatcagtctgaacaaccttgtcaccctgtgtcagcaagacaaccacggtatctttgtagcctgcctgctgaatcttgtcacggttaaattccagcagtaagtcacccttcttgaaggactggccagaatcaacatggttaatgaagccttcgccacgcatattcacggtaccaagtcccacatgaatcaagacttccaaaccatcattcgagcgtaaaccaatgacgtgcttggtggtaaacagcatcagcacttggccatcaaacggcgcgtatatcttgccttccgtcggttgaataccgattccgttacctggcaagcctttatggtcatgctcgtcaaccacatctgccaagttaacgctcacaccactaactggtgcggcaacggcaattgtagcagccttggcgccaggcatggtaacttccgtttgagctgtggtgttgtctgcagcttgagctccggaaattccttcagtcgctaatttcttctgcaattcatcaacaatctcagcatgcttcttttcagaaatctttaccttaaagacgtaaatgaacaatgcagcaacgagcaggaacaatgaaatccagaaagcaaccagtttgaataatgaaatgcctccgggtgtcattgaagcagcggttgcggtaccggtcatcccggcagcaacggcaacccaaccaacaatggcgtttgaaatcgcaccggacatcttgtccagcattggacggatggccaaggtaacagcttcgttacgggtcccatttttaagttgaccatattcaatcgtatcagtcaacgtcagaataacggccatgaaaatgaagccttgtggcacgtaataaaggatcatggctgtgataaccatcggtaagttatcaactgacacaatcagcaaaatgtaggctaaaatcatgctgcacatgctgacagcgtagatggtctttctggtaacccacttattgatgatgggatacaacggcgaggtaaagaaaccggcaattgtcgggataagaccggcaatccagaataacccaggcttatccatgacgtacttgaacatgtagaacatcaggccggcagtggaggcgttaccaaatccataaattaggtatggaaatgcggtccacagcatttgatcgttatgagccaaagcccagaacatgtctttcaaacttgtcttttgtttagtaacggcacgcaaagcattatgtttttcatgcgttcccaaaccaaccacgaacgagcaaatgatgccgacaacggcgattaaaatgccaaatgccgtccagccgggttgcccttcgttgtgtgacccggtaaagacaaacgtaacgtatgtgacaacaggaacaataatgatggtcacaatgttttgaccaaatgcactgaagttagcagcggcagtaaataatgaccgttcatgactatcttcagtcaaagcgggcaccatgccccaatatgaaacatctctgaatgaataaaagatatcaaaggtgataaagatcgggataaacatgatggtgaaccaagttgcacttatccgcgataagccaaagatcccggaaaacagtaatgccagtaatagactggatatcgtcccggcaccaatcagccacggcttaaattttccccagcgggtattggtattatcaacaatattaccaataatcgggtcaatgaaaacttccacaagccgaataatgaaaatcaatccggtaatcattgcaatgagcttgttggcttgtgcttttggaacgccggtaaacatggccgaggtaacatagaccataaagtaggtcccgaaggtcatataaaccgctgatccacctatattcgcaaacgcaaagttgaaaatcgaccagaattttttccggcgatctttcttttgtacagcatccaatttataaaacgcctcccagcgtgccgatatccgccaaataaatgcgggtttcggtatgaaatatttgagaaatatttgcttacaaagcgagtatatgatgtaagggctttcaccaatgccgactttttaccctaaaatacccaaatttaacctaatttaacctaattatagtaaaataaactaaaagggagtgctactatgcgaattgcatttaataaacctgtggaaactatgccgctatattgtgacagtgtcggctatgactgggaccagccgccaattcaccggctaaatggctattacgcctaccattggctgcagacgcaaagcggcagtggcgtcatcacgatcgaccaccaaagcatttcattggagccacaacaaggaattctcctgcgcccaagagtcgctcatgaataccacccaactgggggaagtccctggaaagtatcgtttttgaccttcaacggcatgctttgtcgttccctggccgactttttgaaacttggtgattatctggtgatcaatcaagtttcgcctgaactaacaacttttattccggaagtcttgaatgaatttaacaacagccatccaattgcgctgctcgatcaatccgttcaaatctataagtttatcatgctgctcaaacaaaataatttactaaacaatcaccgctatcaggattccgccatcacaactccaattctcaaatacattgcaaatcactacgccgaacccatttccaatgaaaagcttgccaaagttaccagctattcggtcacctatcaaaaccgggtatttaaacgcttatacacaatgactccgcttgagtatctaaccgattatcgaatgcgtaaggccaaggaattgctgttaaccaatccaactctggaaattcgcgaggtcgccgcaaaagtcggctttcataatccatcacacttcattgatcaatttaaaaagttttatcgtacgaccccctcccactttcggaaattcatttaagaaatccgattcaatcaaaacggcactgtttatgaaatgaccacccattaatgttaaaatgtgcctacaacattaattaaggagtgatcttatcgattcaactgttaagcgtagccgtggcatcaccaactttgatatcaaagttattgggatcgtcctgatgtttgtcgaccacgtccacgaaatgttcgctggtgcaggggtccccgactgggtcgattggttcggacgaccggttgcgaccatctttttcttcctgagtgtggaaggctttgttcacactcacaaccaaaaacgctatctgtcgaggctgttaatcggcttttggatcatgcagattggtaacgccgttcttcagcgttcctttagccttggcagcttcggcctcatcaataatatttttggtgacttattcgttggtgtcttaacgatgtatggcattcaaaccctttcccaagggcgccaatcacatcaagcctcaaaaatttggggtgggctcttcatcatcgtgctgccgctgatctttgctgcaattaccatgggaatcttggcggcttggcacacaaatcccatattgactggtctggcatcaatgcttcccagcccgttaattgctgaaaatgggattctgctctacttaggaccattaatgtatcttttaagaaagaaccgcaactggcagatgctggcaattattgccgttgcctggattgaagtcaatatttgagacagattttaagagacattcagaaccgcgtttaccttccacagctcaaataaatcattaatcgcgattaataacttatttgaaccctggaaagcattaaatcagagatcaggcggccatttggctcgtaagtgttgcaatttcaacttgtaagggggtctggttgcccagtgaactatgaattctctttctattgtagaaagcatgcacatattcaaaaaggacggcagcggcagtttcataatcttcaaagaccggcactggataaacacattcctttttgagggaagcgtgaaaggattccattggcgcattatcgtacggacaacccttacggctgtatgagtggcggatatgtagctcagttaaacgttgattgtaatcatcgctggtatactgtgatccttaatccgtatggatatcaggtccagtaatggttcgatttttaaccgcgctttccagggtctttaagactaaattagtatccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagtgggacgctgttcaaccttggtttggaaaccgaagccgctttccacttattgacggtaacggagtggatatccagttccttcatgagccgggaaatccgtcgtggactgcaccgaagctgcagtggtgaagttccagattcaatcatggtggatcttcataacaccgtatcgctgctttaaacgcaaagattcgcagaatccgttgtttcaagtccgcatcttcggcccggcgttttgaaggtttgggggatcgataacgattaatactgagctctggagaaacaccgaggattcggcacatcttggaccgggtggtgatggctttcttgtgtgaatgaatcaaaagatatggttacttctgcgcaaggaagccccgggcttttttttaggatttcgttccctcagacagcgaagccagcgcttttccatcgctttatttgtcgtggcgatttaccggattgagtttggcctggccctggatccacttatgaacggtgaatagccatgccatattctctggccagttggggctgattcgcctgtgtatataggtttgttgataatgttttgtttgaattctttgtcgtaacgagttggcatgtaaaaattccttccttttgagagacgatttattcattataccctctcttaaaagttgtctcaggaatcagcttacatccaatagttcattcaaatattagtaaaaagcttgatcagtctccaaaggaaaagattatcccagaaattgaaaactgtgtttatagtgtaatagctaataataatttaaaaattcaatctaaagatattaaggtttgtaaatctggtaatagttatcaaatcttaaggaattgtcaaaaactctttattatttttaaagataatgattcatggtacttaaagacacaaccagtaattaaatagatatagttttccacaaaagcattcaatagggtctaccctaatgtaatcactgaaaacgactaatttcattagtaacaattaagtgtttcgaaagcgctttgagaatgacaaaattgttacgtaagccctagtagttatttagtcgttcatgatatgagtgaaaccaacactatccagaactttcaccaagtttttcgattcaactccatgctggtacgtacttaattatgagttaccttatgcttccggaaattttaacgattttatattttaacatggtattaagcgaatgagtgtcgtagccggaaacgccttataataattttttaatggaatgagtttaaaatatattggctacaaataaggaattatctatttcaatgcagaaaaacgttcctcaaaaaatgatcttattccgaaaaaattccgaaataaaaccatttttaataaataactatttagttaattttatatcatttcaattatcaatttgacaggcatcagtacaaatgttgattctatagaatttttattttgaaattaaaagtggattcatctaaactttagactttcttccaacctcttatttaaatttgcttattacattagtatttatatgctaagaggttaattctccttattttcatatttagcaactattttttgaataacatcacttatatccttaggtctagttttataggccttgacaagtactttactttttttagttgcagaaatctttcataacgggagaatctttagagatgtagttaaccggctgtactccataactatctgtagcccattgtttatttattcctattccacagtgcccataagtgcccaaatgatatttcaattgatgaagattaatatcgcaaaagcacaacatcggaagggcaatattattaatgatgtttttattcttcatttttaaattgagataactaacatcttccttattatatcttggaagtaaagccatctcgctaatagcttttttataaaatccaattcccccataaaattaaataaactattagcactctcataaaatttagtatctattttagaagctttttgtgcttggattatatatttttttgcaatgccttttccttcatgtaaaattacttaaaccctagtaaactatcaatatattgtgccgcttctgccgttattctaatatgcgatttttgcaaatgacattttttaaggtccggtaatgataaatttttccctttcgttgaagaataaaaattattttttaagattgataatagttgatttaatgaagcaccttccgagatgttttccttaattaattgtacattatgaattttaatataatatggccacttttccatccacttatatccttctctatttatatcagcgtctgtaactacattattcttatcaaatccatctgaaatggcttttcctacgataaagggagtatgactattatcattatcatttttgcttaagggggttaagtacaaaacgtctcccttttttataccacttggatgcttttttttaccgaagttttcaactacctgtccatcagctaatttggttttatcaaatggaagattaggatcctttaattctgaaccagttccgtcaaattttagccaatatgtagtttgggaattttttgattttgcttgttctctctccttaacttgtgattgaacaatatcaattgtatcagtagtcgaaatatctgctccagtcgagatatctgctccccattgataagtatttttactatcaatatttttatcctttctttcctgaatcattctttctaccatctctttttctagggatatcttttcccctgttatggcaaaattatttgctgaactaaaagcattatcaaaataatgttgaaaagctacatttaattttttttcattcttgattagtaaggaaagctcgatattattaagtagtccattctcagtaagatttgccgaccctgtaattgctattttcgtgtcaaaaagatacaattttgtgtgcaaatttttgactgcttccattcgtacatttcgcttatttaataattttaatgcttctagattacttgccccagaaataaaatcttctctattaaatcttgtaattaattctatttgaacatccttagaaatatttaataacaattttttgattgaaataaaggataaatagggcgtaataatttttagagaattttttgtatttgaaaaatcctgaatgaattcttgacaatgatttgatgaaatcagatctatagacataattttcacctctattttttagacaaacatatacctatcagaataattatactaaaataatatcaaaaaattgatctacttggcaaattctataattaatccgaacagaaattaaaaagcccaaagcaatcacttacaatggtagtagctaattccaaccaatatagggagtgattactttgggtacatctactttatcacg

SEQ ID NO: 25 - DNA, 11105 bp, Unknown
  Metagenome-assembled genome
tcaagatttaacgacgacgttactccaaattaaccagcgaccgcttaaaatactcgactggcaaacaccgtatcaggttatgctgacaaatttgtccaaaaattcggattaaatttgcaatctaccactcaaatgccatccatgccgttgaaaaatattcaacccgtaagaagctgtttagtatctttgattttgacccaataatttgataaactactgtcaaaaaagttggtgatcatatgcaacattttagtcatcattaccaaagcgatatttctcggcaacaattcgatttgatccgtcaggatctggaagcttcaagaaaacgaactcacccaaaacacattgatccttatgatatcttctgtgccatgctctatgtccttaaaaatggctgtacttggcgtgatttgccggctgattatccaaagtggtccaccgtttactactattggatgaattggtcgaaagcccccacccctgataaaccagctttattaactcaggttttaaaaaaattgtcgctgatcgacgattaaggcaagggcgatcagcccgaacttcgttcgtcattttagatgcccaaagtatcaagaacaccgctaccgctgaaaataagggttacgatggtggcaagaagatctcgggaattaaacggcatttagccgtcgacatcaatggcttcccgcaagcgatccatattacccgggctaacatcactgatcgtgacggggcgattgccctcgtcacccttaatttagagcagtttaaattggttcgaaccatgatggttgatagtggttataccggccaaaattttgccaatgagattagcagtttaacctcagccaaggtaatcgtcgttaaaagaaatgagttacaccaattttcggttatcccccaacggtggctcattgaacgttcatttagttggttgggaaattatcatcgtttatggcgtaactgtgagcgtaagctcaacactagtctcatgatggtttcgttagcttttatcaggttacttctcaaaagatactaaacagtttctaaggctgacgtcatggtttgtttctgcgtcattgacagttgctgcattaaacgaccctctttcatgtgactgttcatctaagtacagacacatgatatattcaacatatgtatatgtcaacatataacgccgatcaatgactccatgaaaggtcttgcagcaacttcttaacaaactagtgctggtgggcgtgttgttgacttgactggggccgataagcggcaactaaccctgtcacagcgtccaaagtcataatcagacccattaaccacatcgctgccatattgtgcatggtaccaattagaatcagcagcaccacatttaacgccagcatgagccagcccattgttttcgacatttgttgcatgaaaatcctcctcaagtgtatggataagacctataccatttttcaatactactttaggttaattctaaattatgtttatggcaaccctaaaaagtgttaaaattcttgtcagagggggaaatcacgatgaaaatctatacggactatttctttgatgagccagcgtttgatctccacgatggcgggtacgtgccgcttgaggtcagtgatgcgcctgagaagcccttaaatgtgccgccgttgttgaaaccggataaagagacggcgaccgacgtttattacacggtgacagcagaggctggggaaacgcaactgttacctggggcgaagaccaagacgtggggctataataccagtctgttaggtcagacgattgtgtatcgccgtggtcagcatacgcatgtgacactgaaaaacaccctgcctgagttgaccacttttcattggcatggggctaatgtcagtggcccttatgttgatggcggatgccatgcgccggtttatccgggtgaaagtaagcatatcgacttcacattggaccaaccggcgacgactttgtggctgcacgcgcatccgtgcccatccacagccgagcaggtttggcatggtttggctgccatggtgattgtcaaagacgaccatgaagccagcctgccattgccaaggaactatggcgttgacgatattccggtcattttgcaagaccggcgttttcacgagaacaaccagtgggactaccgggctgattatgatcctgacggtgttgctgggccaaccgcaatgattaacggtacaatcaatccctattttgatgtcaccacgcaaaaggtccggttgcgttttctggatggtgctaatcgccgtgaatggcggttgcatttttccgatgacctgccatttacgcaaattggcggagatggctcattgttaccggaaccggtcaaattcacccatctaatgctgacttgtgctgagcgtgccgaagttgtggttgattttgggcagtaccatgaaggcgatgtggtcaccttatatacggataatgtgccattgttaaagtttcgcattcatgcgttcaaaccgaatcagacgactttaccagataagttgttcgacgtgaaggtgccagtggttgacctagctttgccagttcgccatgttgtgatgcagggaatggacgaaagtgttgcgatcgatggtaaaaagtttgccatgcagcggattgatgccacgcagccaattggcaaagcccagtactgggatgttaccaatagcaatgatgcgcctggaatggttcatccattccatgtgcatggaacccaattcttagtcttgtcgcggaatgggcatgcgccgtatccaaatgaacatggtttcaaagacaccgttggcgtgaatcctggggaaacagttcggctgctggttcgctttgatctgccagggatttatatgtatcactgtcatatcattgagcacgaagatggcggcatgatggcacagattgaaactttcgatccagccaagccaaagcaagaatataaattgatggatatggatacgttaatgatggccttggctaaagaacgtggcgtcaaaccatctgagatttggatgggcggtatgcagtcttatgaaaaaatgggaatgaaaatgtaaacgtcccacaatactaatatagaaaaagatgattttaatatgcactctccaacgatcaaacatcgcggggcttttgtcgccacgttactgacaggtaccttttcgatgtcaatttcgcagtcttctttaagcaccgcttatcctgcttttatgaaagcttttggtttaggagcggatacagttgcttggctgacaaccggctttatgttggtgatgaccttgatgattccggttagtccatggctgttgcataatgttcctttccaacggcttttccaagcgattgaactcatttttgccattgggacaggcttatgtatctgggcaccgagttttaccgtgctcatgattggccggttgcttgaagcgattgcgatcgggattattttcccgagtttccagaccgtgttgctgacgattacgccgcatagtgagcgtggtcgggtgatgggcacggcgggattggtcatgggctcagccttggcagtcggtccgattatttccggtgttttactgacatggttcccttggcaggctttattcttgttcttcttggtcgtttcgctgcttgtgctggccgtttcaacggtgaccattgcgtctgtcatgccattgcaaccgacgcaactggactgggtctccttccttttatccgcaagttttccaattctactttatgccttgggtgctttgtcgaaaaaaggcttaactgttggcgtggttggtttgttgattttaggcgttctggcagctggtattttcgttgttcggcaattgaatcgccaaccaccaatgttgcaaatgcgagtttttgccactggtatgtttactaaagcggtgtttctgaccggaatttcatacgtcggtttgattgtcaccactatcctgatgccgctttactttcaaacgctacttggtttgtcaccgttgatttctggcttgtccttagtgccagctgcggtgttgctgagtattttgaatccaattagcgggcgcctactggatcgctttggaccgcgtgtcgtggccatgattggcatgttgttgattactggcggctttggtctgttagcagtctttgcccatcatttaccgctgattggggcaattatgttggcgatggcgactgaagccggcaatgcctttgtgatgatgccttcagtgacggctggcgcgaatgctttgccgaatgagctcgtggcagacggcactgcggttacgacgacggctcgtcagttatttggttctgccggtgtcatgttcgccacagtgttgttggatggcatgcaaaccacgctgcgaagtcatgctggcggttttgctgttaccttcgctgtgtttgctggcgtgggcctgattggcttgctgttggcgttgacgttaccaaaggaagtcgcgaagaaagcggtatagctgcgaattcgtgcttagttgcaaatgatcaggagagaagcatcgcgactaggaaaggagggcaacacggttgctttagtcaacaaagaccagttcgatagtttcatcttccggtttgatgttgacagataaatgacgattaaggtcggccaccagtttgcgtgcgaaggccatcttctcgtcgaattcggtcatgtgcgaagtaaacgggacgctttggtaattaaagttttcgccgatatagcccggatcagtcacgtagcgcaagttgttttcgtcgtggcgactgcccggtttcaggacggtatccaaatactgatagagaatcgttggatcgtagttcagcggcttatcaagggtcgtggaaagcttgtagccggttgcttgaccagcgaattgttcgttgatttggacttgggtaaggctttgatacaatttcaaaacgatcactcctcttcttttcacttttagtatagcagttatggtagattgtaaaattaatccgaacagcgttcggattaattttacaatccaccataatagtcttgcatatttagatgtcctttcggggataatctgtgggtatcgggtgtggccgatgccttttttattttccattatatcaaaaggcggtctagtgagaatccgaagattctcactagaccgtcttatttgtggagacttatgtcacagcctctttttgatttattcgtgatcctaaacagcaagttataagtggtcgttacaatttctattttgtaaactcaagttcaccaagagcacgttgggctgctaagttcaataggctccactgtcggtcaaagcctggctggaagaaaaagtcagcttcggctaaatcttccagttttaatccttgttggatggctaatgaaataacattaccttgggcagtgatatcataagttgacaatacagcaccacctaatagttgatgagtgtttggattgtaatccagctctacgtagacctctgtatttcccttctccatagggacataagctggacgtaaagtgtctttgtaaaaagatgtgttaatcttaatatcggccttttgggctgtggtcatattcagacctgatgtggcaaagtgatagtcgaaaacacttaatgctgatgagccgaccactcctgaaaatggcatagacggtgtgttctcaaagatgtgttccactacataacgggcttcacgtcgggcaaccgtggctaaagctatcggcatgttcctctgagcaggaattgaataggccaacaccgcatcacctatggcatagacatcaggcagattagttctcaaatatttgtcagttttaatccacccgcgcttatctagttcaaccgttccctttaaccaatcagtattaggtttaactccaacagcttgaatgatcaagtcactaggatattctgcatcgttggtcttaacagcagaaaccgattcagtcccttcatagcattcaatcttagcgccagtgacaacttgaacgcctttgctagtcaattcttttgataaaatatctgttaattcggtatctaggtagttgcccagaggccgattaatcatgtcgattaatgtaacattctttccagctttgatgctggcttcagcagcttcaacaccaatgtaaccagcaccaataacagtaatatttttaacatctgggtcagataattttgctttgatcttttctgcccaatccttgccgcgcattgaataaacgttttttagctcatgaccaggaacgggtaaatcgtttggagttacgcctgagcttaagattaatttatcgtaatcatagctctgtatcttaccggatcttaaatctttcacggtaacttgcttattttctggatttattttggtcacttcatgattggcatatacttctgtcccaaatttttcgagatctgcaggtttaaaattacggacatcattaatactcgttacactgttttctaaatataattccataccacaggacataaaagaaataaaatctcccgcttcgaatagtttaatatctaggtttgagtatttgtgagtaagttccaaaaccgactgatggccgccgtgcgaggcaccaacaacaataacttttgtcttcgacataaaaaatatagcctcctaatagatgggtgacaaataataaatcgttaatgatggccattttgttctaaagtacattcgtgatgacgcaatgattcaccgatatctcatccagatactaagccttcttctctcgaatggagcccaccagatcatctgtagctggagcgttcgcaagcaatgcgcgaacatcatcaagattcaccttaacattccaaactaaaacaccaactaacttatcggtatctatgaaatagacaagcgatccatgcgttcgccgatcaaaaatcaattgcaatttaggatcaatattaccgattgcttgccaggaaatatcaaaaatcatggaatagaagtatggggtatgctgatagctcatgtgagcacctgccatattacggccaactaattcaccagaaagtcgggcatggtccacgtgctcaatccgttgccgacccaagatgtgatctggataagaggcaatatctccagcagaccagatggctgggtcactagtattgagatactcattaactttcacaccaccatcagctaaatccaaacaactgtcttcagctaaactaatccgcggcgtaacgcctaacccaacaatgatcgtatcggctgcgatcaccgtaccatcctttgtcaatagagtcaagtggtcaccttggcgttgatatgattggacaaactgaccactcatcagtgtgacaccattgcgtttgaacgtggcttcatactcagtccgaatagactcaggaaatttaccctcacccagcgctttttctggaaaaatcatcgtaacttcagtctcattttgggtcagtgacgatgcgagctctgtaccaacatatccaccaccaatgatcacaactcgcttgttcggaccactaaatttacgtaacttgcgataatctgaccactgtctaaagactagcacatgtggatcagaaggtccctggatttgtctaggttctccgccagttgctagcaatagctgttcatacttgatttgctcactatcggccaatgtaatgaccttatcttgccgattaatagccgtaaccgttgtcttgaacttaaaagtcacattgggataattttcagcaccaatctgaatgttctcttcagtaaattcatcatctagccatagttttttactcagtgccggtcgttcatatgggacatccgcctcttgcgaaataattaagatctcaccctctgaatcttcctgtcgaattcccttgatggcatagccagcaaccactccgccaccaacaatgacgtatcgatagctgtttgtctgatccaaatcactcatctaatcgcctccataactttactttttctaggatcattgtaatataaaaacgccatgattcgaaaaataacgctcagaattgtcaatcgttgcttgcttttatcagaataataattttatttacatactgctacaaagctatcaaatatcactatgatccagatttagaattgcggataacacagcataaaataatattattttaattaaaaaacctcaatttttaaggtaatcatttttgattttaatttgaagtaacaatattcgaagagttgtcatttttcttggtcatttctcggattttagtggagttagaagtttcaagtggtccgctctgctatgattctctcatgtaaacatcatctttgtatattgaatttctttcgatatctgataaaggtcgtccgtttaatccctgtattacgggcaacatctacatcactcatacccgtttgataaagcttaaaagcgtgttgcaaacggggatcatctttggcatattggggtttgcgtccatgatatttaccctgctgcttagctaaggcaatcccttgttgctggcgctcaatgattcgcttacgttcactttcggcctgatacttatagagttcaataatcaagttggtcatcagttgacgtaaatttgggtcagcaatccctgtcatggacggcaaatttaacacatctagggtggcacccttattttgaatggagttcatgatcttagtcaaatcatggttgtttctgcctaagcgatctaattcagtgaccattacaatatcaccctcacgaatataggccagcattttttgcagttctggccgattagtgttagccccacttaatttatccgtaaataatttatcaacgtcttttaaagccgctaactgtcgatctaaatgttgctccttggaactcacacgcgcataaccgattttagccatttccaattctccttttggacagttctaatgaacacttgtaattcctagtatagcgcagaaataaaaaaggccaatagggtataccctaatggccgtttgatatgaacttattttgttttatatttatcttgaacagcaagaatttttgttaaatattccatatctaaatcttttcccaaggagtcttgataatctgtttcaacgacaaattccttcactgtgccactcatggtctgatatatgaaataaatataaacgggctttttattaacgaagcgctttaatgctttataattagacgtaagacgattcttaactgcgtctaaaaagcgccctttaggaataacaatagttctcatttcgtgacttttgatgggaataaaaccagtcgccgcaatttcatcgccattttggatattcaccatttgaaggtaaggatataagtccttatcttcatattgctttttatagttcttagactttatcttatctataaacaataaaaataagcgatatgtccaagaccttgtcgtatgcgtagtcttactattgctgtctttgcacaatctaagttttactcgaatgatgtatggcaacaactttcgatatagatagaatttcttgtctgtaaccattattcctagcagttgagacgcttcagttcctaaactgtcattatatatggaaatagctgtttcaaaattgttgtttcctgaggagtattcaaaagattgtctcagcttcctgtgacgatttcttaaaaatgttattactgctaatccgaatgctaaccaacctaccgatatgttaatgctaatccattggatgatatttaaaattagttcccatgattgacctataaataattgtataactttcaacattataaaatcttctttcttatttgtttgcatttgtattattatttttataattatcaagcgccttactgttctacgtcaccaagttttaaagccttctttcaaattttgtccgtgtcctactagtaatataaggattaacctgaaagttaatccgtttaaattggttctcactagtaatatagcgatcaggcaaatttgtttgaaaacttggatagtgatatagattccctgtataatggtattttgtagagaagttaaggcggtggctatttccaatcggaggtggtgcttatggtgttaaacctttaaagcccataaatcctaacgaaaggagtagcctaggtgtccgttgcggacgctttacaattaatgctggctttcggtacttttatcgtggccttaatcgcattaattgttgagctgatcaaaagtaagcaaaaaaaataaccgccttagctctggtcagctagcggttattaaatatcgttaaaatctgccaccgtctttaacggctctacatgggaagccctgttctagcgggacttcctttttctattacattatagcatgtcccttaaaaactggctaacgttttaggctttgatcaggttcagaatctggttgtttaatttctggattctgtttagcaaatgctttcagttgtttttgcgttcgattactgatttcatggtgtaaatcatttaacttattttttagtcctaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaacgtgtttggatactttgacattcgatttgattttagttaaattagatcaaaaacaggagtttttaatccatgaaaagctttgcacaccattatagtagcgacatctctcgtgaacaatttgaattaatccggacagatctagaaggcatacgtaagcggactaagccaagaaaggttgatttatggtagattgtaaaattaatccgaacgctgttcggacaaaaaagatcagcttcctttaaaatggtgtttaccacaaacccatcttttaggagctgatcttttgtctagtataacctattccgaac

SEQ ID NO: 26 - DNA, 8233 bp, Unknown
  Metagenome-assembled genome
aacaaatgaggcttatgtcttccttccttgagagagtcaaaccatagtgatgtgaaacatttacggatttagtaatatttatgatatactaatcccccttttgtttatttctttgaagaaatatattttttacaattttgcttaaaaaccacgaataaaacataagttctgttagtgaaaatattttagcagaaaaaactcttttttcagttattaactatgcgtaaagacactcacatgggagttaaataaaaaagaatctctattaaagattcctaataaatatagtacttgaattgtcaaaatgctcaattaattttcatgcaaccgtttgcaatttctgccaaaagtgccataatacaaaatgtaaacgctattattaatacgatattttgaattggaggaatatgaaatggatgaacaaagtagcgcagctgcaaccaagaagtctggtttgcccaaacttcccgccagtaccatttggatgatcaactttggcttcttaggtgtgcagattgcttttaccctgcaaagctcacaaatgagtcgaatttttcaaacgattggagcggatcccaataagttgggctggttctttattttgccgccgcttgccggtttaattgttcaaccaattatcggttattattcagatcgaacttgggcacccaagttgggcggccgtcgattgccatacttggcattaggaaccttgattgccatcatcgtgatgtgtctgttgcctaattcggggagttttggcttcgggtacgcatcaattacggcattggtattcggggcagtcactgttgccctgctggatgtgtcgtctaacattgccatgcagccattcaagatgatgatcggcgatatggtcaatgatgaccaaaagagttatgcatacggcattcaaagtttcctgtcaaatggtggtgcggttatcgcagccatcttcccatttatctttacggcattcggtgtcgccaataccgctaaaaagggtgtcgttccacaatcagtcgtgatttccttctatgttggtgcggcaattctgttactgacaagtgtgctgaccatcttcaaagttcatgaatatgatcccaagacttacgccaaatatcacggtattactgaagaggctaactcaaccggtggtaactggtggacattgcttaagaaggcaccgaaagtattttggacgacgacattggttcaattcttctgctggattgccttccaatatctctggacatactctgccggtgcgattgccagcaacgtttggaacaccaccaacgccgcttccgcaggctaccaagctgccggtaactggtacggtgttttagcagccgttcaatcaattgctgccgttgcctggtcatacgttttggctaaaatgccaaataaccatcacaagttgggctactcaatcagcttggcccttggtgcagttggcttcatctcagtattcttcattcacacccaatacattttgatcctatcatttatcctagtcggaatggcatgggcatcgatgaacacttatccattaacgatggttaccaacgccctgtctggtgaacatatggggacttatcttggcctgttcaacggttcaatttgcctgccacaaattgttgcctcacttgccagctttggcttattcccattattgggtaacgctcagccaaatatgttcttgttggccggcatcatcatggccctgggtgcagcctcagttggatttatcaaagaaacttacaaagcatagaaaggacgtttatttatgaaaagaacttttgaagtgacgccttggaacattgtgactcatgacttcaagccagaagacaaacggcttcaagaatccatgaccagcctaggaaatggttatatggggatgcgcggattcttcgaggaagattacagtggcgacaccttaaacggcatctatcttggtggtgtctggtatccggacaagacccgagttggctggtggaagaacggttatcccgattactttgggaaagttgttaacgcggttaatttcatcaagatgcacattaaaattaatggtgaagccatcgacctggccaaagaccagttcagtgatttcgaactcaatcttgatatgaaaaaagccttgttaacccgctcgtttacggttaccaaaggtgatgccaaggtggcagtcgaatttgttcgtttcttgagcgttgcccagccggaattgtccgttcagcgggtgcgcgttcaaaacgtcggctcaaataaagtggatctggtgattgattccgctatcgacggtgacgttaagaacgaggacgccaactacgacgaacggttctgggaggttctctcaactgaacaggggactgattcaggcaatgtccttgccgaaacaaccccgaacccgtttgggacaccccggttcacttccggaatggaaatgcgtaacgtcacggctttgactgctgacaaagtggctcaacccagtgaaaaagaagttgtcaacgaattcaccggtgttttggcacccaatgaatctgctcaacttgaaaagcgcgtgatcattgtgacttccagagattatgatactcaagctgctttaactgacgccatgcatcaattaagcgacaaggttgccggccagtcatatgatgaactgcttgaagctcatgagcaggtctgggccgatcgctggaacaaatctgacatcgtcattgatggtgacaccgaagcccaacagggaatccgtttcaacttgttcgaactcttctccacctactatggtgaggattcacgcttgaacatcggccctaaaggcttcactggtgagaagtacggtggtgctacctactgggataccgaggcctttgcggtgcctgtctacctgggaattaccgatcctaaggtaacccgcaacctcttgatgtatcgttacaagcagttggacggtgcgtaccataacgccaaacagcagggactcaagggtgccctgttcccaatggtcacttttgacggaatcgagtgtcataatgaatgggaaattacttttgaggaaattcaccgaaatggcgatattgcttttgccatttacaattacacccgttacaccggcgacacttcgtatgttctaaacgaaggttcaaaagtcttgaccgaaatttcccgtttctgggcagaccgggttcactacagccagcgaaacaagaattacatgattcatggcgtgactggccctgatgagtatgaaaacaacgttgataataactggtataccaacattctggcccagtggacgttgaaatacacgcttcagattattaaggaagtttcacccgaacaagctaagaagctgaatgttagtgaagatgaaaagaagcattggcaagacattgtcgacaacatgtatctgccatatgacaaagatctcaacatcttcgttcaacacgatggcttcctcgataaagatctcaagccggtatcagaaattcctgcagatcaattaccattgaaccagaactggtcatgggacaagattttgcgctccccttacattaagcagggggatgtactgcagggtatctgggacttcattgatgactttacaccggaacagaagaaatccaactttgatttctatgagcaatacaccgtgcatgagtcaagcttgtcacctgccatttactccgtgttggctgctgaccttcactatgaagaaaaagccgttgaactttatgaacgaacagcacgacttgatctggacaactacaacaacgataccgttgatggcctgcacattacggcgatgaccggcggctggattgcggtggtccaaggattcgctgggatgcgggttcgcgacggcaagttgcattacgcaccattcctgccgaagaaatggtcacactattcatttagacaagtcttccgtgatcgtttaattgaagtcgacgttgatcaggatggttcccacttcaagttaattgatggcgaaccaattacgattgatgttgccggtaagcctgttgaattgagtaagtaataagcatgatgatgatgagcgaggaatcgctcatttgctgtatagcaggaaaggatatcatgaaagtagtagagaaggattttgggcaattacctgacggaaaagtcgtgaaggcgtttaccctagaaaatatcaagcacacacagattactgcaatttcatacggggcaacttggcaatcgttttccgttgaacgtgatggtgtcaaacaagaattgttagtccaatttgatgatttagccgcgtatttagataatccattccattttggaaatacaattggtcgtgttggtggtcgtctatcaaaaactgattatgatattaatggggcacattttacattaacgccaaatgatcatggcaatgttttacactctggcattaatggctttgatgcggttaattggcacggtgaagcaagaaatttgggtacagcggcggaaattaatttcacacgtacttttgatgatgaattcgccggacaattagctgcccaagtgacctatcgattggacgatgaagatcgtttagacattatatttagtggcgtttcaaccgagaatacattgttcaatccaatgacgcatgtctactttaatttagttggtaaggatcaagatatcagtcagcataaattacaaattgcatcacgtcaacatcttgaagttgataatcacatgattccaaccggtaacatgattgataatcaaaatacaaaatttgattttgcgcatttgcatgccttgggacaagagcattacgatgatgcttgggtattagatcccagccgtcaaggggagggagtaggactaacttcacccgatgaaagtttgaccttgacagtggattcagatcgcaatggtgtggttgtattcactgccaatcctgacgatagcagtgacattaaaacagcgcttgctattgagatgcagaccttgcctgatgcggttaatcatgaaggctttggtgatattgttttgccagcaaatgaaacaaaaacatatactgtaacttaccaaattaaaaaaagcgaggataaataaaaatggctaaattttcagatattaaaggttttgcctttgatttagatggcgttattgctgacacggcgcgctttcatggtgaagcttggcatcaaacagctgatgaggttggcacaacttggacaccagaattggctgaaggtttgaagggcatcagtcgcatggcttccttgcaaatgattttggatgctggggatcatgccgatgatttttctcaagcagataaagaagcattagcagaaaagaaaaatcataattatcaacaactcatttcaacattgactgaagatgatattttgcctggcatgaaagatttcattcaatcagctaaggcagctggctatacaatgtcggtggcatcagcttctaaaaacgcaccaatgattctagatcatttgggattgaccgaatattttgttggcattgttgatcccgccactttgacaaaggggaaacctgatcctgaaatcttcgttcgtgctgcggaagtcttacatttagatccagaaaatgtcattggattggaagattcagctgctggaatttcctcaatcaatggcgcaggtgaaacatcactagcagttggtatttcagatgtgttgtcaggagcggatctgaattttgagtctacttcagaagtgacattagcaaatattgaagctaaaatgcaatagataactaaaaagagtgtcagtacataaaaacactgacactcttttgttgttttaattaacatttgccagcgtattgccctgcttgagtgtgatatcggtaaaagttacggtatgcgttgttgtatgtgatcaacgagagccgtaatagctaattcatccatctgtgtaaatttttactgcacaggtgctaaaataggacgtgctaattgggttaattctgtccaatcgatgatcacaattgatagattctcagagacagaaatgccaacaccttttgcaccatttagtaatcgaatactgctgatgtctgctgagccaattgcagtcgtgaaaggttggggattcccaaatattttggaagcatacaaaacaggtagcgtcaagaatcttgtgtaaatgaaatgccttcgtacatataatatgtatctaacttaaataaatgatgcttccaaggtgtcctggagtcctttgaaccctcggtggatccgcttcagagacagagcttatcgttataaaacatttaaactgagtaaaccaggaagcgatccagtgaatcattccgttggaaatttctttgtggtgggtggtggcttgagatgcttattaaagttctaatcaggttagttggaggtatagtgaatgccggatagcttggctcgcgtgaaggaagaagtccatgagaaaagtgtagtaaatcggcattttaagcagaatcttgattaatttgggataggctgatgcccagttgttggcgaaatcatttcagtttaagttcgctgcttcgcggttggcggccagatagtaatgtgtttataagtcacgatcacggcgccttgcggtctttgagcgcgaacatttgtgttcatagattccgaccaaacattgaaacaggaaacgttgtcgtattggcctttaggaaatgccgattcagccttcatccaaaacgcaaactaacccatcggcaacaaaccacagcacacttttaaacgccctcgctgatcaggttcccagcagttcagtccagattccagtcgattccgtcggccgccacttggtagttcagcaatctttcgtacatctggacgaagccaatcgcaatatgaacggcttcttttgaacggatccctactgctttaacggaagtaagtgggatctaagaagatggccccgcattatgtgaagccagtcgaggctggaaagcgtgaaccggttcattacggtttagtccatgttggaaacagttggcttttttttttggagtagtggcaccgtacttttctcaatgagttcggcaatttcgcagggtaattcccttgggtacaatgaagaccgtgtttctaaattatcaatgtgccgaccgtagggctggcacataggtatgattttcacaaaacccggccattgcgattcgagagaatggtaagttaagttgccgtactcgtatcaaaacgagcgccataaatgccgtgcggttattacagtgttaatcccaagcgtcgagtggcgcgttcgaacccaaaaactatgccaattcggttgtttttttgaagacagactggagtaatcgccaattcgaggggggacgacaaacttcgtccaaatcttgctttatgggctagtgcagcgataatttctgttgggttttgtaaaaaagttcatcatggggaaggcacttcctcctatttctaacaattcagaaatcttttatgcataccacaagatcttttacgcttctccgactaactcgttttggcttattattggctaaatttacggtttcaggggtgtaaaccaattaagtatctctttatatgttaaaaacgggcctccttctctaataatggcgaagagaatgagaagaaagaaggaaaagaaccattttagggctaaatctcagaagtaccacaaagggacccaggcgataatcatcggtctgggtccttaacaaacgccatgacaaattaggattttttaaacaaccctttagttaattaaggaaaatgcatgaagccctcaaacaatggatgtcggccggtatataattagaattcttacagccagaatgagacgggcagccgggcacacaatcttagggcttgataacccgtttcaaagcaatatacttttgcgaatgttgccatggccccactcatcgtctttttacggcagtattaccatacttggatgtgcaatatcaacatcagcggtgtcttaacaacctgggcataaggccttggccgaataccttcttaagccaaatcacgagcaagccttgagtgatccctacgactgcaaattcggtttctgaataaagggccaggttaggattcccaacaacaccggcttgtgaagtgcattgaataatcttacgcctgtattgttgtgtcctaatttctgaaggttgatgagcggctgagcacccagagaaagacatccaacgttaaagccttaacgagccggaattatccggt

SEQ ID NO: 27 - DNA, 2505 bp, Unknown
  Metagenome-assembled genome
tccggtgataaaacctaattcgggtcccaagctgatgccaccgataatgatgataaagctggcagcttgaacgcttggaatagcagcgagtggcacccgaccggcaaccgccaacgcaattaaaattccaatgaacattaatgttttggttctgattggctcacgttcaaagcgccaatatgctggcaggatgctacatagtaaacacataaaactaaatagcagataatgttttccccgtaatagaagtagcagcacgaaaaaggtcatcattaacagaacagcgattagcagccgatgaacataggttagatcaagaagttttttcaagcatgactcaccccctttcaagtcacttttaagcatttgttattttacgcctgtttcagggcttctaatctattctgattatctcatgtaaaccggtgcaatgcacatcgaatttctttcggtatctgataaaggttgtccgtttaatcccggtattacgggcaacatctacatcactcatgcccgtctggtaaagtttaaaagcatgtagtaaacggggatcatcttcggcatattgaggtttccgaccatgatatttaccctgctgtttagcgagggcaatcccttgttgctgccgttcaatgatccgcttacgttcgctttcagcttgatatttatacagttcaataatgagattcgtcatgagctggcgtaaattaggatccgcaatccctgtcatggacggcaagtttaacacatctagggtggcccccttattttgaatggtgttcataatcttagttaagtcctggttgtttcggcccaagcggtctaattcagtaaccaagacaatatcaccttcacggatataggccagcatcttttgcagttctggccgattagtgttagccccacttaatttatccgtaaataatttatcaacgcctcttaaagcagctaactgtcgatctaaatgttgctccttggaactcacgcgagcataaccaattttagccattgtcagcacttccttttggacagttctaatgaacatttataattcctagtatagcacaggaccaaaaatgaccattagggtatgccctaatggacattgaactaacttagcgaaaaagaaaaaattcaccttcctttagctgatctgtatttaatcttgaatctataacgttctgatctccatttgccattttcaatagatcttctttggatataaactttgaatgaaaagaagcttcttgataggcaatttcccaatctctcaaaatattataatcttctgaaaactctatgttcttttttacaccctcaaaatctggaaataatttggtgctgatggctccgttttcttttaaacatttttgtaaataatttcgatccctttgcggtagtttgtggaccattaaatctggtttgtaggaaacaaaaacacgacactcatttgaatgtcgtgtatacataataatattcataactatgtaaaaattcccgacaacataaaaacaacacacttccaatttatacttattatagaaacaaagcaaaaggaagtgaaactatgtcacaatggattctgatagccctttttcttctagcacacccactcatgatgctatttatgcacaagggtatgcacggtggctctggtagtatgggcggctgtggaaacaacactcaacaaaattccaataatactgaaaagccacgtaaaaaagtcaattaacttgggggtatatattatatgaaaatattaactggtagtcgcggtgatgaggtccatgaacacctttacgaaaatggtcaaagacgggttggtcatcgtatactaaagaaaaatacagtgacaaacaacggagaatttcaccctgtacctggaaatatagttctcattcccttaaaagggacggtgaaactgaccacaccagatcaagaatgtacaatcaaaaatggtcaacttgcaatacttggaccaactgatagtttttacttaactgcaattgatgatgttgaatttgtcggtgttgttgatattaaatagctcaaaaagagtgtcacatggcactcttttttatatatgctggcttctccatatttacgacacatatgactgttttaataaagtgtatttcaaaaaaatggaggagacaaagttgaaattaacgcagagaaatatgcctactttagttaccgcactaacattaacagatgttacactctccactggaaaaaaactgcttgaggcagcaacaacttggactacagttttttataaagttgatgcaactactgttaatcaagaggattttagcactaagattggtctaaatagcctacagtctgatggatctgtcgactcgatcggtaattactcttatactttgcctgcagttcgcgtcttttaactaggttgttcactgaagatgtttaaaaatctaaaacagcaaatacgcccttgggactacataatcatttttatactacttgtcgtttctttta

SEQ ID NO: 28 - DNA, 8379 bp, Unknown
  Metagenome-assembled genome
tggcacttgtcacatgaaattgtttagttttgaggggtttaccctcatcttgtactttgaaactaaatatatgaaatatttttttaaaacaacgagaacacgcgtttatttgagtttttaatgaattacattaatcgctaatactcaattaactgtgcgaacgagtggtcaaagcaaaggtaagttataaagggcgcatggtgaatgccttggtataggagccgatgaaggacgggactaacaccgatatgcttcggggagtggtaagtacctttgatccggagatttccgaatggggaaacccaatcatcttagtcgtagttcctattagtgaatacatagctaagtagggtagacgcagtgaactgaaacatctaagagctgcaggagaagaaagaaaaatcgattccctgagtagcggcgagcgaaacgggaagagcccaaaccaacgagcttgctgttggggttgtaggactgaacatttgagttaccaagtgagacgtagtcgaatagctgggaagcacaggcgcgggtgatacccgtaacgaaaccgtactctcagttcaggatcctgagacggggacacgtgaaaccgtcggaatccggaggaccatctcccaaggctaatactccctagtgaccgtagtgaaccagtaccgtgagggaaaggtgaaaagcaccccggaaggggagtgaaacagttcctgaaaccatgtgcctacaacagtggagccttaatggtgacggcgtgcctttgtagaatgaaccggcgagttacgatgcatgccaggttaaggtggaaaaaccggagcgtagcgaaagcgagtctgaaatgggcgtagaagtagttgttgtaacccgaaccaggtgacctacccagtccaggttgaaggtgcggtaaaacgcactggaggaccgaaccgttcagttgaaaatggtgggtgaggtgtgggtagcggtgaaattcaaacgaacttggagatagctggttctctccgaaatctttaggggagcctcggatagaatcatggaggtagagcatgtttggactagggcccgtcatgggttactgaattcagataaactccgaatgccattgattttactcgggagtcaacggtgagtgataagtccatggtaaaggggaacagcccagatcacagtaaggtccctaaatatatgctaagtggaaaaggtagtggattgcagacaactaggatgttggctcaaagcagccatcatttaaagagtgcgtaatagctcactagtcgagtgatctgccgcgaaaatgtaccggggctaagcatattaccgactggatgatcctaggatgcgtggtaggagagcgttcaagggcatgaagtcagaccgtaggacggtggagcgcttgaagtgagaatgccggtatgagtagcgaaagacaggtgagaacttgtccaccgaatgactaaggtttcctggggaaggctcgtcctcccagggtagtcgggacctaagtcgaggccgaaggcgtgacgatggaaacaggttgatattcctgtaccagttgaatgtgtttgaagatgagggacgcaagaggctaagcaaccgacgattggaagttggccaagcagcaagtcttgttgagtgaaatgcttatcagcgtgacaagtgtgatggggagcgaaattaagtagcgaagttgatgtcaccttccgagaaaagcttctaggaatatcaactgcccgtaccgcaaaacgacacaggtagtcgaggagagatcctaaggtgagcgaggaaatctcgttaaggaactcggcaaaatgaccccgtaacttcgggagaaggggtgctgatcgcagtgagccgcagtgtgaaaggcccaggcgactgtttatcaaaaacacaggtttctgcaaaatcgtaagatgaagtataggggctgacgcctgcccggtgctggaaggttaaagggaggttagcttcggcgaagctcgaattgaagccccagtaaacggcggccgtaactataacggtcctaaggtagcgaaattcctgtcgggtaagttccgacccgcacgaaaggcgtaacgatctgggcactgtctcaacgagagactcggtgaaattgatatcctgtgaagaagcagtacccgcgacaggacggaaagaccccatggagctttactgtagcttgatttgagtgttgtaccgcttgtacaggataggtaggagcctagagccggacgctagtttggcgaggcgtgtgggatactaccctgcattatgacactctaacccgcaccactatgtggtgggagacagtgtcaggtgggcagtttgactggggcggtcgcctccaaaagataacggaggcgcccaaaggtccctcagaatggttggaaatcattcgcagagtgtaaaggcacaagggagcttgactgcgagacagacaggtcgagcagggacgaaagtcgggcttagtgatccggtggtccgatggaagggccatcgctcaacggataaaagctaccctggggataacaggcttatctcccccaagagtccacatcgacggggaggtttggcacctcgatgtcggctatcgcatcctggggctgtagtggtcccaagggtgggggttcgcccattaaagcggtacgcgagctgggttcgaacgtcgtgagacagttcggtccctatccgtcgcggggcaggaaattgagaggactgtccttagtacgagaggaccgggatggacctaccgctggtgtaccagttgttcgccaggagctagctgggtagctagtatggatgagataaacgctgaaagcatctaaggtgaaactcgcctcagatgagatttcccatcttcctggagtaagacccctcagagatgatgaggtagataggatggaagtggaagtgcaggagcatggagcggaccaatactaatcggtcgaggacttaaccaagttagggtgaaggctgtagaaaaagatagatattttagttttgagaggcaagtctcaaccgtaaggtagtgtggtgatgatggctgaaggataacctgttcccatgccgaacacagaagtagcttcaacgcgccgaagtagttgggggatcgctccctgcgaggatagggacgtcgccagcacgataaccgttagtcggaagactagcggtttttttattgtgttccattaacgcgtaaatgacatggtagtttactgaagtagactgggttattacaaattcataaatttctctagtcttggggccactaacgatgaactgacgcgtattttaattcaaaataaagagcctacgtcccgcgtacatgggctagttattggtaagactctcatgctattctaaatcgattatgctaattctattgatatccaacgtgaggtgcagatcagcgcttggttgaacatactgatgatcgtatagagacccaattacgttaaaaatggctcttttagtgtagaaaccactccgaatgaggtttgaaaattcattaaacggtaaacccgatcgccgtacttatctggagtaatgtcactaatcaactgacaattcagttaaattcgatcacccagccaattttctttgtgtcacaagtggtgcaaggcacgatttggaccacacaagctggaataacggctaccgtgtacattgaaaatttatgaggcatggcgagttgcatgtacttaccaaacgcaccagtgacttgtggatacgtcaacgaatcccaaattaagccaaaacttcctgacagcatttggtcaacgtagctagcgtctattggtgaccggtgatatggatgttaggagcgacatgctgcatcgtccaacgtgcgtcaaagttcggggcctcgatgttggcaacggtatgggcgaagtctgagataatgttgaaatcggtttgaatatgatgactaactgattgagataaccggccttgccagggctccctgcaaataacagcgtattggttttagactgtggtgcgggaaccttttctgtatagaatccccaaggtccatgaacaataatgggtctcggcgtgaaaaggactttcttgcccagtgcgacgatgccattatcacacagtctaatgacaatggatcaggcttgatcgataatttgctatcacgagccccatattgttcatggacctggggatttatacagaaaggttcccgaccacagtctaaaaaccacacgctgttattgcagggagcctggcaaggcgcgggttatctaatcagttgagtcatcatatcaaaccgatttcaaacattatctcagacttgccatacttgccaacatcgaggccccccccaactttgacgcacgttggacgatgcacgatgttgctcctaacatccatatcacggtcaccaatacgacgctagctacgttgaccaaatgcttgtaaggaagttttggcttaatttgggattcgttgacgtatccacaagtcactggtgcgtttgggagtgtcatgcaaaccgatgcctcataaattttcatgtacacggtagccggtattccaagcacatgggtggtccaaatcgtgccttgcacccacttgtgacacaaaagaaattggctgggtgacgattgtggatttaactgaattggatcagtgattagtgacattactccagataagtacggcgtcgggttttaccgtttagagaattttcaaacctcattcggagtggtttcgacactaaaagagcccatttttaacgtaattggtgctctatacagatcatcagtatgttcaccaagcgtgatctgcacctcaccgttggatggctatacaatagaattagccataatcgaatttagatagcatggaagtctacaaaactagcccatgtacgcgggacgtaaggctttttgattttgaattaaaatacgcgcgtcagtttcacttgttagtggccccaagactagaaatttgatgaaatttggtaataacccagattacgtttccgtaaaactaccaatgtcaatttaacgagttaatggaacacatattaaaaaaaaccgctagtcttcaggactaacggttatcgtgcatgcgagcgtggcaacgtcctacccttgcagggggcgatcccccaactactctcggcgtgctgaagcttaacttctgtgttcggcatgggaacaggtgtatccttcaggctatcgccaccacactattgagaactggtgctctcaaaactagacaatatcattttcttttaccgatgaacaccactactcgtggttaagtcctcgaccgattagtactagtccgctccgtgcatcgctgcacttccacttctagcctatctacctgatcatctctcaggggtcttacttccatataggaatgggaaatctcatcttgaggcgagtttcacacttagatgctttcagcgtttatctcatccacacatagctactcagcaatgcgcctggcggcacaactgatacaccagcggtgtgtccattccggtcctctcgtactaggaacagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcctacctgacactgtctcccaccacgatgagtggtgcgggttagagtggtcatacagcgagggtagtatcccactaatgcctccgccgaaactagcgtcccggcctctacggctcctacctattctgtacaagcggtacaaacactcaatatcaagctacagtaaagctccatggggtctttccgtcctgtcgcgggtaacctgcttcttcacaggtatatcaatttcaccgagtctctcgttgagacagtgcccagatcgttacgcctttcgtgcgggtcggaacttacccgacaaggaatttcgctaccttaggaccgttatagttacggccgccgtttactggggcttcatttctgggcttcgccgaagctaactcatccacttaaccttccagcaccgggcaggcgtcagcccctatacgtcatcttacgattttgcagaaacctgtgtttttgataaacagtcgcctgggccttttcactgcggctggccatgtggccagcaccccttctcccgaagttacggggtcattttgccgagttccttaacgagagttcactcgctcacctgaggattctctcctcgactacctgtgtcggtttgcggtacgggtagttgatgactcactagaagcttttctcggcagtgtgacgtgggttgcttccctacttaaatttcggtcctcatcaccacttgtcaacccgccaaaaagcatttgactctttgactgactcgtggcttgaacatgcctttccaactgcatgcacaacttagcctcctgcgtccctccatcgctcaaacatcatcaactagtacaggaatctcaacctgttatccatcgcctacgccttgcggcctcggcttaggtcccgactaaccctgggaggacgagccttccccaggaaaccttagtcattcggtggatcagattctcactgatctttcgctactcataccggcattctcacttctaagcgctccaccagtccttacggtctggcttcattgcccttagaacgctctcctatcacttgaccaaaggtcaagtccgcagtctcggtaatatgcttagccccggtaaattttcggcgcggaatcactcgactagtgagctattacgcactctttaaatgatggctgcttctgagccaacatcctagttgtctatgcaactccacatccttttccacttagcatatatttagggaccttaactggcggtctgggctgttcccctttcgacgatggatcttatcactcaccgtctgactcccggataaaaatcaatggtattcggagtttatctgaacttagtaacccatgacgggcccctcatccaaacagtggctctacctccatgattctacgtccgaggctagccctaaagctatttcggagagaaccagctatctccaagttcgtttggaatttcaccgctacccacacctcatcccagcacttttcaacgtacacgggttcggccctccagtgcgttttaccgcaccttcagcctggacatgggtagatcacttggtttcgggtctacagcaacatacttcaacgcccatttcagactcgctttcgctacggctccggcttttaaaccttaaccttgcatgcaaccgtaactcgccggttcattctacaagaggcacgctatcacccattaacgggctctaactgcttgtaggcacatggtttcaggaactatttcactccccttccggggtgcttttcacctttccctcacggtactggttcactatcggtcactagggagtatttagccttgggagatggtcctcccggattccgaccaggtttcacgtgtctggccgtactcaggatcctgaactgagggtaacaaatttcgtctacggggctatcacccgctctggccggtcttcccaaaccgttcgactatctgttactttggtaactcaaatgttcagtcctacaaccccaggaagcaagcttcctggtttgggctgttcccacttcgctcgccgctactatgggaatcgcaattgctttctcttcctgtgggtacttagatgtttcagttccccacgtctgccaatacttagctatgtattcactaagcattaatcatcgactaagatgattgggtttccccattcggaaatctccggatcaaagcttacgtacagctccccgaagcatatcggtgttagtcccgtccttcatcggctcctagtgccaaggcattcaccatgcgccctttttaacttaacctcatcacttacgtgacggattaattgagtattacgcgaagtaaataaactttactaataaaaaactcaaaatacgcggtgttctcggcttaattaatgaaattaattaatataaaagaaaattgatattatctagttttcaaagaaccaattcaagctgagggtagacccctcaaaactgaacgcagttttc

SEQ ID NO: 29 - DNA, 15752 bp, Unknown
  Metagenome-assembled genome
ttacaattacactcgttggttaggttcactttttggtttttgaaaagtaaacctaaatgacgagttcaccaaccgaaacaacgtgcagggcggtaggcaggttctaatcaaaatcaaaacttaatttatggccgtcaagctttaacttggcgtcaaacaactttccctttttgctcttgaaaccctttaatttgctcgtttcccccttggtgaccaacgctttaattgcggtcttcccgagcgtcttgctgctccatttcttgggtaaggtaaagtcttcgccttgcttgggtttcacaatgtaaaacttttgtttatttatgacagttacttgtggtgtttctaagaacacctcggcaactttttgcgcttgctgttggtgatcgatttgttgcttaatggctgcactgccagtcaattgcgtgggaacatcagcaatcaatttttccacgaactttttgatttggctcaaaaagttatccggggtgcgttcttcggtactgatttgttgtaacgcttgctcccattttgctgtcatctctgggctagttaacaagggttcgagttcaaccgctttacataaagtaatccccgcttcactgacgtggagcttgttcttttcagtaactaaatagccgcgcttctttaacacttccagcacattggcccgggttgcactcgttccaatgccttgcacgtctttgagaatcgcctgggctgcttcatcatcaagcgttttaccggccgtcttcatggccgtaatcagggtaccttcggtaaatggtaccggcggggtcgtttctttttgcggcgtttgcagatttgcttggacttgatcgccttggtgaacgagcggtaaagttgctgcttcttgctggtcggctttgtgatcatcaaataaagcttgccaaccttgcttagttgggaccttaccggttgctttaaaattggcgtcaccaacttgggtaataatggtggtttcctcgtactcgtacggatcagcaaacatcgctaacgtcgttcttaaaaccaagtcatagacttgttgctgtaatttaggtaagctggctagtttctctttagtcggcacgactttagtcatgataatggcgtaatgttcttcaacctttttcccattaacatagcgcttatttggggtggtattggttaaagcgacttgtttagagactaaccccagatacttcgtcagattagccactaaatactcaaattcttcatcagtgatataagcacaatcggtgcggggatagctaaggaacttagcttcgtataaactctgaatggcggctaaggtttggctggcactggcatgataccgtttattcatggcactttgcagactagaaagtgagaacagttgcggactagctcgttttttgccttgcttttggacgtccttgattaaaccgtcctgcgatcctttatgaacgtgtttagctcgcatgaatgtcattagccctgcttcgtctttaaatcgctgataggggtctaattttgcgacaaatttttgctgattagctaaaatttccgcatttagctcaaaataaggttccggcttaaagtttttgattgcctggtccctttgatagaccatatacaaggttggcgtctgcacgcgaccaattgagtataccccgcgtaccccattttgtcttaataacaaagtatataagggactaccattcataccgatcaaccaatcactaatttgacgggtttgggcttctttataagccaaatagtctttgtgccaatcaccaagatttttaaagccggtaataatggcgtctttttccaaactattcagccatagccgcttaatggtcttctttttaacgtcaatctgggcttggatcatgattgaccacgcaatattagagccttcccgaccgctatcggtggcaacaataatggtatcggccttctttaacaggtctttgacgaccttgaattgatcttttttactagctgacaccacaaacttgtatttatcggggaaaatcggtaaattagataaggcccattgctgatatttctgatcatatttatccggtgtggctagttcaactagatgtccgagaccatacgtgacaagcgtatttgcgggcaaaacagggtcactaaccgtatagtaaccctgtttttttgtgctcttttggaaggcttggacgtatgaacgggcttgactgggtttttcagctaagataacagtggtcatgttcgttcactccttatgattcagcttttgttctaattctgttttgccttgttcagccgactttaaccattcttgccggcgtaatgcttgttgttgctctatcgattgttgcttcaaataatgttgataccggttgatggctttgagatctgcataggctgaccaacggaataataagccacccagcagtaaaactaaggccattagcgcagttcctaaaaaatcggtatggttcgccgtgaaaagctcttggtataaatccattaacatgaggtaaattcccattaaatagaagagcatactaactaagttatcaaaatagtaagacagcttagtccgccgtgaaggtgttgtaaaagggtcggttcgcatatcttttttggctttttctaataaccagtgtgcgattttcttcataactatatatcctcctagtggttacggaaataattttgaaacattctcatggcgcccataccagtactcttagttacaccagttgaagcccagaagtctttaacggcatcaggcgttttaacaaccagaaagccaaaaccaattgaagcaataaaggcaataaacccgtatttagccatattagtgaaacaccatacagatagtgacatacaaagcacctggctaataatagaagcattgtaataaatgtacttcttccaccacgtgccgctgtaatcaaaactttcagtcgccatgctcattgcagctaaaggaatcgtcaggttgtaccaagccatatcagccacaaacacacacattttgataaagaacacgacggttacgacagtgaagactagcagaaacaaaatctgtaagggtagcgaaatgccaacatcttttagcccagggactttattcatgccggtaattgatttagcagtgaatttctgatcagaactaaacatatactttagcaggggcaaggtaattgagccttgaataaagccttgtaagaacacgaaaaccggaatcacggccgctgatttaatcccgtccatgatgatattagcccaagtaacatcggtactttcatctgcctcttttataattgtcatcacaatacgcccaaggacaaccacaacgactaacgatgtcgcaaaggacaggaagatggcataccacgttttaacaatgggcaagctttgattggcttggtcaatgattgccttacagatgttgaataaaccatctaacaaaccagacagtagccattcgagaaacttagcaatcgctccccgaaccattcctgaaatatcacctaaaacaaacatatctatcacttccttttttgcaattcaaagcttcctaatccgtcatctgctttggcagatttatttattgctttagctttataaccatcgctaatttgagttaattcaaatttttgattcttctcatcatcagtatttacttttaaatattctttaccagaagtattactgactgaataattggcatttacattcatcaaggggctttcaataatcattgtttttttattaaattgggttttgtagctttgtcctttttggttgagataccatttattactttgcaaatcttgtgctgtagactttccgcaggcggttagaccgacagcaatcagcaacactgtcatcacagcaattatatatttccgatattttttcattaatatgtcctccattagccaaataagttgttatcgtcgtcctcttctggctcctctgtttgactatctttatttgaaaccctctctaagtcgctgtctaggttgtcctgctgttgctcctcctctgtttgagacatcttgtttgcggctcttttttgagcagtctcctttaattttgctttccatttctctactctttgatgaaagttggtttcctggctggcttctggttggccttgatactcattctgtgacaagttaaccaaatgatcagcccctggaaatagtttaaattggaacgcttttgtagctttgactggtcgcgcattgctaaagattaataagctctgatcttcgggcatacgcatgatttcatcaggtgtcatcagcgaacggctcgtatagctgtaactatcgctcttgctgtggctttcttccttgctatgactggtactctcactacccgtttccactttcacggttgattttcctaacagatcactaaagtatttagcggtcacatcattagcggcattcaagcaaattttaacggcatgattacctaagatactctcggctttatccttgccatacaaggcttgtagctgggttaaggtttgacaaatggtggtgacaccaatgccgtaccctcgacatgttgctaaaaattcttcatactttggaaatttacctaaattgacaaattcatcaaggataaagtcgacttgatggggcaatctagcgtgatgatcggcggctaatttgtataattcatcaaacaattgtgagaaaaatagattgatgaagctttcataggtattatccatcaccggaataatcacatatagcacaactttggctttgccaatctcttttaaatcaaaatccgaaaaactggtaaaatcggccacttctttgtcgacaaacttcgaaatggtcgccagcaaactttcaataatgctggctttcatttcccctttggcttttttgaaacctaactcataagcgcgtctcgctggatcagtcatggttaaatcaagaaacaaggcgtctagcggactatctgcgcccttttcctcagcttcaacgtcgttttcttgtaaaacttgggtcacgcccgccaaatttcgttgttctggtgaccggtggttcatgacaaacaggattagtgccttcaaaagttgacgttgggtactgaaccacacatcttttttaccttcggcattttcactctgaacgatcttggtggcgacagtttcagcttgaatatctcgttgaatataatcaaagggattgtagcgatcactatgcgccatgttggcaaagttgacgacatgtacttgataaccctgggctagtttgataccggccgtcttttcgtataattcacctttcggatcggtcacgacaatgctgttctccgtttcgttaaacaggttggtaatgacgactgattgggtcttatatgatccaggtcccccaaccacaaagatattccggttgggtttggtgctgttattctggtaaacaatctgtttatccacgatccccaaaattgtcccattcatgttaatctgcccccttcgctgacttttctcgatccaataatgatttgagaatttcggccttggtactcttgttaaatgctgtggtgaggtctttggcattgatactaaagtaatggtcactcaattcttttaaattcccccaggtcgcactcccgtgggtttcagtgtccgcagtttcccaagctttgtgcttgctgttccgtttcaaagcaaaataaatggtgtataggaccacagcgatactgacgataattaataccgggttcttttgacccaaatacaagttgtaatagtgccaggggtgtaagactaactgctttaacaccgttggcatatgatccgcaaaagttagcttatagtgcgacaaggccatgactgctccggctaaaatctccgctaaatacaagccaatgattagcgttagtagatatggccaactagctttaatcacagctatgcttctatctttcatttctaatcacctacgattcgtttaatttgcgactgcttggtaccaacataccgttgattgccactaatcaaggttggcaccgccgttagctgatatttttgaatgtaatgccgattcttcggttgattcatattaatcaaaatgatgttgtgactgatgacgttatgccaataaatctggtggaaaatagcttggcaatccgggcaatcatcacggtaaaagaacagaactttatcagaatgcttagccagcgtcacaactgttttctctttctcaacatggttcacatagctatgacctgcaaagcctaatactgcaagtatcaccacgatcaccgctagggctttgcttacttttttaatcaaggtcactcgctttaaaactgttcccaagattctgtacatcagtgattcgatccgtggtggtatcgaaagtcacttgataaagtaccgtcgccttttgccagtcgttgtcgccactcttactttcgtaactgacaacggccaagcctttcatattttgcccctgcttactttgcgtatacaggttcagttgatttaacttagctgaaacactattgctatcaccatacgtgcccttatttgaaaagtattgctgatatagcttgtcggcaatcaaatctttcacgccatctttacgctgtccgtaggtcttgggcttaaagttgttcatgaccttaaagaacttggtgactaccgtattaaagctaagttcagcctgacttttgtctttattattttggtaggtcttataactgtcaatttgggtgctcaataactgcttttgttggttggttttagtcaattgctgactaacttggcgcttctgctgttgtaagcgactgatctgttgttgcgcctgcttaacttggctatgttgataggaattcgttcctaatgacataattaagatcaaactaccaagtgcaatacttaaaaccacgctacgcttcatttgttggttcctccttacttcttgattggccgggctaacgtcacatcgctaccgttcaataagctataaaacgcggtgccaaatgtgctttcgttaaccttgtcgccgacaccaccttgctcaatgattttggtggcttttccttgccacttgtctaacaagattgcggtgtgcccattgttcccggccccggcaccttgattaacaatcacaatatcgccggctttggcgtcattttcactgatctgtttcagatattgatgactgcctttggcgtcacttgccatcgtaccggtaaaccagcccatattagccggtaccttgtaaccagctttattaagcgctaaccagacaaagcccgaacaatcagttccgccagttttgctgggattctttaaatcgctacctaaatcggggctggggtgggtttgcacatagtagaagtcacctttcatactttccgcatttttgacgatactcccaccggaatagcccgggtcactatcacaacctagctcggtcagatcgcctgaactcgcattgtctaaggtattaccggccactgggtcactcgccccgaacacggaataccagtgatcggcatacccgtatctttggcttaaataccattgttccgggttcttactcataccctcgtaatccattaaccaggctttcgtcgctttgtgcacgtccgtatacttaaaaatctgcttgtttgacgcatagtaactactgttcaattcctggtcgagataatccaactgtaccccgagattggtcgctgatttgttttctttgtgggctaagtcttccaacttatccttccgaccacctaaccattgggctaaaccagtagctcccgaacttgaattaaccgaattgggatcaaggcgactttctagttgtaagacccccaagattccggcggccgcttgtggggtggcgccatacttctgtttccagtgcgcatagatatttttggcattttctgtcatgctcttactatccaattgcgtctctgtggtggttgagttatcacaactgttttcttgtagctgaccagtaatcgcggcaatcagcaagacgattagcagaatggcaccgcccacaatataagcaatcaacttccacttctttttcttatattcaaacgacaatacctgcatttaatcacccactttgcgcttggcctgatcaacttgtttttgcgctgctgattggtcactctgcgcattctttaagtccgacttggctgaatccaccttcttgtctttatccttatctttactgccatcaatcttgttggcgtcatctaacttcttttgcgcgtcgctaacttcgttcttagcggaattgagacttaataacgctttgagatacttggctttagggctgttcacgccggctaatttggtttggacagtctgggcgtcttgcgtatcgttatgggctaggaaggcttgtcccattctcaataaaacatcagcgttcgtcgtaaaggataattggttgttgagcgtattggtgtcgtagttaacgatggctttttccagcgccaattggtctttttgcttgcttgtcgccttagttggcaattcccacttggcaacctgcccgctatccttgttggcataagccgtgttaacaaccttattcaactggcttggatcaacctttaaagcttgctggtactgaccatgctttaaaaagacattgacttgcttagttgcagggtagccggcccgttgcatatctttttgcgcttctgaccacttatgatcatttaaagcagtttgaatttggccgctatattttaatcgtgtgacctgggcttggttctggttagctaagctttgatactttcgttcgtcacttttatggactaaaccgacagccaaaacggccacaatcgccagtccggccacgctcaaccacaaacgttgtttggttttctgttgggccgtttcaacttcctgccattcgtgataactcacaaagtcctcaatgctgttaaccacttccgttaactcatttaacgacgtagctttagctacttgttgtaaatagtcgtccgggtgtttagctagggcttctttaggattgcttagtagccgttcatagggcgtccccgtcaagcaaaatagaatcagcgctttgtatttggctaaattgctatgtttgtcatcataaggcatgagttcattggcgcgataggcgtaccaaacatgttgcatggggtaataccacagattagctggatttaacgcaacgtgatactggctatcagcaaccaccttttgcgccatgatttctttcgcaatggccgcccggattgccttattctcatgtggtaattcctttaatgatctgaccttatctggcaaggtataagttaaaacgaccttttggtcttgctcaaccacgttaaccaactgcaagaaattggcatcagcttgctttaattcgtttagctcactcaactggtcatatcgaaactgattgtgattgagttcgaggattaacttgtttccttgccgcctgaacgtcccaacctcgatattcaataactgatttgatttactcatttaaagcccctccttcctcctcggtggtggtcaaagcgtcaatttcacttggcgtcaacaccacgcgcttttgataatccggttggttggcggtctcacggttatatttttcctggtaagcttcgggatcaattaaccgcaattcttcttcggtcaactcgactttcataaaggcacgttggctgccatagatcatcagggcttcgccttgtctacgacgttctagtagtttcttttctttatctgagaacgtcatacgcaacttagtaatgacgtcatcaacgcctttgccatcaaggccaaagaacactttggtataggagttcccaataatggcttcacctatattttgaccggtatcagttgttccttcgatcacatcttgaatttgctgcgtcccagcaatcgccccggcattgtactttctaaaccgcttgtatgcttggtggaaaaaggtggcggccgctttatgcaaagtcaaaaagtgaaattcatcaacaaacaatttcttgcggctatgccgatctttggttatttcgtcccacaaatactggaaggtattcagataagccgctgattggacttcctgttcactttgtaggggctttaaatcaaaggaaatgatcttcccctttaggttaacgttggtgtggccgtcaaataggctgttagagccatgggtataactgcctaaaatatagtagaaatctttaacccgattaaatttgtcggcgtctttatcagctagtttttccaactcgtcataaacattggatagggtcggccactgatcgtctttaatttctttcaagcggctgtatttcaaaacgccactgttgacgtaagcttgtttaacgacatcatcaaggattgccagttcaacttgggtaatcccggttttaaggacttcaaagaacccctttaatcgctggattttatctttgactagtaaatcaaggttcgtgaccgcttcatcagcgctgaggatttcttcggaaaagatttggagcggattaattttgtacttagcattcgaggttaggtgcaagactgcgccacctaaggcttcaacaatcttggtatattcattttctgggtcaataatgtagagttgatagtcttgaatggcgtagcgtagaattttctgaatcatataggtggtcttgccgacccccgaggtcccaataatcacttgattttgattaagcgtcttgttgcgatccaacatatctacggcaattaagctgttggtatctttgttaaccccttcaatatcagatctcggcttcaagtccaaaatttccgcgtcatcaaagggaaacatgctgctggcgacttcggtattactctctttataggtgtaatctcccatgaggttctcgttaattggcatggttgaccaaaatgcttggaaagtcgctttaacgggcactaagggcttcatctgtagcttaatcaaggtgttcttgacgttttcggtcaaatcgtctagttctgctaaactgttggctcgcagataaatgagcatatgttggtacacaaatgtggtagaattatcaaggtatttatctagttgcatgttggctgaatcaatataattttgcagaatcttctttttatacgggtcgaacgtatttaacttctgcgcttccttattttgaatcgtcttcttgtaataggtaatcattgaattgttactggcgctgtcgatatattgcacaatatcgataacgccttttttgcgctttaactccgataaccagttgccatacacccgcttaggatagtcggcaatcgctaacacccgaataaaattctcgcccgactggacgtaggtggggtactgttcccagctaaatggaaatagtgaatgcaagctatcgcgatcaatcagcctggtaaaatcctcaacctccggtttgggcttactactcgtttggtcgctgttgccttggttatgttcttttttagttggcataaataaatcaatgaccttatcaccaaaactcatcctgtttccccctatccattaaaattgatcaggttctttaaaatctcttggacttcttgactagtcaaaactttggccgtcacatcaaagtccgttaacgcattttcaatatcccgtttaacctgttcgatcttttcgtctaaatgagtgaccgctaggtttaagctcttaacacttttgtctttaattggcaccttaacgattagcagatgttgcttagttgtcatatttttggattcttggactttagtaaagtgatccaagtaactggctatgagctggattttgaactgttgctccgggtgatctttttgtaacgcaagataccgacgcttgagaccattgagataggccgtcatattgacgggaatcgtcggttctaagaactgtaacgtgtcatcaacgccttcacccaaggtactcatcagaaacgcgccatagtcctcaaaaacgtcctgttgttcggtttcattaagcagatcaaggttgatcccactaacttccaaaatgccaacgagattacccgttttggtaacttcgtagttaccatacatacccaccaccaagctcatgtcatcaatggtctctttgccaccattgattttaggcggttggtaatcccaatcgagcttcactgatttattggcggttttgctcttcttcaaacgcatttagttcacctcgcttcttcggttttaaataaaacagtttctgaccattggcatagcggcgtttcaacttaaagttatcccgcactttaatattcttccgcgccgcaactggcctaattgttaaaatagccatgacaatcgtcatggctaagacaacaatcactatttttatcaggactaagatcagaccatagggtgggattgcaataaaaatcaagcccactagtcctgccagtgccgcatagccaaaatccttcaaggtgtaatctttccagatcccgtaatctttatcaacgttttctgggaagataaattcttttcctttcttcatttggcaggctcctttttaaattaagtgaataggctgtaaacccaaggtaatagccagataatcgctgccgctaaggccactaaaccagccacccgaccaaccgcgtgataaacttctgatttctctcgcggatcgtctgcgtcaggcattcttttgataataataaatagtgcgacacaaatcccgactaaaacgaccaacccggttaaaataccttgaatcgtcttcccagcgctggttagcttacttttaacttcgccaccgtctgcggcaaagacgacctgagcgttcatcaatcccaagtaaattgtggtggctccagtagttgctaacgcttttactttgttgaacttcatgttattcctcctttccgtcttcctgtgaccgtaattgaaccgattctgcctgcgtttcttctggctcacgctgatagaatttatccaattgttcctcggcaatttgctggcttggtaatgggtcagtagctaaattaacgcggccattttcactcgtggctaagtaatactccttttctgactgacttagctcttgggtctctaagacatgcacattatgttcataacggcctaaggcgttatcaacttctaagccatagaagcctaagaaaccttctaagaagctctcaccaaaaaaggtcatttcgtttttgatctgcttatattgatgggtcggtttatcacttaccaacttttcggtctttttagcattttgactgtcttgatggcgattaaaccagcccctaagttttaatggcggagtttttagctgacgtttaaccgtcttcttaatcattgctcggcgaacttcatcgattggctgaccatcttgatctaaaattgcttgtagctgtttttgatcggttaatttttgatcatcatcgactacaatcgccttttgatcatcatgaactaacttgccattaatgccttgccagctttctgctttcattggatcacctcctcaaaaaaagcgcgttagggacgctaaacaactagctttcccctaacccgcccggtaaaatggattgttaggagggtgacacctagaatcgtaacttccaggtgctgatccccgttagcaacttcactgcttacgaggacgccctctttttttatgtggtttttaatccattcaatgccatcttcagatattaatttaactttgcccgtttccatgagcatttcacttggcaactcgttagggtgccgtcttaaccaaacactcacgtacgtactacctcgttcaagcttgagactagcttgagctaagctaaaccattcctgtttctttgtcacatgtgaatactcctttccctatattatgggttcattgtaccattaaatgagcacgttggtgcacttttaattttacatttagattacaagtgcatgcccccatcttcatgccggtttcgagtttggtgttgccgttgctttttcgtcatttcccactcggtctcctttagtccacgtagttgctgttttcttagatagtctgtatttttcgcatataaagtggtcattaaggcttcgtccaaaatattcatcaggtaatttttcgggctagttgggtggtaattaatggcctgatagtccttaacttgagctcgcttatattgatcaaagcgcattgtctgttgtttcaaacgggtttgcaccatttcaatttgttggtgatccaacttaggatcttggccacattcgccaataaacagttgccgggtgccatcatgttttaagacccgttgcagtcgatgatcctgaatatcttttaattccattttacctaacaggtaatttaaaccggcttgatgttgctgactagtaaagactaccggtggctgctgttgcaattgactaagatcatcggcgcttaatggctttaattctgggtcatagtaaaccacagcggtatagatttgctccttgtcaatcgtctctagcttatcgaggtcactgtccggaaaagcagtcgttagaatgctgtcgtattgggtttgcaccacggctttaacttcccgcatgacccgtaaatctttcaccgctttagaaatgaattcgagttcgcttggttgataagcggctagtatgccccgatcagtaggcttcaaatcgtctaactggtgaccatgtttggctagtaccgtggttaattgcttcttaattgtttggacctgctgattaactaactgccagctggtatatggccgcttggtaaacgtcaataattgctgggttaataagtcgtttcgaatatccgctaaccgttctgccaattcgctacccttaaaaatcgtttgttcactattagtttctttaatcagttcccgtcgttcagctgcggttgtctgttcaaaattaagttccggataaagctttttcgttgctcgttccaccactttatttaacaactggttagcttgtgctagtgatgtcgtttgctggtcaatagtcagcagttgcttggttacatcttcaccaatggcatgtttgattaataagctgtttttccaattaaacagcatgcgctgtttatcatctaaatgttctaaatcgacataggttttcaattgctgacttagatgactaattgtgtgtttttcagagaacgatagctcgtcagttaacgcgtcaaaatgttcatgatttcttatcttttcgtcaagattatgatatttagcttgagcgtttctttgcgcgctaacttgttgattaaatgcttttcgattttttctttggctgttaatgccttcgtgttgggtaggtgtctcttgaatcccttgatcgacaaacgatttttcactaatccgatccggaatatttttttgtgctaaagactgattaacacttgttgcccaattatgccgccactcattaattttttcctttttatcccaatcaaccaaccaaattttcctttgttttggaaacccgcttttggttaaaagttgcttgccattttcatctttaatgtactgcgtctttgcttttaatccccaactaccatcggggttaaatgggcgattggttaacatcacatgtgcatgcggattgtctgggtgatcgcgatgaattgctacgtcagctaccataccttgatcgacaaaattttcttgcacatattttgtcagtaattctttctgttcggattcacttaattctaccggtaaagccacgttaaattcttttgcataccgtgagtttgatt

SEQ ID NO: 30 - DNA, 22479 bp, Unknown
  Metagenome-assembled genome
aattttctaaagctggtcgaattaattcaaattgttgccgagtaatattgctgggataatttttcatagcttaaactcgctttttacatagaagtatatcaaaaatcatagatcttggacagcttctgagaaccgtaaccgagttttacgacgctttattcccaaaggccaagccattgaagagttaagcgatcacaagctgattcaaattaattggtatttgaattcacggccacttaaatgtcttaattggcatacaccaatcgagatcttcctgcttaatttacgtcattaaattcgttcaagttatttcttgcaatctgccatttatttaaataaagtctggttattctgttacatgagtgctaaaatatttttgttcaaaaaataggagatagtaaaatatatgaacagacaattattagaagtatttcagctcaaactgaataatcctcagttaactcagcgtaatttagcccaaaaaatggggtggtcattaggaaaaacaaataaactattagaaaagctgaaagaattatcgttatttaattctgacttttcgttaacagaaaaaggaaaagattatataataaatcaccacccacaaaaagcagtaattttagctgccggttatgggatgcggatggtaccaattaacacggaagaacccaaagggcttttagaagttaatggtgagccattgattgagcgtcttattaatcaacttcatgaaataggtgttcatgaaattcatgttgttgttggatttatgaaagagcattatgaatatttgattgaccaatatgatgtaaaactgattgtaaatccgcattatgttgattataagaatttgtattcgctttatttagctaaacagtgtctggaaaagagttatattattccttgtgatatttggttcaagaacaatccgttttcttcaatagaagatcagtcgtggtatcttttcagtgatcagaaagttaataattcaaattggcaagttactaagcagggggttgtaaggaggactacccgttcaaatcttggaaatcggatggttggaattgcctatttgaataaaccggacgctgattatttgtctcgcttactggaaactgctgttaataatgatatgatgcttggccatttttgggagcagcttttaaatcaggataataagtttattttgaatggcaagcttataaacgatagccgatttagcgaaattaattcgtatgaacagttgcgagacctagactttaactctagtcacttacaaaataatgcgatgaaagtaatagagcagacccttaaaacagatttgcgtggtattcaaaagattcgcgttctaaaaaagggaatgactaatcgttcgttcctttttgtacatgatggccagcgttatatcatgcgaattcctggagaggggactggtgagctgattaatcgacaagaagagtctgatgtatatcagaagttaaaagggatcagctggactgaacgagttttgtatttgaatccatataatggctacaagctatcagctttcatcaataatgctcgtaattcggatgcaaccaattggcatgaagtaaataggtgcatgacacttttacgtaagcttcataatagctccttaaaggtaaaacatacttttaagctatatgatcaaatcaatttttatgaaaagctacgtaaaagtaaatctgcataccgtgattactcagctgttaaagcgcaagttaatcgactaaaaccttttattaaaaagtatgctaagcagaggacactttgccatattgatgcgaacccagataactttgtctttgaccaaaacgatcatctctacctaattgattgggaatatgctggtatgcaggatcccgatgtagatgtagcgatgtttgctatctatgctatgtacgacaagcagcaaattgataagctaattgatatttattatcaacaaacatgcgatcaggtgactagatataaaatttatgcttatattgcagtgtgtggccttttatggagtaactggtgtgaatataaacaatcgttaggattggattttggtgaatactcgcttgctcaatacagatatgcaaagaattatagtagtttagtattaaatagcttggaggaaagaaatgtctaaaattgacaatgcaataattatggcggcgggctttggaactcgaatgcgcccgttgacctatgaaacgcctaagccactaattccagtgcatggtcaaccgatgatcgagtctgtgattgctggattgcatcaaaacaatatagaggatatcactgtagtcgttgggtacttaggtgaacagtttaactacttgccgacgaagtatccaggcattaagttaattagtaatccttattatgatcgctacaataatatttcatcgttatatgttgcacggaatgaattaaagaatacggttattttagatggcgatcaattaattatgaatccccaaatattaaggcgtgaatttaaaaattcagggtatgcaggaacaaagataaatggttggtctgatgaatggatcatgcatattgacgagcaaaataagatagtctcatgtgatcgtgacgggaatgaccatggttggcgattatatagtctttctaagtggaccgctgaggatagcaaaaagctcaaagtatacttaacccaagactttgagaataatgagcgtcacgatatttattgggatgatattgcgatgtttgagcattttgatgatttctctttagagatgatgcctatcaatgcagatgacattgttgaaattgatagtattgatcaattgaagaaagttaacagtctaaaataaaggattatgtgaattgagaaagaaatttaaaaagatcgattggttattggttacaattccagttattggagtctttaccgttagcttgatatttactacttttcccacacggtcacaccattatttatcgatggtgcgaagtttcttgaatcagcggttttcctttttctatattcttgttgctattttcttcctgtgtagtagcctctatgcagccttttcacaatatggggagattaagttaggtgatccaagtgataagcctcagtactcaaacttgcattggggaatcttagtctttacttcgacgatgtctgctgatattatcttctattcactctgcgaatggatgatgtatgcgcaagaaccgtttattaaagacaagcccaatgtacttgaatggtcattaacctattcattatttcactggggaccgattgtttggtcattttatattatgctagctgttgcttttgcgtatatgctatttgttgccaaaaataaacgacagaaattttcggaagcttgccgtccactacttggcgaatatatcgatgggatagtgggaaaggtgattgatttaattgccatttttgcattgattgctgctactgcgacaactttttcgatgtcgatgccattgttagcagcagcggtgggtaagatatttggaattaaaaatataagattactttcattgattttaattatgatcgtggtacttatttatctttcattttcagttatgggaatgaaagcaatgacatggttgagttcactttgctatacattctttattggattaatggcctatatattattatttagtggctcgctgaattttgttcttgattcgggaattcaagcaactgggaacctgctccaaaactttgtggggatggcaacgaccactacgagtgatggctttacacaaaactggacgatttattactggtcgtattggatcgtatggtgtgtagctacgcctttttttattggtggtattagccgtggacgaaccattagggatgtcgtattacgaggatatgtatggggattaggaggaacatacctttcttttattgtcttaagtaattttggcatttctagacaaatcaatcatcttgtgaatgctataggtagtcttcaaaatggagcaacatactcacaaataattttgcgaatgttagaaacgttgcctcagtataggattgctcttgtattacttgccttagcaatggtaggactttactctactgtatttgactcaattacgatggtcatttctaagtattcttatcaaaggttaaatgtcgatgaaagtcctagtaaattaatgcgtggtacgtgggctgtaatattcatgatattacccttatctttattaattagtaatagttctatgtataatattcaatcagtcgcaataattgcagctttaccaactgcaattgtaatgattctgattgtggttagtttctacaagcaagttaataaaaatagacgtagttaataatagtgctcttgcaaaactaattattgtggcagattgtaaaattaatccgaacgctgttcggacaaaaaagatcagctcctaaaagatgggtttgtggtaaacaccattttaaaggaagctggtcttttttgtccaaacactggtcagacaatttttgggcctatgatatttggtgttgatagataaaattcatcaacactattcttatacttaaacaccaaatatcatagaaccataattaacagagcaaatcaggtcacaacttaacagttgtggcctcttttttgatactgtataattaaagggttagaaccgtgtcattacttaatgacataagtaaggagataaaaagatgaaatatggctatgcgcgggtcagtaccactgatcaaaaattagcaaatcaaattgagttactaaaattggcaggagcagaaaaaatctttcaggaaaagtttaccggcacaactactgaacgaccggagtttcaaaaactgttgcgcgctctaaaaacaggtgatactttgattgtcactaagctggatcggtttgcgcggaacacgcgcgaggccttagccattatccaagagttgtttaaagaaaatgtcaaagtcaacattttgaatatgggcttaattgacaatacgccgactggccaattagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgatgaacaaatcagatttgcttatgagctgcgaaaacaaggcatgacctacaagatgattgaacgaaagacggggattagtaaacgcacgcagcagcgacggtttaagttaattgagaaaccaagtgatacttctaaaatctaagacaggtgaaagatcatgaaaaaggatattttaaattatttcctattttgactgatttttaataatcgtgtgatgtccctaatagtttgatttttactgtgtatggtaaagtgtttatatactataattgaaaaagtgttctggacgattaatattcttatttggtcacaagatagctgtcgtttttgcttgaatctaaaacaattcatcagggatagtcgaattagcttacgatcacaatattgttttttttaatccgataacattgttaggaatcaataaaagcatcatcatcacttagaaaatgttaactgcccttggaactttgacagcacgcttgatcgatatggtagttctttttagttagtcattctatggtaagatgatcatcgatttttaataacttaatttacaatctaacgtataacataaatttcttctaaagaataatacttctctaaatactcttgaaataagtgcaaaatcctgcttttccaggattgatatcaacaaattaattcaaaataaactgttcaatttaagtgtaacgtattgtatccacagctgggacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattatctagttgagacatctattcctaccccgcttatcttgagtttcgtcgcttaaagcatagcactagggaggcttagatgcctttttttgttatcaaaaagggcctagtacttttggaatggaaatactttccaacaccaaaaattctagacccctaaatttgcgatctaccacgtatgtttaaatcaaatttattttaaatataccttgtacagtgaagtttattgattgtgtgatttatgataaaagattaatcttttatcataaatcacacaatcagtaatacataagttaagctcaatcttatttacgtttggcaaggccttcacgaataattttttctaagacatcaacaattttttcgtcattctcaaaagcgatgcgtttaacttctttatatgtgctcatgcgaagttgaacggttttagttctttctgtttcgaattggtatggactttttagatttttaagttgttcagatgcctttttactaactttgtttaaaaaatcttctgccatgataaattactcctctaactgttgaattctaagtagttgttcattaagaaccatttggtacatttggattgctcttttatcccaatggtctttattccgtattccttcattagcaaacgttttaacccgttcttgagttctaattgagtttgaaaagaccccttcgccaaaaaagtcttttgcttgtgcagaaatttcagtatcaacttttgcacgtggcttcattaagtacaatatgacaccaactaactgaaaacttccattgtattgttcacgtagttcacctaaatgcgtagctgtttttaaagaacttgtatatgactgcttttgagtttgtaagacaattgagatgaaatctgaagccatgattgcgttattagtaaagacatttattgttggtggtacgtcaataaaaatataatcgtaattttgttttaactttgaaagcatttgtggtaatagaatattacgtttaacccgactaactttttctacagcaccaatccataaagacaatgtccaatctgtaggaatcatatcaatttggtttgtaacagacacaatagatttagacaaattccctccaagaaggccctcatataatgaaagttccggctttaaatcggctttataagtctccttcataatttcagttgcatttccctggggatcgaaatctatcagtagtacttttttcccctcttgacccaataaataggtttccattacagtcaaggtggtcttaccaacgccacctttaaagttgaagtttaatagtgttttcccattcatagtagcacctacctttacataaacactttaccgtgatttatgattaatcgcaaattttatatgatttatgattaatcataaatcatatacataaaactatttacttaacctttgcagaatgatatgctttgttcataaacaaaaaatcccaatccactcgggattgggatttttgcagtattgacaagtagctatcttgcagctacctagtccaagcaattttcaccgccaagttaaaattgcttgaacaaattgtaatcttgtttacgtgctaattataccgcaagcaaaccttaaggggcaagcaaaggtaaactaattaaaacgaagataagaccaatggactaagtagcttctaataactacttagtccatttttagttcttaaaaattaaaaaagttgccgaattgcaactcacaaacaaacacatgctggtgaatttacaaagtcctcactgccaatgatgctttataattcagtcagagcatatcaaatttgtattttagaacaagtctgatgttttagcaactctctttgaagacagcatgtacaagtcaatgaaggggagttttattatggatcaaacaaattttaattttattgaatcaaaaaaagcttatgaaacccgtttttttcaattcccacaagttttactatacggagaaaaatacaaaaagctaagtgatagtgctaagttaggatatatgattttacgtgatcgtctagattactcattaagaaacaactggattgatgagaagaatcgagtctatttcattttcacaaatcaagagcttcataatttatttggctggggcaatgcgaaaattgttaaagtaaaaaaagaattagaaagggcaaagttactctatcaagttaacttaggatttgatccgaagaaaaagaagaatctaccaaatcatctttatctagctgacctcgaagttacaactaaagacatttacaaaaaaaagattactaatgaagagccgaaatcccttgatacaagcggaagtttcaaaatggaaccccgacaaaaagagccgaaatcccttgatacaagcggaagtttcaaaatggaaccccgacaaaaagagccgaaatcccttgatacaagcggaagtttcaaaatgaaacacaatctagactatactaataatttagatactaatagatacaatatagatactcaaaagttggacttttccacagccaatttctcaccagcagaaattcaaaagcaaaaccaggatttggtgaaccatgctaatgacttcttaactgatgaagccagtggcttaccggttttcttagaaccagaagctgtgcaactacttagtttttggtgccgtaccccgcaacaaatgcggcgcttcattggcattatcttaaatgctaagtaccgagttgaaaaggatcatcaagatattggggttctaatcccgcttgacgacgaagaacttaaacctttgatgactaaagccttgagacgctactttaacgccctaagaagcaatgagaagcatatcaagaacgtggagaactacttatacggcaccatgcaaaacctatttggcgtttggtggaataaacaagcggctagagaatatgcggccaaacaccccgaagaacagaacactgacaatgggccttcttggaattaaacgtcatataggctcatttaagccgctttaagtgttacatgcataattatattaaaatcgttttaaaatcgcttagaagcaaaaatagacaccttgagtggctgaattggcgatgactgaactaagggaatgtgaaaggagctttttaaatgaccaaatccagcaaagaagtcgaaacaattgagcaattgttggctgccccctgggcagtcgatattcaagacgtttgggagcaagcagcccataacccagatcctgataaacgcaagctgtttgacgcgttacacacttacctcttagataaacgccaagagcaaattatcaacgaaaagcattttgtgatttaacatggacaggtcaaataatcagtgactgaaataaaaaggagacacaaaatttggctaagacacgaacatatatggacaagtataaattcacagctgcagaaaaccaacggtttgcccgagcaaattttaccaagttagtgcatactaatgctcgctttgaaggcgttaataccactttgccacaaacacaaactattatggacggtatgagcgtagcaggagtacctgttgaagatgttttgacgattgttaatttaaagcgtgggtggcaatatatcactgctcaaaattcccctttaacgttaaccatggaaaaacaaatcaacaagattgtggcagcggaagacgccttagtaccaggagaattacggcaagggaaaggaggagttaatttaggtagtgacgacttttttgaacagcctttaattaacgaaaaacaagaacaatcctttttacaaaaaatcttggctgatccacgaacgacgattactgataaagcattgactgtcatgtatcataatatgcgccaacaaatcttttgggacggaaacaaaaggacggcaactttaagtgccagtaagattatgattgacggtggcgctggtttaatcaatgtcccattagataagtgggatcaatggaacgaactaattgccaattattatcggactaatgacatgactaaaattaaacagtggacatatgataatggtattcaaggattacaaattcgagcaaacaaaaaattaagtgctaatgaattgaaccagatgtacaagcaactaaaaaaaacggataaattagaacttaaattagttgaagacgagattagtaaaagaacccaaaacaatctcaaagactttgctaaaaacaatctagaagttaagccaaaaaataatcctgaaaataaaaacgatcggcctagttattattaggttgatcgtttttgaatttattcggcttatgggcattaacgtaattggcaaatatttttaaaagttcttcggtttgttcaaccgtgagattatcagcttgaaagtatttttcgagcaaagcccctttttgaattaatcggcgagaacgggctttgcgggcttgccgatttacgtagtatttagattgccgtaatttaaaatcttctcgctcaattttttgttttaaacgcgcttgttgctcaactagtttttcatattgattaggcatagtcattaccacctaactattatcggttattttgagcttgatttaaaaaggcggcaacttttttagcaatcattttaatctgtggagtggtaagtgtcccataatccaaattggctgatctaatgatttgcttaccgagattttgttcaattttatttttttcagctttaatcttttgattaagctgttttaatttggcttcttgtttttctaagttactttgagacataatgatccctccaatcgtattaaaaataatcaccgaaactatatcatacagagaacgttaagtcaaaggatagaagttgaaatagcgaagcggaaggcatacactagaagtaaatttaggggaatcagcaggccgagtgaaacgaggttaatgcgcacttacacatagaatgaattctatgttgtactaaccccaaaatcctgtattagaagtcgccgatggcgacaacaaagtcaagcccatagaatcaaagtaaagaggtgactagcatggcaatatttcatatgagttttagtaatattagtgctggaaaaggacgaagtgcgattgccagtgcggcttatcgaagtggtgaaaaattatttgatgatcaagaaggccgccactatttttatgcccgatcggttatgccagaaagctttattttaacccccaaaaatgcaccagaatgggccagtgatcgagaacaattatggaatgaagttgaaaagaacgatcgtaaatcaaactcacggtatgccaaagagtttaacgtggctttaccagttgagttaagcgcagatgaacagaaagaattattaactaaatacgtgcaagaaaactttgttgatcaaggcatggtagctgatgtagctattcattgcgatcacccggacaatccgcacgcacatgtgatgttgactaatcgcccatttaatcttgatggtacttggggattaaaagcaaagacgcagtacattaaagatgaaaatggcaagcaacttttaaccaaaagtgggtttccaaaacaaagaaaaatttggttggttgattgggataaaaaagaaaaaattaatgagtggcgaaaaaattgggcgttgagtgtcaatcagtctttagcacaaaaaaatattccggatcggattagtgagaaatcttttgtcaatcaaggaatagatgataccccaactcagcatgagggaatcaatagcaaacgacacgaacgaaaagcatttaatcaacaagttagcgcgcaaagaaacgctcaagctaaatatcataatcttgacgaaaagataagaaatcatgaacattttgacgcgttaactgacgagctatcgttctctgaaaaacacacaattagtcatctaagtcagcaattgaaaacctatgtcgatttagaacatttagatgataaacagcgcatgctgtttaattggaaaaacagcttattaatcaaacatgccattggtgaagatgtaaccaagcaactgctgactattgaccagcaaacgacatcactagcacaagctaaccagttgttaaataaagtggtggaacgagcaacgaaaaagctttatccggaacttaattttgaacagacaaccgcagctgaacgacgggaactgattaaagaaactaatagtgaacaaacgatttttaagggtagcgaattggcagaacggttagcggatattcgaagtgacttattaacccagcaattattgacgtttaccaagcggccatataccagctggcagttagttaatcagcaggcccaaacaattgagaagcaattaaccacggtactagccaaacatggtcaccagttagacgatttgaagcatactgatcggggcatgctagccgcttatcaacctaacgaactcgaattcatttctaaagcggtgaaaaatttacgggtcatgcgggaagttaaagccgtagtgcaaactcaatacaacagcattctaacgactgcttttccggacagtgacctggataagctagagacgattgataaggagcaaatctataccgctgtggtttactatgacccagaattaaagccattaagcgccgatgatcttagtcaattgcaacagcagccaccggtagtctttactagtcagcaacaccaagccggtttaaattacctgttaggtaaaatggaattaaaagatattcaggatcatcgactgcaacgggtcttaaaacatgatggcacccggcaactgtttatcggcgaatgtggccaagatcctaagttggatcacaaacaaattgaaatggtgcaaacccgtttgaaacgacagacaacgcggtttgatcaatataagcaggctcaagttaaagactatcgggccattaattaccacccaactagcccgaaaaattacctgatgaatattttggacgaagccttaatgaccattttatatgcgaaaaatacggactatctaagaaaacagcaactacgtggactaaaggagaccgagtgggcaatgacgaaaaagcagcggcaacatcaaactcgaaaccggcatgaagatgggaatatgcacttataatcaaaatgtaaagataaatgtacacatatgtgttcaatgggtgctatatttgccattaaaagtacgcaacctagatgcggattatcaggtgtgataataatgcctacatgagttttgatggttaaaacattcagaaaactatatttagggcaccgaattgttgctgcgctaattgttgaattccaatggctcagtcaaaagggtagtttgataagcttgtcagtgaaaaggtagctcggtcgaattatgattacgtcgtagtgacgacgattcagactaagttatttcatagaaaaagattttctgggcacactatttaaattggtgtgatttttttattttgcacccgacttgaactagcatcactaatatcataagcttaaattaggaaattatacggattcaacgatgattggggcgttttatgaaattctttacggcacacaccactaccgcaagtaaaatcgtgacgctgatttatatattttatcggttaattgtcatttttatgttaggcaatagcatttatatgcaagaatggtcacacgtcgctttattagtgctgacattaattttgtttatgctaccatatttaattgaaacttatctgcatattaatatacctagtttgctagaattgatcgtaatcagttttatttttagctcaacagtattaggtgaactagatgacttttatggtcatattccagtctgggacacagcgttacacgcactaagtgggtttttggctgctggagtcggtttttcgctgatttatttgttgaatgaaaatataacgattctgaaattaacaccgctatttattgcggtgaccacgttttgtttttcaatgacggtcggggttgcttgggaatttgtcgaattttcagcggatcgttggttgaatatggatatgcaaaaggatcgcattgtgcgccaaatcaatagcgtggatctaggccaacgtaacaataaagtggtccagctgaaagatattcaacgaacgacgattgaaagtgaaaccgctgatggcaaaaaagtgactactgtgatccataacggctatctcgatgttggcgtgatcgatactatgaaagatctattcgttaattttattggtgcgttatttttcagtatttttggctatttatatatcgatcatgaacataaacgatttcagcttattcgtaattttattccgaccaaacggaaatgaattttccagtaaataataagatagagggtacgcgtgcagacgccaaccttgtatatggtctatcaaagagaccaggcaatcaaaaactttaagccggaactctattttgaactaaatgcggaaattttagccaatcagcaaaaattcgtcgcaaaattagacccctatcagcgatttaaagatgaagcaggactaataacattcatgcaagctaagcacgttcagaaaggctcacaggccggtttaatcaaggatgtccaaaaacaagacaaaaagcgtgctagtccacaactattctcactatccagtctgcaaagtgccatgaataaacgttatcacgccagtgccagccaaaccttagcggctattcaaagcttatacgaagacaaactactcagttatccccgcaccgattgtgcttatattactgatgaagaatttgagtatttagtggctaatctgacgaagtatctggggttagtctctaagccagtcgctttaaccaataccactccgaacaaacgctatgttgatgggaaaaaagttgaagaacactatgccattattatgactaaagtcgtgccgactaaagatcaattagctaccttacctaaaatacagcatcaagtctatgacttagttttaaaaacaacgttagcgatgtttgctgatccgtacgagtacgaggaaactaccattattacccaagttggtgacgccaaatttaaagcaacgggtaaggtcccaactaagcaaggttggcaagctttatttgatgatcacacaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtggttactaaatatcataagggaaggcattccctatttctatacaattcagaaatcttttatgcatttacacaagatattttacgctctcaataaatttacctacgggttatttatcaattaactttgatagataataaccaactacaaatcctaaagtattagcaagcacgtcatttatatctacccaacgatgtgttattgccaaattgtctgttataaattgaataaattcgatagtgaatccaataaggattccagttgtaatcacatgagaaattttgaatttgggagagaataaaatataggtaaatattcctaagggacaagtcataatgatgtttagccagaatcctaattgatctaattcttgaaagggaatgtaagcaactggtgccttaccaatcatcataaagctaatagcttgatttgacggtggcaatttaataggtaaggttgggctaaaacataaaaaacaaattgataaggctgaaattcctaataatacccaggcaaataattttgaaatatggttaataattcatcatctactttcattattaattgaattaaaaatattgcgataatttataaattcttccttaaatacatatttttgaaaactaaatttcaattataagcatttttatcaaaactatcacaaaaaagtagcaataacggaactttaacaaatcttttaccacatttaatgtttagcagctgaaacttgaaagctaataatcacgccaaaggcgtgtggttattggcttttttggcaaaaaaataaacgcaagctctcctgcgttgtatactttagtcgaccaaaaccaagatacaaaggagacttacgtcatgaatattataagacaaaaaaatacagaaaacgagcttcacaatattgttcatcaatttacttccctcattggtctatctaaactcaccaagttggtgaattatcgccggcattcagaaatcagcttgatgaaggtcattgaatggctgctcacgacaaagttcctgggacgctcgctttatcgagcccatgaaacacctaactttaccagtcgcaccgtcagaaataatttgaacgatggccggatcaattggcaacgcttgatttgtcaagttgggagtcatttaatcaagcatttacgaccgtttattgaccgccggcggcggttagcattgatcattgacgatacactcttttcccgtgagtacgccacccaaaccgaattactagcgcgagtctttgaccatgacaaacagttatatattaagggataccgggctttaactttgggttggagtgacgccaatacattcttaccgatcaactttgcattaatgtcttccaagaagccacaaaacgtccttggaaaatcagctaaaacaaccgatcaacgaacaattgctggccggagacgtcgccaagcacagcaaaaaatgaacctcgtttcattgcaacttgtcaagcaagccctcgcaaatggcgttctagctgactatgtgttatttgatagctggtatagctcaccaaaaatgttctatgaattaaccaagttgggattaaacggcgtgggcatgcttaaacggtccagcaaaatttactatcaatatcgcggacggcaatattcagttagagcattatacaagcgactgcaggcctcaaaatatcaacccaagcaagcttatcaatacagctgctttgtcgaagcgcacgtcgggaaccaaaaattcaagcttcgcttggtatttgtggctaatcgggcccgtcaagatgactacctagtactggcaacgactcagttaggccttcagccacaagagatcattcaactatacgcccgaagatggcaaattgagaattactttaaagttgccaagcaatacttgcggctcgacaaatcacaagttcaaaattatgacgggctttgtggccatttagcaattgtcatgatgacttatgacctattagcttggcaggaacggcaaaatcaggatgatcgcaccattggggatttattctttataatgaacgaagccatgccagatattgagttgtctcaagcactggtatggcttctaaattcgttaaaaacgattattaatcatgaagtttatgcaagaagagcccaaattattcagatgatgaatcagttcttcacatttttgccgaaacggttagtttcgctgttaacagcaagctaaatggttaaattaattaaaatatgccctgtgataccaagggatcagtctgtcttcatactttcaagtttcagtttagcagataagtaagcaaggaatgcatgatattttaaaatatgcaaattaaacgttctggcatggtcttcaagatttaatcttgataatcttgtaatagaaaaatatactcatttaagctttacaacgtcactaattagtatgagaaaattgctaattacttaattttttaacagaaaatggtccaaaaagtaaatctagtagtcgctttttggcattttttatttggggaatatgtatctatatctaatgtggttgcttatttggagaaaaaataattagcataatagaatatgattttaaatatgatttttctacattaaaacgtttattattatctgggtgttagcattatttttgtattaaagccattcccattttaaaaatttgtagttaattagtagacagaaataatgaaatgtttagttatataatgacaattgactatttattaaataaatgtaaaaattagggctgtatttataattttaagctttggttaagttaggagcgtatgaagaaagtgcctgttaaaaagaatttgcataatcatagaaaacacaatcaatataaattcaaaaaaatattttggttgtttctattgttgttattgattttaggggtaggtgttgctggaattgcctatcgtaatatttatagggcaaccactattgtttacaaaaaagcgaatgctcataaagaacgaaacgctggcaagttaattgataataaacgccctatttctattttacttttaggaactgatacaggcgctcttggtcgcacgtataaggggagaactgatacgatgattattatgtcaattaatcctcaaaaacagaaaactgttatgatgagtttgccacgcgacatgaaagttaatttatctgggtattcggagtattctcccgctaaaattaatgctgcttacacttatggtggtactaaagaatctatcgatacggttcagaaatatttaaaagtcccgattgattactatgttttagttaatatgggagggctaaaaaaagctatcaaccaagttggcggagttactgtagtttcaccacttacttttacatatttaggagaccattttgttaagggaaagaagtatcatttatacgggaatgatgcattaaagttttcccgtatgcgttacagtgatccccaaggggattatgggcgacaattacgtcaacgattgattttgacaggcctattaaaaaaatcgttttcgtataggactttcctatctagcagttttttaaaaacaatttctaaccaagctcaaactgatttgaatcgttctcaaatgtttggtttatcaataaactatcgtaaagctggtaaccatgttgtttctgatcatgttcaaggagtgggtaaagaaattggtggtcaggattttgaagtggtttcaaaatctgaactaataaaatcatcaaatattattcgaaataatttaggattgacgcgttattaattctatatataaattttttggaggacagcatggaaaattatttggaccttcgccaaatattagggattattcgtaaacatattatctttatcataattagttttatcctttgtttaattattgctgttggtttagagaagtttgttattacaccccaatttacttcgactgctcaaattttggttaatcaaaaaaaagatacttcagttccaggggcagcttttcaggatcagcaagccgatgttcaaatgatcagtacttataaggatatcattacaaaccaattggttttgaaaacagctagtgagcgattagctaatcctgtcaaagtaattcgttcagcacgaaaggctcgataccatgtttcagcaaatggtcatcgtcacttaattaaagcatcacggccagctgttgttaaatcaacagggactccttatgatgtgagcgttaaacaattacagggagctatttctgttactaatcaacaaaactcacaagtttttgctttaaatgtgaagagtgatgatccacaaaaatcagctgcaatcgctaatacagttgcacaggtttttaagcaaaagattcgtcgaattatgagtattaataatgtcaccattgtttctgaagcgacacctgtaaagcagaagtcgttccccaaaacttcaatagtgctgctagctggggcggtaattggtttgctggttggattaggttatgcgttcattagagaattaacagatacaacaattaaagatgatgaatttttaaccaatgagttaagattgactaatctaggtcacatagcagaaattcgtaagatacacggctcacatttggccagtaaacgtcatggggaacatctcaaaccgaatcatcgaagagtttaaatcttagttatacaggagaaaattatgaacatttttcatcgtaaaagaaaaaagctttccactgatactttaagaaatggtgtgaagttaattactgatgttgatcctaaagatattgtttctgaacaatttcgtacagttaggacaaatattaatttttcagcagttaatcaaaaattaaaaacaattatttttacttcttcggcagttagcgagggaaaatcaactgtttccgctaacttggcggtcatttgggctcagcaagggcagaaggctctatttattgattcagacttgcgacgtccaactttgcatacgacatttggtttattaaataccaatggcctatccacggctttatccactgatatagatttcaattcagtagtgcaaaagacggagattgataatttatctgtgatcactagtggacccattccacctaatccatcagacctgttggcttctaatcggatgaaagaattaatttcttattttaagaaaatctatgatgtgattattttagatgttccgccattattgtcagttactgatacgcaaattattgcagctcaggttgatggggtggtgttggtagtgcgccaaggattagcacaaaaattagctataaagcgctcaactgaactcttaaaaatggttaaagccaatttattaggttatgtattaaatgacgttgcacctaagaatgggtacggttatgactacgactacggctacggttatggctatggatatgggtacggttatgataataagggtaaatagttgccaagggatatgatataaaatgattgatttgcattgtcacttgctcccaggggtggatgacgggtctaaaagtatggatatttctttgaaattagctaatgatgcagtaagagatggcatcgactatgcattattaacgcctcatcatatgaatggtgtttatcttaatcacaaaaaagcagttattcagcaaacacaggagtttcaagtggaacttgataggcataaaattccactcaaagttttccccgggcaggaagttagaataaatggcgatttattaactgctcttgatcaagatgatattttatttgctgatgagggcgggcgatacctaatgttagaatttccggatgacgatgttccaaattataccagtaacatgatttatgaacttatgcaacgaggcattataccgattattgttcatccagagcgtaataccaaaattatgaagaaaccggacattctatatagattattaaatagaggttgtctttctcaaataacggctgggagttatgtaggagcttttggttacaaagttcaaaaatttagtaaacaattaattcagactggacaggcatatgtttttgcttcagatgctcatgacttacctaatcgtaaatacgaaatgactaatgcttttgcaaaattgaatcatgaatttggtaatgattatgtatcccgatttagtgaaaatgcaaaaagaatgatcaatggtgataatattctatccaatgatttttctaaaataaaaacacatttgtttcatttttttaaataagggggaggtgatgtatactttatgcaaactgagagacgtagtggaggagatcctaaatacggtcatccaatgacagataataacgtagtcgtagtaaataaggaacgagttgagcgacgcttcttttatcattttttcaaaagattttttgatatattattaagtataattggtatcattcttttaacccctgtatttattattactgccattttgataaaagttgacaatccagatggtccaataatttattctcaaattagaattgggaagaatggacacccttttagaatgtataagtttagatcaatggttgtaaatgctgataaaatgttaaagggcttactagatcagaatgatatagagggcgctatgtttaaaatgaaatcggatccgcgagtcactaaaattggtcgaactattcgaaaatatagtattgacgaactcccacaattactaaatgtaattaagggagatatgtctttagtagggcctaggcctccgttaaaaagagaggtggaggattatactgaatatgataaacaacggttattggttgtcccaggatgtacaggaatttggcaagttagcgaaagaaataaagttggatttcatgaaatggtgaaattggatattaagtatataaatagttcaaatttgtggcttgatttttttatattgtttaaaactatttggataatttttttccctaatagtgcatattgagaggagactatgatgaaaatttgagagcgtaaaatatcttgtgtaaatgcataaaagatttctgaattgtatagaaatagggaatgccttcccttatgatatttagtaaccacagaaaacatcacaggaggcattccccatgaatga

SEQ ID NO: 31 - DNA, 5021 bp, Unknown
  Metagenome-assembled genome
cacttagagataaagatggtaacagtctttctcaatgatcattgagaagcctgttaatgtcaaacatacttagaagctgtctaaaatatcttaagtaatagttgctaaaaacgctaaacgaccatttgcagaactggtggttaattgacgctcacaattttccaagtcgccgacaattctctagccaactaaaagatgttcgactacccaacgttgggcatgacttcgaatcgattgcactcattgcgctcgcaacctgcacggttgcgtttaaattactggctacatcgagggaaaattaacgcctgaataaccaccatcaactaagacattttgaactggcgtaaatgcatggcatgtaaagcgatcattgcactggccccgtctcgatcagagacgttcgctcgcgtcatgtgaaggcctgcggaaagccatgatatacaactgcagatggcgcttaatccccgagattttcttaccagcgtcgaacctttgttttcagcagtagcggtggtttttgacgctctgagcgtcaacgataataaggaagtaaagctgaacgtccttggtagtttcgccgagtaatgacaatttttttaaaactgttccaataagaatcagccgtaggctcagctttagttgaccaaatttgtgtaatagttgtaaactgaccgccattctgggaaatcacccggggacttgacgccattggcaccggttttcaagacatataggaccgcacagaagacctcgtagaggtcatattttcgaggcttagttcgcttacgaaaattttcttctaaagctggtcgaattaattcaaattgttgccgagtaatattgctgggataatttttcatagcttaaactcgctttttacatagaagtatatcaaaaatcatagatcttggacagcttctaaaagattgtcttgatcacgtgggttttcagaactgttttctatatcggcatatagattggaccaatatttttgagactttgcgtcaacaatatttaaggttttgtaaaaatcgttaactccgtccaacacagtgtttctatcatcaccgtttagtcttgctaaagatgattcaagttcaatttcatcgctaaatggagactttagaaattgccggttattttccttttttgaagtaaattctgagaatatattttcaaagtgatcatcagttaatgttggtgttcttgcgttatcccaggaaatatttgccaagtatttcagcatcgttgggccatcaactaacttttgttcttcgactagttctcgataagcgttgattgattcgaggtcttcatattgatcaatgctggtataatgagcattcgccatcccaagttcttcgccttcaaagacaaatggggttccttgcatcatgtgaagggtagttcccagcatcttagcggcacggacacggtatttaggatcatcattagcaaaccttgaaacggcgcgtggctggtcgtgattattccaatacaaggtgttccaacccttaccatccaaggccttttgccagcgggacagggcattctttagctcaggtaatttaacaggttgatcgttccattaccaaggtgtttatctggattaggctccaaagcaacgtgctggaactggaaaaccatatttagttcatggctgtcgagaccggtataattgatggcatcttctggttttgaactcagcatttcaccgacggtcatcacgtcataatgggagagaaccttgtcgttcatttcgcgcagatagtcatttaatttaggaccatcggcaaccaatccctcggttaatgggtaggtgccaggttcaggtgcatcggggaggccttcaggcttggaaattaggttgatgacgtccattctgaagccatcaatacctttatccaaccagaaacgcataatgttccaaacggattcccgtacttcaggattttcccagtttaaatcaggttgaccaggagcaagtagatgcaaatagtattggccacgttctggaacataggtccaggcactgccaccaaatgctgcatgccagttattaggttcatgcccatcaacgggatcatgccacatgtagtagtcagaatattgattatcctttgactttttgctttcttggaaccagcggtgttgatcagaagtgtggttaaccacgaggtccatcagtaactttaagccatgggagtggacttcttttaataattcattaaaatcagccatcgttccatagtcaggcagaattttttcataatcggcaatatcatagccgttatctttcaatggtgattggtagattgggttcaaccaaaggacgtctacacctaattttttttaaataagggaggcgtttgatgatcccatgaagatcaccaataccatcgttgttgctgtcttgaaaactttgtggatatatttgataaattacggcgttttgccaccatttgtgagtcatattaatttctcctctgtttttagtgatcaaagcaaagcagttataagctggatcctaagttatcttgaccggaaatcttggattttggattgagatgacttaagtacaggctgctactctgcttagttgtcctagttattatagtttaactggtttactcagttttgaatgaataatatttaaatctgatttttgatgtaataaaatctgacattcgactcaataatcccaattaaagtgatataatgattagaattattaaatttatataaaagggagacgagtgaaatgtcatcattatttcgtaaaaaggacattaatgttcttgtaagccatgcttcccccctaaaaaggacgcttcgaacttgggatttaacctttttagggattggagcgattattgggaccgggatatttgttttaactggtaagggggctttaacagcagggccagccttatcgttatcatttttaattgctgcaatctgttgtggctttgctggtttgtgttatgctgaattctcttcaatggcaccagttgctggttcagcctatacgtattcatatatagcttttggtgaaattattgcttttgtcattggttgggatctaattttggagtatgctttaggtgctgctactgtttcagttggttggtctggctattttgttaacttgctaagtaactttggtattcatattccgactgtgttaacagcagctgcggggactactccaggagtcaatacaatttttaatttacccgctttctttattgttttagtgattacatggattatttccatcgggattacccaaacaaaacgggttaatgacaccatggttttaattaaactagcggtaattattttatttattgtttgcactttttggtttattaaaccacataattggcagccgtttagtccttttgggtggtattcttatcatcatggaacagctgccggaattattccagcagcatccattgttttcttctcgtttattggatttgacgcagtttcatcaagcgctgaagaaactatcaatcctagtaaaactttgccgagagggattttgctttccttgttaatttccactgttctatatattgcaatgacgttaattatgactggtgtagtgaaatacactatttttgctaaatatcttaatgcgcccattttggcggttcttgttaaaacggggcaaacctggttatcgattatcgtcagtttaggagctattttaggtatgacgactgttatcctagttcaattatatggtcaatcacgtatcagctattcaatgtctcgtgatggactattccctaagttctttggacaggttgatcaaaaacaccaaactccttttaaggggacttggttttttggcatcatcacggcattagcgggtggttttattaacctgaatattttggcggaattggttaatatcggaacattaacagcttttatactggtatcagctggggtactaattatgcgccgcacgcatcctgaaatccatcgaggatttaaagcccctggtgttccggtaaccccgattattgctattcttttttgtattaccctgatagctggcttaaattgggaaacttgggttcgttttgtggtttggctagctattggtatggcgatttactttggctacgggagacgacatgcgacaattaattctgaaaataaggaggactgatatttatggcctatcaacgtatattggttggactggatgggtctaaaccagctgatcgtgcttttcgagtggggtgctctctagcccaatccttatcagcaaggctttatgttctttggattgttaatcgtgatcgaggcatggactcatcttttggagtaaatgaggacttttatcaggatttatatcgaaaagtgacacaaaagatcaaaccttatttagaacaggcccaagaacaaaaagttgaagtagtgggtaaagtcctaataggtaatgtcaaaactatattggctaaagagtttcctcaagaacagcaaattgatttaattattttagggaacacaggcattaatgcggtcgaaaaaatgctacaaggatcccatagtggctatgcagtacgccacgcgccttgcgatgtgctgattgttagatagtaattatgtgttggcattggttgaaaacggtcagcacttggtctaggcgtgaccgagcttccgagttgaggatgattccaacttctcaagttgaaattatttgcagttaaaaactgtttttacagatataaatatagttttcttactgattctttaattttatatttggttaaagagctaggctgcctgtataatagatccagtagagaagttaaggcggtggctatttccaatcggaggtggtgcttatggtgttaaacctttaaagcccataaggtagattgcaaatttaatccgaatttttggacaaatttgtcagcataacctgatacggtgtttgccagtcgagtattttaagcggtcgctggttaatttggagtaacgtcgtcgttaaatct

SEQ ID NO: 32 - DNA, 25728 bp, Unknown
  Metagenome-assembled genome
agcgacaataatgacgtcttttttgaattgtttgcctttaaaatgattcattactctgtcctctctgtcttttttctcaattttacactaaaatagatttttttgaaaactttgcaacagaaccgacagaaagtatatgaaaaacttttttaatctcaaatctatatggttatcaaatattgatacttttacaaaaaatagtgaagaagctgctgataacttaattgatgataaatttgagggaaaacttgaaaagctagcgttagacatgccagcttttataactagttttacagaactagatataaactcctttgacaaaaacggttttgtaaaggaagaaatatcatgctcattaataaaatgcgaagaaaaattaggcaagaatcgtgactttatttttattccttatcaaaatatgattcacttattgagtgtaattaaggagtgccaagcaggtaagcgagaaggtatcctaaaagaaacaacaatatttgctcgaaaagtttggtatatcacggattacgtaaatagaatggacaaacttgaaaaagactattttgaaggtaaaaagtctgtggagcaagttggccgaggcatgctaggaacgaagtcaatgaagtactcaatacaaaacgaattcagattgggcattgtgtttccatacaaaaaatcaaattatggtaatgaagctggtacaaacttaggcatacaaccttctttttgctttgcgacacaatacttcaaaaaagaggaactaaggtcattgaatatagaaaagctgaattaatagtactaaaccgaaaatagccactagggtataccctaatattcatttgcacttttacactacactaggagttatagacgtgcattaggactgttagaaaaggaaacgttgagactagattcgtaacgctctcttgatttcccaagagcaacgtttagattggcagtgaaattcttcgataaactattatggataggttaagcaacataaggtagaaatatacttatgaatgacagtggtttaattgtgtagacagcaatcattatcataatagtatagagctaataacaaggtaggaaagaatggcgtataattctctcctaccttttttattgttgctagtctgattaaccattgatttgctatcggtcaaaatttctattatgagattagacaaattaaatatatgcttttaacaaaatgttaacatgagattttaaatattaacaccattttaacaccttttcatataccatatctttggttgatttgaatatgttttggagatgttcaaaatgattgataattattattacaaagattattcggaccagtatagtcgagaaaaagtaatttgtttaattgataatgatattaaaaaaaagatggggggctacattcaaagtacttcaggagaccttttcatagcagatgttacaattttttattttttcgatactgctcagcatcttaaatttgactacggattctcagacaaagttcctattagtgttagaaaattttgggaacaacgcattaacgtgttggagcacccttgattaaattaaaaaaataattggaagtgagacaaatggttttggtcttaggaacgatcttaacaatctttttattagcttatctaatttatgttctagtgaaaggagaatcatagtatgccaacatgggctcaatatttaccatatatcattgttccattattattagccattccattaggcaagtacatcagccatattattaatgatcagaacaattttatgagcagaattatccgaccaattgaaaacaaaatatataaattttttcgtgtgtctaatcgcgagatgagttggaaaacttatttaataagtattttaatgttttctttagttagttttttagttttgtttagtattttgagattccaaaattatttacctgggaatccagaacatttttcggggctttcttggtcattagcgtttaatactgctgttagttttgtaaccaacactaattggcaatcatattctggggaaatggctctttctaatttttctcagacgattggtttaactgttcaaaactttgcctctgcggctgttggaatcgcggttctttttgcattaattagaggtatccaacgtacagaagcaaaagcaattggaaacttttggcgagacttgaccaggatctttctatatcttttaatcccgcttagtttgtttatgtctattatgctcatggcaggtggtgttcctcaaacaactggtggttataaaactgctaccttggtacaacctgttgccgttgataaacataaccaggcgattcatggggctgaaattaacgtcaaaaaaaatacagttaggattaaaaatcacaaaatcgatggggcaaaaattataactaaagaaaccttaccgttattcccacaagcttcccaggtatcaattaagttattggggactaatggtgggggggtcttaggtgctaactctgcccatccatatgaaaatccaacaccttttacaaactttattgaaacaacggcaatgcttcttctgcccatggcgctatgttttagctttggtgaatctttaaagcggcgtaaggaaggttgggcaatcttctcagctatggcaattatgtttgtagttgcgttaatatttgaaggaattgttgaacaacatgggaccactttagctcatattggtaatttggctatggaaggcaaagaaactagaattggtattcctggatcagctgtctggagtattgttactactgcaacatctacaggcgcaacgaatgcaacattagatagttttagttctctgggcggattaatgcccatggctttaatgcaattaggcgaggttgtttttggtggtgtagggtctggattgtacggcatgcttggatttatcatcctaacagtttttattgctgggctaatggtaggacgtacaccagaatatttaggtaaaaaaattgggccttacgaaatgcgtatggctgttatcgcttgcctatcaacgccaattgcaattttaacttgcagcgctattccagcaatgttaaagagtactttaactagtcttagcaatagtggagcacatggattctctgaatttttatatgctttttcatcagcaggggcaaataatggttccagctttggagggttcaatggtaataccattattttcaatgttttattagctgttgcgatgatcatttctcgttttcttcctattatcgctataatggcgattgctggtaaaatgggacagcataaaattgttgctagtagttcgggaacattatcaactacaagtccaacctttgtttttatgttaataatcgttgtattaatcattggcgtgcttagtttctttccagcactatcattaggaccaatagcggacttcttgacacattaatatgattttacattatgcgtttctaaaattagtaaggtgggtctgactatgaatgaaaaaatagagaaaaatcaaatgtttagccgaaaaatgttaggagcggcacttaaagaaacttttcttaagttaaagcctaacctacaaattaaaaatccagtgatgtttctagtttatgtatcagcaattgcaacaactatcttatttattttatcgctttttggcatctcagacagaattgtaagtagtggttttatctttacagtagctgtaattctttggattacttgcctgtttgcaaacttttcagaggctgtcgctgaagggcgcggtaaagctcaagcggcagagttgaaaaaatcaaaacgtgcagtaatggcaaaaaggttaaataaagttggcgatttatcaaatattgaaaaagttagtggagaaaacttaaataaaggtgatctattccttgctgaagctggggaaaccattgcagcagatggtgaagttgtcgaaggagctgcttctgttgacgagagtgcaattaccggtgaatctgcgccggtaatacgagaagctggcggagatcgctctgctgttaccggtggtactactgttttatcagatcatttggtcatcaaggtaacacaagaacaaggtgctagttttttggacaaaatgattggaatggtagaaggtgctaaccgtaaaaaaacgcctaatgaaattgcactagaaatttttttagttgcattgtctatcatatttgtgttggtagtggcggcattatacacgtattctcagttatcatctcagatacttgatatgagaaatccaatgtctattgtatggttaattgcattactggtttgtttagccccgacaaccattggagcacttctttcagctatcggtattgctggcatgagtagattgaatcaagctaatgttttagcaatgagtggtcgggccattgaggctgctggcgataccgatgtattactcctggacaaaactgggacaataacattaggcaatcgacgtgcctcagcatttattccagtcgatggccattcagaaaaagaattagcaattgcggcacagctttcatccttagctgatgagacgccggaaggaagatcaattgttgtattagcaaaagaaaagtatagccttagagaacagaacttagaagcaaatcaggctaagtttattccattttcagcacaaactaaaatgagtggtgttaattttgctggagatgaaattcgtaaaggtgcttcggagaatatcaaacaatatgtcctgacaaaaaaaaataaatacagcgaagaatgccaaatagcagttaagagaattgctgaacagggagggacacctttagtagtatgcaagaatggtgttattcttggtgttatctacttgaaagatatcataaaacccggcgttaaggaaaaatttgctgatctaaggaagatgggcataaagacaatcatgattactggcgataatccagtaaccgctgctgccattgctgctgaagctggggttgatagttttctatctcaggctactccagaaagtaaaatgaaaaccattcgtgaatatcaaaataagggacatttagttgccatgactggcgatggaactaatgacgctcctgccttggctcaggccgacgttgctgtagctatgaacacgggtacacaggctgcaaaagaggctggtaatatggttgatctagattcttcaccaactaaattaattaaaattgtccaaattggtaaacaattattaatgactcgaggaagcttaaccactttttcaattgcaaacgacattgctaagtattttgctatcattccggctatgtttgtaggattatatcccaagttaaatgtgcttaacattatgcatttgtatagtccaacaagtgcaatcctgtcagcattgatttttaacgcactaattattgtcgccttaattcccctggcactcaagggagtacgttaccgagaagttccagctagtcagttactgcggcataatttgctagtttatgggcttggtgggatagttgttccattcattggaattaagttgatcgacttgatcattgcactcatactacagattctatgagaagggagaaagacaataatggtagttaagacattaggtaagtcaattttggcagtaattgtcataacgattatttgtggtatctataccttaattgttagtgcaattgggcaaaccttttttacctcacaagcaaatggcagtttagttagatctgatcaaacagtaaggggatcagcactaattgcacaaccattcacaagcaaaaaatacctgtggggtagacagatggatattactgttggcgatataactggacaaaaaaacaataaaaatattatgtactctgtggcctcacaaatgagccctaacgataaaagttatcaaaaggagattattgataaagaaaagacaataaaaagattgaatcctaatgccacttatcgacatgttcccattgacctagtaactaattcaggaagtggcttagatccggaaatatcaccaactgctgctaaatatcaggttaagagaattgctaaggctcggcatgtcagtgttcaaaaaattcaacgagtgattgaccaaaataccaaaactcgcactctgggaattcttggtgaacctcgggttaacgtgctagaaactaatctggccttggataaactatcaaaataacttttgaagcttagctgagataagtcgcgggttaagcccctaaatgattaccatatgtgataatcatttaggggttttgtgtcatatgtaatagagcctataaagatcttgatttgaagattataaaagacaagactttatttttgggtaaatttagttagaacgatagtatacttaccaaggatattcttgtattctatttggagggataactagatgaatcaaaatgaacgtgcaagtaggtacttaaaagatgcaaatcttgaaacttcaggcagggggaaattaaagattttctttggttatgccgctggtgttggcaaaacttattctatgctagcagaagcacaggacttgaagcaggagggccaggatgtcattattggataccttgaggatcatggcagggcagatacacgcaatcttgctagggggttagaatcaatccctgtaaaaaaagaatcctataagggaatgtatcttcaagaattcaatctcgatggtgcactggaacgacatccacagacaattttagttgatgagttagcacatacaaatacgaaaaaaagtcgccatttgaaacgttatcaagacattcaggaattacttactgctggtatcaatgtttatacaacgctaaatgttcaacatctagaaagcctgcacgatataatttttgaacaattaaacgttgatattcaagaacgagtaccagattatatatttgatatggcaaatcaggtcaagttaattgatatcgaacccaatgatctgatcaatagacttaaaattggaaaaatatatgctagaaatcatataaggcaagcattagctaatttttttaaatctgaaaatcttactacgttaagagaacttgcattgaggaaaatgactttaagattggctaccaactcaaaggtaggtactgatcggctactagtctgtttatccggatctaagagtaatgaacgtgtcattcgttctgctgcacaaatggctcaagcttttaatagtgacttcattgcggtttatgttaagaacaatcagtttaataaatgggaggaaaacttaaataataacattagccttgcccatcaactaggtgcaaaggttattaaattgcagggtgagaacccagctctgcaaattacagagtatgccaaagaaagcagcgtaaccaaaattgtacttggggctagtccttataaaaaaatatggccaacacgatctacacttgtgtatcaaataggacatctgttaccagaagttgatgagtatgtaattaatagtgctaaaactaatttgaatcaagtccaacatttaaatggtacatttttaacccattttaaaggttcacttagtaagtctggctctaagcgcatggctaaaaatatgctaatgatttcaagtattattttgggaagcacagtggttggagaactattaatatttgcacaagtaccattggtaaatgtcgttttggtttatatgttagggatcatgctctgcgcaattaacctaaaagatcaagtatatggattcttatcagcttttttagcagtaattagtttcaatttattttttaccaaaccctatttttctcttagtagtagtccagtttacttgttgacattttttttaatgctactagtttcaataatcagtaattattggacactaaaattgaagcaccaagttcaatataactctaaccgtgtctaccaaacagaggtgctgttggaaactattcgtaaattgcaacaagccaaattatcaaccgatattattgacacgactgttcaacaactacaaaaaatttatagtgctacaatggtcttttatgaatgccaggattctaagttactgcaacctaaaatttatctgttaaaccaaagccagagctctttttatgagttttccagtgataacgagaaagccattgcaacctgggcattcaagaatggtcaagaagctggattaactactaatactttaccacaagcaaagtgtttatatttacctatttttggaaattccccttcatcagttgttgcggttataggcttagcaataaattcaaaacgatctttggaaatatttgatcgtaatttaattatttcgatattggatgaatgtggtcaagccttatcaaggatgagaatcctaaatgaaaaaagaaaagctgaaattaaatcgcatcaggaaaaactcagggctaacttgctacgaggaatctcccatgatttacgaacaccgttaacaaatatttctggtagtgcagatatattgaaacgagaaggaaataagcttagtgatgttgagaagtatacattatatgaatcaatatttaatgactcttcatggttaattagtctagtggagaatctattggcaatgactcgtttagagagtagtcttcaagtacgtcattctccagagttaattgatgatattattcaagaatctttgcaacatcttagcccaggatttgaagatcataagattaccgttaacttgtctgatccattattaatggtcatggctgacgcacacttaattacccaagtcattattaatatagttaacaatgctattcaacacacaccggaaaaaaccaaaatttcgattagaatttttcaaaagaataccaatcaagtccaatttgagatttcaaataacggaccaaaattaactaatggtgatctggctcacctatttggactgttttacactggcaaacaaaagcaaccattaagggctcaaagagggcttggaattggcttatcattgtgtaaatctattattgaagcttatgatggtaatatttgggctaaaaatttaaataacggcgtatgtttttactttactttacctatttggagcaaaaaaaatgaaaaatagaattttgattgtcgaagatgatccagaagtagctcgattaatacaaatgacattaagatccgcagattataagtatggcatagctagaaatggcaatacaacgctccaatttattccaatttttcaaccagatgtacttttacttgatctaatgttacccgatatggatgggatggacattattaagcaaatacgagctgccaacaataatatacctattattgttatttcagcacgtgatgaggacgccgacaaagtgcaggctctagatttgggtgctgatgattatttaacaaaacccttttctattgatgaattactggctagaattcgtgtttccttgagaaggactaacataatatataacaacggaaaaaccaatattaataattattgtaatggagaattgactatcaactttgattcacaaacggtcaaagtaaaccaaaatgaaatccatttaacaccaatcgaatataaggttttgattattcttgctgaaaacacttcccgcgtgttgacacaccgctatctgttgaaagaggtctgggggacagaatcggttgaagatacatcttctcttcgagtgaccattgcaactttgcgaaaaaagattgaagttaatactcagaatcagtatattaaaacacacattggagtcggttatcagatggttcaactagatagttaagaatagaagacccataatttatggtttcaatcagtatatcgtaaattatgaacttctttaaagtgatttcattatgatgtatatggcatagttgcttttcttcgtgtttaggcttactatttttcagtgccatatttcaagaaatgactttggaggcaagtaattatgaataagcaactagaacgtgtttcttttgcgggggcacttgttactttaggaattgtgtacggtgatattggcacttcaccattgtatgttatgaatgcattgattggtgacgccggtaaaatgggaaatatttctcccgattacgtgattggatcgatctcgttgattttttggacattaatgatcattacaacgttgaagtatgttgtcattgcaatgcaagccgataataagcgtgagggcggaatttttgctttatatgcattggttcgaaaaaattcaaaatggttaatttggccagccttgattggtggggcggccattttggccgatggaacattaactcctgcagtaactgtgacttcagccattgagggattaaaaaaacaacaccttggccctgtggtgtttagtaattctcaacataacgtcttgattatcacaacagttgttctactcgtattatttatgattcaacgttttggaacaggtgtgattgggaaatcctttggaccagtgatgattttatggtttggctttttggctgtctttggaatcgttaatctaatcaattatccaatgatattgaaggctatttctccttattatgcaattaggatactattcagtccagttaacaaagtgggaatctttatacttggaagtatctttttggcaaccacaggagcagaggctttatattccgatatgggtcacgttggcaagcagaatatttatgtaacatggccactagtatatagtaccctatttttaaattacttaggtcagggtgcttggataattagacatgcaggtgatactgcttacaggaacttatcgaacttaaatcccttttatgaaatgctccccggaacttggcgcctagttggcattttgctagccacactcgctgcaattattgcctctcaagcgttgattacgggttcttacactttagtcgatgaagcaattggcttaaaatttttacctagaatggttattagacatccaagtaatataaaaaatcaaatttatattgcaactgttaactggatactatgtataataacaattagtgtagtctggttctttggtagttcacaaaaaatggaggccgcgtatggtttagcgatcactattaccatgcttatgactactgtgcttttgcatgaattcttaaagaaacacctggctaagggaacagcacttataattgccttgttttttggttttattgagttaatctttctaatttcaagtttggttaagtttattcatggcggttatgttacgttaacaatcatgttgggcattctttatattatgtggctttggtactttggaaataaacgaagagaacattatgagaaagaaagcgagtatgtttcacttcttgactatcgtgatcaactctctaaattaagcgcagacaatacagtacctttgttcacgactaacttagtgtatatgactaaaattaagggtgattaccaaattaagcgtagtaccatgtattctattctcgacagacaacctaaaagagctaaagtttattggtttgttacagtcaatgaaaccaatgcaccttatgaaagtaattatacagttgatttacttgagacgcataatgttgttaacgttcaattttacttagggtttaggaaatctcaatccgttagtgtctatttacatcaagttgtaaatcatctagtggaacaaggtattttagaaccacaaatacccacgtattcaacagagcgacaacggaaagtcggcgactttaagtttgttattataaaggaacaaccagcagatttaattgtcaatgataagttaagctcgttagatagaagattgattggcgggcgcatctatttgcagaaaattacggcctcacctatttcatggtatggtttggagtttagcaatgtcatagaagaaagttctccgttatttattactcaagatcaggatcaatacttaatccaaaagaaaatttatcatcgaggcagattaagtaagactgaaaaatgagtatgcagtagtttaagtgcaacaactaagttagaaaaattatatttagttttaggtagattgtaaaattaaccttcaatgcatattaataatatttctaacgttcataatgagtttgaatcaatttattataataagaattataaatagtttatcgacagattttagagtttctattaacccgagccaatcaacgatgctgctaaaccggttcaggctggtaaaacagaggctactaattttgtagatcaatggttgcctcgaactgatgaaactgaccaacgacatatgacactgaggggcttattactattagccatgagtagtttgttataactcttcggaatgactcagcggcagtacaaagaataggatgatattatatggtaaatcatcagcaaattaagaaccagtttgagagcttaacaaccctacaagctattcagaaacaggcataccagatgttaatgcaagggctggccacaactggtttctcaatgcgtgagtggggaatattagtctatcttgaacaacacggacaagccactgctagtgaattagctgatgcgttcatggttacgcgcacactaatttccagaaacacttggcgactgattcaagataatttaattcaatcacaagtaaatcaaactgatcgacgaattgtgcggctaaccttgactactaatggccaagaaactgtccaaaggagcgttcggcaagtgcaagcaaatttaaaaactttcaaccaaagtcacgatttggagaagttgactaaacaagtggaaactttgtcacaacaactggctaagataaattaaaagtttttcaaagtaagtaaagcctgaataatctctacttttaaaatttgtatgatttggtccttttgagggccatcttttatcttttcagtcacttttgattgctgacaaaacttaactggtcactaaccgtcacattttgaggggttaggggctttatccagctgctgaaggcatgccaaataaacccctttaaaattctaaattttttaagccacgtttagttgctttagcctataattgttggatattcaggagaatccgcttgaaaagcccttgatacacgtgggtcgcacttaatttcaactgaattcgacgggccgtatggaccactttcccagccacttttaagagatacttgcgaatcgtttcaattcgaaaggcttgttgggccttaggaaaagttaggcgacgcattaaattgaccacgttgtacgccagctcactcattaaggtccgcaattcgttttttaacagcgtcgcactgtcagttttatccatcgcaaagccggttttagcttctttaatgaagttctccatcgtgccccgtcgccgataaatctgaaacacggcggccgctggtacggctgaacttaagttggtaatgacgaaggtgtagtcaaataacagctggccgggcgttaatttagcttcgacgcaaacgcggcgcgcggttggccagctttgggcctgataagtcagctcaaagtaaaccgtttgcggctgatcccagctgtgatcatcatactgaattcgcgcttccgcttgacgctccaagacggcattggtctttaagcgaatcacgtagttcatggcttgcgcttcacaaaaatcatagagttccggcgtcgcaaacccgctatcggcccgacagaaaaggtcggtcactggaaccgattgttggtaatgctcgattaatggccggataaactccacgacccccgtcgaagtatagacgttgcccggtcgcaatttaacctctaaaaaatcaccggtttgaccgtcaaaagccacgattggatgctgcccccagcagccgtaatgggaattgtaggccaccccttcctggtgaccgaaggcctcataataggttgaatccagatctaaaattagcgtttgttgattggtttgtcgacggccaagatcaagcagggcttggttagcgcaccgcatgccggctaaagttgccggggtcgcccgctttagcagggccgaaagtgaggactgttgggcaacctgcggtaaacagagttgaaaacccggatccttcgccaattgattggcggcgcaatccgcccgataacccgcaatgagttgcagcagccactgatgcagtaactgaccattgctatgctgccagtacttacgctgatcattaaagggtacctgcgccagcagttgatccaagtgagttttattaatgaattcttgaactaagactaagccgctatccgacgttaacgtgccaccagtatgcgaaacatcaattttagagttgaattgtaacggaattttcgataaagtcattagagaggactccttttgttggttttttctgataaatttaatttaacagatcggagtcattttttcacccaatgggtgaaaaaagccgctgcccaaatcattaatttgatcgggtcagcggcctctttttatttttttagagattatctgggtaaagatgccttaatgtaaataaagatcggtccgttaaaacccttggggttgagcaggccggtcttttgttgaagtgaagaaaatttaaacattaagattatttttggctcgtgacaataatcattttgtatacccaagtaattaatcgagcgttgcaagtggcaaagtttctcaccattaaaaaagcttagatatatttagatacaaattttttgacgttttgaatatgtgataattaaagtgtttaaatggaacgaaccaggtcacaacttaacagttgtggcctcttttttgatgctgtataattaaagggttagaaccgtgtcattacttaatgacataaataaggagagaaaaagatgaaatatggctatgcgcgggtcagtaccactgatcaaaaattagcaaatcaaattgagttactaaaattggcaggagcagaaaaaatctttcaagaaaagtttaccggcacaactaccgaacgaccggagtttcaaaaactgttgcgcgttctaaaaacaggcgatactttgattgttactaagttggatcggtttgcacggaacacgcgcgaggccttagccattatccaagagttgtttaaagaaaatgtcaaagtcaacattttgaatatgggcttaattgacaatacgccgactggccaattagtctttacaatatttagcgcctttgcgcagtttgaacgcgatatgattgtcacgcgcacacaagaaggtaaattgtatgccaagcaacatgatccgttgtttcgggaagggcgaccgaaaacgtattctgatgaacagatcagatttgcttatgagttgcgaaaacaaggcatgacttataagatgattgaacgaaagacggggattagtaaacgcacgcaacagcgacgatttaaattagttaaaaacaatatattttaaaactgtttacaccataccaaaaggggcttcgaatacgaggccccttttagatttagctagtaatccgtattaaagttaatggctagctcccagttcaactttttaatggcttacgatctgtcaacaaagcaattggtgacagaataaaaacaatcaccgctcctactaagtaggtatgactgaaggcctggctgatctgtcgattcttagtatgcttaatttttctcaaagctgtcgttaaagcttctttttgtgccaattgtttgagacctactaacaattttttctgaccctggcttattttctgattacccaaattaattttttgagaagctactgacagtttagatatagcggtattttgattttttaacttggttaaggtaagtgctagttgctggttacccgcttttaagttgtcagtagctagtgctaacttcttctgggcttggtagacctggtgaagatcagttcccttttggggctgtggtaaaccaacttgagatttgaccgcctgtttaagggcacgtcttaggctcgtctgtttatttttagttgttaatttggctgatccagtagtggaaaataggctgttcaattgttgatgagccactttatttacttttggtgataattgctgtcgatcaacaatttgaatggtatcttgatgcatatgctgcttagctgtattgacattattatcaaagaccattactagaattgcaattcctaaacaggtgccaatttgacgcgctgcattaacaattcctgaaacaatcccacttttatttttgggcaaatgcttaaccgagaccactaacgaaaccgaagagaacccaaaaccaacaccgttgatcactaggaaagtaatgataacagctttaggcgttgtggtggtgataaacgacaagagtagtaaactagctgctatgactaagaggccaatcaaagtaaccgaaactgcgccaacttgatcaaataacttagttcccaaagacatcgctaccatgattgtttctgtgggtatcgggtgtgaccgatgccttttttattttccattatatcaaaaggcggtccagtgagaatcttcggattctcactggaccgccttatttgtggagacttatgtcacagcctcttattttttcctactactgtcaacacgatcacctaagatcccaactaatacgccaataacaaccagaatataaccaactaaatcatgatatggaaaatcgtagtgattacttgcccacagtatgattaaaagaattacaactagggttgtgcgaagccaaaagctttttctcatactatttggctgccagtggtaatttaaagatgataaaagtcgatacagcgtaaataattaaaatcggaatcagtaacattccataggtgatgggccacgtcaaaacggtcattaaggtagtgccaacggtatttaaaattactaacgttttcctggttagtttaaatgaatgccacattaaaaaccaccagtataccaatgagataagcagtacaaagcttcccaattcagttaatgacaatttatattcctcctagacgttgcttatttgtattagcactatggaacataatttagacaggctctctaaattaatacgttttgattttataaacgccaaaacgattgatgtccatataaagtttactatgcggatgagcatctctcatattagtcaggtgatctgctatattgctaaaatagacagaaagggtaactccgactggtggagatacaagtgatccaaattcagcaatagcttgaccatttttgaattctgctatctctttatttactgctgtcttattgcgcatatacaccctaatcccccaccaaaaacgtttaatagttggatttgatgaagacttggccaacactacaccgaatgctgcacttgttgaagctccatatgtcttatcattagtcttgatagtatagccgttgcttttaatgtcagcattgacttgtgaaagctcatcttctatttctgtaaccatgctttgagaaacattattattttcagggagctgtaatacgtattgattattaacaacttttacatatggatcaagttgattaatttgattctcagtcaattgattattttctgaatctgataattttgctgtttcagttgtttgatcagcatcctttatgacattagtttgttttaactgggtagtatctgcagaagccctgcttgttggtatatatgtggcagttaaaattgcacttgccaatagaactaaccctaattttctgtttttcattgttcatcgacctcctaaagtagcaaaatcttagtctacgaattatataaaaatatttacaagcaaaccataagtcttatttttagtattttcaattataatactcatacgcgtggtgctagttaaatttagacagtaaaaaagcctgacggtgtacacttaaattaatatacagtaaagaagtgttaagcatatcagactagtttaagccttatcagccgagaatgagtgatgttgatattgctgaagtacgtgattaagccggccaaaaccattgcattaattatttaataaattgtttatttgtttgtctgctaatgatataattaagctagatggaggaggtatcaagatgaagattattacttttactgctatcaagggtggtgttggtaaaacaaccttgactttaaattatggtgattggttagccaaacatggtaagaaggttctattaatcgatttagaccatcagtgcaatttaacaaccgtttttgaaaagacacgacgaaacaataccatcgctgaagcgtttaaagaaaatgacaatgctcaaaaagtaaaaattgacagtgtcggaccgaatctagatttaatagccggttttatagacctagatgttttaggaagttatctagaaaataacagtaacaaagaaatgatgttgttcatgtggtttaaaaacaactccgattcattaagcttaaccgactatgactatatcttaattgatacgcacccagattttagcaccattactaaaaacgctattgctatcagtaattacctgcttagtcccattacacccagtgaacatggctacaatgccaagtttgacctagaaacacgactcgaaaaattcagaaaatcactttttgattatcgaactggcgaaacttacgttgacgcaaagcttttctttatcggtaatatgattagacataatacaagcatgtctcgcgatttgctaaaacacatagaaggcgatgaaacagtcgcaactataattcctgaaagagagctctttaataaagctactgcaaggcacgcttcaatatttgaattagccaatcatgatgaatccattttaaagcaaaatcaaaagttcatagaacacgccgatcatctttttcaagaattagcaaataaaaccaagtaaggagagttagattatgagtttagattcattcaatcataaaaaagacgaagaaatgagagaaagttacgaaactacattgaaagacaacaagaaagatgcagtcgcatttttgaaaaatatcagccgaaaggaagtagagcgtaagcgatcagttaccttctcaattactgaaagccaactaaaaaaaatggatacggctgcccgaaaaaacggatttaaaaatcgttcagaattcttagcttcaatcatagacgcaatttagtaattaaataaataattaatcaaacaagtaaacatacaatttatttgtttgattaatttgtgcttaggtaaaagctagtaaagtgcactgaaccaaatacggttgcctgtaagtaagcgctatgctagactaagattaatttaacaaccaaataaagagatcaagctaaacagaaaaatccccgattcacgaggaatcgaggattttaggtttagcaagtagctaatagagagctacttagattcagacaatttagaccgccaagttaaaatcgtctgaacattgttcttaatttgtaggttaattataccgcaaaccagtcctatgggacaagtgaaggatagttaaaaacaaattaaattcaatggactaagtagctaaccaatgctatttagtccatttttgttgttagaaattaaaaaaagttgccgtataggcaacccagaatagacacatgccggtgaatttacaaagccgatcacgtccaatgttcgctttgtaattcagttaaagcatatcagatttgtattttaaaacaagtcagatgttttagcaactctcttttaagacggcctgtgtcagttaagaaagggagcttttattatggatcaatcaaactttaactttacaaatgctaaaagagcctatgaagtaaagttctacgctttgccgcagatcttactccaaggagaaaaatataaggatcttagcgatagtgccattttactttattcggtgttacgcgatcgtctaagttactcactaagcaataattgggttgacgaaaataacaacgtatatttcatatacacaaacaatgaactaaaagatttacgaaactggtcaaataataaaatcaataagattaaacacgaattaatggacgcaaaccttttgtatcaaaaacatatgggttttaatccaaaatcaggcaaaaacgaaccaaatagattatatttggcagatttggaagtaacagcaaaagacgtttatattaagcgagagccaataaaatcgcctgaatcccttggtgcaagcggacttctcaaaaagagaaacccgcatgataccgttgaaccccttggtacaagcggacttctcaaaaagagaaacccgcatgataccgtttctgatacgcctgaatcccttggtacaagcggacttctcaaaaagagacaagatctagactatactaataatttagatactaatagatataatatagatactcaaaagttggacttttccacagcccaattctcaccagcagaactagaaaagcaaaacaaggatttggtgaaccatgctaatgatttcttaactgataaagacagtgggttaccagttttcttagaacccgaagctgtgcaattacttagtttctggtgccgaaccccacaacaaatgcgtcgcttcatcggcattatcttaaatgctaagtaccgagttgagaaggatcatcaggatattggggtcctaatcccacttgatgatgaggagctgaagcctttaatgaccaaagccttgagacgctactttaacgctcttagaagcaatgagaagcacattaagaacgttgaaaactacttgtacggcaccatgcaaaacctatttggggtttggtggaataaacaagcggctagagaatatgcggccaaacaccccgaagagcaaaacgctgacaatgagcgcttttagaattaaacagcatataagctcatctaagccgttttaagtgttcgacacataattatgttaaaactggtttaaaaacgtttagaagctgaaataggtgccttaaatagctgaataggcgataactaatctagaaagatgggaaagagttttttaaatgaccaaaccaagcaaagaagtcgaaaaaatagagcaattgttggctgacccctggacagtcaatattcaaggcatttgggaacaagcagcacataatccagaccctgataagcgcaagttgtttgacgcgttacacacttacctcttagataaacggcaagaaaaaattatcaacgaaaagcatttcgtgatttaacatggacgagtcaatgaatcagtggttggaatgaaaaggaggtacaaaatatgactaagacacaatcatatatggacaagtatcaatttacagttgcagaaaacaaacggtttgctcgaacaaattttaccaagctagtgcacactaatgcccgctttgaaggcgtaaataccactttgccgcaaacacaaaccattatggacggcatgagtgtggcaggcgttcctgttgaagatattttgacaattgttaacttaaagcgtgggtggcaatatatcactgatcaaaatgcccctttaacgttaaccatggaaaaacaaattaacaagattgtggccgcggaagacgccttagtaccaggagaattacggcaaggaaaaggaggagttgatttaggcagtgaagacttttttgaaccacccttaattaacgaaaaacaagaacaatcctttttacaaaaaattttggctgatccgcaaacaacgaccactgataaagcattgactgttatgtatcataatatgcgccaacaaatcttttgggacgggaacaaaaggacggcgactttaagtgctaataaaattatgattgacggtggtgcaggcttaatcaatgtgccgttagataagtgggatcaatggaacgaactaattgccaattattatcgaactaatgacatggctaaaattaaacggtggacatatgacaatggcattcaaggattacaaattagagcaaacttagagcttaaatcagttgaagacgaaattggtaaaagaatccaagaacaattaaaagattttgcggatcaaaactcagaaattaagccaaaaaatgatccagaaaataaaaacgatcggcctagttattaggttgatcgtttttgagcttattcggcttatgggcattaacgtaatcggcaaatgtttttaaaagctcttcggtttgttcgaccgaaaggttatcagcttgaaaatatttttcaagcaaagcccctttttgaattaatcggcgagaacgggctttgcgggcttgccgattttcatagtatttagattgccgtaatttaaaatcttcccgctcaattttttgttttaaacgcgcttgctgctcgactagtttttcatattgattagacatggaatttccccatctcgtatggctaatgatctacggactttacctttaaaaattcagaaaattgcttggctaaaagcttaatctgatcgttagacaaattagcataatctaaattggcttgactgatgatttgtttacctagccgttgttcaatcttatttttttcgtccttaattttttgattaagggcttttaatttagcttcttgtttttctaagttactttgagacataacgatccctccaatcatattagaaataatcaccgaaactatatcatataggaaacgttaagtcaaagtataaaagttgaaatagcgaagcggaaggcatacactaaattaaagttaagataatcagaagaccgagtgaaaagaggtcaatgcgcacttacaccccaccaaattcttgtggggttaatcgtgataaaatcctgtattagaagtcgccgatggcgacaacaaggtcaaaacccatagaatcaaaggaagacggtgactgacatggcaatattccacataagttttagtaatattagtgctggtaaaggacgcagtgccattgccagtgccgcttatcgaagtggtgaaaaattatttgatgataaggaaggtcgccactatttctatgcccgatctgtcatgccagagagttttattttaactcctaaaaatgcgccagcatgggcgagtgatagagaacaattatggaatgaggtcgaaagaaaagatcgacgagcaaattcacggtacgcgaaagaatttaatgtagctttaccagttgaactaatcgaagatgaacagaaagaattattgacaaaatatgttcaagaaaattttgttgatgagggcatggtagccgacgtggcaattcatcgcgaccacccagataatccgcacgctcatgtgatgttaactaatcggccgtttaattcagatggaacatgggaaattaagagcaaaaagcaatatattttagatgataatggcaacaaaacatataccggaactagcaagtaccctaagagtagaaagatactgatggtcgattgggataaaaaagaaaaaataactgaatggcggcacaattgggcggttagtgtaaatcaagttttagagcaaaaaaatattcccgatcggatcagcgaaaaatcatttatcgaggagggaatagatgataccccaatgcaacatgagggaatcaatagtaagcggcatgaaagaaaagaatttaaccaacaagttaagaaatatcgtaagaccaaagcgaattataaaaacaatcaagaaaaagtaattaatcgaggtcacttggatagcctaagtaaacacttctcgtttaacgagaaaaaagtggtcaaagagttaagccacgaactgaaaacttatatcactttggagagtttagatgataaacggcgcatgctatttaattggaaaaacagtaccttaattaagcacgctgttggtgaagatgtcactaagcaattattgacgattaaccaacaagaaagttcactaaaaaaagcagatgaactcttaaataaagtagttgatcgcacgactaaaaaactttatccagagcttgattttgaacagacaaccgcggctgaacgacgggaattgattaaagaaactaatagtgaacaaacgattttcaaaggcagtgaattaaacgaacgtttaatgaatattcgtgatgatttattggtccgacaattattgacctttaccaaacggccatacgttggctggaagttattaatgcaacaagaaaaggaagtcaaaatcgagcttaaatatacgctgatgattcatgatgatagcttagaaagtctagaacacgttgatcaaggtctactagaaaagtattcaccaaccgagcagcaaaagattactcgcgcagtcaaagatttacgaacaatcatggctgttaagcaagttattcaaacccaataccaggaagttttaagaagggcctttcccaaaggcgatttagatggattgccattgattaaacaggaacaagcctatacagccgtgatgtactatgatcctgttttaaagccatgtcaggctgaaacaattgaacagtggcaagcaaatccaccacaggtgttcagtccccaagaacatcaacaaggactagcttatttatcgggacagcttagcttagatcagttagaaaatcatcacttacaacgggttttaaagcatgatggcactaaacaactcttttttggcgaatgcaaagccgatccgacgattaagaacagtcagatcgagaaaatccaaaagcagttaaaagggcaacaagccaaggacgaccagtacagaaaagaaaatatcggacattatcaaccgctaaattacaagccagttagtccagactattacttaaagacggcctttagtgacgcgatcatgactgttctatatgctcgtgatgaagattaccaacgacaaagacaggcgcaaggtttaaaggagactgagtgggaaatgacgaaaaagcaacggcaacaccaaactcgaaaccggcatgaagatgggggcatgcacttgtaatcacaaaattagcgactggttaattggtatgaatggtagcccataatgtattttatattgagaaaaatttggtacgtagagcgtgctcgattagttacgtatagctgccagccttgtgtatggtctatcaaagagaccaggtaaacaaaacctttaagccgaaaccttattttgaactaaatgctgaaattcttgctaattagcaagaattcgtcgcaaaattagacccctatcagcgatttaaagacgaaacagggctaataacattcatgcaagctaaacacgttcagaaaggctcacaggccggtttaatcaaggacgtccaaaagcaaggcaaaaaacgagctagtccacaactattctcgctatctagtctccaaagtgccatgaataaacggtatcacgccagcgccagccaaaccttagcggctattcaaagcttatacgaagacaaactgctcagttgttatccccgcaccgattgtgcttatatcactgatgaagaatttggttatttagtggctaatctgacgaagtatctggggttagtctctaagccagtcgctttaaccaataccaccccgaataaacgctatgttaatggaaaaaaggttgaagaacactacgccattatcatgactaaaatcgtcccgactaaagatcaattagctgccttacctaaattacagcaacaagtcggttctgttgcaaagttttcaaaaaaatctattttagtgtaaaattgagaaaaaagacagagaggacagagtaatgaatcattttaaaggcaaacaattcaaaaaagacgtcattattgtcgct

SEQ ID NO: 33 - DNA, 2916 bp, Unknown
  Metagenome-assembled genome
tcttatactttgcctgcagttcgcgtcttttaactaggttgttcactgaagatgtttaaaaatctaaaacagcaaatacgcccttgggactacataatcatttttatactacttgtcgtttcttttatccccttgattatatttggatactctcagaagcaacagatgaccaccgcgactaataatgctaaaccaaccacctatgctgaaatttctgttgacaaaaaagtaataaagaaaattaagctctctcgcaaaacacaacaccaattatttacattacacccacaccccggtgaatataatattatagaagttaatggaacacgtatacgcgataaggaagataatacacctgatcaaattgccgttaatactggttggatcagtaaaccgggacaacaaagtatttgtctacctcaccgtctgatcataacaatcaaaagtagtaataataccaacactcaagataactcacttgtaaggccatgatcaaaatactatgtaatcatgattaatcattttaaaaagcaatcataattctcaaagtcgggaattgtgattgctttttattacacgctgattattattaccaattatgagatgcagtcttataagtcatttaactgcggaaataagaattcaagcacatctgcagttactctatgcttttggcccttataagggtaacagtgcatatccatcattggattatagttggcctcaataatcgaataggactcgtgatcagaaacgggtactgatctatcaggaataatcaaatcaattccgcatatttttgcacctaaacattttacagcagcagcagctttttctttgtaggtaaaatcaatttgatcagttacatcaacagagtccccaccagaactaatattcgaatttttcctaagatagatacgctgaccactcatcggaattgaatcaaccgtaaactgctgactttttaatgtcatttgttcgaccatccctaaagaaatcttagtaagcggtgttcgatcattcaaaccacgcaagacgctctgatttttgattgcaactaattgttttaccgtatggtgtccatcaccagtaacattagcgggaattcgtaataagaccgcttttaccttatcatcaattactaaaaaccgatactcaggtccagcaatgaagctctcaactagtacggtcgaacactcggcaaatgcgcgtcgaatcgcttgcgaataatcaaccagcgatggagaaagtttaaacacggtaacacctctaccgtaattagccgactgcggcttgatcacaattggattgcccataaatctcggataagccgctaaagccatattcatgctaataaattcaactccggctggagcattaaaacctgacgtggtcaaaatttttttggtagctgtcttattcttcatgatcagcggcacaatataactatctcggcttgtcatatttccattcttgacatattcaatttggtgactcaactgtagctttaataactgatcattttcatcgatcacatctactgtaatacctttttgaatggcatcaaacattaaaatttgtgttgatagttccatattagtaaaaccatttagctgatatggaatctgcgtaataaccttacgattctctaatccgttggctgttgcaaaaactgattggttaatagtcattagttgcttcaccattcggccactaatcgtttttgcaacatctgtcaatccatttttggcctgctgtagtaccctttcatagccttttaaatccaactgttgtgccattcttttcattaaatcaattattttaaggccgtttgttcgataacgagttggcgtcaatggtgactcaagtgccacctcattattgatttgatcaccggccattatccaatcattactagtttccttttcgtccgtccaaagcatgaacaacataaatagttccagaaatacgatttgattttcactaaccccataacgttcaaacggattgatatcaatattccttaattccaaataatcaacgctcgcttgttggtcaattgtctgttcgcttctacgtaacctaattggtgaatagaactctttttccttaatcaaatgaccttcacgtatttgcgtttctatatcggcaaaataagtttgtaaagattcaaatgatacttgaacattgtttttattacaatagccaaacttactatttctgatactccgtacttccgtttgtggttgctcatcatttgattcaaaataattggattcagcaacaggactggcaccaaatagataggtaattaaccagcggtaatgaaggtagttacgcgccgttttaagatagagtatatttttaaagcatttaaaatcagttacctcactttggtgctgatacagttcttcgaccaatacagtcggaaattcaaagttaaaatgtagcccactaatcatctgtttacgtcgaccatatattctagccaagtagcggcgatataaaacaccttgaaaatcaggcaatttggctaacttaatctcatcatcgcggattggaagctccggtggcatactgagtggccacaacatttcatttgctggcattgattgataggtaacatcatgtaaagcagctaaccaacgaaataaatcattcactgtattcactactggcgttacaatttctaattgagtctcagcaaaatcggtacggatataaggatggaattggcggctaccaagtacgtttggatgatttgtaacggctaattttccgttcaggcttacgcgttgactttctcgttccacaccaattcttgaatgtgatattgcggctatgttttgcgcctgctgcaataattcgctaaaaatcatacactactcgcttctctctttttctaattttattttt

SEQ ID NO: 34 - DNA, 5056 bp, Unknown
  Metagenome-assembled genome
cgaagaaatggaacgctcttcggcttttcggtgtctactgaaatcaaggtattaatgggaataacagcctaagatatttggagttcagagagggctcgtttgattttcaaacttcgcaacagaaccacattgcaattaagcggagtaaattgtataataaaaaatatatgaatagctgggttgtggctagctaaaaaacgccgactaatgaattttttcatttttgtcgttttttttcgttataaaaaaaaaggtaggtgtaatttaatgggatatatatttttggggctcgcgattctaggtgaactcttgggaacgaatttgttaaaagcttcaaacggattcagttcgctttgggaaactgtggggtctttagtttcatacggtgcaagtttttattttttagcattagctatgaaaactataaacttgaatgttgcttacgctttatgggctggcttaggaattgtattgacaactgttttggcagtagtcgtttggaaagaatctattaatctgagcagcgtcttaggaattgtattaattttgtcaggagttgtcgttttaaacttgtatggtcctggtcattaaaccaaaataaaaaacgactagctgtataaatattataataaacaaaaggcacctggtgtgtctttttattatgcttagaatataaatatttgaaaacgggttaattaattgaaatatttgatataatagtgagtaatttgattgctaaaagcctttgcgtagacgttccaaaaacgtgtacgtccgatttacttttagtgaaagaaaatgaaagaattcctgcagatggccttatattaagtgaagcgttcgttgatgagtcaatgattactggtgaaagccgagcagtcaataaaaaaacaaatgaccttgtttatggtggttccctcaatcaaaaccaaccatttgagatgaaagtcacaacccttggaaaagattcatttctcaatcaagtggccgaattagtcaagaaagcccaagctcaaaaatctaatttggaaaatatggctgacagagtggctggttaccttttctatgctgcacttattgtcggtatcttctcattaattttttggacaattagttctaactttagttttgctcttcttcttgcggtttctgtttttgtaattgcatgtctgaaggcggccaccggatgttaccacttgtgccatgaatgttgccacccttggtcaccgaagttaccaccaagtgccagcatgttaccatttagaaatcaataaaccttcgatatactttgaatacgcatgtagtaagcgcgtacatcaaatatatcggaggtttttgttatggcgattcagtttcgcaagatcttggaacttgccccagatcatagccaacgcagcattgccgcaagcactgggcattcccgccgcaagataaaggaggtaatcgaacgggctaagcaaattgaacttacgctgccaattgacccagcgttgactgatgcacaactgggcagaatcttatttccggagcttttacctgaaacaaccggacgtgagatacccaattttgagtatatgcatgaggaactaggcaagaagaacgtcaccctgtccttgttgtactatgagtatcaaactagttgccgagactctggcaagataccatattcgtatcgctcttactgtcggatgtatacaacgtttgcacagaagtacaaagcaacgatgcgtattcgtcgcaaacccggtgagctaatggaagtggattgggccggttccaccttgacggtgattgacgcagatactggtgagaaactaactgcatacctttatcttgcagttcttccgagcagtcaatatggctattgtgaggccttcttgagcatgaccatgccagactggattcgtggtcacgtgcatgcgtatgaatacttcggtggcgttaccgagattctcgtctcagacaacctgaagacaggtgtcagcagtcacacgaaatttgatcctgtcctaaatccagtttatcgagatatggcagaacactacggtactgtcgtcatgccagcacgagtacgccggccaaaagataaaccaaaggtcgaaggcacagttaaggcactttcgacatgggtgatcgcagccttgaggaaccaacggttcttcacgttagacgaattaaatcaggccgtttggtcgaagttgcgggactttaaccaacggccatttactaagacatataaagcatgccgaaatcgagaagaaggtttcaatacagaagaaaagtttgcccttcatcaacttccggccacaccgtttgagatggcagcatggaaaatcgctaccgtacaaccagactaccacatcttagtggatcggatgttttattcagtgccatttcaatatattggcagtcaagtcgatgttcgcctgacgagtaccttaatcgaggtcttcttcaaggatagccggattgcctcacatgcaagactatatggtcgcagagaacaattctcgaccaatcaagagcatatgcctgaggcgcataagctgtacgtttcacatacaccagaatcaagccgtaactgggcactttcagttggcgaacacgtcaacactgtcgtcgattatcttcttaatcacatgcctgaacgccaagcgttgcataaaattttgagtcttcaaaaacttggcaagaaatatggagcaagtcaactggaagaagcatgtgcggaagttgaaaaggtcgctcaagtcccaacagtgcggatcattgagcgggttctgattaatcgcaagaagacctcttcaactacgcagatagaaaagcagtcaacagaagactacggtttcacccgtggtgcagaatactttgggaggatcactaatgatcaatcaagaaacgactagaaagttacacgaaatgcgactcacgtcgatgatcgaagcactatcatcacaggaacataacgagaacattcgtcagatgagctttgaagaccgcctcgagttactcgttgatattgcctacaacactcgacaaaacaacaaactggagcggttgatcaaagatgctgggtttagcacaaccgcgccttctattagcaacatagactatcaaccagatcgacaactgaatcaagatgtcattaacaagctggcgacaggcgcctacatcaaagcccatcacaatgtgctgattatgggtgcttccggaaatggtaagacttggttagcaacggcattgggaatcgcagcttgtaggcaattctataaggttaggtatgtccgtttgccggagttacttgacgacctattggtcgctaaaaacgaagtaaatggtgacttcaagaaaatcctagtaaaatatggcaagtatgatctcttgattattgatgaatggctattgacgccagtttcccaggagcaagccaccttcatccttgaattgatggaacgtcgagcaggccaacgggctacgatcttctgttcacagttcgggccgatggcctggcatgaaaagcttggacaatcacagattgcggatgccatcttggatcgaatcgtgcacacggcgtatcacattgaaattgatggaaagaagtctatgcgtgaacgatatggaattggaggccaattatgatctcagaagcagttcaacgtcgcgtcgccagctactacatggaaagcaagctgactgaggaacaattaaatgaactcgaaagtgcactcgtagacgcaatctggtttagtgacgagcacatcagcgaagatgagctcgtcagaatcggcgtaaagctgatcaataaattcttagaggaagatgccgaaaagccatagaatgaacggtgcccaccgacgatacttgccggtgggcattcttgtggtaactttgatggcaatgagtggtaacatccatgaccgaaggtggcaacatgtttggcagaggtggtaacatccggtggccgccttcatgtccacacgctttaggtcttgcggttccacttgttgtttctcgcttaaccagtatttctgctaaaaatggtttattaattcagaacagaacctctttggaaaaaataaatacaattaaatatgccttaatggataaaacaggaacattaactgacggtaattttattgtccgtaatgttattaattttactgatgaaacagacattctccaaatcatggcagcacttgaaggaagttccactcacccgattgctcaatcaatcgtttcagctgctaaacctcttgaaaatctaaaagttgaagcggttgaaaatattccaggagttggaattaaagggcaagttaatcaaaacttttatcaaattgttaactataaatatcttcgtgaaaatcaactttcttatgatgaacaaaagattgctcaatatttagatttaggtttaactgtatctttcctaatcaatgaacaacaagatgttttaggatttattgccttaggagattctcctaaagcagacgcgaaagcctttattaatggtttattagcccaaggaattacccctgttatgctcacgggtgataataaagaaactgctcaaaaaattgctagtgcactaaatattcccgaatttagagcggaattaaaacctgaagataaagcagaaattgtgaaagaataccaaaagaaagccggcgttcttttcattggtgatggtgtcaatgattccccagctcttgcaactgctacgattggttttgcgattggagcaggaacttcggttgctatcagtaccgctgatgtcgtcctagttaactccaatccaagtgacgtcctggatatgattaatatctccaaacgtatgcttagaaaaatgaaacaaaacctctggtttggagcaggctataacatcattgctattcctgttgcagcgggtattctttatccatttacagggattggttctgttgcgaagtttgaaaatcaaacgagccctctctgaactccaaatatcttaggctgttattcccattaataccttgatttcagtagacaccgaaaagccgaagagcgttccatttcttcg

SEQ ID NO: 35 - DNA, 3899 bp, Unknown
  Metagenome-assembled genome
tataaatagccccattaatccaagttcttcgttcttgctcccgtccccccggcgaggatcaattagcgtggaacttggggtaccattactgattgaatttgctggtttgttccataagtgagattgtgtctgtgaaaacagagacacgggtgtccgcaagtcgccgggactggtccaagtgcacagctctttacagccaacgttaaaatgtgatatgctgagggccactttcatttgaccattggaatttcgctacccatttccgctgataatgtcagcatttgcacctgttcaccgggttcgagaaagttaccaacttcgtattcaacataacctttggcaaaccagataattctggcgtttcggcgttctggggccatccagtatttgggctcgtcgactttaccaatgaagccgtttaagtcagctaacccacaggttggttcaatctggaaatcggtatataggccaacggggatgtctaccttatgcgaacttaacgaagatgcctggacttggcttggaaactggatcttaatatcatcgaccgttaaatgcgaaatcttactttttccttctttagtgaatttaagcagacccgcggcctttagttgattgacgtgtcggagagtgatcgtttggctgattcccaactttgccgataattctttaatactgtatggtctggctgccaacagacgaatgatttttaatcttgctggactcgaaagggctttataaacgggtaaggaatgatcattcatatctaataacatagaaataacacctaatcttttagttgttttagtaacatcatataacttaaaggtgtaaatatgcaacctgattagtttttatctccctttaaaacaaactgcttagttattcgaaggtcgatatttctaaaataatacactgattagcattgaaagcgttatcagcaccccatataataaaaatgtacacaggatataagaccttataaaatataatttatctaaggagactgattagtgatgaaatcaacttacagttacgatacgctttttccgattggcaatattgatccaaaagtttggagctcgtttactgaacatttaggccgttcaatttacggtggcatttatgatccggacaagccgttttcggatcaaaatggctttcgcaacgatgttaaaacagccgttaaagatttaaaccttggggtcatccgatatcctggcggcaactttgtttccaattatgactggaaagatggcattggccctaagaaggatcgcaagaagcggatggacttcgcttggtcgaccgttgaacctaatcaatttggtatcgatgacttttgcacctgggcaaaggaagttggtgttgagccaatgatcgcggttaacttgggcaccggctcgattaagagtgccgccgaattagttgaatactgtaatcatgattctggaacttactggagtgatctgcgaattaaaaatggccatcgagaaccatacaacattaagtattggtgtttaggtaacgaaatggaaggcgattggcaagccgggcatatgagcgcttcccaatacgctgacaaagcccgtgaggccgccaaaatgatgaagtgggtcgattccgatattaagctggtggcctgtgggagtagttatgaaatgttaccaacctatctcaaatgggatgagaccattatgaagcagctatacccatacgttgattacatctcaactcataattacaatatgaattccggccaaggcactcaaaacttcttggcttcttggaaacagctggatgaccacattcaaaatacgaagaacgtgctgaactattcgaagtcactgcaaccgaagttcaaggataaagatattaagatttgtcttgatgagtggaatgtttggaacatgcaggatatcaagatggatagcttggatgatttgaatgggatgaccacctttgaattaactgatgctaagaaatgggaagagcatccagcaattttacaggaaaagtactccttacttgatgccttggttgtgggtggcttaggaattacgattttgaataatgtggatgcggttgaaattgcttgtttagcgcagttacttaacgttatttcgcccattacaacggatgaagatggtcatttactcaagcaaaccatttattatccattccagttattaacggaatacgggcgtggtgaagttttgaagccacacattgaaagtgacacgcaatcaaccgactatggtgacattccggtagttgaaaccgctacggtgtatgacaaagccaaccaacaattacatgtatttgccttaaattcagatactaagcagtcatctacgctcgcccttcatttgaccggatttaaatcaatcaacttaactgaacacattacctttaccggtgacgatttgaaagcaattaatacgtttgaaaatcctaataatgtcataccaactaaactatcaacggaaaatgaaagccttgataacttaaccttaccaaaagcttcctggaacgttttgacatttgatgttgctgaataagccggtcactagaaaggtgatgtaatgaatggacgctacacatcaaaaagcagtttcatttaaagaaaatcttggctttaaagattatgttggctttggatttggcgatatggcgattaatttcacctttgcttcgttaggcatgttcgttgtctttttttacactgacgtgattggaatttcggcaggaattattggaactttaatgttattttcccgttcgtttgacgggattatcgatgtggttgtcggcggtttagtcgataaaacgcatagccgttggggtaaaacccgaccctggttactatttggggccttaccctttgcaattctgacaatttcaatttttgctgtgccagccggctggtcggaagttgccaaaatcgtttatatcttcctatcctataatttgttgatgattgccttctcgtccattgcaattccttatgggacgttgaattcattggtgacgcgggatcaacatcagcgtgagaaatttaacctgtttcggatgttcatggcccaagtcggggttctaattgtgactaacgcgacgatgccaatggttgatttctttggtaataagcagttaagttgggtaatcacttatacgattctgtcagcaatttcagtgctattgtttatggtcgtttttaaatcacaaaaggaacgggttcaagttgttgcagctaagaagattccactcaaagtgagtctcaatgcgattttcaagaataagtattggtggatcgcaacagttttcttcattatatatagtattggctatgctttaaatcaggggagtacgatttattatgcaaagtatgtactgcataacgattccttggttggcgtgttgacgattggttacttggcaccagtcctaatcggctttatcttcgtttcccatctgtttgttagatatgggaagactaaagtgatgctttggggatccatcttaagtatccttggttatctgttcacattgatctcacctgataattttgcggttgttatgacttcccaaattattaaaggggttggccaagtcccaattctcggtggggtttgggcaatgttcccagatacgattgaatatggtgagtggaagactcacgttcgagttgaaggcttgctgtacagtggtggcagccttggtcaaaaggttggtgttggtcttggaactgctttaaccggctgggttctagcctggggtcattataatggcgctttatcagcccaaccatccagtgccatgaactcaatctaccaactctttatctatattccaattgtcatttacattttacaaattgtgttattgctcatgtacaatct

SEQ ID NO: 36 - DNA, 3844 bp, Unknown
  Metagenome-assembled genome
atcattgccataatcttgaacatgaagagaccggaatgatgggccaaattcaagttgtgccgtaacggtcacttaattcgcttaatgaaattacgccaagtctgcttaatgctgtcaagttgttgtggtggaattaaacccagcatcatgatgaatagtagcagtgggcagaagataattagaagaattgttgctagcatccacatatttgttcacttctttttctttttgataattatgccagagatgtatggagattatgtgcaaaatatatggagatgaaaaaatttgactaaaattttagttgtcgatgatgaaaagaaaattgtagatatagttaccgcctatttaatcgcacaaaaatttgaagttgaggtggcctactcgggaacggaagctttgaccaagttttataaatggcagcctaacctggtggtgcttgatcttatgctaccagatttagatggtaatgaagtgaccagaagaatacggcaagatagtaaaacaccgataattatgttgacggcaaaatcaagtgatgaaagtattgttaacggattgcaatctggcgccgatgactatgtagttaagccttttagtccacgagtggtagtagaacggataaaaaccgtactacgacgtgtcacagaagaacaagcggaaaaagttctctcctttaacaatggacagttaaaaatcaaattagaatcgcaacaagtttttgtccatgatatggagattgcactgacgcatacagaatatgatattcttgcaacaatggcgaactattatcgacaaatatttacccgtgaacagttaatcgatttaactagaggaattgactatgacggactagatcggatgattgattctcatattaaaaatttacgacgaaaaattgaaagtgataatactaagccggtttatataataacggttcatggccgaggctaccgttttggtgggagtaaagatgaatgaaacgacagattcggacacagctaataatctcttttatatttttggtgttattgatcgtaggttcaattagtttaatgaccatgagtttagttagtgatcattttgacaaatatgtgcagaaaaaacatgatacaacgctcaccgcatataaaaacgaattaaaggttagttatctgatcaacaatggtacttggaaaccggccaaagttaaaaagatcggtgttagagcattgcaagatggtcttattttggttttgaaaaatactgacaataaaataatatgggaaccaagtcaaaccttgttacatagggctactaataccaaaaatatagatagtatgaacaaaaaaaatggagctatcaagattaattccaaaaaagtcgccctagtacaattctcacataatgatgctttagggtatacacgacatgatgtcgcatttatcaatgatttacgaattagtttggccggtatttcaatctttgtatttttagttgcaatagtcattgcagtatggatagctcgtgatctaagtagaccgttacgacaaattgtatcctttactcaggcggtagcgtctggggattatcgaaaccagttaccgcaacaaacacaaatcgtagaggtaaatgcgctagtaaatgtaactaacgaactttcacgccagttatccaagaatcaggcgctacgggagcgtttgtcttccgatattgctcatgaattacgcacgccattaacaacgattcagggttcgctagaagcgatgatcgatggaatctggccaattgatgaggcaagattggttagtttaaatgatgaagttatacggttgacccacttgatcaataatattgaaaatattgcttcaattgaacatcgcgaggataagttaatcaaagttgatactgatcttagtaaattgatacagcaggttttaaataattttcaaagtaatcttgaggagaaaagaataacgcttgattaccagacggaaaaaatcatcgttgcaattgacccaaataaaataaatcaggttattaccaatttattgtcaaacgccataaaatttacacaaacaaagggcaaaataataattaagttaaaacgtgtagcagataatgttgttttaactattgaagacaacggtagtggaattgcagaaaaggatgtcccacatgtatttgatcatttctatatggctgatccagcacgaaatcgccaacaaggcggccaagggattggtttagcaattgttaaagcaatcgtggtggctcatggtggctcagtttctgtggacagtgaattaggtgttgggactatttttacagttaaactaccattgaataattaggagggaatgatcatatgggagcactaaacccgatcgcgtttaaattaggaccttttctggttcattggtacggtattattattgcaagtggggcagtacttggtgtgctgcttgcaattaacgaaactaagcgacaaaggatttctgcagatgacatttatgatttagtattctgggcattgccaattggatttattggcgcacgaatctattatgtcatttttgaatggcagtattattcacaacatttaaatgagatcattgcgatttggcaagggggtattgccatttatggtggcctaattgctggtgggattacattgatcgtcttctgtcggcagcgtagcttatcagtttggcaggtcctagatgttgttacgccaggcattatgttaggtcaagttattggaagatggggtaactttgttaaccaggaggcctttgggtctgctgtttcacgcagttttttgcagcagttacacttgcctaactttatcgtgcaacagatgtacattggcggtgcatatcatcaaccaacttttttatatgaatcagtatggaattttgttggcttgatcttactccttagtttacggcataaaagaggtctgtttaaacggggagaaattgcgttaagttatgcgatttggtattcatttggtcgattttttgttgaaggaatgcgaactgatagcttgtatctatttggccaagtacgtgtgtcacaattattatcattgattgttttcattgtgatgctcagtatctttgtttatcgacggaaacagcaaaaagcttctaattatttaattgattaattaataatgtaaaagaaagcgaggctaaattatgattaatctgtattttcatactagtgatccggcaaaacgaaaaatgctcgattggtttcatgatcaaaaaattgatgtacagatccgtaatattatgcaaaagcgattaactgaattggaaattaggcacttgtttttgctatccgataatggtagcgatgatttgattgcaatacgttcgaaggctgttcaagaacacgtttttgataagggtctaacatttaatcaattagtgattgcggtatatcagcaccccaaaattttaaagaacccgattgtgtttaatgaacaaagcctggttacgggattcagtattgaggatatcggtgtttttgtaccatcaaaacagcggaagcgtgagcgattgtcattatttggtaaattatatactgcagaatttggtaaagtttcttgaattgaccagggctttacaacagaataaatttttttgctttttgtgtttacatttgtaaacttaagaggtatgatatttgcatcgtttacaagtgtaaacacaagggagtgatgaacctgaatgaaattgacggtcacaatggaaaagcttataaatgcttcaacgtaattaactgtaattgcttgtttaataaaaagatggttgtcgtatgaccgaataaaattaatttttataaaaaaaggaag

SEQ ID NO: 37 - DNA, 2718 bp, Unknown
  Metagenome-assembled genome
ataatcttcaaataatcccatactcatttatctcctaatcttcatacttcaagcgctcatttaaagcacgtacttttcccttttcaatatcatcagaatgtctatttctagaatcaagataaatctgttttaatcgcttaaaatcaacatcaaaaccatttttttgcatttcttcaacaaaaaatttatccaatctcatcatcataaaaaacaccccctaccacataaaataattttgctttttaaaatcccactttgcaacgacttcttccgcagcttccatttgctctttgctatattcttcattaccaacatgaactaagtcacccttatcaacgtcctcaatttttaaatcttgcttgatctgcttaaaaagaccgccataactaatttgccgtgtaccagccaaagcatactctagatcattaatcacttctaagttacggtcatcatcagcagtcatatagtcagacgacttaacttcatacttagcagtttcttccgcactagcttgcagagaaccagtacctttgcgtttattagccttaactatttcaacatgcacaactggatcataatcaacttttaaggctctctgccacaatttagtccactctgcttgtttgatatagttagtattattaccagtaaaatagctcgattttacaaacaataaaacatgcaaatgttgattatatgacctatcttcatcattgaccgtgatttcagttgaacgcagataaccaagtaaatttttggtaactttcttataacgggtaagcttattaaacgccttggttaaaactcgcaatgaacttcttagctcttctgcaccataagcattcttaactgtcagtgttaaaaataaaaaacgtcccttaggctgtctgctaacggcttccgcaataatttgttttaattgacttgaatttttcatactctttctccaattacacaacggacataagcgtttctgacaaaaccaagtctggtagagttttaactgattattgatcttacgaaaacgcaaagtttccccacaacccctaatatcatgtgcacgtttaaattctaaaatcgacaaatattctgcataacggacattttcaattttacgttcacgccaaggtcttactttcccgttttttgttttatcttgaaaaatttctgacatatataaaaactccttttctaacctacgtgaaaaggagtttgatttctgtttttgcttatataattttgacaaccataaaaattatatacctaattgttcaaaagtcctatagcatctgttatactaggctttgaagcaataaaactttgaaatcaaactcacgtgttccggacgcccaaatcaggaacttgcacgtgggtttttttcgtgcttttttattattaaattttatatgtccaataatacaccaaaaccccataaaatcaatgataagggataaattactcgcaaaaataaaaaactagttgatcatactagtatcaagataagaaagaactggtcaaaattgaccagttccaaaaagaaaaaagcaaaaacgggagctgacgcccccgaactctgcaaaaattcaacacaaaaaaacagttatctcttaagacagttactcatgattcttcgagttttcatagtccttagtaatatcctgatcatttcccaaatgaggctttactgaatcaggtatattatcatacgtttcgcttagataaccatatgcatctataatcttttcaaactgtcgtgacttatagtcatagcttaaggttaaacgaggacgaatcttttcatctacaaccagttgaaccttaaacacaagaacttcttcatcggtttccgttccaatagaagccttaaaaaaagaaccctttggatgataattcccactagtaggaatttttacaaaaaaaattggtttaaagactcttgccattatcaacaactcctcaatataagtttatagagtgttatgaatgtcactcaataaacttattgtacttcatgaatgtcatttagtcaaactgtaaaataaaaatatttactttcatacatgcattaccatatcaggcgctgacgccccgaaccccgtccaagctgtgctagcttgaccgcctaaatgagcgggagcccccgctcaaactcaccccgtactcgccgtaaggcaggcaaaaaaagcaggggtgcttttctttgcatgcacaaaagtatcttaatccagtagtcaatcaactccttaaagcctcaaaaagggactaactgctcaagcagtaagtccctttaattcgatttaccgttgactgacggccattaaacagctccaatactcatcagcggttaaattaaagccatagaccaaattcaaaggcttggaccatctaatttatcacgttgtctctctgaacgctcctgcggcctctgaggggcttttttagctggctcttttagcccagcccgttctagccacttatctggcagtccgacgcctaatttgcgctgtaggaaacggtcaacactccgaacaattccttgtagcgtcccgactaacttttgaagccggcgattctcaatatctagttccatcgccttactttcagctttaatcaattggtctttttgaatatccatatcagacctttgggacaatgtttcagtaaaatacgtatccgttaagctggcgccctgtttaagtttatcaaaatcaaaacggt

SEQ ID NO: 38 - DNA, 7036 bp, Unknown
  Metagenome-assembled genome
gcggcgggtaggcacgcgttcgccatttcaattctctctgttagaccacgattgacctaggccctcgcctcccagtagtccagagcggttgcggcatgtcgatgaggtcgcgccttgtgctccgtaggacccgcgggcgacctgccccgagagcgtgtcgccgcggtcggcgtcggagtggcgcgcctgctcgagccagcggaagcagtgaggtagcggccgagcccctcgtagagacgccgtggaacggctcgaggaagatcctgagctctgggtgcatcgcgttcacgagccccagctcgccgttcctcgcggcccggctggcggtggcgacgtgctcggagacgagcccgagcgcggggaggacgcgcgcgtaggcggagtggtcgtcggtcgagacccaggagccgtcgacgaccccggcgagcgaggcgcggagctccgcgtcggtcggcctgccgcggccgagacggcggcgaactcgtcgcgaggtcgttggcggcgcagaccacgcacaccttctcccgcgagatgccgcgggcgcggacggccctgcgttccggtgcggcctcctcggcatcccggtccgcgacctctccctgttcccgcgagcgactcgctgaggtaggtgccgtcgacctggaaacagtggcgtctgaagggcggtgcagcggcgcccaatcaaacgaagaggcgcatgcgcaatgaaccacgaggtcctgaggcagacgccgcacctcctcgcgagctccctgagggactcgccggcgagcgctccctccgcgtagtcgcccaggtcgaggccggcagcttggacatcgcacgcacggagccggtcctcgcggagaaagtcctgccgcacgacttgcacctccacctctgccggccgtcggcggagcggcccttcctcgtgacctcgggcgacccgcacctcgggcagcgggccggctcgccgggcgcggcgcccgacgccatctcgtcggcgatcagcgccctgacggcctcgacgagctggcgcttctcggcggaccgtgagggagcgcgcctcttgcagtatcatgtcaagcatgtccggggccctccccttcgattctggtgtttggcgacacgaatcgtagtcggggccccgacgcttatcggcttgcttaggtcaatctggtctaacagagagtttcaattcaagcatcacgtaaaatatgcaagctctcgctctgcttcctttggcaggaaactattgtcatcaactgccacatttctaaattcgacgatgtcagcagaggcgcaattggcaaacgccaccggattccaatccgctcgcctgaacgcagtttctacactatccttgaacaaatatattggcgaaagtcacataagcaacgacggatagactgatctcgactgcacccaacctttttcgccacttcaagaacatggtgatgtggttgccacggaacaacttgattccgttcggcgaagacgaatgcgcccataattagcgctcaaatatgggtaccgccgcaaacccattgcacttaaaccgcacacaatcgggcgcgggaggggcgcggcaggaaaatgcccctagttggtcagcgacgtcctgctctcccacggactcctccgcagtaccatcggcgctcgggggctaattctgggttcggaatgggaccagtgtggctcccctgccatggcgctggaccacaggggcatttatcgtccggggcagcgtcgccgtgccctggggccgcacagcgcgacaaggcgggcctcgcaagaagaccgcaccgaccgggcaaaagagcggaagaagagctcgccgattagtactgctcggctgagcgcctcgcggcgcttgcactgcgcctatcacctcgtgtctacgaggggtcttaccagaaggaaaactcatctcgggatgggcttcccgcttagatgctttcagcggttatcccgaccggactcagctaccgggcagtgccattggttgacaacccgcacaccggaggtccgtccaccccggtcctctcgtactaggggcagcctccctcagttttcctacgcccacggaggatagggaccgaactgtctcacgacgttctgaacccagctcgcgtaccgctttaaatggcgaacggccatacccttgggacctgctccagccccaggatgcgatgagccgacatcgaggtgccaaaccttcccgtcgatgtggactcttggggaagatcagcctgttatccccggagtaccttttatccgttgagcgacggccattccactctgagccgccggatcactagaacctggtttcccatctgctcgacttgtgggtctcgcagtcaagcctgcttatgctcttgcactcaagggggtggttgccgaccatcctgagcagaccttacgtgcgcctccgttacactttaggaggcgaccgccccagtcaaactacccaccagacacggtcccccgcccggatcacggcgcggggttaggctgccagaacgtcgagggtggtattccaagggcgactccccagagactggcgtccctggttcagcgtctcccacctatcctctacacgacggaccggcagccaatgtctagctgcagtaaaggttcacggggtctttccgtccttccgcgggtaagtcgcatcttcacgactagtgcaatttcaccgggtctatggttgagacagcgtccaaatcgttacgcctttcgtgcaggtcggaacttacccgacaaggaatttcgctaccttaggaccgttatagttacggccgccgtttaccggggcttagattcgctgcttcgcttgcgctgacagctcctcgtgaccttccggcaccgggcaggcgtcagaccctatacgtcgtcttacgacttcagcagagtcctgtgtttttgataaacagtcgtttggacctcttcgctgcggccggccctggctcggggagcgtgtccctccacccaggccggcaccccttctcccgaagttacggggcagttttgccgagttccttaaccatagttctcccgatcgccttggtatgttctacccacccacctgtgtcggtttgcggtacgggctcctggcggctccctaggggtttttctcggaagcatgggctcactcacttcgctcagtcgtttcgtccgccacctcagccgtcgcgagaggcgcgtttcactacctctcggcctacgtggcatcacggggacgtccagaaccccgctgagctacccttcttcgtcgccccgtcggtgatagcgccgcgtcggaggtgcaggaatgtccacctgctgtgcatcggctacgccttccggcctcgccttagctcccgactgaccctgggaggattagccttgcccaggaaaccttgggtttacggcgggggcgtttttcacgcccctctcgttactcatgccagcattctcacttccggccggtccaccgcgggtcgtcccgcggcttcgccccagacggaaagctcccctaccactgcaatgcagtccgccgcttcggtaccgcgcttagccccgtatattgtcggcgcatgtccactcgaccagtgagctattacgcactctttgaatgaatggctgcttctaagccaacatcctggttgtctgagcagacgcacatcctttgccacttagcacggatttggggaccttagcgggcggtctgggctgtttccctttcgaacacacggcttagcccacatgttctgactcccggactctgggcctgcggcattcggagtttgattggtcttggtaggcggtgaggcccccgcgaccattcagtgctctacctccgcaggtaaacgtccgaggctagccctaaagctatttcggggagaacgagatatctccgggtttgataggcctttcactcctatccacaggtcatccccccagttttcaacctaggtgggttcggccctccacggggtcttacccccgcttcagcctgcccatggatagctcacccggcttcgcgtctacggcgtgcgactgagcgccctgttcagactcgctctcgctgcggctcgcttacaagcttaacctcgccacacaccgtaactcgctggctcattctacaaaaggcacgccgtcacagcgcaaagcgctgctccgactgcttgtaggcacacggtttcaggtactgtttcactcccctcccggggtgcttttcacctttccctcacggtacttgtccactatcggtcacaggagagtatttagggttggagggtggtccccccaggttcccaccgggtttcacgtgtccggcagtactcaggtgccacccggcagccccctcggattcgcgtacggggctctaaccctgtgtcgccggccttcccaggccgttccgcttccgcgggggtttgtgactgccatgtgggtggtcctacaaccccgccggcgccgaagcggccggcggtttgccctaggtccccgttcgctcgccactactaggggaatctcgtttgatttctcttcctccgggtacttagatgtttcagttccccgggttgcctccttcgcgcctatgtgttcggcgcgcggcggcggggtatggcccccgccgggtttgcccattcggagatccacgggtcaagcggatatgtgctcctaaccgtggcttatcgcagcttgtcacgtccttcgtcggcttcctgtgccaaggcatccaccgtgtgcccttaccatcttcttctcgatggctcggtgcatacaaaacacaccccggcgcccgtgggcgccggtgcgatcagatgcgatcttcttgatgaagaaaaaatatcgtcttgtcacgctatgcagctctcaaggtacggcgagggcgagccctcgagaccggacactgcgcgcctctcggcgcgacgaaagccatcagcgggaacggacgggcaccgtctcgtctcatagtcttctaagaagcttgttctccctagaaaggaggtgatccagccgcaccttccggtacggctaccttgttacgacttcaccccccttaccctccacaccttcggcgcctccccccctcgcgggttgggccgacgacttcgggtgcagacgactcgggtggtgtgacgggcggtgtgtacaaggcccgggaacgcattcaccgcggcgtgctgatccgcgattactagcaactccgacttcatggaggcgggttgcagcctccaatccgaactggggccggctttggggattcgctcctgctcgcgcagtggcagcccattgtgccggtcattgtagcacgtgtgcagcccaggacataaggggcatgatgacttgacgtcgtccccaccttcctccggcttgacgccggcggtctcgcatgggtgcccggccgaaccgctggcaacatgcgacgagggttgcgctcgttgcgggacttaacccaacatctcacgacacgagctgacgacagccatgcaccacctgtccaggctcctctcggccacggcgtttccgccgcttcacctggatgtcaagccctggtaaggttcttcgcgttgcttcgaattaagccacatgctccgctgcttgtgcgggcccccgtcaattcctttgagttttagccttgcggccgtactccagtccatcgtgagggcctatgcggaggctgcaaccccgcgaggaacgcgatgatctcctaaagtccgccgagaagatcttgtttgacggcgttgatgggcaaggtgatgccgcgggttagggacgtgtcgaatcgtgtcgcgatgccaagcagggtcgtagcatctcttggaacatcacagtataatctgtgtctatgagcttagtggactgatgtgcacagcaacgcaactctgaacaaccgtcatatgggttcggcattttccgtgccgcgcctcccgcgcccgattgtgtgcgggttgtggagaggcggattgtgggcccccgggggcgcccgggcgcgtatagttaattcccgcgccgcgacgggcacccgcccggacgacgcgaggcgaaccttgaaaaccggatactgcgatcgaaagatcgacgaaagacagcgaatagaagagcgaagttcgaattttcgaattcacgtcaattcaaaccaagcgaatccagatcagcgggatctggtcaggcaaccggctcaaagagcagagacagcgcggctgacgccgcgcctttgaacggagagttcgatcctggtcaggatgaacgctggcggcgcgcctaacacatgcaagtcgaacggttaaggcaccttcgggtgcgaataaagtggcgaacggctgagtaacacgtgggcaaccgcccctcgcaccgggatagcctcgggaaaccgtgggttaataccggatactccgcacccccgcatgggggggcgggaaagcccagacggcgagggatgggcccgcggcctgttagctcgttggcggggtaacggcccaccaagggattatgggtagccgggttgagagaccgaccggccagattgggactgagacacggcccagactcctacgggaggcagcagtggggaatcttgcacaatgggcgaaagcctgatgcagcgacgccgcgtgcgggacgaaggccttcgggttgtaaaccgctttcagcagggacgaggccgcaaggtgacggtacctgcagaagaagccccggctaactacgtgccagcagcgcgggtaataagtggggcgagcgttatccggattcattgggcgtaaagcgcgcgtaggcggcctgctaggtcggaactcaaatccgggggctcaaccccgcccggttcgataccggcaggcttgagtctggtaggggaaggcggaattccagtgtagcggtggaatgcgcagatatttggaagaacaccggtggcgaaggcggccttctgggccacgactgacgctgaggcgcgaaagctagggagcgaacaggattgataccctggtagtcctagccgtaaacgatggacataggtgtggggggatgtgccccccgtgccgcagccaacgcattaagtgtcccgcctggg

SEQ ID NO: 39 - DNA, 2714 bp, Unknown
  Metagenome-assembled genome
cagatttatcttgattctagaaatagacattctgatgatattgaaaagggaaaagtacgtgctttaaatgagcgcttgaagtatgaagattaggagataaatgagtatgggattatttgaagattattacgatgagcatgacttagataaaaatagtgaatacagccatatgagtaaaaaagagttagtgattgaagctgaatatttacataattctttgtggaatattttgaaatatgttgataacggcggtacagatatggatgttgttaaagcggaagtctatgacggcatatacgaaagtcggatataaacattgcatgtttagtgatttttgaaattttgttccatggtttttgtggatcgaaaatttcggttttgcgaattaaaggaatctcggcggaaaagatagccgagatttttttaattcgggcgtcaatttttcttagaaaaattaagctagtgagtggcgattattttggcggaagagaacagccaaaattaactgccacgagagcaagattttccgaacaggaaaatgagcggttgggtctgtcccgctggcaaggcgaccctcggtagagcccaaactttacaaggtaaagtatattgggctataccttgcatggaggcttgccgaattctgtgctatgctctaaccaaatttagatgtttggaatggagtggttacatgagttatttagtcgctaatatgcagaaattgaaagctgataatctggtgggcttgggtaatcatgatcaacggcgagcccaacatcacaaaaatactgatattgacgttgaccgttctgttttaaattatgatttagttgctggccggacgggtcattttaaaacggatattgaggcttacattaacgagcataaaaccagtcagcgggcggtcagaaaagatgccgttttggtcaatgagtggattatctcgagtgatagtcagttctttgccgatttaacggcggctgatacgcgcaaatattttgaaacagcgaaggactattttgctgaaaaatttggtgaagaaaatattcgttatgcaattgttcatcttgatgagagtactccccatatgcatatggggattgtcccctttgatgatgaacataaattatctgctaaacgagtatttaatcggacggctttgcgagatgttcaagatcaattaccggcttatttacaacagcatggcttcaatattcagcgtggggttcaagaatcagaacgtaaaagtttgacggtaccggaatataaagccatgcgggaatctattaaacaaagccaacaaaagttagcagcggttgaaaatgaaactaagcagcgccaagcgaaactaaagacgtatcaagccactaaatttgatgtaaatagtgttaaaacgaaggaatcccgtttccataagcggtatgtgctggttgaccgttttgattttgataaacttaaacagggcgccagcttaacggatacgtattttactgaaacattgtcccaaaggtctgatatggatattcaaaaagaccaattgattaaagctgaaagtaaggctatggaactagacattgagaatcgtcgtcttcaaaagctagtcgggacgctacaaggaattgttcggagcgttgaccgcttcttacagcgcaaattaggggttggtttaccaagtgagtggctagaacgggctggactaaaagaaccgtctaaaagagcccctcagaggccacaggagcgttccgagggacaacatgatgaattagatgatccaagcctctaatttgctctctaagccattttagctgttacccgtataatttattgtccgtcaacggtaaatcgacttagaggggcttagagagcctttcaggcgatattagcccctcttggaggctttaaggagttgacggactcactaggccaagacacttttgcgcatgcaaagaaaagcaaccctgctttttttgcctgcctcacggcgagtgcggggtgagtttgagcgggagctcccgctcatttaggcggtcaagctggcacagcttggactgggttcggggcgtcagcgcccgagggcttagaaactggtcgattttgaccagtttcttcttatcttgatactagtagaaacaactggattttgctgtttttgtacatatgccttgctattatagggttttggtgtattattgaggtataaattttaataaagaaatacaaaataaaaacccacgtgaagtctctgatttggtcgtccgagcacgtgagttgattatcattcgggatttatagtcttattctagggggaaaaccctattctgtcaaggctgtaagcttagctaaaatgatatttcagctccttcacgtggatagaacggaaggagctttttatgtctaaagtatttaaagataaaacagaaaatggcaaagtaagaccttggcgagaacgtaagattgaaaatgtgcgctatgcagaatatttggcaattttagaatttaaacgggcacatgatgtccgaggttgtggtgaagttttacgttttcggaagattggggagcatttgaagctgtatcagacttggggttctgttgcaaagttttcaaaaaaatctattttagtgtaaaattgagaaaaaagacagagaggacagagtaatgaatcattttaaaggcaaacaattcaaaaaagacgtcattattgtcgctgttctgtt

SEQ ID NO: 40 - DNA, 6178 bp, Unknown
  Metagenome-assembled genome
tagccagactcattctccgagccgaagctgtagcatcctcaaaaatcgagggtctccagattagtgcaggaaagctgctcgaatatgaagcattggacgagctcggagtatcgcaccgtataggcagcactgaggcggcagtcctcggcaatatttcatccatggaggagagcatcaatacgctctccttcaagtcctctttcgatgtggacgacatctgttccatcaacaagaaactgctggagcataccgatctcgcagactatggaggggtaatacgcacacagcagaactggattggtggcaacaatgtcaatccaatcggtgcagcctatgtcccaccacgcccggaactggtactggattatatcgaggatctcgccaaattcattgccactgcccagatgcctggcattgcacttgccgcaattgcgcatgcacaactcgaaaccatacaccccttcgctgacggcaacgggagaacaggacggactctcgttcaggtaattctgcgcagatcaggccttgctcagaatgtcgttcctcccatctctctgattcttgcaactgacaaggcacgctatattgataatcttgcagcgtaccgatggaatgagaacgccgaagagcaacgctcaaggatattgtgcgaaagcgattgggtcgagtactttgcacgttcctgcagccttgcatgcaagcgtgcgcataacttcaacgacacacttgaatcgatactctcggactggcgagaaaaagtgcatccccgtgcaaactcagcagcagatttgctccttcccaagctcataggaaatcccgtcatcagcatcacttctgctgcaaggctgtgcggcagaagcactgaagcagccaggaatgcaatagccacgctcagcgaggcaggagtcctgtatcagagttctaaaaatcgcaagagcaacctatacgtcgcacgagaagtcgtcgacgcattcacaggctatgaaataagacttgcgtcgccggctggcgatacagccgttgcactgccgtcccgtccagctccgcagcgtccgcgtcattgatttagcaaagcgcctcatctgcaacatattgcacagatgaagcgctgaacagtcggctattcccgtaccagcgcatccgagatggcagaggcaatggtgtgcgcgtcatcgctttctctgagcatcttgcggaaggccggatccatcagaaggaccgccgtcttcgagagcaggcggatatgctcttccctgtctgtctccggcacgaagagggcaactgcgatatcgaccggcttctcgtcgaaggaaggccaggggacagcggtcttgttcttccataccatgacagcaggcttctgaatagtctctgccttcgcatggggcacggcaaagccctcggtgagtccggttgcaccgagctcttcccttgcaaggaaggcctgataggcttcctcgtcgtctttcacgatgcccagggcctcggcctgtgcacagagcatgcggagcaactcatggcggctttccgcttccctgccgagcaatatctgatcgtcggatacgaagtccatgggctccccttctcgcagcttccactcatcttcctgacaagcatatggcagatgggtgcctatctgtacagaaactgcgctaggagcgcggctttctgtgcgtgagatgccagcctccgcaataggggcaggcatagacatagagctgtggcgcatccttcctgtgcgcaccatgggctgccgccttctttgcctcgacagccgtcgcatagcggcgcttccttgcacaggcacggaactcctccgggctctcatccggacgccttcctgcctgggcaagcccctgtgccctgcgcacgctgcctttgctgccacgctgtcccatcggctccagccctcctctctgcatcgaatccagcatagccaaagagccgctgcatctgcctttctgtttctttgccgcacatagtcctttcaagggcagaaccctgccgtccaggaaacccgacacatgttcaaaagtttatgcctgggtatatacagcaatgcattgcaggctctgtcgcgcgtgcatgcgcattgggaggcacatcatgggcattgctgctgcattcgcggttccgcatccgccactgatcatccccgaagtcggccgggacgaagagaagggcatccagaagacgatagatgcctacgaggaagtgggcaggcgcattgccgccctggctcccgatacgatcgtgatctcctctccccataccgtgatgtacagggactacaaccacatctctccgggcaagggtgcacgcggctcctttgcgcagttcggggcgccggaagcacgctatgaggttgcctacgacgaggaattcaccgacgagctcgatcgtctggcacaggagcgccacctttctgctggcacctcctatgagcaggaccgctcgctcgaccatgcaacgatgatcccgattcatttcatcgagcaccactacaagggcgcaaagtacgtgcgcgtcggcctctcgggcctctcccctgctgcccactacgagctcggccaggccatccaggcagccgcagagaagctcggacgcaggtgcgtctttgtcgcgtcaggcgacctctcccacaagctcaaggcagatgggccttatgggtatgcaaaggaaggccccgagttcgatgctgagatctgcgacatcttccagacgggcgacttcctgcgcctcctcacgatggacaggggctttgcagaccgtgccgcagagtgcggcctcaggagcttccagatcatggcaggagcgcttgacggcatccctgtctcctcagagcttctgtcccatgaaggccccttcggcgtcggctacggcgttgccgccttcacgccgacatcagacaagcgcgacgagagccgctgcttccttgctgcctacgaagaggcacacgcagagaagatgcacgagcgcaaggagaacgaggatcccttcgtccagctggcagaaggtctctcgagacctatgtgaagacaggaaagcgcatcgttcctgatgccagccttccagccgagctcacagagccccgcgctggatgcttcgtctccttgaaggaggacggcgagctcagaggctgcatcggcacgattgcaccgaccagggcaaacctcgccgaggagatctgcgccaacgctatctctgccggcacgagaggcccgcgcttctctgccgtgaaggaatcggagcttcccgagcttgtctattcggtcgatgtgcttggagaccccgagccgatcgacagcctctctgagctcgacccaaggcgcttcggcgtcatcgtctcgacgcccgacggcaggcgcgggctcctgctgcccgatcttgacggcatcgatacgccagaggagaggtgaagttgcagcccgcaagggcggcatcaatccgaaagaggaagacgtccagctcgaacgattcgaagtggtgagacacatctgatggaagagaagcgagagagcactgtgacctgtccggtctgtccgcatgcctgccatctcaaggagggacagctggattctgccgtgccgcggtctgccgggacggggagatcgtctctgagagctaggcaggcttacatccatagcgctcgatccgatagagaagaagccgctctccgacttcatgcctggacgacggtgctctccgtcggcagctacggctgcaacctgcgctgccccttgccagaactggcagatctcgcagaccggagaaggcggcgtgccctggaaggaagtctcgccgatagagcgtggcttcggcacagggcctcaagaaggaagaccccttcataatcggcattgcctacacgtacaacgagccgctcatcggctatgagttcgtgcgcgacacgggcgtcctggcgcatcaggccggcctcaagaacatcttgtctcgaatggctgcgcaaacgagcctatcatccgcaagcttgcacacctgatcgatgcggcgaacatcgacctcaagggaccaagccagaagttctacgacaactgtgccgagacttcgcgactgtccagaagtcgatcgagattctggctgcgacgccgacctgccacctcgaggtcacgaccctgatcgtccccggcatgaatgacaaggacgaggatgtggagagcatcgcgaagtggctctcggagaccgacggaaggagatcccatcacgctcacatcacccgctctttcccaagaggcatatgaacacgggcgagccgacacccgtggagaccgtctaccatctggcagatgtagcgaagaactatctcgaccgggtccggtgcggaaacgttgaaatctggcaggagcgaacatgcgggagggctggcagaaacgtatgtcagccctccctcttcgtgccatactggagaaggacataagccaggaaggaacgatatgagaagcacgagattgccgataccacgcgcaaggagcgcatccagattgtcacagaagccctctcctgggagatgactgcggcgactgctcgctcgatgctgcggtatcgaagttcatgagcgtatatcgagggagaaatcgagctcgccgagctcaacatgatgaaggcgacggagcgatcgagctcggcatcggcgacaggtccgagatcgacggcggctgcagctgggcctgaaaggcttcgtctgcctgcatgagatgggcctctccccaaactttgagctccatcaggaatggaatgagggtgcgggcacgcgggcgaggacggtactcgacccgcaccggcatctcgtcgtactgatgcctctcacaaggccgtctgcctcgagctccttaaggatgaggcaagcatcgtgtcgtgataccgaagacgagcttcctgagctcgccgtagcgggctcctctgatgcgagagcgcaacgaggagcaggatcttccacttgccgcccaccgcgtcgaggacacgcctcagagcgcagcccgaccccgtgatgcttgcatcggcgctcgcaaagcacggcgcatcgcctggtctcagccatagtcagattttccttaccacatcaactaaaactgcgtacttgctccgtattttatacctcataccatgggtatcaatagaaggcacgcacagagcgtgcatgagacatgaaagcaggtacagacgatggagtatcagttcacagaagagaacttccagagaggtctcgacagcaaggagcccgtcctcgtcgacttctacgcagactggtgcggcccctgcgtgcaatgatgccggttgtcgaggatatcgcaaacgagtatgagggccgcctcaaggtcggcaaggtcaactccgacgagcagcccgagctcgcacaggccttcaatgtatgagcattcggccttcttcatctgaaggatggcaaggtcgtggaccagatggtaggcggaatgccgaaggcaatgctcaagggccgcatcgacgcccagctctaagttcaggatgcacctgagagagcttgcgccaggagagcagctggaggatatcatcgccagctctcccctggcgcttcttcagttcgggacacaatcctgcgcaccttgcggagcactgcaccagaagattgattcctggcttgacgaacgcgaaaagacaccggggcatcttccgcttgcagccgtctacatctcgctcgacgagcatccggccctggcagcccaggcagatgtgctctcagccccgacgctccgttctacgcagaaggccagctctgggcagaggcaaaaggctatttcagccttgaagcgttcctggaagggccgagcgcgcagagcagatcctgaggaaggcacagcctccagaccagataggacggcatggcaggcgcttgtccaaaaaaacagagaagcagcccagagaacgttctgggctgcttttccatctcccgaggatgctcttgcagccgcccgtccgggccaggcagccaggtccagctctcagtcaagcgccttcagggtctgcgcaagcaattccagatagcggtccatgcggatagccgaggaccacctttgtctggggctttggtgagtcgccctttctcgtcgaccaccgttctccgtaggtgagctcgcctctggtttccagtccacaaaccagtcggccgttcggcagcctcagt

SEQ ID NO: 41 - DNA, 16480 bp, Unknown
  Metagenome-assembled genome
gtccgcctgcatggcccttcgccattgcttcctccgctcttccggatgcatcagccgttcatccatatgatgcagcggagcggcgacaggaattcctgcggttatgccggaggtcctcagccattacgcaggaatagggaggctgccatgaagacgcaccgctactttgccattcttacactcgtatgcatggcaatggccatcgtgaccggatgggaaatgacaaaagagcactgattgatagaggaccatagctggtcctctatacagaagagccgtctcctgcttcctgatgaagcgggagacggctctgcctgttctgccggattccctggaacgtggaatccatatctgattgcctgccctgcagggacgctcagcctgctatgcctctttggctgccgaccctgcctgagcctggagctcttctccccttctgaagatgaggcggaagaccagcctgcccagagggccgccgaagaagatctgccaggcaagcgccatggggaagttcagagctgctgtctggatccaggttcctatgaggcctgcagacgagaagtccttgaagaggaaggtggcaacgaggctcatggccgggcacatgaggcacacggtgagagagcagcggatgaggagcatccagaagaagggcatgtcctctgtgacaacacggctcgtgagatgcacgacgggacactcgaagacgaacatctcgaggatgatagcgacaggccacatgatgcgcagctcgcccagggccatgaggaagacctggtcggtcatgccaccgatagtgagcgagatgttgtagcagatcatcgcatagaccatgatgaaggccatgatcgttgtgaacacgaaattctcgaacctggtctggggcatagagagctctccttctcgttgtgatgactgtgttgttcgttatcacgagaggctcgtgtgcgtttccaatgggaccagtattcggtttttggctgattgcgcctcagaaaccttaccatgcacagggccagcctatatgaattccacaacatcaggctcggccacggaagggcctggcactgcgtctgcggtacggcagagccatgtggttgtgccatgatggaagggagctgaagggatgaggagcatgacgaagatctacatcgatgcagatgcctgccccgtgatacgtgagagcctggcaatagcccgtgcagagaagattccctgcatcatcgccggcaacacgacgcagaacctcgagcgccatatgcggccacaggacccgagagagccgagagatccgaagcatccagacagcagcttctggaccacgaccctccaggaaagcatcggcgccgattctgccgacttcgctatagcctctgccatcacgcctgaagacatcgtcgtcacacaggacataggacttgccgatatcgtgctcggccgcggggcacacgccattggcgtgcgcggacgcatctacaacccgctcacgatcgactcgatgatgttcatccggcatgaggagaagaaggtcagacgtcaaggcggcaggaccaaaggtcccgcgcccttcacgaacgaagaccgcaagcgcttcgagcgcaacctccgccagcttgtgcatgaagcaaagcagccgcagagcaaatcgattgattgacctgcggatttcccacatgcatcaccacgtgtatggcttcagcatgaaacttcggaagcaacttcggaacttcaggagcaacatcccgttccatcactctgcaatctccgctcttcatgcgaagcccccaatggcatggcctccgggcaagctggtaatttcagacgcaaagctcagtagcgtgtgcatgaggtccggcattggctgctgcccatcaatcagcctgcttctatgccagccccactgcatgcaggatgaggagcacaagcgcagcagctagcggaaggcctgcggcagctaccgagaacgagagtgccagcttcatgagcactgccctgtgtccgtcttcctccgcaagcacatcgagagcatgtcccagcgtttccgcttcgagctccgctgcttcatgatcgagattctcggcaccagcacggagccttccctctgccacgcgcagatgctcctgcggcgttccgagcggtgctgccttcatccccatgagagatacggcagcgatgatgaaggatgctgcagcgacaatgccttccgcaaagagcgcccagagcaggaattcatgcgcaaggccggtcaagctttccgcagcagcgacaccggctgcaagggcgcagagagtcacgagcggcacagccataagcagcacttccgcctcatgcttcaggctctgctggcgtgcctgctcctgctcgagcgcaagcctgccgagccgtgctgccgcctcatcgagcaggcttccgccacaagctttcctcttatcttccgtgcgctcttccatgctctgcaccttccagtcaggccgtttctgccataaagcctagcatccctcatgatggaggatagctgtactacaccagattccgtctcagcagagctcgagctcgggactcttttcgactagatcgatgacatcctcgaggaactcgttgctcatctgctcggcccacggacgtggatagcggtagaagaggaggtatgcaatccgctctggaggaggatcctgcacgaagggcacgacagcgagatcgggattgctcctcgcgaagagatccgccacactgcgggtcacgatggtccaggttccaggctcctcgaggagcatcgagagcatcgagaccgtgccaactgtcacatggcagctcatgaaacctgcaaatcgccttctgtgccagatctcgaaatcggacgagacggtcgatcggatctccttcatctcgtcgagatcttctgtgctgccagtatcgacaaatcgcgcatccttatggcagacaagaaccatgtcttccttgtagagcggacgggatatcacgctcttcgacttgtggagcgtgaaggcaaagccgatatcgatggcctgctcctcgatcaggcgatggatctctgtcgaatgcacggtctggatgaagagcttcgtgcgtgacgagaagaagctctctgcctgatctgatcttccatgcacgcctgcatcatttcgagagaagagaggcttttgccatgagcaccgaatatagagacacattccctgaaggattcctctggggaggcgccatctgcgcgaaccaggccgaaggcacctggcatgaaggaggcaagggcctcgactatacgatgtgctgcaagggcggcctgcgcgacccgaacccccagccgcctcttccaggtgtctgccacctggaagaggcggccatcgacttctaccaccgctatcccgaggacaccgagctcttctccgagctgggtctcaaggtcctgcgcacccccattgcctggacgcgcatctatcctacgggcgaagaggaggccccggacgaggccgggcttgcctgctacgacaagctcttcgactgccttcttgcccacggcatccagccgctcatcacgatctcccactacgagatgccctggacctcatcgagaagtacggcggctggcgggaccgtcgcctcaccgacctctgcctccgctatgcccataccctcttcgagtgcttcggcttcaaggtcaagctctggctcaccttcaatgagatcaacaacatgcgccgcgattccccgtacgtgggcggcatcatcctgaagccaggagagagcaaggcctggaccatctgccaggcaagccaccatatgctccttgccaatgctctggccgtgaagatgtgccctgagatgattccccgatgcccgcatcggtgccatgggctcgctcagcaacatctatccttacaactgcgaccccgtgaccgtcttcgagacgatggactgtcgcaggcgctcgctctactacttcgatgtcatgttccgcggctcctatcctggctatgccttccgcctctggcatgatgcaggcgcggacatgaagatggagccgggggacctcgatatcctggcagccgaccataacgacttccttgccttcagctactaccgcaccacgacccacgggcgtgcccagcagttcttcggcgataccggcggcgagatcggaacccccccagcccctacctcgagacaagcagcttcggctggcagatcgaccccatgggcttccgctttgccctggacgagctctggaacaggtatcaggtgccgctcttcccggtcgagaacggcctcggcacccaggacaccgtcgaggacgaaaagatccacgatccctaccgtgtcgagtatccggaaaagcatctcaaggccctgaaggaagccatccgtgacggcgtcgatgtgatgggctacacctggtggggtcccatcgatatcgtgagcgcaggaagcttccaagatgtccaagcgctacggcttcatctatgtggacaaggacgatgaaggaaacggcacgctgaggcgtatcaagaaggattccttcgccgcctaccgccacatcatcgagacgaacggcgccgagctctgattccctctagcttctcccccgcattgccccagacaggcctccttctgtctggagctctttctgtttccatgcactgccctcttcttctttcatactccatctggtatccaagacatttcaggcataccatctctggccatttatgctatctatctgataacatttgtcgacagtatagcaagacacgctctcaacaggaattcccatgcggcacgagccgcagccataggagattaaggatgcagatacagaaacgcgatggccgcttcgaggactacgacaggaacaagattgcccgtgccatgcagaaggcgcttgccgaagtaggcgacccttcaggcgaagacgaggcagtcctcgaagcgctcctcgtatatgtggagcaggcaatcgaggagacaggcgccgccgaggtcgagaagatccatgacctcgtcgagcgtgccctcatggaatcaggccacttcgatgccgcgaaggcctatatcctttaccgccacaagaggtccgagctgagacgtgcccgccagagcatcgtcacgcttgctctcgaaagcagcgcagatgcgcaggcctcggcacggctggatgcggtcctcaccaagatttcccgcgacttcgaccccgtgctctatccggcagatgccctggctgccaagttccagagcttcgcaaagccgggcatggatatatccgcccgcctcgatgcacttgtacgtgctgccgtcgagctcacctcccaggaagccccctcctgggagctcatcgcaggaaggctccttgcctttgcagcagacacgcgactcaaggaagaggagcacaggcgcggcatcgaaggcttctactcgaagctccgctatctcacggaccaggggctctatggcacctacatcctcgagggctatacgaaggcagagatcgaggaggcatattccttcatcgtccccgagcgcaccgatctcctcgactatccaggactcgacctcctgctcaagcgctatgtcgtgtgcagccatgaccataccgccctcgaatcgccgcaggagatgtttctaggcatcgccctccatctggcgctcaaggagcagaaggatgtgcgcatgcgctgggtccagcgcttctacgacatgctctcgaagctcgaagtgaccatggcaacaccgacgctctccaatgccagaaagccgcaccaccagctctcgagctgcttcatcgataccgtgccggacagcctcgaggggatctaccggagtgtcgacaacttcgcgatggtctcgaagtacggcggcggcatgggcatgtatctcggcaaggtccgtgcgaagggcggctccatccggggcttcgagggagcagccggaggcgtcatccgctggatccgtgtcatcaacgatacggccgtcgcggtcgatcagctcggcgtgcgcgcaggagccgttgccgtctatctcgatgcctggcacagagacttgccagagttcctgcagctccgcacgaacaatggagacgaccgcatgaaggcgcatgacgtcttccccgctgtctgctaccccgacctcttctggaagatggcggatgaggacctcgaccagccctggcacctcatgtgcccccacgatatctcgaccgtcaagggctatgctctcgaggactacttcggggaggaatgggagaggcgctaccgcgactgcgtggcagacccgaggatccctaagcgcaccgtcacgatcaaggacatcgtgcgcctggtgctcaggagcgctgtcgagaccggaacgccctttgccttcatgcgcgataccgtgaacaaggccaatcccaactcgcatgctggcatcatctactgctcgaacctctgcacggagattgcccagaacacaagcgagatcgaatccgtctcagaggagatcgtgacaaaggacggcgataccgtcgtcgtgacgacgacacgccccggagacttcgtcgtctgcaaccttgcaagcctctcgctgggcaggatcccgctcgaggacgacagctaccttgcccataccatcgagagcgctgtccgtgccctcgacaatgtgatcggcctcaacttctatgccctcccctatgcaaagatcacgaacaggcgctaccgttcggtgggactcggcgtctcgggctaccaccatatgctcgcaaagcgccacatccgctgggagagtgaggagcacctcgcctttgcagacgagctcttcgagcgcatcaacaggcatgctatcgaagcatcttctgcgcttgcggaggagcgcggcgcctacgagctcttcgaaggctccgactgggcaaccggcgcctacttcgagaagcgtggctacgtctctcctgcctggacagagctcagggagcaggtcacaaagcacggcatgaggaacgcctaccttctggcggtcgctcccaccagctccacctccatcatcgcaggcacctctgccggcacagaccccatcatgcgccgcttcttccttgaggagaagaagggtgccatgcttccccgcgttgctccggaactctcctcccagacctggtggtactacaagccggcacatctgatcgaccagacctggagcatgaaggcagcaggagtgcgccagcgccacatcgaccaggcgcagtccgtgaacctctacatcacgaacgaatatacgatgcgccaggtgcttgccctctacctcgaagcctggagaggcggcgtcaagaccatctactatgtccgcagcaagtcgctcgaagtcgaagagtgcgagagctgcgcaagctagagagattccaaccccttcttgaaaggacatcccatgcagaacacgacgaagctcaaggcaaaggcgctcttcaaccctgatggagataccgacgtgcgagagcgccgtctcatcggcggcaacacgacgaacctcaatgacttcaacaacctcaagtacgcctggacctccgactggtaccgccaggccatgaacaacttctggataccggaggaaatcaacctctcccaggacgtgaaggactaccccaagctctctcaggccgagcgtaccgcctacgacaagatcctctcctttctggtctttctggactcgctccagacggcaaatctcccgaacatcggcgagttcatcacggcaaacgaggtgaacctctgccttcacatccagacgttccaggaatgcgtccactcccagagctattcctacatgctcgacacgatctgcagccccgagaagagaaacgagatcctctatcagtggaaggatgatgcgcatctgcttgccaggaataccttcatcggaaacctctacaacgagttccaggagaaaaaggatgcccaggcgcttgtgcgggtgatgatggcaaacttcatcctcgaaggcgtctacttctactcgggcttcatgttcttctacaaccttgcccgcatgggcaagatgcccggaagcgcccaggagatccgctacatcaacagggacgagaacacgcatctgtggctcttcaggaacatgatcctggagctccagcgcgaggagcccgagctcttccaggagaaggacatcgcagacctcaaggccatgctccaggaaggcgtcgagcaggagattgcctggggcgcctatgtcttgggagacgatatccccggcctcacctcgaagcaggtcgaagactacatccgctatctcgggaatctgcgctggagctctctgggcatgggcgagctctatccaggatacgcagaagagccggctgacatggcatgggtgagccaatacagcagtgcgaacatggtgaagaccgacttcttcgaggcgcgctccacagcctatgcgaaatccacggcactggtggacgacctgtaggagatgccttcttccccaaggatgcggccctgccgtcttttccctattcgtcttcttccggcacgatttctgccctgaacaccatgatcgtatcggcgtccgagcagcagaactccgctgtgccttcaggctgtcccggaatgcgccctccatagcggaggatatcgatataggggaaagcgcagtgcattgccatcgggcagatctttccgcggtcttcgtcgaaatcgaagacctcccccaccttgtggcctctatggcagccgtacttgcctctacggtctatgacctggatcttgatcttcggacgccttcttgccatgtcccctccttgccagctcttcctgtccagtgtgatgcatgggaagagcttgtggaagaggtgcaggaacatgttttctggcagagcagatgcccgtcaccgagggctccatctcagtagagcacccgctcgatcacggcgacaaggaccgagcagtccctgctgccaagcatcagaagaagcagaagatggtccaggacaaaggcaacgaagccctgctcgtccaccccgttgccgaaagcatcggagcgcacatgtgcatctttctgcagagcctgccaaagatgcctttcgacccctcccaagaaggcatgcatgcgcgcagctccctccttggcaggacctccgccagaggagagggcgaaaccatgcagcgcggggaagccggggtatgcctgcattctccaggaggcatggcagaagagctcctctgtggcagcagcgaagccatcgccttcccgcctcaggctgtcaagatcgaagatgtctgaccagatgtctgcggtcacagcaagaagcagggaatccttgtcaggaaaatagtggtagagcgtccctgccgcaactccggcttctgccgccaccgagcgcatgccgacaccggcaaggcccttttgctgcacaatctttctggcagcggccaggatctcttccttcgatgttgcagctggcttcatggggactcctagagccggggcagaagagcgagccccatgcagatgatccagatatacatgaccgtcttcggaagcatcaaagcgcccactgcaggcttcctctttgccagaaacgtgactggcagatagaagccgaaggacagggcaatagcaatgcacatcctccagagcccatagcccccctcattgccggagattgcaaagagaacgattacgagaaggccggtgacggcaaaggggatattgcgcgcaagcgaccagcgcaggttctccttgccggatgtccattcattctgcggaaagaggcagagcgcgatcctgagcgctgctgtcgcgaagatgatagccgggatggcaggcgagattgcgatatccggaaagatttctctccagatgaagtacagcacgacatagaacacggtcatcgtcacggaggtgatggcagtaccaaggccaagctttttcgtcgtgtcttccctgatgccgaaaagatgcatctggacacgcggaatcaggtggaaggcgtcccctcctccgagcagcacggtcatgaggccaaacagcagaaagaccgtccgtccctgtgcctgcgtgaagaagatgatggcagccacaagatcgaacgcaaggtagcagatatcgaagatgctctctgcgatgcgcatgcctttgggcatgccttcctgccttgcgtccttaggactctgttccatagcagcctctttctttcagaacagcaggaagcatcccgctttgcgtttcaatatgaacgctgttcatattgacgcctgcaagacacagcatcaactgaaaggaaaagcggcacatctctgacatcagctcctccgccagcaaaggcacctgccactcaccgaaccgcctgccgatcaacagtgcggtgcagagcaatcaggctcatcgcaagcatacatggcaaggaaagcagaatggccattttcgcaggcagaggctctgcagacccgcattgctccgtctttggactgcatttggatatgcctgcaagatgcctgacagataactgtcagaacatttgttctcattttttgctacgctcctccctgcccgaagacatgtccgtcgctggacggacaaatcgcgagagagcagggactgcccatggacagcagcaatatctatgactcggtcttcaagaccatggtgcacaaggcacccaggctactgatccccctcatcaatgaggtgtttggacgccgctatgagatagatgtccctatcgtgcagttcaacgaggagcacgaaggacctctgggcacccgcatctccgattccgtcttccgcatcgaagatatggtctaccacctggaatgccagagcactcacgacgccagcatggtcgtaagaataatcgaatacgatttcagcatcgccctgcaggaggctttggagcagggcgcaccttaccggatgaaattcccgtcctcgtgcgtgctgctcctccgacatacctccaagacgcctgactatctggaaatggaagtggagatgcccgacagcgaatctttccgctaccatgcaaaaatctacaagacgcagcttgtcagcgaagaggagatcttccgcagacgccttctcatccttcttcccttctatctcatgcgctatgagaaggagctctcgagcctggacgcagaatcggatgctgcagcagcactcatcagagaatgccgcgagatacgcatgcgccttgccgacctcacgctcctgcagggcgacgagcttctctatcggcagataacagagcttataatcagggtgtcagaccatctgcttgcagcaaatgagccactgaacaggaaagtgaggccagccatgggcggagaggtcctcgagctaatggacgacaagatcgagcgcagccgcaaagagggcatccaggaaggaatcgcgctcggccgtcaggaaggggtcgagcgggccgagagcatcctcgccgagcagctggccgccctcggcatcgaccgggcgctcatcgaccggatgatggcagatgccgccgcccaaatctcatctcaacaggagcagggcaactagcctcagcgctccagagcgttcccttcacaggatgcgcgtgcacgtgcattgtcatacagagacggttctttgccgtccggcaggaaagtgaggccagccatgggcggggaggtcctcgagcttatggacgacaagatcgagcgcagccgcaaagagggcatccaggagggaatcgctctcggccgccaggagggggtcaagcttggccgccaggaaggggtcgcgctcggacggcaggaagggttcgagcgggccgagagcatcctcgccgagcagatggccgccctcggcatcgaccgggcgctcatcgaccggatgatggcagatgccgccgcctctctgaagagcatgccgcatcagtagcaggaagaaagctttccccatgccggatggcagaacagacttcacgctaccacaggctcctcacagatcatgttcactctgcccacctgcaggcacgcatatccattctgcttttcgcgcattccccgcatgcgctctgatgcctatcttctggatggcagctcagaagctatcccacaccctcctccatgaatctgcagcttcctgtgtcgtctggaaaacgcaagtccttcagaaaaggacaatcatgtccacttcagcaatcgctgccgcactcggtgcctataccctcttcatcattgtcctgctcatcctgctcgtcgttgcctactggaagatgttcacgaaggcaggcatcgctgggtggaagtccctcatccccctctacaacgtctatatcgccttcaagattgcctggaaggaccagaccgcattctgggtctggcttgccgcaaacgttgtctacggcctgttcagggaccatgaagatggagtctccggtgtcatcacgatcgctgcgggcacccttgcccttgtctggtggatgcgcttctgcatgaagcaggcaaggtcctacggcaggggcaccggcgcaggcattgccgccttcttcctgccgaacatcatgacgctctactacggcttcgcttcctcctgcacccatgcaggtccccaggactagtcgggagcactgctatggaagatgcgcaggacatggcagagaagctcgaacgctatgagtgctttgcccgaggcctgagagacgagcttgccacgacggaccagaagcttcagaccctcaaggcgcagggcaagacgaagaccgccacctaccggcagctctttgcaaaccgcttcatgctcgaagagatggtctcgcgcctcgacgaggcagacctctgagcctgtctctcctctcgccatatgagatgatgggtataaagagagcgtcagacaaaacgcgagacaagggagatgccttatggagaaagagctgcttgactacactgcgcagaaggtcgacgagatgctcgctgcgccttccgcctctgccgatacgaagaagtctgcccaggcctggaaggacgctatcgcagccggcaaggatgccgatgccgcaacgaacaccctgctcgatgctatcagcgcccaccagaccacaatcgactccctcatcggcttcatgagttccgacaaggcgaaggagctcttcggcgcagacgttgccgcaagaaacgttgctcatgcagaggagcgcaaggccaagggcgccaagtggtgcgactgcgcagcctgcaggccctgccatgagctgctgcacaggtttggccgtgaagaggcagacgtctatctgtgacacgggaattaagatgtacaggacaagcaggccagaggctggagtctctggcctgctttgctgtatccgtctttgcagaacttcgaaagcccgccaattcagaagaagagatccgtcagcagacaacccccggctacgccgcgcaatgctcggcatcagtgcacgcgcgatttgcaatcatagcgatgaacagatcgaaagcacggcaactcggcgagagcaacacagaagccaatcccatctatggtgcgagatacgttccccactattgagcggcagaaaagcttgctccatcgaagcgcatccagacatggagctggtctacccttttcatattcccgcatgccgcagaaaatgcgatgtctgggaccagagcatgaagacaagcaagatgcctcccagaagagctgccgggccgaagccttgccctgagctgcggctcttgctccgcttatgaaggacactcctggcagatggcgtatcatggaaaagaggcgcgatatccggaggcaacatgggcgagctcactcttgaggaacgtggaaggctgatcgtggatgcatgtctgaagcagacaagcaccagcccctatcaggtgttcatgaacgtggcacggcaggactttgtacgcatgcacgggccggaacaccatgtgctggatggggcggcactgctgagtgcataccgcaacgcaggaggagacgtcgaccttgctgctgcactggcagagctcatgtcgcgcggtctcaagatgcctggcgccatgtgcggacgctggggcgtatgcggagcgacagcatccataggagccgcgctcagcattctggaacagacaggcccgctttcagacgacgactcatggggcagccatatgcgctacacgtcgcgtgcgctggacagcctgtcgcgcataggcgggccgcgctgctgcaagcgcgatgcgtatgtatcgctgcagacagcggttgactatgtgcatgagcgcttcggcgtcagccttaagaaggacagcatcgtctgcgagttccatccgtacaatgcccagtgcctgggcaagaagtgtccgttcttcccaaagacggaggcggatgcctgactcatccgcgcagctgcctaatcgtctccagcagaaggcactctgccgcagatggcttcatatacccatcccccgagacttcagccccctgcaccagagccgcctctgcagcacacagtgcggctgactgtatgcccttcttctccaaaggctcagacgtatcagatggagcccatgcatcggtccacgcccggaggcagatcaagccaccacgcccaatctgccccgaaaggctttgcaggtactcctggggatttctggatgtgtccacccggcatgtgcatctcttgggccggcagccggatgcatcgctggatacgtgccaggcacgatgctgccgccgaggacgtccggagagaccttcatattgccacggcagaagcttcagccatgcagaggatttctggaacagcaggtcgcagggatgcctattcaagacgttcagaaaccttggttcatgtatgcaggacacagatagaaaagcagcccagaggcaatcctctgggctgcgaatgtttggtgggcgttagaagatttgaacttctgacctcttccgtgtcagggaagcgctctccccctgagctaaacgcccgattatctctgctgggttggggtgccctgcagcagaaagatactttacgcgaatcgtggctcctgtgcaagaaaaactttcccaaatctgcgattgcccttaaattcgcggggcgaatccgcactccgagtgcaacagaatattacgaggtagccgcccaggcgcgacctatgatgatgcttgcggagacatgcatcattggaggcaccatggacggctacagccatcttagcattgcggagcgcgaggacatcatggtccgctggaagggccatgagggggtcagccagatagcgagggagctccacagggacaagtcgaccatatcccgcgagatcaggcggaacggctggcagggccctgcagggcgccgctaccgcgcgtctacggcacagaggaaggcggacaggaggaggctgcgctgcaggcgccccaggctcatggacgagcccgagaggcgctcgctggtcgtgaggctcatgcgggacgagcactggtccccggaggagatatcgggccgcatctcggaggagcggcccgacctcgccgtgagcgattccgccatctaccgtgccgtggagtcgggatccctggactgcgggcttccggggcaccggaaggccgcaaggctgctcaggcaccatggcaagcgcaggcacaggaagggaagccaggagcgcaggggcagggtgcgcataacccatgacatctccgagaggccggaagaggcatcgtccaggaaccggacaggcgactgggaaggcgatacggtcgctggcaggcagggcggtgcatgcctcgtcacccaggtcgacaggatgagcggataccttgtcggcggcaaggccgccaggaaggcccatgccgaggtcaacgaggccacggagagggcgctcgagggagaggccgtccataccgtcactctcgacaggggcaaggagttctcggatgcagagggcctccaggaggcgctgggagcgccggtctacttctgccatccccaccatccatgggagcggggcaccaacgagaacaccaatggccttctcagggactggttcccgaagggcgagagcctcgacgatgtcagcgacagcgaggtgcaggaggcatgcgattcactcaaccggagaccacgcaagcgtctcaagtggaagtgcccctgggaggtctaccaccaccagtcgttgcacttgctctgaggattcgcccggtttcatcacaggatcgggagcgatgatgccaccgcccacgcactcgagaccacgatagatgaccgcactctgccccggcgccacggtgcgcaccggctctgcgaacgagaccgtagcgctcttttccgtcctcggagacagagagccgagcttcgcaaagaggacctgtgtgcctcgtgcggacgagcactcccctgcttcaggcgccgtgccagcaatccagtggcaatcttcgagcgtgtgctctttcgtccaaagtcccgggcacatcttgtctgccgtcacatagacgacattttccttcgtatcggttgccaccacatagcggggca

SEQ ID NO: 42 - DNA, 156401 bp, Unknown
  Metagenome-assembled genome
cgctgcctcgcaaggcagaccgaggttcgaatcccttcatctccaccattcgtctatcggacccggatgcttccatccgggtcttcttgcatgaaggagacttatggatttcctctcagagatgcattcgcttcctgcacgctctgccccaggcactgcggcgctgcacgcgcagccggcaaggcagggctctgcggcgccacggcagatctcagatcgcacgcgccgcactccatttctggggggaggagccgccgatatcgggagaggcggggtcgggtgccatcttcttcactggctgccctctgcgctgcatcttctgccagaaccacaacatctcgcaggaaggcttcggccacaagattacggtaaggcgcttggcaaagatcatgctcgagctccaggaccagggggccctgaacatcaatctcgtgacgcctttccactatgcaccctatgtgcatgaggcgctcctgcttgcaaaggatgccggcctcacgctcccgattgtcgcgaacacgtcgggctacgagctgccagagctcgtcgatgcccttgcagacgatatcgatatctggcttacggactacaagtacgcatcagcagagcttgctggcaagctctctggggccaaggactacccggctgtggcccatgaagcgctcaggcatatgcatgatgcgctcatggcaaaaggcggaaggattgaggacgcagacggacggatgctccagggcatcatcgtccgacaccttgtactgccgtcgcacgccgatgactcctgccatgtgcttgaccgcgtctgggagctctgcggcaacgatgtcgacatctctgtcatgaaccagtacacggcaaacgagcgctgccggaagatgggcggctctcttgcaggcgctgtcacggatgcggagtatgaaaaggtgcttgaccattcggacgagctcggcttcgagcgcctctggtggcagcagggcggcacggtctcggagagctttgtgcctgccttcgatgcaaccggcgtggaaggcccggagctctgatggaagagcgccgttgagggaataagcacatcaaggcaatgcagatatctaccaatagattggtgaaggcaatggatgagaacaagggcacggagctcacagatgatgagaggcgcgagctcgaggagctgagggccgagaaggcaaagcgccaggaagctgccaaggcagcacaggagcgcgccgagctcgagcacctgaggtccgagaaggccgtggccgcaaaggagcaggaagagatcaggcacgagcaggcacagcgcgagcgcggacgcaagctcatggagcccgacgacgacctcaagatgccgctcggccagaagatcacgattgtagctgtcgtcggcctcgcgatcatctttattcttgtcaacatcttctcccactagttgcgcgttgctgaggggatatgcaggaaaagtggtaccctttacctgcttacatatcaggctgacagtacagggggtcttcctttatgtcgctgaccgataggacgaagccgactgacgtcgcgctcaacaccgatctctatgagctcacgatggctcagggattctgggagtcgggacttgccgatacccaggcatgcttcaatgtcttcttccgcgagaatccgttcggaggcggctacgccgttgcctgcggtatgggccagattgcagacctcgtcgagaacttcgtgttcgacgatgatgcgctttcctatctcggatctcttccggcaccgggcggcggcaagatgttcaagcagggcttcatcgactatctcagggacttccgtctccatgtgagcgtgtgggcagttccagaaggcgacatcgtcttcccgcgcgagcctatggtcagggtcgagggaccgatcatcgactgccagctcatggagacagcgcttctgaacctcgtgaacttccagacgctcgtggccacgaagactgcccgcgtcgtccagtctgcccagggacatcctgtgtctgacttcggcctccgccgtgcccagggtcctgacggcggccttgcggtcgcccgtgcctcctatgtgggcggcgcctcctcgacctcgaatgtgcttgccggcaagatctacggcatccccgtcttcggcacccatgcccactcctgggtcatggcattcccgtccgagcttgaggccttccgtgccttcgcgaagtcgagcccgaagaactgcgtccttcttgtcgatacctacgacgtgaagaagggcatccagaacgcgatcacggttgcgaaggagatggaggcaaagggcgagcgcctcgctgccatccgcatcgattccggcgaccttgcaaagctctcgaagcttgcacgcaaggagtttgatgaggcagggcttccatatgtgaagatctccgtctcgaacgacctcgacgaatacacgatccagtcgctcttcgcgcagggagcgccgctcgattccttcggcgtcggcacgaagcttgccacctgcgacccgcagccgtctctgggcggtgtctacaagctctctgccacgaaggcgcagggtgccgacaagtggacccctgtcatcaagctatccgagatgagctacaagcgcacgattccgggcatccagcatatccttcgcttcaccgatgctgagggcgtgccggtgggcgacatgatcgtcgacgactccgtcgcacgggatacgacctcgaccatcgtcgatatcatggatcccgactacacctatgatgtctccggctatgagtcccatgagctcctcgtccagcttgtggaggatggcaggcgcttcggcgagcagcagacgctcgagcagtcgaagcaccgctgccgcgaggccctcatgcacctcgatccggccgtcaagcgtttcctgaacccccagttctatccggtgggcatggagccaggcctcgccaagctcaggagtgaccttgcccgcgaggagcgcgccggctctggccgccatacgcttgcctaaggctgcatatttcacgtaaagtggcgatgccaccctgctcagatgggcagggcggtatcttttcttctgttgcatacaaagggcgcacgtgcgcctgtatcagaaaaggagctgccagagatgcccgagaacctcgatcagctggtgcgtgccgctatcagcgcggctcaggagcagggagaccttcctgcattcgaagtgggagatgtgggcctcgagcgcccgaacgatacgtcccacggcgactggacctcgaccgtggctctgcgctctgcaaagcttgcccacatgaagccgcgcgatatcgcctctgccatcgcgaagcatatcgagggctcgaaggagatcgacaaggtcgagattgcaggccccggcttcatcaacttctatctctcgaccggcgcgaacaacgagatcttccgcacagtcatcgaacagggtgccgacttcggcaagtccgatgtgggacatggccagaaggtccaggtcgaattcgtgtctgcaaaccccaccggccccatgcatgtgggccatggccgctgggtcgcactcggagactcgctctgccgcgtcctcgagcacacgaactaccaggtcgagcgcgagtattacatcaacgatcacggctcccagatggacgtgttcggccgctccgtctcgaagcgctatctccagctcttcgagatcatggagaaggactcttgcgacctcgatggcgctgccgaagcgctcttcgccgaccgtgcccgctatgtggaagacgaagaggatgaggcccctgagacccatccctacatggatgaattcaataccgatctcggcggcaatgcctatggcggagactacatcatcgagcttgcgcgcaggttcgcagagaccgacggtgaccgctgggtcgaggcagaggctgacgcgcgtgtggcagagttccgcgagcgcggctacaaggcaatgctcgagacgatccgccagacctgccatgatgcccgctgcgacttcgatgtctggttcagcgagcgcagcctctatgagaaggacgagaccggcacgaatgccgtcgagcgtgcctttgctgcacttgacaagggcggctatctctaccgcacggacgacggtgccctctggttccgctcgaccgagttcggcgacgataaggaccgtgtcctcgtgaagacgaacggcgagtacacctacttcgcctctgacatcgcctaccactggaacaagttccagcgcgtcgaccatgtgatcgatatctggggtgcagaccaccacggctacatcgcccgcgtgaatgccgcctgcgaggcgctgggatatccgggcgagttcgaggtgctcctgggccagctcgtgaacctgctcaggaatggccaggccatccgactttcgaagcgcaagggtgtcatggtcacgttccgcgagcttctggacgaggtcggggccgatgccgtgcgctatacgctcatctccaagagctcgaaccagacgatcgacttcgatatcgaggccgtgaagaggaagagcaacgacaacccggtctactacgtgcagtatgcacatgcccgcatctgctcgatcctcaggcgtgctgcaggcctcgagctcgaagaggccgagcctcttggcatggacgccgtggcagagcgctcgatcggtgccgactacgacctctcgctcctgtccgacccgaccgagcttgcactttcccgcaagctctccgagtttccggagctcgtggcaggatgcgcgcgcgacagggcgccgttccgcctcacgcactacgccgaggagcttgcaggagacttccacgcgttctacggcgtctgccaggtgcttccgagcgagggacgtccggtcgatcccgagctctcgcgtgcccgccttgcagcctgcgatgcggtgagacgcgtccttgccctcacgctttccctcatcggcgtgagcgcaccgacccacatgtagcagctgcatcaggcagcttctctgcgcaccctttcctttgcaggagagagtgcgcttttgtttcaggaagatgtgcgaatcgattaaaagcttaatacgtataggtaccggcgctccgagtgtctgcggtgcatccatatactgttttcatgcagcgaatgaattccgggaatccggaagccaggatgtttggaggcacttcttggagctcaaggaatacattgctctcaggagggcctacagcttggagaggagagcgagcgctcaggcgccaaggctcactttcgaggagtttgccgttctctgccacctgcgcagtgcaggcgagcacatgaagacatccgatatcgccacctaccagagctcgcttaggccgacgatgacgcacaggatgaaccatctcgtgaagctcggcttcgtgagcagggcttttggtgtcgaggaccgccgcaatgtatggtgtgcgctgaccgatgaaggggctgcattcgtggaggagcgcgcagaggcgatgaggcaccagatcatagccgatgctccgtcaaggcgtctctcgaaggaccgcatcgtgcggctggtcgaggcgatgggcacgcatgccttccatgcaggcgacctcatgcttctgggcctttccgggatgcctgaggaagaggccacgatctcagatctcgtgaagctcctggggcttctccagccgaccgtatcgatgtcgatagcagcgctcgaagagcatggctatgtcatccgccgccaaggaacgcgcgatacgcgctctgtcacggtcgcgctcaccgaggaagggaagagccgtgcccatgagctcaaagaagaggtgcagaagatggctcctgcacgctcccgtgtatcctgagcacccagaaatgctccagagagcgccttttgttgcgttctgtgtcccctcggtggcaaaaatggctgcatttcttcgtttttgagcagcagcagacatgcttgtgttatagtcacgttgtttcggcacgcctatgcgtgcatccatacctcaaaagcagctggcatcacatagaaggcttctgcccttgcagcggtgctgcagctaccccgacatgcaaacgcagcccatacatcccggcatggcaggggattcatacatatctgctcctatgagcgagaaagcaggaacattttgtcggacgacatgaacgagggcggagcctcggtacccgaggtgtccgctcagccggtcccaggcgagaacgaggaagcgccgaagccgaagcgccgccgcacgacgcgcaggaagaaggatgcagaggatgcatccgcagccgcagatgtgtctgcagaatctgcagagaaggcagaaaagcctgttcgcaggcgccgtacacgcaagaaggcagcagaggctgaaaatgcagaggcacctgcagccgagactccgaaggcagaggccgcagcagaagaggcaccgaagccgcagcgccgccgtcgcacaaggaagcaggcaagcgctgaagctgcacctgccgagcctgcaccttctgagactgctccccaggagcctgccgtgcatgcagagcatgagagcgcagaggtacctgcagagcatgagcagcgccgagagcatgaaggccgcgcggagcgtgcagaagaggctgctccggctgcagaggagcaggagcacgaggctgagcctgcagccgagtcctcctccgagcagcaggaaggcagcgcttccgagcacgagcatgagcacgaggagcgtggccgtggccgcaggaggcagaaccgccgcttcgagcgcaacgggtccgagcatcagggtggccagaacggcgagcgacaggagcatggccgcttcaaccagcgcaatgaccgcttcaaccagcgcaacaaccgccagaatggccagaaccgccgccgcaacaacaggcgccaggaggttccggagccgagcctcacgcgcgacgagctcaaggagatgaaggttgccgagctcaggagcaaggcagcagagctcggcgtcgagtatgtgggcctgcgcaaggccgatcttgtcgagagcatcttcgaggcagcagcgaaggccgaaggcttccgccccgttacgggcatcctcgagatccagcccgaaggctatggcttcatccgcaccggcaactacatgcagggcgacgacgatgccttcgtcttccagcagatgatcaagcagaacggcctcaggaccggcgacgaggtctcaggcaccgtgggtccgaaccgcaacaactcgaaattcccgcccctcatctcgatcgacactgttgacggcatgaccgtcgaggagctcagacgccgcccgcgcttccgtgacctcacgcctatctatccgaacgagtgcctcaagatggagcatggcaaggactcgatcacaggccgtgccatcgatatcgtgtctcctatcggcaagggccagcgaggacttatcgtctcgccgccgaaggcaggcaagacgaccgtgctcaagaaggtctgcgaatccatcgcggccaacaatcccgaagtgcatctgatctgcctgctcgtcgacgagcgtcctgaggaagttacggacatgcagcgctccatcaagggcgaggtcgtcgcctcgaccttcgatatgcctgcatctaaccatacggcggtctccgagcttgtcatcgagcgcgccaagcgtctcgtggagcttggccaggatgtcgtggtcgtgctcgactccatcacccgtcttgcccgtgcctacaaccttgcaatgccggcaagcggacgcatcctttccggcggcgtcgattctgccgccctctatccgccgaagaagtttttaggcgctgcccgaaacatcgagaatggcggctcgctcacgattcttgcctccgccctcgtcgatacgggctccaagatggatgaggtcatcttcgaggagttcaagggcaccggcaacatggagctcaagctcgaccgcgagcttgcggacaagcgcatcttcccagccatcgatccggttgcatccggcacgaggaacgaggagcttctgatcgatccggagctccagccgttcgtctggggcatccgccgcatcctggcgaacatgaacaacacggaacgtgccgagatggcgctcgtgaagagcctcaaggccacctcgtcgaacgaggagttcctgattcgttccgcgaagaaggctgcacagagcgaatacgtggacgcgctgtaaggctgaagagagaactgccagagggaccgtgccggaaggtgcggtccctcttgctttgaagagccagcgcaccgaggcaacaaaaaaggcctgcagcataatctgcaggcctgaacattcatggtggagaataggggattcgaacccctgacctcgtgactgccagtcacgcgctctcccaactgagctaattccccttgggcgaaagatactatagcagaagagatgcgattctcgcgcgagaatatgcaagttgccagaaaaggcattctggcgcccgcctgctctggatagctcggtgcacgcgtatcgcttttcgaaattcaattcatggtctgccttgcatcaggcgctgcaaccggtaaagtaggtgtagctggtacgggccagtgtccgtacggcgatggcacatacactcgatacgcagcagaccgttgccttccgcacgcagggcctcccaaagacgagggatcccgggagccgaggcagctcttcgctcaatgtcctaggtgcaggcgcaccagggaggttatgcagatgaagccaaagagggtcaatccttgcgtctatgccgggctcatggggccggccatgtgggccgttccccagacagcattcgcacagaccgcaggccaggacctggatccccagaccatgcttgttccgtttgcagccggtctcggctgcggcatagcgcttgctggcaccgtctctgcgattgcctggcatcgctcgaagaagcagctcgaggcagagtccattgcccgtgccgaggatgcctggttcggtaccgaggagagcccttcctacgtgccgcagcatctgcgcgctcccggcgaggaggcgcatcccttcttcgaggaggaagagcaggatgctggccgcacgctcgagctcgaccgcgaggaagagaagaagcaggagcgcgtcgcgacagaaggaccgcgtctgcgctccgtgccgacgattccggctgtggatgcagacgacgagccgaagccgccgacaccgccttcaaggccgcgtgtatcgccgtctgagacggcatcggtctccacgacgatgacgggaggcttcccggtgcagacagccgagagcatgccttacagcagcatcgcctcgcgcatccctgacattgcagcatctgccagcccggacgagacgacggtcttcctccaggaagtgcagaagaaggaagcgtccaggaagaatgcccgtacggcccagcctggtgcaggagcgcatgagactgaagactacggcgatatcgcagagaactatgtccagcgcctgaactgggcagagcgcatgagcaagcgtgcccgtggcgtgcgttcggtcctctcagagcgtcttgcgaaggactcgatggacgatcttcccgtcatcacccgtgccgatggcacggtcggcgatgtgggcaccgactggtgggagcgcgagcacggcaaggacatctcgcgcgacctctcgattcctatctctgatgactactcggttgtccagccgaccatcgacgatatgccgttcgctgcgagcgtgaccgcctcccagagaagctttgcagctgaggatatcgcagctgccacgacgcgaccgcgccctgaccgctccgagatctcctcgcgcatcgcagagatcgactccggtctctatcccgagaaggagaaggacggggaagacaaggacgcaatgtggaaggctgcgctcgatgcgctcgccgagaacgataccgatgccccgcaggcaggcttcacgccggtcgtggcagctcctgccgggctcgacgacgatgaggtgttcgatgagccgacagcatctcttgcaccgcaggtgccggatgctccttcgcccatcgacacggagtcctatgtcgactacctgatcagcgacgagatgtcgaagaatccgtcatatgcaaggacctcgcgcgactacctcaaggtgatcgagggcggcagccagaagaaggatgattcgtctgccaaggcaaagaagcggtccacgaagctcaagcatctgaagccacgcgggaacaggggccgctcggccaatgaagcatagcgtgctggaagacatcaagagacggcggggagctttcctcgccgtctttctctgggtcctcttcatctggggccactcgcttgtccagggaggggcctcgcaggcagaaagcggcgtcttcgtgacgctcgcgcgtccgttcctcgaagcaatcggtgtgagagatccaacgacccaatcattcatcgtccgcaagtgcggacatttctccgaatatctcgtgctcggcctgctcgtgcatcatgctgcacgtccggactggtcgcatatgactacgcgtcttgcggcgatgcttctcttcatcgtctgtgtgccatcgcttgacgagacgatccagatcttcgtgccgggccgctcgagtgccgtgcgcgatgtcttcatcgacctcgccggggctgcgacaggccttctgattgcgacgctcttctcccgccatagagcgaaaaaggcgcacagctgagctgcacgccttctgcattccatctatagcgcaggagcttctgagggcctgtctgagccttatgcctcgagatagcgggctccttgtccgctagcagagcagatgcggatccagaagccttctgcggagcctctgacagcatccacgacgtcgtgcgctgccgagtctgagccgcagatcgcaagcatcgtcgagccagagccggagatcacgaacgcggaggcgcctgcctcgagcgcacgctcgcgcagaagcgcatagtcggggatgagctttgcacggtatggctcatggagcttgtcctgtgccgccttggcaagaagatccatgtctccacgctcgagcgcgcggacgagggcgacgatgcggcccatctgccagacgcaggtcgagagctccacctcgtggggcagcacgcgcctcgcatccgccgtcctcacctcgtagggaggggcgattgcgacgaagcggagcttgtctgcaacggggaagtggagagataccgtgtccttgccgtcgacaaagctcgagacaaggcctccgaggatggcaggagccacattgtccgggtgaccttcgagatgcgttgccagatcgagcgtgaaccgctcgtcgtagggcctgtcggcaagcgcctgtgcagccaggatgccggcaacgacgcaggcagagctcgatcccaggccgcctgagagcgggataggggactcgatcgtgagacgcagcggcaccggctcgagaccgagccttctggtagcgccgcggtagcttgcgagcacgaggttgtcgtcgccccggaagcgctcctcgcagcccaagatctcgagatggtccgacttctcgaagccgaagcgtgcctcgagatcgagggcaagccccaggcagtcaaagccgacgccgacattggcagatgtggcaggaacgcccacccatacgctgtctgccatgctagctcctcgcaaagatcttgagagaggcatcctcgacgacggcacccatgccctcgatgccgcagacgcccgtgtggagcttctcggagaagcgaagcgatgagagctgcacgggcgctaccgtgtgtgtcgcagcctcgagcgcgtccatgcaggcaaagtcgttcatgccttcggtcggctcgccgagcgcctggagcacgtcggagcagaacttgtaggggcttgctgtcgagaggcagacacgctcagtgccatccttggggatgcggtcgagcacgcacttcgcgactgcggtgtgcgtatcgatcaggacctggtccttctcataggtgctcttgatcgtggcacgggtctcggcatctgttgcaaagccagcacggaatgtctcctggatgcgcgcaaggatttccggcttcacggtatagaagcccttttcattgaggtcgttcatgagggaagcgatgtagtcgcagtcgccgtccgacaggtagtagagcaggcgctcgaggttcgaggacacgaggatgtccatcgaaggggagatcgtcttcacgaagtcgcggcggcggtcataggtgccggtctcaatgaagtcggtcaggaccttgttcgtgttcgaggcgacgatgaggtggcgtacgggaaggccaagctgctttgcgaaccagccagccaggacatcgccgaagtttccggtcgggacgcagaagtcgatcgcgtcgccttccttgagggcgcctctgcgcacaagctgggcataggcatcgaagtagtaggtgacctgcgggacaaggcggccgacattgatcgagttcgcgctcgagagcacgatattcttctttgccaggcgctccttgagggacgtgtccgagaagatgcgcttcacgcccgtctgggcatcatcgaacgtgccgcggatgcctgagacgcagacattggcgcccttctggcagaccatctggagatactggatgtccgagaccttcccatcgggatagaagaccgtgacgccgcagcctggcacatcggcaaagccttcaagggcagcctttccggtatcgcccgaggtggcggtcacaatcatgacattgcggccatctccttcgcgtgcgacgctcatgagctgcggaagcatctggagcgcgacatccttgaaggcgcaggtcggcccatggaagagctcgaggagccagtcagctcccagctcggtcaccggcgtcacggctgctgtatcgaacttcttgccatacgcgttctcgacgcactgcgaaagctcctcttccgtgtagtcggtgaggagggcgccaagcaccttcttcgcattctcgtggtaggtgccagccaccatatcggagagcgaaatcttgttcttgccaagctcatcggagacatagaggcctccatctggggcaagaccttgaaggattgcttgcttgcttgttacggtttgcgcacggctgcgtgtactgtgatagaaagtgttcaccatttgattgccccttgcgtcagaggttttacgggcgcttgtggtccatgatagcggtgttcatcaggaagacgggcttccgtcacacgttggaaagattggatgatatatgaacgtagccctgcttggccacggtacggtcggtcgtggcgttgtccagatcatcgaaagctcggtacccaccctcaaggtcacgcgcatcctcgagctgccggaccgctgcacggaaccgcgcatgacttcgaacttcgacgatatcgcgaacgaccctgaaataactgccgtcgtcgagtgcatgggcggcctcgagccggcgcatacctatatcctgcgcgccctcgatgctggcaagtctgtcgtcacatccaacaaggcagtcgtcgcagcctacttccaggagttcgtcgagcatgccgcaaagagcggtgcccgcctcttcatcgaggctacctgcggcggcggcattccctggatcgcctccatcctgaaggcgaagcgcatcgacaagatctctgccatctccggcatcatgaacggcacgacgaactacatcatcgagaagatgcgcgatgacgcggtcgacttcgatgtcgctcttgccgaggcacagcgcctgggatatgccgagcgcgaccccacggccgacatcgacggcatcgacgtgaagaacaagacgatcatcggcacgtcggttgccttcggctgtgcctgccagaaggacatccctacaaccggcatcaggaacttgaagattgcggacctcacgttcctcgagagcaggggatacgtcgtgaagctcctcggccgcgcgactcagcaggatggccgctacgccgcagcagtcgagccggtctgcatgccgctgcgcacgctcgaggcggatgtcccctcgaacttcaacctcgtgacgctcgacggtgcgacgatcggcacgctcaagttctatggccagggcgcaggaagcctgccgactggcaacgcaatcgtccaggatctcctcgactgcgccgagggcgccgagcccacctaccggttcgacgagccgcttgcctgggatcctgcccttctcaagggcagctaccttctgcgcacgaaggcagaggcgccggaaggtgccaagccctatctcgagggctactggcgcctcgacggcctgaatgtcgagactgcccgtgcgctctatgagaagcagcttgaaaaagaccctgctgccttcatggcagcattcccgcaggaggcataacgtgctcaaggttgcaaaattcggcggctccagcgtcgcgtcggctgaccagttcaggaaggtcaagagcatcgtcgaggcagaccctgcccgccagttcatcgtcgtctctgcagcgggacgccgctcgaaggacgacgacaaggttaccgacctgctctatctcgtctgcgcacatgtgaagtaccacgtggatgcaacgcctctcatggagcagatcaaggcccgcttcgtcgagatggcacgcgagctcggccttgcctatccgatcgaggaggagttcgacgagttcgaggctcatgtgaccgagtactcgcctgagtacatcgtctcccgtggcgagtacttcacgggccagctcatggctgaataccttggccttcctttcgtcgatgctgctgacgtcatgcgcttccaccgcaatggcaaagtgagcatgacaaaggcgacgcacaacatccacgagatggcaaagaagataggcccgttcctgattccgggcttctatggtgcgacgcccgaaggcgagatccgcctcttcgaccgcggcggcggcgacatcaccggcgctatcgtcgcgcgtgccataggcgtcgacctctatgagaactggaccgatgtgtcagggttcctgtcctgcgacccgcgcattgtcgagcatccccgccccatccaccgcatcacgttcgacgagatgcgcgagctctcctacatgggagcttcggtcctccacgaggaggcgatattcccggtacgtgaggtcggcatccctattgcaatcaagaatacgaacgacccgcatgccgagggcaccatcatctccgaggaagcgacggatgactctgtcgagcacctgatcacaggcatcgctggcaagaaggacttcctctgcgtctacgtgaagcagaaccatatgtcgacggctgtgggcgtgcttcgccgcgtgctctccatcttcgagcgctacggcgtctcgatagagcatgtgccgaccggcatcgactccttcggcgtcgtcgtgaatgcagccgatgtgcatgactgcctctactcgattgtgggcgacatccaggaagaggtccagccggatgaggtccgtgtcatcgatggcctggctctcatcacggtcgtcggccgcaacatgtcgaagcgcgtcggcacctcgggccgcatcttctccacgctcggcgagaacggcatcaacatccgcctgatcacgcagagctctcaggagatcaacatcatcttcggcgtggacaacgccgaattcgaacgggcaatacgtaccatctacctggcattcgctgacgagatggtggaataggagcaagaaccatggcaggaaagcgcgtagctatcctcggcgccacgggcgtcgtcggaacccagatgaggcagtgcctcgaagagcgcaacttcccggtaagcgagctggtgccgcttgccagcgcgaagagcgccggcaagaccttgacgttcaagggcgaggaggtcgaggtcaaggaagcaaagcctgaggcctttgacggcatcgatatcgtcctcggtgcagcaggagacggcattgccaaggcacttctgcccgaggcggcagcacgtggtgcggtctgcgtcgacaactcgcatgccttccgtctcgatccggatgtgccgctggtcgttcccgagatcaatccggaagacatccagaaccatccccgcaacatcattgcgaaccccaactgtgcaacgatcatcggccttgtgccgacctatccgctccacaaggcggcaggcctgaagcgcatgattgtctccacctaccaggcagcatccggcgctggcatgccgggcctcacagagctcacacgcgagctcaaggtgctcgccgaaggtggcgaggtaggggatacaagccccttcgcctaccagcttgccatgaacctgattccgcagatcggcagcttcaaggacgagggctacacgtccgaggagtggaagatgcagaacgaaggcaggaagatcatgcacctgccggaggtccgcgtgaactgcacctgcgtccgcgtccccatcatgcgctcccactccgagtccatcacgctcgagttcgagaacccgctctcgcctgatgaggcacgcgagatcctttccacggcccccggcgtcaaggtcgtcgatgaccctgcgaacctgcgctacccgatgccgctcgatacctccgaccaggacctcgtcttcgtcggcaggatccgccgcgatctctccgctgcagatggcgtcaacggcctcacgttcttctgctgcggcgaccagatccgcaagggcgctgcaacgaacgccgtccagattgccgagtacctcgtctagaacagcattcatagacacaaagaagccctcccatgctctggcgtgggagggctttcatgtatatgagttcacagctatcggctgatgtctacatatcgtcagcagcgatggaggaatcgcattcattgcgcatgcgctctatgcgccgaaggaggctctcctttttctcgtagctgtgcgactggaagatgtcgccgttgtccttcgtgaagaagcggaagaagtagttgcccgagagcgtctcgtagatgcggtacttcggtgccggctcgcgcttgaaggcatcgacggtcgaatcctcgacagcagcagccggtgcatcctcgcgcacggcatcgatgccggcaaggcactcctcgcgcgacgggaagacaagagacgtgcccaggatgtggccattgctggagcacaggttgaagaggtagcggccatccttctcgttcagaacatactggcccatggaggctcctttcgctcgggtgcggatagtgccataaatcttgcagcagatatggatgaatgcatcccttagagcggcaaatggcagaccgtcctgtgcgaacggagaaagaggctctactcgtgcacgaccacgacgtcgccgacatgcacgagatcgtagagctcgttggccgcatcgagcggcaggttcacgcagccgtggctgccgtctgtcttgtagatgtcgccgccaaactcggttctccacgttgcatcatggaggccccagaccgtgctgatgaagcccatccagttgtatacgaagttttcggaggcatcctcgcccgtgagcgtgatggagttcatcatgttctggatcgtgaagacgccctgaggtgtgtcattgccggcagcgacattgccggtcacgacatcggattcccagagcacctgtcctgcatccacgagcacggcatgctggttcgtgatgtccacgtcgatgtagcggtctccccagtcagccgcaccggcttccgtgaagccatctgcctcctgggtgacgtggatatcgattgtcgcagtgtcctttgccatggcggcggcataggcctcttgagcgaagctctcagcatccacaagctggccataggtgctttccgactcggggttcgtgttgcaggagacagtcttcgtctcgcctgcatagttcgtgaacgtacgcgtggtccccacggtatcgaaactgtcctctgcccacttcttgatggcatcctgcgtcagctgcggcatgaaggaatcatcgagctcgatccagtcagcgacgacgttgtcggaaggcgtcgctacggtcgtgccgtcgagcgtgatcgtgagctgggcgcccatgagggagttggcggcagggatggcagtggcgaggcgctcatcggtcgagaggacctctggcgcgatataggcagcatcgttcagcttgcaggagcttgccagatgctggaaagatgtccgcacggcgttctcgacgatgtcctcgtgaagctgggtgcccctcgtctcagaagcgacgacaaaggtggactggcttgcgtcgtaggcaagatgagcatcctcagagggcgtggctgtctcgttcacgttctcgacggccgtgctcacggcatccgagagggcttcctcgtcgagcgtgacggcatcagacggaagcacgatatcggtcttcgtgaagagggaacgcacagctgcgacaggccacacgaagccgttctgggccttgaggagctcggaagcagccttgtctgcatcgcaagcaaagcctgcgctatcgcccgagaccgtgaagctctcagtgccatccgcatcggtgacggtgaccgagaagccatcagatgcatccctgagggtggcagagatcttggaggagcctgcgaatgcaatgtctctgcctgctgccgtggtgccaggaagggcatggctcaggaagaagacggagccaacaagatagatggcagcgaggacagcgatgatgatgggagccttcgaggccttcctgcgcctctgcttcctctgttctggacgctcctgcctgggcgccttgtgccttgcctcatgcttcggggtgctctgcccatcctgtgcggtcgacatatgcgctgcgctgtgggcaggccttctcgtatcgctttccatatgtctggacactgctcttcgactctctttccagccttgggttccggagatgctatcgtagcagcattggaaggcgtacggcagagctcaaacgaaaggtccagaacgtgaagccagaattgatcgaagacctcgaagatccaaggctcgacccgtatctgaggctcacgaaccatcagctgagatgcgagctcgagccggaacgtgcccttctcatctgcgagtcccagatcgctatcgaggtagcgctcaaggaaggcgtgcgtccgctctcgcttctggcagacgaatcgcaggtcggaagcatttcatcccttctggctgtctggccagacgatgtgccggtgcttctccttccgcataacatgtcggagaaggtcataggatataggctcaaccgtggtgtcctcgctgcgatgaagcgcccgcagctgccttccgcagaagggcttctggagcgcctctgcgcagagaaggagcgcgtgcgcctcgcggtgctcgaagggctcgtcgatgtctcgaatgtgggggcgctcttccgctctgccgcggcgctcgacgtggacggcgtgatcgtggcacctagctgtgccgatccctggaacaggcggtctgtgagggtatccatgggaacgatcttccaggtgccgtgggcaaaggcggaggacagatggcctggggacttcttcgcactcctggaacgcaagggcttcgcatcggtggcattggcgctcacggatgatgcggtgccgctttcggatccggccctgaaggaacctctccatgaggcgctcttcttcggctctgaaggctatggactctccgatgaggtgctctcgcgctgcgacaggcacgctatcatcccgatgagccacggcgtcgattcgctcaatgtggcagcaagctcggcagtcacgttctgggagctctgcgccaggcgctaggggagagcgcaaagagaatagcttgacatgaaaaagcgggaggcactggtgagtgcctcccgcttgcttgcggcagagcagatgtcctactgctgggccggggcctgtgcagggcgcggagcgaagccgtcatcgcgcgtgaacattgccatgaactcctcgcccgtgatggtctccttcttctggagatagcgggcaatctcatggagcttgaagcggtggtcctggagcgtcttgagggcggtctggtggccctcctcgacaatcttctggatcatctcgtcgaccttttcggccgtgccttcggagcaggtgagctcagatccgccgccgaggtagcggttcctctgctggcccagggcgaccatgccgagctcttcggtcatgccgtactgcgtgaccatggcgcgggcgatctgcgtcgccttctcgatatcgttcgaggcgccgttcgtggcttcgccgaagatgagctcctcagcagcgcgtccgccgcacagtactgcgatctgctcttccatgtccttcttcgtggacaggaaatgctcgttctcgtcgacctgcatcgtatagccgagagcgcccgacgtgcgcggcacaatcgtgatcttctggaccggagcatcggagcgctgggtggcggcgacgatagcgtggccgacctcgtggtaggagacgacctgcttctcatgctcggagagcaccgtcgacttgcgcttctcgccggcgatgacgacctcgacagattcctggatgtcttcctgggagacgcgcttcctgcccaagcggacagcgcgaagggctgcctcattgatgatgttggcaaggtcagcgccggaagcgcctggggtcgagcgggcaatgacatcgaggtcgatgcccggctccatcttcacgtcgttcgcatggagctgaaggatggccttcctgccggcaagatcggggagctcgacggggatgcggcggtcgaagcggcctggacgaagcagtgccgggtcgagcgtctcgggcctgttcgtggcggcaagcacgacgatgcccttgtggttgtcgaagccatccatctcggagaggagctggttcagcgtctgctcgcgctcgtcgttggagttgatcgaggtgtcgcgcctcttgccgacagcatcgatctcatcgatgaagacgatgcagggagccttcttgttcgcttccttgaagaggtcgcggacctttgcggcaccacggccgacgaacatctcgacgaactcggagccggagatctggaagaacgtgacccctgcctcgcctgcgacagcacgtgcgaggagggtcttgcctgtgcctggagggccgacaaggagggcgccacgggggcagcgtgcaccgatctcgttgtacttctcagggtgctgcaggaagttcacgatctcctgcagggattcctttgcctcgtcctggcctgcgacatccttgaaggtcgtgtggacctcttcgcccttgacctccttggcagaggacttgccgaggccgcctcctccaaggccgccaaagcccgatccgctcgagaagtccatcgtgtcgcccatctgcttgcgcatgcggcggttgatgagccagcccaagaagaacacgattgcaagcggcaggatgtagctcaggagcatgtagtagagcaggctctggttctcgttcgggatggatgcagacatgtcgacattatgctcggtgagcctgtccacgagtccgtcatcgttcgggaatgcggtcgtcgaatacgtcttctcggtgccggaagagtcctttgccttgaacgtgatctcgttcgtgctggtatccaggtcgaccttggagacctggttgtcatcgaccatctcgaggaacgtgctgtagcttacatccgtcacctgctggtacagggtggggttgaagtacgagttcaggccgaagatcagcgcgatagcgacgatcaggtacaggatcatcgactgccgttgcttcttgttgtccatcgtcttctccttgcgggcgcagacgcgccctcgtccaactgcattgtgagttgttgtaccccaagctcactgtcgctgacacctgcatctgaaaaaggggcaaagggagcatgctgcgtcagtgtgcagcatgctccacgagaaggccggtgcggtaggcatcgaggagagcccgaagatccgatatctgctgcctgatatcggcgccggtgtccgtgtcgccgatgaggagcggccgctcctcatactcgaacttgtcggtatcggagacgatgtcctcgttgagatccagcacgtcgtggatggagctgaaggggcggtgcgccttgatgcgcatgccggtatcctcggcgatgagcgtgtatcccgcgataccggtcgtgtggtggtaggcacggcagaagccgccgtcgatcacgaggaccttgccgtctgcgcggatcggactctcgcccgccgaggcgtgcacgggcgtgtgcccgttcacgatatggcagtgaggtcccgtgaggccgaactcggcaagcacgcggtctgcgatctcgggacgcgtaacgagcgaataataggggtctctcggttccttccaggtgctcttgtccttcacatatgtgcgctcgaacgtcctgacctcgcggccggagagcggcgagaagcggccgcaccagagataccacatccagtcgagcgagagctggtcatgctggtgccaggcagtccttgcgacgcgttccgcatagtcgaggtatgccttgcctgcgtagagcgtgtctccatgcttcacgggattgaacgagccatcctgcttcatcggaaggcaggcatggaacaggacattccggttatgcacgagatacatagatccgtggtcatagaggaagcctatgtcacgctgcaggcgctccgaggtgcgtgcgctctcgacgaggtttgccatgaccttggattcctcgacgctcagccgatagggatgctcggggtcgaccgtcgggaagtcggatgtcgtgagctcgtattcggtgccgttgatgcggacacagccgcgctccttgtcgatgtttccgagaaggagccgtccttccatctgccagttcggatggcgctggatggtctggccttcgagcttgaacatgatgacggagatagccttctcgaagggggagagcacatcgtccttcttgtacgtccgctcggcaaagagcgcgagctccctcaggcttatgccataggagttctcgaggatctcgagggcatcgtagtggatgttgttgcggatgatggcggcaaggcagacgggagaccctgcggctgcccccatccagaggatatcgtggtttccccactggatgtcgaccgagtggtagcgcatgaggcgctcgatgatgagctcggcgtgaggaccccggtcatagatgtcgccgaccacatggagcctgtcgaccgcgaggcgcttgatcagggaggcaagcgagcagatgaagtcgtctgccgaacccgtgtcgatgatcgaggtgatgatgcgctcgtggtagacctggcgcaccttgcgctcgtccggcgtgaagtgcaggagctcatctattatgtaggcataggcgacaggcattgccttcctgaccttcgagcgggtgtaggagcccgaaaggtagcgtgccagacgcacgaggcgcgtgagggtgatcgcataccactcctcggtcgcgcgcccctcctccttcatgcggcgcagctttgccgtcggatagtagatgagcgtgcagaggtcctgctgctcgctcttcgtgagctccagagagaacgtcgagcgcaccctttcgcggatgacgcccgagcagttgttgaggatatgctcgaaggcctcgtactcgccgtggatatcggagacgaaatgctctgtcgccttcgggaggttgaggattgcctcgagattgatgatttcggtgaatgccgtctgggcggtcgggaacttctctgagagaagctcgagatagcgcctgtcggccggttctggttcgcccatgctctgctttcttctcgtcatatctacatagatgtgaccatactggcataccagattgagcatggatgcgacaaatccatgagcggaaggctcaggagcatatataagagatgcgccacgagcgttccggcagcaattgtttcagggcagcatcgtttctctgtccagaatatatgagcaggtgccttcggcggccgatgagtgctactatgtgtcgccagaggcaatgaagaggacgagtaccttccaagcacggccgccagagagcggggctgctggaatcccgtgaccggagcggaagggaatatcaccttggagccgtggtccgaacgcagaagccctgcaagtaggcaccaccggattggccgccgtcataggccagccgagtacggcggagtttccgctcgctgggtggtctacaagcgaagtgtgccaaaagcagcgcttcgtcccagcaagagggacggggcgctttatttatgcagggcgtcctttgggagggaaagccctaaggctttccggaaagcgagggtctcaaggtggctaacgagttcaagaagacgatgaacctgccgaagaccgggttccccatgcgtgcaggccttgcacagcatgagcccaagcgtctcgagcagtgggagcagaacgatgtgtacggcctgcttctcaagaagaatgaaggccacgagaagttcgtgctgcatgacggacctccgtatgcaaacggcccgatccatctgggacatgcacagaacaagatctcgaaggacatcatcaaccgctactggtccatgcgcggctaccagacgccgtatgttccgggctgggactgccacggccagccgatcgagcacaaggtcgaggagaagctcggcacggagaagttcaaccagctcccgaccgtcaagatccgcgagatctgcaacaagatggctgtcgagcaggtcgacacgcagcgccagggcttcaagcgcctcggcgtcctcggcgagtgggcaaatccatatctgacctacacgcatgactacgatgcgaccgacgtcgagatcttcaaggccatcttcgacaagggcgccatctaccgtggcaggaagccggtgcactggtgcatgcactgccatacggctctcgccgaggcggagatcgagtacggcgacgaggtgtcgccggcaatcttcgtgcgcttcgagatgacgacagtgccggagggcctcgaggcctacaagggaaatctctgggtcgacatctggacgacgacgccctggacccttcctgccgatgacgccgtgatcctccatcctgaagccgagtacgtcggcgtcctcgttgatggacgctgcgagctcatggcagaggcgctcgtcgagaaggactgcgagaagttcggctacagcgactacgagcttgcccgcaccgctgacggctctgtctggaagatgacgggcaccgagctctgccacaacaagtacaagcagccgatcttcggcgaccagggcgtcgagggcgagttcatctatgctgactacgtcacgctcgaagatggcaccggcatcgtccataccgctcccggccacggcgtcgacgactacaatgccggcatgcgcttcaacatcccgatcgtgatgccggtcgacgacgacggcaacttctacaagggcgacggcatgggcacgggcggcccctggtccggcatgaacgtgaacgatgccaacccgaagatcatcgagtggctgaaggagcgtggcaccctcatccttcatgagaacatcacgcactcctatccgcactgctggcgctgcaagcagccggtcatcttccgtgccacgagccagtggttcgtctccatggaccagaccggccttcgcaaggaggcgctcgacgcgctcagccacgtccgcttctatccggcccattccatcaagcgcatcggctccatggtcgagcagcgcccggactggtgcatctcgcgccagaggaactggggcgtgcccatccctgcctacacctgccaggactgcggcgagaccgtgctgaatgacgagacgctcgacaaggtcatcgacctcttccgtgccaagggttccgatgcctggttcacggaggatccgaaggactatctcggcgatgcctgcgtctgcccgaagtgcggcagccacaacctcaaggcgaacaaggacatcctcgatgtctggtgggactccggcgtctcgcatactgctgtctgcaagcaccgtccgtacctcaagttcccggccgacatgtacctcgagggctccgatcagcaccgcggctggttcatgagctcgctcatgacaagcgtgggcgcctacggcgtcgctccctacaagtctgtcgtctcccagggcttcacgcttgacggcaaagggcgcaagatgtccaagtccctcggcaatgtcatcgacccgaacaaggtctgcagcacgcgcggtgccgatgtcctgcgtctctgggtggcctctgtcgatacgtcgaccgatgtcccctgcgacgacacgatcctggaccacgtcggcgatgcctaccgcaagatcaggaacacgttcaggttcctcctcggcgagctcgagggccagttcgagcttgatgccgacggacttcccttcgaggagctcacggcctacgacaagctgacgcttgcccatatgtgcgaggtccacaaggctgtcgagaaggcgtatggcgagtatcgcttcaacgtcgtctaccgcaacctctacgactacgtgacggagctctcgaacggctacctgaacgcgacgaaggaccgcatgtactgcggcggcagggactcgaaggagcgcaggagcgcacagacgacctgggcatacatcctctcgatgctcatccacgacttccagccgatccttgcctatacgaccgatgaggccatggcattcctgccgaagtcgctcaaagacggccagacgtttgccgcccttctcgactggttcgagaacccggtcgcagacgaggtcttcgagaagtacctgccggcctacaacgcaatgaccgaggccaggagcgccttcacgaaggcatacgaggaggcgcaggcagcagggacgattgccgagaagacgtcccaggctgctcgtgccgagctcgtgctgccgcatgatctgtatgagctcctcgccggcgagcttggctgcgatctcgccgagccgttcgtctgctctgacgtgaagctctccgagggcgacgagcttgcctgcaccgtgcttccggccgagggcgagaagtgcccgcgctgctggaactggcgcacgctcggcgcagatggcctctgcccgcgctgccatgcagccgtcgaagaggcaaacgcacgcgcatagcgattccgtgcaacaataggaggcggccgtgcttggcatggccgccttttcatgaagaaggaggatggatggcaaaggcaggacgaaggacaaggatcacgctctttctggcgatgacggcagtggctgtcatcttggaccagatcgtgaaggcctgggtgaggagcgcgctcccaaagacaggagacgccgcccccttcattcccggtgtgctgcgccttctccatgtggagaacacaggcgctgccttctcgatgggcgagggcaagggcttcttcttcgtcgcaatagctgtcgccatcttcatcctggctcttctcgctgtctggaaggaagagctctcggtgccgttcgcactcgcgcttggcgctgtcgctggcggcggcatcggcaacatgatcgaccgcctcgtccagggctctgtcacagacttcttcgcgacccagttcatggactttccggtcttcaatgtcgcggacatcttcgtgacgctgggcgtcatctgcgtcctcatctgccttatccgtgagggaggcgaggacaggcgtggctagtgcactcaggacatttctcgtggggccggaaggagacggcgagcgtctcgacagctttctggcatctcaggacaatatgccgtcgaggagcgcctgcgccaagctcatcgaatccggtgccgtcacgatcaacagcacgcatgccgactcgaagagcgagaaggtatgcttgggcgaccgcattcaggccgaagtcgaagagtcggaagaggtaggcggccctcttgcccccaatccctatataccgctcgacatccgcttcgaggacgaatatctgatcgtgctctcgaagcaggcgagccttgtctgccatccggcgccgggccacgtggacgatacgcttgccaatgcgctcgtcgctcactgcggctatggacatctcggcatgctccagggagaggagcgccccggcatcgtacacaggctcgaccgcgatacctcgggcctcatggttgccgccaaggatgacaggacgcagaaggcgctccaggacctcatacgcctccgtgtcctcgacagacgctatgtcgtgctcgtgcatggctatgtggcacctgacgacggcacgatcgtgacgggcattgcgaggtccacgaaggaccgcctgcgcatggcggtatcggacgatccgggggcacgcgaagcgatcacgacgttcaagacgctcgagcgcttcgaggcaggaaggcgcgacgaaggctacagcctcctcgagtgccatctctatacggggcgcacgcaccagatccgcgtgcatatgcgccatatcggacacccggttgtaggagatccgctctacggaaagggcagccttcttcagaacaaggggctcacacggcagttcctccactcctggcatattcgcttcgaccacccatgtactggagagaccatagagttggccgacagactgccagacgatctcctgaatgtattagaatcacttcaaggtacctcgatgggcctgaccgagcggggacgcgaggtgtgcccggagcttggcctgtccctgtgagagcgcccgatatgcgcctgaggaaagagggggttgcttcgtgggatatacgatgctcaaggcgggcctgacgcccatcgtaatcttcaacttcatcatgctgctgttcttcacgctggcatacttctaccagttcgtctatatcctgcatgtgtggagacgtggcgacgtgaagataccgcctgccaagaagcagcactgctatgccttcgtgattgcagcccacaacgaggagcctgtcatcggcaacctcgtgcgctccattctctcgcagaactatccgcgtgagctcatggacgtctatgtcgtggcagatgcctgcacggacaacacgtacaaggaagcgctcgatgccggtgccatcacctgggagcgcaatgaccttgtgcgcaagggcaagagctgggtcctcgactatgcgttcaaccgcatcctcgacgagaccggcgacaagtatgacggcttcttcgtcttcgacgccgacaacatcgtctcgcctgactatacgaagatcatgaacgatgccttcgaccagggctatctggtcctcacttcctaccgcaactccaagaacttcgattcctcctgggtctctgcagcctatgcgctctggttcctgcgcgaggcgaagttcctgaacaatgcccgcatggagcttggcacctctgctgccatctcgggctctggctggcttgtctcctcgagcatcatccgtggcatgcacggctgggatttccacctgctcacggaggatatccagttctcgacgttctgcgccgcgaacaacatccagatcggctatgcaccggctgagttcttcgatgagcagccggtcacgttcaaggcatcctggattcagcgcatgcgctggacgaagggcttctaccaggtcttcttcagctatgcgcgcgaccttgcccacggcatccgcaagaagcagttcgcttcctatgacctgctcatgaccatcgctccaggcatgatcttgacgctcgtttccgccttcgtgaatgccgcctatctcggcatcggcgcggcaagccatggttttttggcaacgcagggcgagctcctcatgtgtgtcggctctcttgtcatgaccttcggctccatgtatgtcgtgttcttcctgctcgcaatcatcacgacggtctccgagcgcaagcatatccatgcgcgcaagaagtggcgcatcatcacgaacatcttcacgttcccgctgttcatgatgacgtacattccgatcacggtcgtagcactcttcaagaaggtcgagtgggtgcccacgaagcatgacattgctgtcaacttccaggatgtcatgaacgaaggataggggagcttatgcggggaatcgggttctgcgcccgattccccgttttaggtgaatggatgcaaataataggcagatgggtgctacaatccgttcaaccaaaacggacgtagcgtttcgagcagatggaggcaacgcttcatggcaacattcttcgaaggagagtcccacactttctctgagtacctgctggtgcctggctattcatcatccgagtgcattccggacaatgtttccctgaagacaccgctcgtgcgcttcaagcgtggagaagagccttcgatcacgctcaacatcccgatggtgtctgcaatcatgcaggctgtctccggtccgcgtatggcaatcgcgcttgcccagcagggcggcatgagcttcatctatggctcccagtccgtggagtccgaggctgcgatggtcgcagaggtcaagtcctacaaggcaggctttgtcgagtccgactcgacgctaacgcctgacatgacgctccagcaggtcatggacctgaaggaagagacgggccactcctgcatgcccgtcacggatgacggcaccggccacggcaagctcctcggcatcgtcacgtcccgtgactaccgtccttcgcgcgacgaccgcggaaagcttgtccgcgacttcatgacgccgttcgagaagctcatcaccgctcccgacgacacgacgctcaagaccgcaaacgatatcatctgggagaacaagctcaaccagctgccgatcgtcgacaaggatcagcatctcgtctccctcgtcttccgcaaggactacgactcccacaagtcgaacccgaacgagctcctcgacgcccacaagcgctacatggtcggcgccggcatcaacacgcgcgactatgccgagcgcgttcctgccctcatcgaggcaggcgccgatgcgctctgcatcgactcatccgagggcttcagcgagtggcagaagctcacgctcgactggattcgtgcccactacggcgattccgtgaaggtcggcgctggcaacgtcgtcgatgccgaaggattccgcttcctcgcggactgcggtgctgacttcgtgaaggttggcatcggcggaggctccatctgcatcacgcgcgagcagaagggcatcggccgtggccaggcatctgctctcatcgatgtctgccgtgcccgtgacgagtactacaaggagaccggcgtctatgtgccggtgtgctccgacggcggcatcgtctacgactaccacatgacgcttgcccttgctatgggtgctgacttcatgatgctcggccgctacttcgcacgcttcgacgagtccccgacccgccgcgtgaatgtcaatggctcctacatgaaggagtactggggcgagggctctgcccgtgcccgcaactggcagcgctacgacctcggcggcaagaagaagggcctctccttcgtcgaaggcgtcgactcctatgtcccgtacgcgggctcgctcaaggagaacgtcgatggctcgctcctgaaggtccgctccacgatgtgcaactgcggtgccctcaacctcaaagagcttcgcgacaaggcaaagctcacgcttgtgagcgcaacctcgctcgtcgagggtggagcacacgacgtcgtcttgaaggaccaggatccgaacgtgaacttccgctaggagcgaagacaagatctgctcagagcctctgcctcgtgcaggggttcttttcatagcaaggctgagaagaagagagcgcctcccggatgacccggaaggcgctctgcctgcgatatgaaaactgcctagccctcttcgccgagcaggaccttctccggcaggatcggaagcgacctcacgtagcggcctgtcgcatgggcgacggcgcttgcaatcgccggggagggcgtattgatgacgacctcgccgatggacttggcgccgaaggggccagtcggctcatagctgggcatgaactccacgcgcatgtcgggcacatcgaggcgggaagggatcttgtagtgcatgaaggaatcggtgcgcatgtgaccgcgtgcatcgtagacgacctgctcggtcagggccatgccgatgccctggacaaggccaccctctgcctgcacacgggcaagcggcacattgatgaccgtaccgcagtcgacgacggcagcatagtcggtgagcgtgacctggccggttgccttgtcgacctccacttcggcgacgcctgccatgaagggaggaggcgactgcggctgcgtgtttgcgccatggccggaaagatggccctggttgaggccgaagccgatggccctgttcgcaagctccttcacgcccatctgctgcgtgccgtcggcgctcgtgacgacgccttccgagaacgtgacctcgtcgggtgcgaccttccaccaggtagcagcctgggcgcagatctttctcttgagctcctcggctgcgcggagcacggcaccacccgaggtataggtgccgctcgaggcgtaggcacccgtatcgtacggggaggtgtcggtgtccacgccttttaccacgatatcgtcgacagggcactcgagcacctcggcggcaatctgtgcaaggatcgtatcggctcccgtgccgacgtcggtcgcaccgatatcgaggatatagaatccgtcatcctcgagcgtgatgtcggcattcgcgatatcgacattgctgatgccagagccctgcatcgtaagtgccaggccgatgccacggactcggtctccgaggtcttcgctcaagggtctgtccttccagcctgccatctcgagcgcgcgcttcaggcattcctctgcccggcagctcctgagcggctcttcgccgagctggtggaggttctggcctgccgtgacgaggttcttgaggcggatctcggcagggtccatgccgagggcatctgccatctcgttcacggcagactcgacggcaaagcagccctgtgtcgcgccatagccacggaaggcgcctcccggcatcgtgtcggtgtagcagacgttgtaggcaaagcggctcggcacctggttgtagatgggcagggtctttcctgccgcaagcgtcacggtcgtcgagccatggtagccataggcaccggcattggagaggacatgaagatctattgctgtgagtgtgccgtcacgcttcgcacctattttcaccgtgagatacatctcgtggcgggagttcgtggccgagagcgtctcctggcatgtcaggatgcatttgcaggggtgtccggtctgtatggctgcaaaggcagcgtagacctcgcaggagcctgactgcttcgcgccgaagccgccgccgacgcggggcttcacgacacggatgcggctctgggggatgcccaaggctgttgctacctggcggcggatatggaaggggacctgcgtcgaggacacgatcatgatacggccgaaggcatccgtctcggcgtagcagcggaacgtctccatcatcgactgctcggctgcctgcgtatgataggtatgctcgagcacgatatcggctgcttcgaagcctgcatccacatcgccgtattcatggccgcctgtcgcgacgagattgcgcttcgggtctccggtcttgtcgccgccgaaggtccagtcgtcctcgtcgtggatgatgcagggattgtcgagggattcgcggacatcgagcacgtagggcagcttctcgtatttcaccttcacggcgtgcacggcaaggtctgctgcgacctcgttctcggcgacgacgatagcgacctcatctccgatgtagcgcacggtgtcgtccaggatgcacgtgtcatagggactcatctcgaggtagctctgccctgcaagcgtgaagcggtgatgaggaacatccttcgaggtatagatggcaacaacgcccgggattgcaagcgctttttccgtatcgacggaaagcacgcggccatgggggacagaggagcgcacgagacgcacgatgtaggcatcatccggtgcaaggtcgtcggtatagacgggacgtcctgcgaggagcgcctctgcatccttcttcacgacggcagaggagagcgtctttccacggtctggcgtctcgatctcggcagcggctttgcgcacctgctcgacggccgcctctgcttcggcagagccttgggagatctctgctcctgcagcgcggtcacggccgaggaagcgcctgatggcacgcatctgggatgtgtagcctgtgcagcggcagagattgtttgcgaggaagctcctcatctcatggccggtggcatcaggattcgtgcggtcgagcgcaagcacggccatctcgaggcctggggcgcagaagccgcactggtctgctccttctgcagcaaggcactctgcaagctccttgcgctccctgcccatgccttcgagcgtcagcacctcatggcccgagacgcgggacatgatgagggcgcaggagagttcgggcgagccgtcgacaagcacagtgcagaggccgcagttcgtcgtctcgcaggcgcacttcacgctcttgattccatgcttcctgagccaggagaggagcgtctcggccgggtctgccttggtcgtgacggggcgtccattgagggtgaaggcaatctcgatgctttcgctcatcgtgcatcctctctgatctcagaggtttcagatgaaagcggattagcggctgcatgctcgatggcacggtgtgccagcttgcgcgctgccgcctttctccaggaggcagagccacgcatatcggttccgaagggaagtgctgcgacaagctcttccacccggtcgagctcgtcattcgatgggtgctctgagagcgtgcaggacgagaggtccacaagctgtgcacgcttcggaagcgatcctacggcgaggcgccagcagccatcctgccagacggcgcagacattgagggcgctgaagtccgtggcagagagcctcacgccttcgaaggcggcgcgtgccggcgtatcggatagcgaaacctctgtgagcacatcgtgcacggtgcccatgcgggcaaactcggcaagcggcaacgtgccagcctttgcgagcgtgacctcggcatcgaagggaagaaggcagcagagcacatcggagaagcccatgcgggaaaagacggagccgccgacggttgcctggttcctgaactgggtgccgacaatgccctccgtcgcctctgcaaaggcgcctgcggtaaggtgtgcaaatgcttcgtcggtgcgtgcacgctcgatgcttgccatggcaccgatatggatcttttcgtcgacatgcttcacatagtcaaggcccgctgatgcaaggccgatcgcataggggacggtcctgtcctggaggcggagccacatcatgccgccgagcacggtagcgtggggatgttcctcaaggagcgcgagcgcctcttcgggcgagcgcggacgcgcatattcttcaaggcggagcaatgaaggccttcctctctttgtggccagaaccactcactgtgacgtttatggagccatttcagcagttcgcacgcttcatgccacgaggtatacatgcccgtgtcggcctcaggtccatatggggacgagatgtttaagcgcatggaaatgctgagccgttataatcagagtccgttacctgcttccgcgttagaaggagcgctcaggatgagtgacagcacgaacgagatgtctgccatcccggagtacgatgcccaggccatcgagaccaagtggcagcgcacctgggaggaagaggatctctacaagacggataccgatcccgccaagccgaagaaatatgtgctcgagatgttcccgtatccttcgggagacctccacatgggccatgccaggaactatacgatcggcgatgcaatggcacgccaggcacgcatgcgcggctacgacgtgctgcacccgatgggcttcgatgccttcggcctgccggcagagaatgctgccatcaagcaccatacgcaggctgcaaagtggacataccagaacatcgcccaggccgtgaagaccatgaagcgcatgggcttctcatacgactatgaccgcatgttcaacacctgcgaccccgagtattaccgctggggccagtggatgttcatccagatgtggaagcgcggccttgcctaccgtgcgacgagcccggtgaactggtgtccgacgtgcaagaccgtcctggccaacgagcaggtcgtcgagggccgctgctggaggtgcggctccatcccggagaagcgcaacctctcccagtggtacctcaagatcaccgattacgcccaggagctcctggacgacctcgacaagctgactggctggcccgagaacgtgaaggcacagcagcgaaactggatcggccgctccgagggcgtagagatcgacttcaagctcgccgacaccgacggtgtcacgccgactgaccgcacgatcacggtcttcacgacccgtgccgatacgctcttcggcgtgtcgttcatggtgcttccgcccgagagcgaccttgctgcagagctcgtggctggcacggagcatgaggaagagttcaaggcgctcaaggccgcaacagagaaggtctcttcagtcgaccgccagggctcggcgcgcgagaagcacggcgtcttcacgggccgctatgtgatcaacccgatcaatggcaagccggctcccatctgggttgccgactatgtcctcatggactatggcaccggtgccgtcatgggcgttccctgcggcgaccagcgcgacttcgacttcgcccgcaagtatggcctgccgatcccgccgatcatctgcgagaaggaagatccgctctacgacgggctcaaggaccagcgcgacctcgtcgtcacgaacgtcgactgggattctgcgatggcagcagagggctaccttgtgcagtccggcgagttcacgggcatgaagggcggcaagcactccgaagccgtcgatgctatcgtgtcctggctcgaggagcacagctgcggccgcacgaaggtgcagtaccgcctgcgcgactggctcatcagccgccagcgctactggggaaaccccatcccgatgatccactgcgacgtctgcggcgacgtgcctgtgccagaagaggacctgcctgtcaggcttcctgagaacctcgacctcggtgctggcgagacgcttgcagagtacgcgccgttctatgagacgacctgcccgaagtgcggacgtccggcaaagcgcatcacggacacgatggacacgttcacgtgctcgagctggtactacatgcgctataccgacccccacaacgacaaggcgccattctcgagcgaggctgtggaccgctggatgccggtcgacaactacatcggcggcatcgaacacgctatccttcacctgctctattcgcgcttctggacgaaggtcctgcgcgacatgggcctcgtgaagttcgacgagccgttcacgaacctgctctgccagggcatggtcaaggatgcaaacggcgagacgatgtcgaagtcgaagggcaatgtcgttcctccttcctccgtcatcgagccgtatggcgcagatacgatgcgtcttgccatcctcttcgtcgctcctcccgagaaggacttctcctgggatgaggaggcagtcgcaggctgcaaccgcttcctcaagcgtgcctggaggattgtctggcagctcgtcgagggtgccgatgcgaagacagctggcgctgtcgatttcagcaagctcgacgagggcggcaaggagctcaaccgcgagctcaaccgcctcggcatcaagtgcacgcaggacttcgaccgcgcgcagttcaacacggccatctccgccatcatggagcttgtgaatgcagcatcgaagtatgtgaacgcgcaccccaatggcacgggcgatgcagcgcttggctgcgcctgcgcttctgcgattgtccgcatgatggcgccgatcgctccgcactggtccgaagagctctggcatgccgcgctcggcgagacggattccgtctacaacgtgccctggcctgagttcgacgagaagcaggcccagagccagaccgtctcgatcgctgtccaggtcaagggcaaggtccgcggccacgccgaggtcgctgccgatgcatcgaaagacgtggtcgaggaggcggcgaagcaggctgtcgccagctaccttgagggcaagacgatcaagaaggtcatcgtcgttccaggcaagctcgtgaacatcgtcgctatctagcctgagggctcaacgagattcgaggaagggctccgcactgaaaacggtgcggagcccttctgctgtctatggaatgtgcctgccgggatgcaggcgctagcgcgtgccggcatcgtcttcgaggtaggtgcactccgagctgttcgtgcggatgatctcgcgcaggcgctcgatgtagcgggagagcagggcgctcggacgcctctcacggtggatcacatagccgacacgcatggtaggcgctcctgcgagagggaccgaggcgatgcctgactgcatctcgtccgagagcacgcctgtggagagcgtatagccgtcgaagtgggtaagaaggctcgtgagcgtgccgcggtcggagtagcggatggtctttctgtgtggaagctgtgaaagcggctcttcagaataatagaaagagttctccgttccctgctcgaaggagtagcgcggatagggctcgaggtcttcgggctggatgagatccttctccgccagaggatgctgctcgcccacgaagacgtggaccggcgcatcgaagaggggatggaagtcgagccgtgcatcctcgaatgccttctcgaggaccggcctattgaagccatcgagatagaggatgccgatctcgctcctgaagtcgcggacatcggagatgatcgcgcctgtcgcggtctcgcgcatgacaaagtcgtattcggggcttgagcagctcttcacgacgtcgacgaaggcctgcacggagaaggcgtaatgctgggcagatacggcaaggcgctcctgcggggcagacccctggatgaagcgctcctcgagcatgtctgcctgctcaatgacctggcgggcatagcccagaagctccgtgccttccgccgtgagctcgacgcccctgttcgagcgggtgaagatttcgaagccgaactcctcttcgaggtcgcgcatcgcgcaggagacattcgactgggcggtatagaggtttcttgccgctgcattgatggagccgtgctcggccacggcgatgagatagcggagctgctggagagtcatggagttccctctcagaaaaatgtgcaggtttgacgatgggtgacactcgtattaaactaccactgtcaaagttcaatcgtagaggaagtggggtggagttttcgccccgcttcctttgttatgtagggccgatagcccgaaggaggggatggctgtgtcgaagagcgcacaggaacaggacatcatcgatgccctcgagaaggcagcgcctgcgcatgcgatcgatatcgtggacgtgagcgtcgagggcgcaaagaccgctccgatcgtctgcatcaggatcgatcacgcagacgaggatgcagagccgatcacgctcgacgaggtgacggcacagggcggctggatcaacgaggtcgtggacgagctcgatcccttcccgggggcctatacgctcgagatctcgtcgccgggcatgtcgaggccgctcaggcgtccgcatgacttcgagcgcttcgcaggcgagaccgtccagatcaagctggacagggctgaaggcagaaagcgctggacgggcgtcctcaagggcttcgaggatggcgcagtcacgatcgataccgacgaaggggagcagcgcttctcgctcgatgagatcgccaagtgcacgatcaagcccgatttcgatactgctggaaagaagcgtggcggcaagaactaggccgccaaggaggaatgagatatggcatctgaaatgatggaagcgctcatggcgctctgcaaggaaaagcacatcgacgagctctatctgctcgatcgcctcgagcagtcgctcgcaaagagctacgccgacatcctgcacctcgattggggcgcaaaggtcacaatcgaccgacagaccggcaggatctacgtctaccgcctcgagccgaaggacgagtcctggaacgacgggaccggcgagttcgaggagttcgacgagatcgacgtcacgccgaaggacacgagccgtcttgctgcccagcaggcaaaggctgagatcaacaacatcgtgcgcaatgctgcccgccagcagatctatgaggagttctccgaccgtatcggcgacatcatcaccggtacggtgctccagtccacgcctgacttcacgatcgtgaagatccgcgagggcgtcgaggcagagcttccgcacttcgacctccatcgccatcctgacgagcgcaacgagcgtccggtcggcgagcactatgcgcacaatcagcgcatcaaagccatcattgtcgacgtgcgcgacccgaacagcacggtgcagccgacgcgcggcgagcgccagcgtccggccatcgtgatttcccgtacgcacccgaacctcatcgcgaagctcttcgagctcgaggtgcctgaggtctatgacaaggtcgtgaaggtgaactccgtcgcccgcgagccgggcatccgctcgaaggtcgctgtctcctctgtcgacgagcacctcgatcctgtcggcgcctgcgtcggcccgaagggcagccgtgtccgcacggtcgtctccgagctccgcggcgagcgcgtcgacgtcgtgctctgggacgaggatccggcaaagcgtgtcgcaaacgccctgtcgcctgccaaggtctcgcgcgtgcttgtcgaccccgagtccaactactgcacggtcatcgtgccggacgaccagctctccctcgctatcggcaaggaaggccagaacgcgcgcctggcagctcgcctcacgggctaccatatcgatatcaagaacgaatcgctcgcaaagagcatcctgaacgggacgcatatcccggctgtgcagcatgaggaggacacgctgatcgcagacgagggcgaggaaggccatcgctgcgagtatgtgagccctgacggcatgcgctgccgcaacatggcccgtccgggatcgaagtactgcggcatccacgagaagctcatggacgccgagatcactgacgatcccgattcgctgatctgacaatgcgacggaacgtcgcatcacacccgtcgcatctaggaaggttggttacatggcaaagacccgcgtacatgatttggcaaaggaatacgggatgtcgagcaaggagatgctcgactatctcgatcagatgaagataccggcaaagtcgccgtcctcgacgcttgaggacgtctacgtgaaccttgtccgcaagaagctcaagccgatcctcgaagcccgcgccgccgagatcgaggcccagaagaaggccgaggaagaggcaaagaaggaagaggagcgcaaggctgccgaggaggcagagcgcgagcgtgtggctgccgagaagcgccgtgcacaggagcgtgctgtcgaggagcagcgccgccgcgaggccgaggctgcccgcaagaaggccgaggaggagcgcgccgaacaggagcgcaaggccaaggaagaggcagagaagaaccgcgtcagggacacggctccgaagagcgtgccgtccttcacgagcctgctcgaccagatcgcccagcaggagaaggtcctgaagcagcaggaagaggagaaggaggcacgcaagaagcaggaagccgaagagcgtgctgccaggaagcgccagcgccccgagcgcaggaactcctccgaccgtggcggccgtaacgagcgttccgatcgtggtggccgcggcgaagagtgcaacgatgagcgccatgagcgcaacgagcgccgtggcttctcgatggacgaagtcagaaggaatgctgcccaggcagcgcctgctggcgagggcaagtccgacagccgtggcgagaaccgccgcaggaaccagaagcacagccacaggcagaatgacggggaagaccgctacacccgcatggcacgtgctgccgaggaatacaaccgcgagcacgtgctcgaagaagcccgctccgctgtcgaggaagccacgcgcgaatcgaccggccgccgcaagcgccgcaaggagcgccgtgccaagcaggctgccgaggctgccgaggagaagcgtatcgaggaggccgtgaagaacgaccaggacctctcccagctcgatacgatcaaggttccgcagggctcgaccgtggccgagcttgcagagctcctcaaggtccccgcaaatgacatcatcaagcgtctgttccttctcggaacgccgctgacgatgacgcagagcatgacagatgaccagatcgagctcatcgccgacgaccttggccgcgacgtcaaggtcatgaccaaggaggaggagaactccttcagcttctacgacgatccgaaggatctcgttccgaggccacctgtcgttaccgtcatgggacacgtcgaccacggcaagacgtcgctcctcgatgcaatccgccataccggcgtcgctgcaggcgaggctggcggcatcacgcaggccatcggcgcctcccaggtcaagattcatggccgcacgatcacgttcatcgatacgccgggccatgcaacgttcacggccatgcgtgcccgtggcgccaaggtcacggatatcgtcatcctgatcgtcgccgctgacgacggcgtcatgccccagaccatcgagtccatcaaccatgcaaaggcggcaaacgttcctatcatcgtcgccgtcaacaagatcgacaagccgggcgcaaatccggacaaggtgcgccaggagctcacggaatatggcatcatccccgaggagtggggcggccagaacatgttcgtgaacatctccgccaagaagaagatcggcatcgaggacctgctcgaggcagtactgctcgaggctgactacctcgagctcaaggcgaacccgaatacgttcgcatccggctatgtcctcgaggcaaagctcgaccgcggccgcggctctgttgccacgatccttgtgaacaggggcacgctgcatgtcggcgacgctgtcgtggcaggcacggcctacggacgcgtccgcgccatgcttgaccagcacggcaacaatgtggctgaagccaagccgtccgaccctgtcgagattctgggcctgcagtcgatcccgaatgcaggcgacgagttccgcgtcttcgacgacgagcgcgatgcacgccagctcgccgagcagcgccagctcaaggcccgcatcgaggagcagaacaaggccaagcacgtcacgctcgagaatctcttcgacacgatggaggagcaggacgtcaaggagctcaacctcatcatcaaggcagatgtccagggctccatcgaggctcttgtcgatgccctctcgaagctcgaccagtccgaggtccgcatcaacgtgatccacacggccgtcggtgccatcaacgagaccgatgtcatcctcgcagacgcctccaatgccatcatcatcggcttcggtgtccgtcctgatgcaaaggcccgccaggctgccgagaaggacggcgtcgagatccgtacctactccgtcatctacaaggctatcgaggagatcgatgcagcacgcatcggcatgctcaagccgacggaggaggagaagcagaccgccacgatcgaggtgcgtcagacctacaaggttccgaaggtcggcatcgcagccggctgcatggtccaggaaggcgaggtttctgccaccgaccaggtccgcctggtcaggaacggcatcgtcgtctacgatggcacgattgcatcccttcgccgctacaaggacgaggtcaagagcgtcaaggccggctacgagtgcggcatctcgctcgagaactatcaggatatccatgtgggcgacacgatcgaatcctacaagatcgtcgaggttgcccgtaccgagtaaggtcaagccatgaagcagaacaggaattcccgtcgcatcaacgaacaggcgcgcgagaagattgcagacatccttctgttcgagatctccgaccccgatctcgcgctcgtcaccgtgatgggcgccgaggttgcgattgacaagtccttcatgcgtgtctacgtgtcctgcgatgcagaccgctacgaggaggtcatggcggcgctcgaccgcgcaaagggccgcatccgctcgctcttcgggcacgctgttgcctggagggtgacgcccgagatcgagttccgcatcgatacgacgaccgacgaggccgagcagatcgcccgcgccctcaagaacgtcccgccgacgctcgcggtcgagaaggacgaggatggctacccgattcagccatccgagaccgaagccgaatagaggggctgtgcagtacgacgatatgaagacgcaggccgcatcgtttgcggccctcgtctccctgattgaggaggcgcagacgatctgtgtctgcgcccatacgagcccggacggagacgccctgggctcgggccttgccttggcccacatccttcggaggcgctggccggaaaagatggtcacgaacctcttggcagatgccgatccggtgccgaggatctatgccttcctgccgggtgccgatggcttcgtgcaggccaaggactatgaaggggcaccagacctcttcatcagcgtcgatctgccggcaccgtcgcgcctgaatgaggcagaggctgtgctcaggcgcgcgccgaaggttgcagagatcgaccatcatccttccgagaagccgttcggtgacgtgcacgtcgtgcgtcccgatgctgctgccaccggtgtcatcatcgccgagttcgcgcagcatatcgaggcggagatgacgccggagattgccgactgcctcttctgcgccatcatgaccgataccgggcgcttccagtaccagaacgcgaatccggaggccttcgatatcgcctcctatctcgtcgattccggtgcgaacccctcgaacgtgtcgcttcatgtctatcagagcttccgtctgcagtacctgcatctcgaggctatggtcatgtcgaggatcaagacgtttctgggagggcgcatctcctacagctactccacggtggacgacctcgagcgtaccggtgcccagctcgacgagtgcgacgggctcatagacgtcgtgagaagcgtcgacggggctgaggtggcgctgttcctgaaggagcttcctggcggcggcgtccgtggcaacctgcgctcgaagagcgactacgatatctcggtcgtcgcgcgcgagctcgggggaggcggccacaaggctgctgcaggcttcacactgacgggcgacctcgacgaggcgctctctgtcgtgctgccacgcctcaaggcgctgctcacgaacgagccctgcgctcctgccatgggcggggtgagcgagtgaagcgcggacagagcggactgaatcttcttctggctgtcgacaagccggaaggcatcacaagccatgatgcggtgtcgaaggtgcgctatgccttgggcgagcgccgcgtaggccatgccggcacgctcgaccctgccgcctctggccttcttgtcatcggcgtcggccagggcactcgcctcatgggcatgctgacgcaggaccagaagtcctatgaggcccgcatctcgtttggccgcgagaccgataccgatgaccgcgaaggcaagaccgtgcgcgaggccgaggtgccgaagcgtctcttcgatgaggaggaagcacgccgagccctggctggccttgtcggtgtgcaggatcaggtgccgccagcatactctgccatctcgatcggaggcaagcgtgcctatgcgctcgcccgtgaaggcgaggcggtcgagcttgcttcgcgccggatagagatataccaggccctgctccttgcagtcggcgaggacgacgaagggctcttctgggactgcgcgttcatggtatcgaagggcacctatatcaggagcattgcccgcgacctgggacgctctctggggagtgccgcgcacctcggggcgctccggcgcctttcatccggaaacctcacgctgaagaatgcgcatgcgctcgaggagattgccgaggcaggcgccgatggcatcctttcccttgcggcagatccggtgcgtgcgctcggcctgccgaagcgtgctgtcacagactctgagctcgagaagctcctccagggaaagacgcttccccgcggcagtatcgacctcaaggaaggggagcgctgtgcgatggtctcatccggcaaggtatacggtgtatgggaatgtgtgaacgaccgtctcaagacggtcgcgaatttcccggcgggcatatcaggcgtccgctagagacaaggagagagaatatgcaggagcagtgtggcggcttcgcactgccactcgatgcagcggcaaagcaggcgcttgtcgatgcggccaccttcggacaaggcaggctgcccgagccacgtgcgcatgagctgggaacgctctatctgcgcaaggcagcctcccaaaagctctcctcctcatcggtcattgcgctcggcgccttcgatggcctgcatctagggcacagggccctgattgcccgccttgtcgcagatgcctgcagccgcgagcttccctctgtcgtcgtgaccttcgaccccgatccttccgaagtcgtaggattgcgtcctgaagcgaggctcctctctgtctctgaccgcgtacggggcctttcttctctcggtgcagatgccgtccttgtcatgcacttcacgcccgagcttgcagggcttgctcctgctgctttctgcacacgcatcgaggaagcgcttcatcccgtatccgtgcatgtcggcacgaacttccgcttcggcgcacgtggcgcaggcgatatctcaacgctccaggagattctcggaagccgcggaatcgatatcgtgccgcaggatctggctctcggaggcacggagcctgtgagcgcgacaagaattcggcatcttctcgcgcagggcgcgctcgatgaggcggcagagcttcttggccgctgccattacgtccgtggcttagtcatgcacggccgcggcgaaggcaccggcatgggctttgcgacggcgaacgtccagtgcgagccgctttctgccatgcccgctgaaggcgtctatgggggatatgtcgtcgtggaaggcgtgccctatgcctctgctatcaatgtcggcgctcccaagagcttcgaggaaaccaagcggcccaacttcctcgaagcgcatctcctcggcttttccggcgatatctatggacgggaggtgcaggtcatcttctgccgctggctcagggcacagcgcaggttctcttcgatggcggaactcgaagcagtggttcgcgggaacatcgagtgggtacatgtgaacctgagtgccgacagcgagggggcaatctgttgataaccgacgaagacaaggagcgcgtcaggcaggcgaccgatatcgtccagcttgtcggcgagaccgtcgtgctgaagcagcgtggccaggaattctggggctgctgcccgttccatcatgagaagtctccgtcgttcaaggtgaatccccagactggcctctggcactgcttcggctgcggtgccggcggcgatgtgttcagctatgtccagcgcagggagaacctcgagttccccgatgccatccgctatcttgcagaccgtgccggcatagagctcaccgaagagaagacggcacaccatggcccgaagaggcagcggctccttgcctgcctggccgaggcagagagcttctacacgacgatgctcatgcgcggcaagggggagggccctgctgcggcgaggagctatttctccggacgcggcttcggctctgccatctgccgttcctggaacctcggctttgcgccggggcatggcatgcttgcggcacatctgcgctcgaagggcttcacgaaccaggagattgtggcggcagacctcggacgcgaacgctcggggaggatctccgaccggttcttcgaccgtgtcatgttccccatccacgatgagcagggacgcacgattgcctttggcggcagaatcctcgaagcgacaaagcatgacgggatcgcgaaatacatcaataccggcgatacgccggtcttcaacaagaggaagcacctcttcgcgatagacaaggcacgcgatgcgatggtggagacgggcacggcaatcgtgtgcgaaggatataccgatgtcattgccctccacgaggcagggttcaggaatgcggttgcagcgcttggcacggcattctcgctcgaccatgtgaagacgctcgagcggctgcgcgtgaagcgcatcatctgcatgttcgacggcgatgcggcgggtcagcgtgctgccgagcgcgcagtacagtatgtggacaagacgacagccgagcttctctgcgtcgtgctgccgaacaaccaggacccgatggagtttcttgcgtcgcatccgaaagaggagatggaaaagcagctcgcaggcgcgcgtcctctcatcgatttcgtgttcgcaaagcggctcgaagcctacgacctcacgattccgggtgtccgcgtgaaggcgctcgacgaccttgcgggacttctggctccgctcaaggactcgcccctgatcgactcctatgcactgcagctcgcagatgctcttggcatggaccccgaagagacgaagcggacgattcgcagaaagccgctgccgagggagacggcacaggcacctgccgcacgcaggaccgcgcgtcccgagcaggagcagataccgacctatgacgggccaagctacgacgatgcggactactacgaggaggagcaagcggactacgtgccagatgatgcctacggagcagcggcgccggtaccgactgcactctcctcggacgagcgccgccagatcgatgcggagcgcgagcttcttgccctgactgccgcctatccgaaggaagcgcgggcctactcgcagaggattgcaggcttttcctgggcggactcgagacacgaggcgatggcatgggcgatgctcgcgacgcctgaggatgcagcgcctcaggatgtcgtggcagcggcgacctctgtctatcccgaagcggcacagcttctgggtggcggcaggcttgcctcggctgaagggatgacggcggggcagaagatggcttttctcgtcgataccgtcgagctctattccacgaagcgcaagatccgtgccatcaggaccgagctcagaagcacgcctgatgcgctctccgaccgcacgaaggagctcttcgtcgaagcgacgcagctacagcggcatgtgcaggagctgtcaggcagactttctgcgtctgcggacgctcaataacgggtaaagtagtaaagattgtgcgtcgaaaggaaatacgtggctacaaagaagtcgaaagaggatatcaagctgtcccccgaactgatgcaggccgtcgatgcccttgtgacgaaatcgtccaagaatgacggaacggtatctgaggatgatatccaggtcgcaacccgtgatatcgatgtcgattccgaagaactgtcgaatctctatgacgtgctgcgctccaagggcgtagatatcgcgagcgacgatgcggcaatgccgaatgtcgatgaaagctcgatagacggcatggacgacgacctcgattcggacagctacgaggacgatctcgaagacggcctcgacgagggtgaggacgaatcccgcgcaagcgaggcaaaggaagtcaatgccgtgctgcgctccactgccacgaagggcaagacctcgaagaagcgctcgacccgcagccgcaaccgcagagctgatacctctacggtcatgctcacgggcgacccggtcaggatgtacctcaaggagatcggcaaggtcgaccttctgactgctgacgaagaggtccatcttgctatgaagatcgaagccggtgccgaggcaacggagaagctcgaagctgccgagaatggcgatatcgagctcacgcgtgccgagatgcgccgtctcatgcgcatcgagcaggtaggtctcgacgcaaagcagcagctgatctcagccaacctgcgtctcgtcgtctccatcgcaaagcgctatgtcggccgcggcatgctcttccttgacctcatccaggaaggcaaccttggccttatccgtgctgtcgagaagttcgactacacgaagggcttcaagttctcgacgtacgcgacgtggtggatccgtcaggccatcacccgcgctatcgccgaccaggcacgcacgatccgcattccggtccacatggtcgagaccatcaacaagctcgtccgtgtccagcgccagctcctgcaggatctgggtcgcgacccgacaccggaagagatcggcaaggagatggacatgtcggcagaccgtgtccgcgagatccagaagatctcccaggagccggtctcgctcgagacgcctatcggcgaggaagaggactcccagctcggcgacttcattgaggattccggcgctgtcgctcctcctgaggcagcttccgagtcgatgctccgagagcagcttgaccaggtcctcgacggccttgcagaccgcgaacgcaaggtcatcaagctgcgcttcggcctcgaagatggccatccgcgcacgctcgaggaggtcggacgcgagttcggcgtcacgcgcgagcgcatccgccagatcgagagcaagacgcttgccaagctccgccatccttcccgttcgggacgtctcaaggactacatggaagagtaggcacaaaatgcacgtccaggcagctgcaggcatgcagctgccttttttcatggaggagggagcaatggacagggaccatatcgagcggatagtcgaggatctcatcatctgcatcctccttgctatcctcattgccctgatcgtccagctcatcttcccgagttcgggcatatctatgggcatccccttggtgattccctttgtcttcgtcttcccgatagggtggaagcaccggggcaggaacggcgggaagaaatgatactgcaagagcgcagcaggattcaggcctgctgcgctcttgtcatgtctgggacgtctggaaagccttgctgcaaggagcgctcggggatggcgggcaggctgtccgcatctggtggcttccggtgctcgtggaggcggctatgccaatgactgcggcaggattcccatcccttttacgcgacctcgactgcattgtcgtgaaccacctggagtccgaccactgcgcctcgatggtcgaggtgctcgccctctatccgaactgccagatcgtgtcgaccgagaagtcgttcatgctcatgcacagcttcggctatgatatcgactcccatagccagctccaggtacaggagggagactcgctctctttcggcaggcatgaagcgaccttcatcgaggcaccgatggtccactggcctgaggtcatggtcacgctcgacctcacggacggcgtccttctccgccaatgccttcggcagcttcaaggcaatcgatggcaggctctgggcagacgagtgcgactgggaccgggattccttcgatgaggtccggcgctaccactgcaatttcgtcggcaagtatggcccgcatgtccagcttctgctcaagaaggcggcaggcgtcctcgacaagatcaggatagtggcaccgctccacggccctctctaccgcacgcctgaagacaccatgcgctacatcgacaagctgaaccgctgggcaagctatacacccgaggagaagggcgtacttgttgcctatgcctcgatatagggcaacgctgagaatgccgtgcagcgccttgctgccgagctctgcaagcgcggcgtcacgaacgtgaagctctgcgatgcctcgacgacgcaggcatcctacctgattgccgatatgttccgcctctcgcacatcgttctcgcctcgccgacatacaacctgagcatctgccctgtcatggagagcctgctctccgagatgaagatgctgaacctccagaaccgacatatcgtgctggtggagaacagatcgtgggcctgcacggtcggcgacctcatggaggactgcatcgacgagaacatgaaggacatggaggtcttgaacgagcgcctctcgatgtcctcgtcgcttccggatttgaagggacgcgaagccgagtccctagcacaggctatcgccgattcggtggaagaggtcacttgcgactgctcgaagcgcttcgagaagaagcagaagcaggaagagccagaaaagaagttttaggcaggtgccgtgtcggtgcctgccttttgctgtgaggtgaggagatatggcggctcgcgctagaatcagcttgtaaattggcggatggcgggaggcaggatggacggagcggggagagcggtcgaggcgtcttccgaattttcggagcttgtgcagattgtcgaggcgacgggatccacgaacgacgatgtgctggggcttgctgctgaagacgctcctgaaggcacggcggtctgtgcgaagaggcagacgacgggacgcgggcgccgggggcatagctgggtctcgcctccaggaggcctctatatcacggtgctcctgcggccaaggacagatgaatgtgtctcgtcagggcttcctgctgtgacggcacttgctgtcctggaaacgctcggaggtcttggagcagaaggcctctgcctcaaatggccgaacgatcttgtgctgaagaaggctgatggctcgcttgcgaagcttggcggcatcctcgtcgagtcgcggcaggagagcgggggcgcgtggcatgcagctgcaggcatagggctcaacctcgtgcgtccagctcaggaaaagatcgtgccctcgcgcgtgcacgacgggatggcgaagcccctgcccgctgcctatctcgaagatgccttcgctgatgaggtgccagaccttctggaggaaggcttcggcgcgcttgccataagcctggatgcatccatcgtctcggcctcgcgtgtctgggccagaaaggcaagccccgaaacagggccgcttgctcccatcagagagcgcttcgagcgcaagctcgcctatatcggagatgatgtctttgccatagatccagctggcatgcttctggctgagggaagattctccggcatcgactcctggggaagggcgcagatcgctcttggggatggctccgtgcgcatctttcttccggaagaggcatcgctccgtccgtgccattgattggcagatatgtggacatgccgcgcagagccttctgacgcttcacatccgaaaatgattagttagactaaataactgttccgagactggtattgcagctctgaaaccaggaggaggaaagatggacgtggaaacgcgcggcgagcttcctgaagacggagcgccggacatcgacgtacaggacgactcggccttcatcagcgagatatcacgccttctgagcagcacgttcgaggccatcatccgcctcgaggactgcgtctaccgctcccatgggatggacctcacgaactccgagctgaacctgctctcgacggtcggcaaggccatgctcgtcgctcaccgggctctcagcatgtccgagattgcagacgctctcggcatcaagcgtccctccgcgaccgctatcgtgaagaggctcgaagcgaagggctatatcgcgaggaagcggagtgcagacgatgcgcgccgcatcgatgtgacgctgacccgcaagggagaatgcgtctaccgtatccatgcaatattcaaccgaaagatggcagccgagatttcccgtggccagtccacagaggagcgccgtgtgcttctgcagggcatcagccgtctcgaacatgcctatacagaagctgaacgcgctgccgtgcaggcagtcgcgcgggcgccttttgcaggaaggagctagcgtggcattcacgattgtcggcaccggatcggcacttccgaaaaggaaggtcacgaacgacgacctttccgagttcctcgatacctcagacgagtggatctccacccgcaccggcatcaagacacgctatgtctgcacggacgagtcgctcgacgaccttgccgcagaggcatctgagcacgctctggccgatgccggcatagaggcgaaggacatcgacctcatcatctgctccacgacctcaggcgaccatctgatgcctgcagaggcctgtgccatagccgagcgccttggtgccagctgccctgccttcgatgtctcggcagcctgtgctggattcgtctttgcgctcgatacggcagatggctggttctgccgcggacgtgcgagacgagcgcttgtcgtctctgcggagaagatgagccgccttctcgactgggaggaccgcagcacctgcgtgctcttcggagatggagcggcagctgctgtcgttgaggcaggaggcaagagccctatctggagccatcttgtcacaaagcccgatgttgcttcgctcgatgtgccaggacttcagggcacatctccctttggcagcaccgaagatgcccagccttcgaagcttctcatgaaaggacgcaagatcttccattttgccgtctcgagcatcgaggaggagctcaaggccctcgaaggcgagtcaggcattgcgctttccgatatcgaccatttcgtcttccatcaggccaacgagaggatactcgatgctgttgccaagaggtgcggcatcgacccttccaagatggcccataccatacaggagaccggcaacatctcgagtgcctgcataccgcttgcgctcgaccgcatgtcccgtgaggggagcctccatgcaggagagcttgtcctcatctgcggcttcggtgccggcctcgacatcggcacgaccctgatccgctggaataaggaacaggacgcataatcgctatcaggcgccttcggcgcatgagatacgcgcttcggcgcagaaagagaaggagaaacatcatggcagagtcaacgttcgatcgcgtcgtcgcaatcctcaaggaccaggagggcctcgacgacgtcgagctcaagcccgagacgaagctcgctgaggtcggcctcgattccatgagcactgtcgaggcggtcatggcatgcgaggacgagttcggcatcgagatcgaccctgaggccaacccccagacgatccaggagttcgtcgacctcgtcgaggctcagctctaaagagtacccagcaggaaaggatgaaacgcgtatgatcaagactcctctctgcgacctgacaggcatcgagaagccgatcttccagggcggcatggcatggattgctgatgcaagcctcgccgctgccgtatcgaatgccggaggcctcggcatcatctccgcgatgaatgccaatgccgactggctcaggaacgagatccgcgactgccgcacccgcacggcaaagcccttcggcgtcaacatcatgctgcagagccccttcgccgacgaggtggcccaggttgtggccgaggagaaggtccctgtcgtcgtgacaggcgcgggcaatccgagcaagtacatgaagacgtggcaggcggccggcatcaaggtcataccggtcgtctcctcggtggcgcttgcacgtctcctcgagcgtgtcggcgcatccgcaatcgtcgccgaaggcggagagtccggcggacacgtcggcgacgtctcgacgatggcactcgtgccgcaggtcgtggatgccgtgaagattccggtcatcgcagccggcggcatcgccgatggccgccagatggcagctgccttcatgctgggcgcctgcggcgtccaggtcggcacccgcttccttgtggccaacgagtgcacggtttctgacgaatacaagaagcgtgtcctcaaggccaatgacctctcgacaatcgtgaccggccgctccatcaacggcgccgtgcgctgcctcaagactccgttctcgcagaagttcctgcgtgccgagaaggaaggcgccacggctgaagagcttggcaagatgggcgccggctcgctcaggaaggctgccaaggacggcaactatgaagaaggctccttcatgtgcggcgaagtcgctggcatggtgaagaaggagcagtctgcagcagagatcgtcgacgatctcatgcagggctgcgaagaggcgctcaagggggcaacgaagtggctggcgtagcattcctgtttgcaggccagggctcgcagaagcccggcatgggcaaggccctcttcgattcctctgaggctgccaagaaggtcttcgatggcgtggatgcggtgcgtccgggcactgcctcccagtgcttcgaaggcacgaaggaagagcttggccagaccatcaacacccagccctgcgtctttgcaacggaccttgcggccgcagctgcgctcgaggaccttggcatgcatccgaatgtggtggcggggcactcgctcggcgaggttgcagcgctgacctttgccggcgccttctcgctcgaggagggcacgcgcctcatcgaggtccgcgcccaggccatggcagactgcacggccaagcatcctggcgccatgcgcgctgtcctcaagctcgatgccgcaaaggtggaagagcttgcccacgaggcaggcgaggcatggcctgtgaactacaactcgccgcagcagaccgtcgttgcaggctctgccgaggcctgcgagaagctcgatggccttgtcaaggcagcaggcggcaggagcatgaaggttgccgtctccggagccttccacagcccctacatggctgaggccaccgaggcgctcgccgcctatctcgagacgaatcctgtccatgcgccgaagctccctgtctacgcaaacaggacaggggagacctatccggaggatgtggctgagatcgccgcgctcctctccgagcaggtctcgaatcccgtgaagtggaccgctgagctccatgccatgcaggatgccggtatcgatacgttcatcgaggtcgggccgggacacacgctcacaggtctcgtgaagaggacgctcgaaggcgtggatgccgtctgcgtcgagacacccgaggctgccgaagaggcacgtgccctcgtggctggaaaggggctcatctgatggcagaagcaaagacgggcacgttcgagcgcgatgcttcgcgccgtgtcgcgcttgtgaccggaggctcgcgcggcatcggacgcgccacggcgctggagcttgccaaaggcggctacgacgtcgcgatcgtctatgccggaaacgaggcagcggctgaagaatgcgtcagcctcctgaaggaggcgggcgcgaccgcgaaggcatatcgctgcaatgttgccgatgcagacgaagcgaatgcgaccgcaaagcaggtgcaggaggacttcggctctgtctgggccctcgtgaacgacgctggcatcacgcgcgatacgctccttgctcgcatgaaggacgaggacttcgacgccgtgatcgacgtgaacctcaagggtgcgttccacatgatccgtgccctcatgcgcggcttcgtccgccagaagggcggccgcatcgtgaatgtggcatcggtcgtgggactttccggcaatatcgggcaggcgaactatgcagcctcgaaggcaggtctcatcggcctcacgaagacggtggcaagagagcttgccggcaagggcgtcacgtgcaatgccgtggcaccgggcttcatcgagaccgcgatgacagagaagctgcccgaggcgacgcgcgccagctatgaggcggagattcctctcaagcgtctcggcacaacagatgaggttgcccaggtgatcgctttcctcgcatcggatgcagcatcctatgtgacgggagagactatccggatcgatggcgggctgtgcatgtagcgcagcttcctgcaaaggaaggaacaatatgaaccgcagagttgtcattaccggcatcggcgctatcacgcccgtcggtctcactgcccacgagagctgggatgccctggttgccggcaagagcggcatcggcgagatcacggccttcgatacggcggatttccgcgtcaaggtcgcagccgaggtcaagggcttcgacgctgaagccgtgctcggcaaggcagaggcaaagcaccacgaccgcttcacgcagtttgcgctcgtcgcctctgacgaggccatgaaggactccggcctcgatgctgaaggcgccatcgagcctgagcgcctcggcgtctatatcggatcgggcatcggcggcatcggcaccatcgaggagcaggtcgagcgcatgctcaagggtggcccgcgcaagatctcgccgttcttcgtgccgatgatcatcgcgaacatggcatcgggcgaggtctcgatcaggcagaatgccaagggaccgacgcttccggtcgtgacggcctgcgccacgtcgacgaacgcgatcggcgaggctttccatgccatcaaggcaggagcagccgatgctatcctcgcaggcggtgccgaagcggcaatcgtgccggtctccatcgccggcttcatgaatgcccgtgcactctcgacgaaccccgatcccgagacggcctgccgccccttcgatgcagaccgcaatggctttgtcatgggcgaaggcgcctgcgtgcttgtcctcgaggagctcgagcatgcaaaggcccgtggcgcccacatcgtggccgaggtcgcaggctacggcaacacggccgatgcctaccacatcacctcgcccgatcccgacgcatccggcatcacgcgtgccatcaaggaggctgtggcagaggcagggctcgaccccaaggagggcctctatatcaacgcccacggcacctcgacgaagctcaatgactcctccgagacggagggcatcaagcaggcacttggcgaggaggcagcctatgctgcccatatctcgtccacgaagtcgatgacgggtcacatgctcggtgctaccggcgcagtcgaggcaatggcaagcgcgtatgcgctcgagcacggcatcatcccgccgaccatcaactacaagacgccggatcctgcctgcgatctcgactacacgccgaacaaggcacaggaattcgatgccacatgggcgctttcgacttcgctgggctttggcggccacaatgccgtgattgcgctcaggaagtatgaggaggcgtaaggcatggataccacaacgaagaggatcgatgcggtagccgagctcatgcagaagcgcgggcttgcccgtgtccgtatcgaagagggcgactctgccatcgagctcgagcgtcctgaagccttcccggcaccggtcatggcaggagcggctcccgcagaggtgacgtccgctgcggcacccgcagaggtagcccctgcatctgaggcagcaccgcttcctgcagcggatgcatccgagcctgaaggcgaggagccgctcgacatgtcgaaggtcaccgctgtcaaggctcccatggtcggcgtcttctatgcggctcccgcaccgggtgccaagccttttgtgcaggtcggctcgaaggtcaagaagggcgatgtcctctgcgtcatcgaggccatgaaggaaatgaaggaagtcacggctgactgcgacggcgaggtcatcgatatcacggtctccgacggcgagctcgtcgagtacggctcggtcctcatgaagatctactagggagatggcatgaacaagacagagctggagaagattctgccgcacaggccgccgatgctgcttctggacgatgccgaagtccaggatggcaaggccgtgggacatatcacgatcaagggcgacgagttcttcctccaggggcacttccctgactacccggtcgttcccggtgtcattctttgcgagatgctggcgcagaactgctgcgtccttctggcagatggcatcgacaaggaacaggcgacgccgttctatacgagcctcgacaaggtgcgtttcaagcaccaggtgaggccgggcgataccgtgaccctcgagtgcgagctcacgaggagccatggcatgttccacttcgcccacggcgtggcaaaggtcggcgacacggttgcctgcgtggctgacatgtcgtttgcgctcgtcccgaagaaggacgcatagaccatgttcgagaagatactgatcgcgaataggggagaggtcgccgtccgcatcatccgcgcctgcaaggagatgggcgtcaagacggtcgccatctactcgacggccgatgccacggcgctccatgtgacgcttgctgacgaagcctactgcatcggcggcccgcgtgcctccgagtcctatctgaacacgaatgcgatcatcacggtcgcgctcgagtcgggtgcttcggcaatacatccaggctatggcttcctctccgagaatgcctcatttgcccgcgagtgccgcgagcatggccttgtcttcatcgggccttcgcctgagattatggagctcatgggagacaaggatcaggcacgccgcacagcgagatcggctggcgttcccatcgtgccgggctgcgacctgctcgagtcttctgcgcaggcagaagagaaggccaggcgcatcggctgccctatgcttgtgaaggcacgggcaggtggtggcggacgtggcatcaggaaggtgctcaagccagaagatgctcccgctgccttcgagcaggcacatgccgaggcacagagcgccttcggcgacggcgaatgctacatggagaagttcatctctccggcacaccatatcgaggtgcagatcctcgcagatggccacggcaacgtgttctcacttggcgaacgcgagtgctccgtgcagcgcaggaaccagaagctcctcgaagagagcccgagtccctgtccggcgctcacgtctgagatccgcgagcacatgttcgagtgtgcccgcaatcttgcaaagaaggtcggctacgaggggctgggaacgatcgagttcctcttcagcgataccggcgagttctggttcatggagatgaacacgaggctccaggtcgagcatccggtgacggaattcgtgacgggcatcgaccttgtcaagtggcagctccgtgtcgctgcaggagcagacctctcgaactggaagcaggagaacatcaacgtcgtgggacatgcaatcgagtgtcgcatcaatgccgagatgcccgatttccttccgtctgcaggagacatcacgatgcttcacacgccgaatggcccctgggtgcgcttcgactctgccctctatgtaggctcatcggtgccgccctactacgactcgctactcggcaagctcatcgtctattcgccgacgcgcgaagaggcgatacgcaagatgcgctctgctctgggagagcttgtgatcgagggtgtcagctacaatgccgatcttcagctcgatatcctcagcaatcccgaattcctgtcgggcaactaccatacaaatctgatggagcacctctatgagtgaacgccagaagtctctgaacgagcttgaagggcccgtcaccgaagtgccgatcgatattccggagcgcacgattctcgtgcgctgcccgcattgccgtcatgctatcgatgccggggtgctgaagcagaacctcgatgtgtgcccgcgctgcggcaagcacatgcgcatcggcgcaaggagaaggcttgccctcacggcagatcaaggctccttcgaagagtgggacgccgacatcgaggcgaaggacatcctctccttcccggactacaaagagaagcttgccgctgcacgccagaagtcgggcggggagaaggaggccgtcatctgcggcagggcgacgatccagggcgagccctgtgccctcttcatcatgaacggcgacttcatgatgggttccatgggagctgctgtcggcgagaagatctgccgctgcttcgagcgggcgacagaggaaggcctgcctgttgtcggcttcacggtatcgggtggtgcccgcatgcaggagggcctcacctccctcatgcagatggccaaggtctcgaatgctgtacgccggcacagtgcagcgggcctcctctatatctgtgtccttaccgatcccacctcgggcggcgtcacggcttccttcgcaatggaggcagacatcacgattgcagagcctgacgcgctcgtcgccttcgcaggtccgcgtgtcgtcgagcagacgacgcacaagaagctgccccagggcttccagcgctcggagttcgtccttgcacatggcttctgcgacatggtcgtcgagcgcaaggagattccctccacgctcggctatctgctctggcttcatgacaaggaggcgtggggcacacgcgaggcaccgaagtgtgcggctgccttccccgaggaggcacgctggccgcttccgcaccatctcgagaagccggctgctgcagatgcctctgcctatgaccttgtgaagcgcgtgaggaatgccgacaggccgtctgttccctccatcatggacatgaccttcgagggcttcatcgagctccacggggatcatgagttcggagacgatgctgccatcgtggccggccttgccacgcttgatggacatcctgtcacggtcattgcaaccgatcgcggacgcggcatcaaggaacgggtggccagaaactatggctcgcctgagcctgaaggctaccgcaagtcgctccgtctcatgaaggaagcggagaagttccatcgccccgtgatctgccttgtcgatacgtccggtgcctatccgggcatggaggcagaagagcacggccagggcgccgccatcgcagacaaccttgtcgcaatgggcgctctcaggacccctgagatcaccgtcatcatgggcgagggcggctcgggcggtgccttgggccttgccgtctcagaccgtgtcctcatgctctctgatgctgtctattcggtcgtgagccctgagggctgctcgacgattctcttcaagacagcgaagcgcgcagccgatgctgccgaggctctcggcatcactgctcccttcctcaaggatctgggcatcatcgacggtattgtcgacgccgagggcttcggcaccgaagagttcgcagagcgcttcaggaaatgccttgcggatcaggtgcaggagctcgaagggatgacggaaggcgagcttgtcgatgctcgctacgagaaataccgtgccatcggaaggagagacagctgatggagaagaccacagggctcacggcaggtctgggcgccctcacgacaggcggaggcgatctgccacagcgtccggttgcaatcgtctgcgattcctcctgcacgctcgcgcgtacccgtgcagaggagctcggcgtcacgatggtgcccatgcactacaacgtcgacggtgtccgctatgcggagaccttccggaacgagaatggcgactacgactctctcttccggaatggcaggctgctcatgacagaagcggtctaccaggacgagtttgctgacgaattcaggcgcctcctcgatgctgatttctcggtgctctgcctcacaatctcttcgaggctctctggcacctacaggagcgctgtgcacgcacgtgagcagctcattcgtgaaggagaggcaccggagcgcatgcgcatcatcgactcctggacgacttcgggcgggctcgagttcctcgtacgtcaggcacgcaagctcgtgagcctgggctatggcctggagacggtcggtgagaagctcgaagcggagcgtgcacgtcagggcatcgatttcacagtgccggatctcgaggttctcaggaaatcggggcgtctcggtgccacaaggcgcgccgttccatcgaaccttgaccgcttccttgtcatggagctccaggagggcggcatcaaggatgtctgcgtcgcccacggcatgcgcggcacagcccgtgccctcatagccgagattccggaagaagcacggaagaactccgtgaccgtcacaggatacggcgaggcgcatgaggcggtcgaagagcttgtgcatgaggtgaggcgcgagcttcctgagacgacgatccatgtgcgtgatggaggaccagttgtctcgcttcatctcggcgtcggttcggtgagccttgcctggaggaactttgcggagtagccaccaaaatgcggagagcgcgtgtgcagaatgttgctgaagcattgcatagcacagattcttcgaaatgcacgcttgcattgaaacgagctttccgtatactagctagtgcgctttgagagcaacacattccccggtggcgcagtggtagcgcaactgactgttaatcagtgtgtcgtaggttcgaaccctacccggggagccagaactgtccgagagcctgtcatctgacaggctctctttttctatctcagctctccagctttgattgtcctgaaggtccagctcttggtgtcgacgagcgagaactcttcggtgccgatggggcctccccacgaataggtggagaagacatcgcagctcaggagatttccttcttcgcgaacgtacttcaccggggtatgtccgacaacctggaagagctcctgggggcggtagaggatatcgagatctgccatgccctggggacgtgcccagaggggagagaactcctgccagagctcgtctctgcccatctggttgatagcggcaagagcatcatccgtagatgcggaagcgaggccttcgtcctcgatgaagtcttggaggatgccggcgtgcgagaagcagacattgtcgatgcgatggacaaatgccttgcggtcttgaggcaccttgtcccagaatgcgcgggagcgctcctgcacatgcctgagcacattgcctcttgccatgccggactcaggcgcatcccagaaatacgacatgtcatggtttccatagcaccagtaagcatcgtgatgggcagcaaggaaggcttctacacgctcatagagggcatcgtatgcctcagggcgtcgctgcatgccccagtcatcaggcaggtctccgagctgcacgattgcatcaggaggctcctgctttattgccgcatcagctgcatcgaacatccagggcttcaggtggacatcgggaatgacaaggacatgcatggaagcctcctatctgccaagaggatggagcggatttgtgtcagtatagctgccagggacggcagcattgaagtgctgcttcctcagtgcaatctcagggcaaggcaatcgcagggcggttgatttcacctgtcatccgtacactccgggggcaggtcaggattcctgcagctagccgaacggatgcagctgcctgtgcacggcctccttcctgccggaacggtgtgcagattccgtgcagcggcgttcggatgggtcctgcaggcgcatgattcaagggccctccggggtgcttccggcactcatccgaacggctgcagatggcggtatctgctgttctccggagggctacctcagtgccggcttcccctccttcctgtgcaggtcgaccaggcatgcaggctcgaggacgatcctgtcggggcctatgagctcgatatggaatgcatcgaggagcgccctcgcatcgggcccgaaggcctccagaagcctgagcgacgggcatgaccagccgtccttgccccggatctcggaattgacctctcccatgagcagggagcagtcctcctcgtcgagcctgtcgaacatgatgcccttccccttggggaggatcttcctgatctcggagtggttcctctcgcatccgcccttctgccaggcgctcatcgtgtcgcagcagtagagcctcgtctctcccggccgctctccgaagatggccgccagcgcggcctcgtcggagaactcctcgccgttgtccgtgagcacggtgccgaacaccctgcgcatgccttcggctccgccgagcgcgcggctgacgagcccgagccccgcctctacgcatgcaggcgtcttctcggcgagcagcagcgcaagctggaagctcgtggggcggtggtacagggcgagcaggcactgcctgtcgagccccttcctgccttccaccgtgtccatctcccaggcgcccttccggatgccctcgggaagggcgcagaaggcgctgtgcgacctgtcgggggaatggcgggaggcatgcctgcctccgcctccgctgtgcttcctgggcttgtacgacaccttgctcctgagctccatgttggagagcccggcatagccccggcctgtccattcgtagatcgtggaggcgcacctgccgagctcgggatgcgcatgcgcgatctgctcgggcgagagccctcgtgcgaggcagtcctctatcaccgccaccttctcgaggaagctgccctcggtctcgtcgacgcccctcctggcctccgagaggacggcatcggcctccttctgcgcgaggcgggcatcgtagaacacgcgcggcttcctgctgcatccgtagcccttcctgtggctgcatccgttgcagcatcttggccatgcgccgagcctggggcatgcatccccgagcccctcttcgggcgcatgctcccctgcctgcgccttcggcgacgagacgtagcggtgcctctcgacctcgtcgtgcacggtcgagggcgaccttcccagcagctccgcgatcttcctgcagctgtcgccgcggtcgaggccttcctcgacaagcctcctctccggcttcgtcagcctcagatatgccctggactggggcttcctccctttcttcctggatcttccggacatgcgatgtcagcttcttcctgcacgtcgtctggccggcctctccggccaccaccgcacaggttccgccatccatccgcacatgtacagctgacttccggaaccgttcgtatgaagtctgtaattgagccaatagcagggctctcgagaatttctgaaatagttgttgcatcgaatctgagaatccctatactgggtacttgcgcaacggtgcagtcacatattccccggtggcgcagtggtagcgcaactgactgttaatcagtgtgtcgtaggttcgaaccctacccggggagccagagaattcggagccggacttcatgtccggctcttttgtcatagatggactgctccaggtctctggcaacccgacactcctgcctttcggtgttcgagaattctataagctgcctgcagaaacgtcgagcttgtgtgcactcagccgacaggccatatcggtgggtacaggggctgtgctagcatatttaccatagtttgatgtaatgaaacaatgcgtagcaacggaggcatcttggctaccagcgcagctacaaagagcgggaaacgcatatcgggcaaggatgcctggtatcctcctgcgaagcgcgaccgcttcatcatccagcagcttgtgagcaaggacttcaagctcaggtatcgtcgctcggtcttgggcgtggcgtggtccgtcctgaacccgctcctcatgatgattgtcatgtctgcggtcttctccacgttcatgcgctatgcagacgattccattggctgctatccgctctacctcattctcggcaacaccgccttccagctcatgagcgatgccacgagccagggactgacatccatcatcggcgctgcctcgcttctgaagaaggtcaagatcaaccgctatgtgttccccgtgcagaaggttttttctgcagctgtgaactatgtcttctccctcattgccatcttcatcgtcatgctcttcttccagattccgttgacgccgctggcgctccttctgccggtcgcgcttggcctgctcgtggtcttctcgatcggactctcgcttctgctgtctgcccttgcggtcttcttccgcgatgtcatccatctctggagcgtcgtccttacagcttggacctatgccacgccgctcttctatccggcaagcatccttccgcactggatgcaggtcttcgaggcattcaatccgatctatctctatgtcacgttcatacgtgacatcctgctatggcagaccctgccgacggcgagcctcgtggtccgctgtgccatctgggcagtcgcttcgctcgcgctcggctatgtggtattccaccgccacgagcacaagttcatcctctatatctaggcattggagacccatggctgacaacaagcttcctgacgatatcgccgtgcgcgtcgacgatgtatcgatgatcttcaatatcgcatcggagcagttcaactccctcaaggaatacttcatcgcaatcatgaagcacgagctctccttcaaggagttccgtgccctcaaccacatcacgttcgatgtgcacaagggcgaggctttcggacttgtggggacgaatggatccggcaagtcgacgatgctcaagatcatcgctggcgtccttgaggcatcggagggcacctgtacggtaaatggcacgattgcgccactgattgagctcggcgccggtttcgacccggagctcacggctcaggagaacatctatcttaacggtgccctcctcggctattcgaaggagttcatcgaccaggagttcgacaacatcgtggaattcgctgagctcaaggacttcatggagatgccgctcaagaactactcctccggcatggtcgcacgcatcgcctttgcaatcgctacgatcaccgatcctgacatcctgatcgtcgatgagacgctttctgtcggcgacttcctgttccagcagaagtgcgagaagaggatcaacgagctcgtgcagaacgacaacacgacggtccttctggtctcccactccatcgatctagtcgagcgcatctgctcgagggtcctctggatcgaaaagggccagcagcgcatgctcggccctgtcgatgaggtgtgccaggcctaccgcaatctcaagtagctcctattccagaaaccgggtttccgatgatcgactacaagctcgcaaacatcctgatcgctcctgacgaattctctgcttcctatcctggcctctactggagggacggagaaggcaaggcagcctatgcaaaggaggagggtgccctcgagatttcggggacggtcgatttcacgacatatctgaatggcctctcgatagagaagtggcaccgctataccgttgtcaccgacgtcaccctagagctccagctttcgggagatgcctgcgaggtctatgccacaggtatttctgccggcatgaaggcacccaagcgctctgagcgtcctatcctcaaggtcggtgcctccgaaggcatacaggtcgtcgaagtgccgcttccgaaggaacatgccgccatccaaggctttgccattcattctgaaggcacgacgaagcttgctggcggatgctatcttgccgaagtcgatgaggatgtgccaagaccggtgaggcttgcgcttgcaacgacgacattcaagaaggaagcctatatcacgcgcaatatcgctgccgtgaagaaggaagtcttgggctcgaaggatcccatcgcttccggcttccatatgttcgtgatcgacaacggccgtacgctcgatgcggaggcgctctcagatgagggtgtcacggtcatcccgaatgcgaatgtcggcggctcaggcggctttgcccgtggcatgattgcagggctcgactggaatgcgacgcatgtccttctcatggacgacgatgtgcgcgtgctgcctgagagcttcaagcgtacctatgcattgctctgtcttgcgaacgagcgctaccaggatgccttcatcaatggtgcgatgctcaatatcggccagccgaacatccagttcgaggatgtagcacaggtcggacgcgatggccgctaccacggcatcaaggatacgaagatcgaggtcgatacctacgaaggcatcgcccacaacgagtccgtcaacgtcgaagtcccgcgtgcctatggtgcctggtggtactcctgcatcccgacgaaggcgatacgtgcaaacgggctgccgctccctgtcttcgtgcgctgcgacgatgtcgaatacggcatccgctgccagccgaagtacatggcaatggatggcatatgcgtatggcatgagcagttcgagggccgcttcagggcttctgtcgactgctaccagtacaccaggaacttcatgatcatgatggccgtggatgagctgccctactggcgcacgttcatgatgaggttcgaccgcacgttccatatctatctgcgtgccatggactatgaggcgtgcgagctccttctcgacggcctcgaggattacctcaagggcccgaccttcatcgagacggcttctggcgaggacatcatcaagcgccagggtgccaagaacgagaagctcctgccgatctccgagctctcggaagaggaccagaaggcgtgcgcagaggctccggccagctcgaacccttgggtcttcggcgaaggaccaaggcgccatatcgtcctgaagcttgcagagtctgtgccgcatgacaggcatgatctgcctgactggatgctcgatccgaaaccggtagccgtgaactattcacacggtgcctatccaacggccatgacggcacgccattctgtgctcgttgcctacgatatagacggcacgcatgcccatgtgcgccgcatggaccgcaagcggtgggaagatctcaaggagcgctaccgtacgctcatggcagattacgcgacgagaggcgatgcagttgcgaaggcctaccacgaggcaaagccctatctcacgagcacagaattctggaagagctacctccacatggatgcatagccagtcttgaaatggatgtgacagagccccgcagcttctgctgcggggctcctttcatagcgagcgatggggaaggtgcgatgggacacgcttctccgttctgaagatgatgttttctgttgtgccgggctaaggtagggagtatcctgtctctagcctttaatgcgcggtacgagatgcccgaaaggcgctacataaagagcagtttccttatggaatctctccatgaagcgaaaagacggggtgtctgtgccgccatcaggcggacgggcaccttttgctttatcggagggagactcatggagcaggaacccaaagcggtcatcatggatgctcaggccatggaccgcgccatcgtgcgcattgcgcatgagatcatcgagcacaacgagggagccaagaccatcgctgtcgtcggcatcatccgccgcggcgagatccttgcgcgccgcctcgtcgatgcgatcgagaagatcgaggatgtcaagccgcccttcggctcgctcgacatcagcttctaccgtgacgatttcggcatcaactctgccccggtggtccatgcgacgaacatcccgttcagcgtggagggcaaggacatcatcctcgtcgacgatgtgctctacacgggccgcacggtgcgctctgccctcaatgccctcatggactacggccgcgcaaagtcggtgcagcttgccgtgatggtcgatcgtggccacagagagcttccgatccgtgccgactatgtcggaaagaatgtgccgtcctcccgcgaagaggatgtccgcgtctgcatagagccgctcgattcccacaccgctgtggagatctggaacaaggcagacgaacccagcgatggaggtgttcactgatgtttgtaaagaatctcatcgatacgtacagcctgacggctgacgatatcacccagatactcgataccgcccaggcattcgagtccgtcaacaattcccgaacgatcaagaaggtcccggcacttcgtggtcgcacgatcgtgaacctgttcctcgagccgtcgacgcgcacgaagagctccttcgagctcgcagagaagcgtctctcggcagactccctctcgatgggtggctccacgtcctcggtcgtgaagggcgagtcgcttgccgacacgatccaaacgatctccgccatgaatgtcgacatgttcgtctgccgtgcccgccttgccggcacaccgcagcgcatcacagagaacaccgatgctgtcgtcatcaatgccggcgacggcaagcaccagcatccgacccaggccatgctcgacctctatacgatgaggaagcacttcggacacctcgatggcctcaaggtcgcaatcgtcggcgacctcgcccactcccgcgtctgcggatctctggcacccgctctcaagaccatgggtgccgaggtcacgctcgtcggtcctccgaccttccaggtcgacgatcccgactggttcggctgcccccagacggcacacttcgacgatgtgatcgaggacatggatgtcatctacatgctccgcgtccagctcgagcgcatggaaggtgctgccattccgtcgaggcgcgagtacaaccgcctctacggcctcgatatgacccgcgtgaaccgcatgaaggacgatgcaatcatcatgcatccgggtcccatgaaccgcggcatggagatcaatgcggatgtggccgactgcagccgttcgcgcatcctgaaccaggtcaatgccggcgtccttacccgcatggccgagatgtacctgctcctgggaggagagaacaatggcatttctgcttagaggcgcgcatgtggtcgacccgcaggtcggacttgacggcgtagccgatgtccttatcgatggagacaagattgcagaggtcggccagggcctcgagccgcctgctgacgctgaggtcatcgatgcgtccggcaagtacctcgtgccgggcctcgtggatatgcatgtccacttcagggatcctggcttcgagtacaaggagaccatcgataccggttcccgtgctgcagcacacggcggcttcacggatgtcgcaacgatgccgaatacggacccggtgaccgatacgggagccgagatccgctaccagatcgaccgcggcaagcatgcaggacttgtgcatatccgcccgatcggagcactcacgcgcggcgagaagggcgaggccctctccgagattggcgatatggtcatggaaggcgcagctgccttctctgatgacggtcacggcgtgcagagtgccggcatgatgaggacgtgcatggagtatgtgtcgcagttcgaccgtgccgtgcttgcccactgcgagatcgactcgctcacgacgaacggtgtcatcaacgaaggcaaggcatcgacccgcctcggcatgttcggctggccggcactcggcgaggagcttgagatctatcgcgacatcgagcttgcaaagctcacgggctgccgcttccatgtctgccatatctcgacggccaagggcctcgatctcgtacgcgctgccaagaaggaaggccttcctgtcacctgcgaggtcacgccgcatcacctgttcctcaatgaggatgacatcacgccgacctacaacacgaacctcaagatgaatccgcccctgcgcacgaaggccgacatggaggccctcgtcgagggcatctgcgatggttccatcgactgcgtcgtcaccgaccatgcaccgcacgcaccgcatgagaaggactgcgagtgggagattgccttcttcggctgcgtcggcctcgagacgtcgcttccgctcatgctcacgaagctcgtccttccgggcaagatgagctggagccgccttgtcgaggtcatggctgtgaacccgagaaaggtgctcacgctcgagccggtcaaggtcgaggcaggaagcacggcagaccttacccttatcgatcccgctgccgagatcgaggtcaccgaggactggctgcagggcaaggcgaagaactctgccttcctcggctggcatcttaccggtgctgcatccgatgtcttctgcgccggcaagcgcacgctcactgacggtgtggtgacgcccgcatgagcgcggcagcaggtccaaagctcgcgccatacacgcttgtctggaagcatgaggcggcagaggatatctgggacatctgcctcgagacggaaggcgagctcgtacaggggctcaagcccggcatgttcgtgaatgtcgccgtgccgggcgacccctcccatatcctgcgcatcccgctctccttctaccgcaccgatccggtgcgtggctggatctgcatgattgtagctgctgtgggcgaaggaacgcgccgtctctgctcgctcgagccgggcgagggctcgacgcttctggctccgctcggacatggctggaggatgccgcaagaaggcgccatgcgtgcgcttctcgttgctggcggcgtcggcgctccccctgtctatgctgcggcccgcatgctccaggcccgcggcatcgactgcgatgtcgtgatgggcgccaagagcgaacgcttcctctggaaggagggggcgcaggctctgagcggcaatgatagcggggcaggctatgagagtgcgctttcccgtggtggcttctgcgaggtgttcctggcgacggatgacggaagctatggctaccacggcttcacgacaggccttgccgaggagcttgtgggcaagcatggctacgacgtcgtcatgacctgcgggccccagcccatgatggcaggcgtcgcgaagatcgcagcagaagcgcatattccttgccaggtctctatggagcggatgatgacctgcgggttcggtgcctgcaacacgtgcagcgtccagatggcagatggcaccgtgcgtgcctgctgccaggatggtcccgtgttcgatgccgaggaggtgctctggaaatgacaaaggtcaagatggatgtcgatcttggcggcgtgcatatgcagaaccccatctgcaccgcttctggcaccttcggcaatggccgccagttcgagagcttcttcgatgtatccgagcttggtgccatcacctgcaagggtgtcgccgccgagccgtgggcaggaaatcctgcaccgcgcttggctgagatcacctcgggcatcatgaattcggtcgggctccagaacccgggtgtcaggggcttcgtcgaggagtatggcgaatatctcgccgggctcgatgagcgcggctgccgtgtcatctgccaggtcgcaggacactcgattcaggaatacatcgatgcgctcgacctcttcgaagagcttgcgcccttcgcagcgggattcgagatcaacatctcctgcccgaacatcgcctgcgggggcgctgccatgggtgccacgcctgaagcggcagctgaagtcgtccgtgcccttcgcccgcatacgaagcggccgatcctcgtgaagcttgcgccgcacgatgtcgccgatatcgcccgtgcctgcgaggcagaaggcgccgatgccctgacgctcatcaacacgattccgggcatggcaatagatgtgaggacgtacaggagcaggctctcgcggccgatggctggcgtctctggcccctgcatccatcctattgccgtgcgcatggtctgggaagcggcacacgccgtgaagattccgatcaacggcgtcggtggcgtcatgactggcgaggatgcggcagagttcctgctggcaggagcgaccgctgtctcggtcggcacagccaacctcgtcgaccctgtggcagcaccgcgcattctttccgagctcgaagcctgggcagagtcccagggtgtcaaagatatccacgaagtgataggagcatgcagatgctgagcgaagctgaagcacgcaatgccgtgataaccgccctcgactgcggacgcgacgaggcgcttgccctcgccgatacgctttctggccatgcgggctgggtcaaggtcggcatgaccctctactatgcctgcggaccggagatcgtctccgagatgcacaggcgcggcctcaaggtcttcctggacctcaagctccatgatattccgcaccagatcaggggtgctgccgaggcagcatcgcgtgcaggtgcagatatcctctcggtccatgccctgggcggtgccgagatggtgaaggcagcccgcgagggtgtcgaggcggcagcgaaggaccgcgacgagcgcacgaagatcatcgcgatctcggtcctcacgagcatggaccaggcagcccttgcctcgatcggcgtggctgattctgttgccaatgaggttgcacgtcttgcaaagcttgcctatggtgcaggagccgatggcatggtctgctctccgcaggaggctcatgagctccgcgagcttctgggacctgatgcgctcgtcgtgacgccaggtgtgcgccccgcaggctctgctgtaggcgaccagaagcgcatcgcgacgccggcgtctgccgtcgcatccggtgcctcgaagctcgttgtcggacgtccgatcacgcaggctgaagacccggcagcagccttcgaagccatcgtctctgagctctgtgcatagaagcttcttcagagcggggcgaatttcgtaggagttgtgtaaagtccctgcgtaaagcccgatatttggcatatctgcacttgcaaaatgcctgatggattgcgagactatagtatcgcatgatgggtttgaagcagcttcggcaccaagaagaggtgcctgcatgcgtttccagtttggaggaacaatggctctccctcaacttaccgacgagcagcgcaaggaagcattggagaaggcagctgccgcgcgccacgcacgtgcagagctccgcgagaagatcaagaccggccaggtcacgcttgaggaggtcctcgattccgacgatcctattgccgcccgtctcaaggtgagcgctctcatcgagtccctgccgggctatggcaaggccaaggcagccaagatcatggccgagctcggcatctcctccacgcgccgcgtcaagggcctcggtgcccgccagcgcgagcagctcatcgaagcgctctccaagtagtgggcgcgacaccacgactttttgtcatttccggaccgtcgggcgcaggaaagggaacgctgcttgcagagctccgcaagcagcgcccggacctgggcttgacggtttcggctactacaagaagtccacggcccggcgaggtcgacggcacatcgtattatttcctgtctgacgaggagttccgccgccgcatcgcggcaggggagttcgtcgagtgggcagaggtccatgggcatctctatggcacgcttgtgagcgaagtgaagcgtctccttgctaaggggcattcgctcgtgctcgagatcgatgtccagggagcgctcaacgtccgcaaggtctatccggatgccgtgctcatcttcatcgagccgccttcgcttcaggtgctcgaggagcgcctgcgtggacgtggcaccgaggatgaggcatcgatcgagctcaggctcaagaatgcccgccacgagatggagctcgcggaccagtacgatgtgcgtatcgtcaatgacactgttgaccgtgcggcacaggagcttggctctgtgatgcgccggttcgagatggatggaggttcccattaatgtccgtcatcaagcctgaaatcgacaacctgctcgacaagaccgagcacaacccgttcctgctctgctcgatggcatcgaagcgtgcctgcgatatcaacaacatgatccgcggccagcatctgcgtgtcgtcgacgtccaggacttcgacgatatcacgaccgtcgtctccggcgaggaccctgtctccatcgcaatgaaggagatcgaggatggcaccctcggattcgtgaaggatgacttcgacgaggccatcaagggcgcaaacaagtcggtcttctgatgagcgaacgcgtctgtcttgtccactaccacgagattggcctcaaagggaagaaccgctccatcttcgagaaccagctcgtgacgaatctgaagtgcgccctgcgcgacacgcccctcaagtgcgtgaagcgcatctgcggctatatcctcgtgaccttcgagggcggagcgacccgcgactaccaggaccttatcggcaaggttccgggcgttgcccgcgtctcgcttgcccatgagtgcccgcgcgacctcgcggagtactcccaggctgccatcgtctctctcggcgaggcagggagcttctccaccttcaaggtccatgcacacaagtcttcgaccgactatccggtccataccctcgatatcaaccgccaggtgggcgcagccctctgcgaggccttccctgacaagaaggtcgacgtccacaaccccgatgtcacggtccacgtgaacgtcgtgcagggctcggtctatgtctacgccgtctccgagaggggagcaggcggccttcctgtcggcactgccggcaaggttgtgacgcttctgtcctctggcttcgactcgccggttgcgacctggatgctcggacgccgtggcgccatctgcgtgcccatccacttctccggcaggcccatggtgtccgatacgagcgaatggctcacccaggatatcgtcaaggccctcgcgccctccggcgtcgtcggccgtctctatgtggtgcccttcggagcgcgccagcgcgagatctctcttgcggtcgaccagaagctccgcatcatcacgtaccgccgtgtcatgttctccgtcgccgagcgcatagcacgcatagagggtgccaaggcacttgtcacgggcgaatcgcttggacaggtcgcctcccagacgctcgagaacatcgctgctgtggatgagaccgtatccatgccggtgctgcgtcccctcatcggatccgacaagcaggagatcatcgagcgcgcacagcagatcggcacctacgatatcagctgccagacggctcctgactgctgcacgctcttcatgccgcgccgtcccgagacgcatgcaaagcgtgacgaggtgcacgaggcctgggattccttcgatcatgaagcgatgatcgaagatctcgtcgaccacatcgagtatgtggacttcgaccagtgcccaagctaccgtcctccccgcaagcttcgtgttcgtcatgaggagctcgcacctgccgagtgggagaagaaaggcctcgtgtcagagggctgagctggccttctgcgaccttccgcaagatctttgccagatgtctggcagcccgaagaacgcaatcctgtctgtcatatcgccttcctcatccagtctggagagggaggcgactttttcatggcacagagaaggcttcaggacagaacagcatcgaggctcaaggcacggatgccgcggctcaatcttggaaacaggaaggcagcctgcgtgctcatcgcggcaggctctgcggtggcgctcttcctggcgcttgcagcagcgatcaggacccccgccttcacggtggacaagagtgcagccgtgagctcttcgacgcctgcagcagaggagacgaaagatgcagcatctgcaagcacggatgccagctcggaggataaggcaccaagtccggtgcttgtagatatcgacggagcggtggcacatcctggcgtctacgacattgccggcacgaccgagcgcgtgaaggatgcggtcgaggcagcaggcgggcttctggacgatgcagacaccgcaagcgtcaatctcgcgcaggctgtcacggatggcatgaagatccatgtgccgaaggaaggagaggcatcctcctctgctgcctcagcggctggcactgcctcaggctccacttctgctgccggctcttcgggcacatccagcaccttggcgtcttcttcctccgcttctgcttcttcgggcctcgtgaacatcaataccgccacagccgaggagctcgagacgcttcctggcgtcggcgaatcgactgccaaggcaatcgtgcaggacagggaagagcatggcaccttcagctcgaaggaggacctcatgcgtgtctccggcataggcgagaagaagtacgcgaagctcgaggcgaatatctgtgtatagggagcagaagccgcctgagcgaccatttctgcctgaaacgctcctggcgctgctctctgccatctatgcctcgaggctcgcgctcttgtgcctgccgtgggacggcataggtgcagaggtggaggcagctgtagccgcatcgctcgtcgtaggtgcactcctgttcctgcgcaggcagaagatgcttgcggcagcagttcttgcctgcacgctcgtggcgctcatctcctctgctgccttctgtgccaggacggaggatgcagcagaggcacttcaggcaacaagcgcctctaagcttgtcttcgtcgtcgagggagacagctcgaaagggacgagcggctggcgctgccgcgctgcggccgaggaggatggacacactgtcggcgatgtctggcttgttggttcgcgggagctcacggcgggggagcgtgtgcgctgcatcgggcgcgtgaagccgcttgcggacgatgactatgggagaagctcgcttgcacagggcatctgctgcacggtcaagatggtccgcatcaccggcagggatgagcctcaaggactgcgcgcactgatagagcatatccgtaccgcaggcaaagacgcgtttcttgcatcggatacgccggagcgggcgctcgaagtgggatcggtcctgggcttcaaggcgccgctccaggaagaagggctctccgatctcttctctgcctgcggcgtctcgcatcttgtcgctgtctcgggtggacatcttgctgtcatagcctctgccctggcggtcgtcctcgggtggctccggctctcgccgaagtggcgcattgcgctctccatcaccctcaccggcatctttgtcgttctctgcggcttgccggtctctgcagtgcgtgcctggctcatggcctgcgctgcatcgggagcggtgcttgccggcagaaggagccatgcgctctcggcggtctctctcgtgggcctcatcctcgtctgggcatctcctgcatccgctgccgatatcggctttctcctgagcatctacgcggtctgcgggctctgcatctttgcatcctatctggcctacgcgttcacgctcctcgtgccagagcttccctggctcaatcgtgtgccgagacgcctcatgcgcgccttgggaaagctgcgccagaatgtgctggcgcttcttgcagcgacgcttgccgcccagcttgtcacggcggcactcacctcagaagtcttcgggacactctcgctcgtggcgcctctcgcaaatcttgtccttgcgcttccgttctcctgcatgatcgcactggcgcttctggcctttgcagtgctcccgctcccatggctctcgcatctccttatggcaggagcagatctctttgccggattctcgcttgctgccgtcaggttccttgcccatctgccctatgcaagcatctcgattgcagctacgacagcggtgccagagattgtcgtcctggcatttcttgcgctctggcttgctgcctggcccgagctctcttcagcctggctcaggcgttccgctatcgcctgcgccttcgggcttgcctgcctcatcgtctcctggcgcttcttcgtgccggcacggctttgcatccttgatgtcggccagggagatgcgattctcgtgcaggaaggagccgcagcggttcttattgacacgggacctgaaggcgcggtcgcagaggcgctcgagaagtcgcatgtgctccatatcgatgcggtggtgctcacgcacctgcatgacgaccacacaggcggggtgaaggatctgggaagcgtcgctccggtcggcacggtctatgtcgccgagggcgtcaagggctccatgagcgagacgctcagaggagagatagaggagctgaccggaaaggatgcagaggagatctctgcaggctctgtgctccatgctggcggcttcacgatgcgtatggtctggccaaaggcggatgtcacaggggaggagaacggcgactccatcgagctcgtgctcgagcatccagaaggaggcggcaccttcagagcacttctgacgggcgatggagaggaagacgagctcaggcagtttgcagatgaggttggcgacatcgatgtcctgaaggcagggcaccatggatcggagatttcgatcgatgcaggcgaggcgcgggagcttgcgcccgagctggccgtggcctctgccggcgagaacaacaagtatggccacccgacggagcagtgcatcgagacgctcgaagggacaggcgcgcgcttcctctgcacgaaggatgtcggcacggtcgagatacgtccccatgaggaaggctatgcggtgtacacggagcgctgattccgtcagaatggagaagagcagaaaggggagccatgggaaaggcgagtacgctcctgccggtctatcttgtcatcggcacgaacgagatcaagcgcgaagaggcaatacggcgcatgaaggcaaagctcgatccaggccttgctgccttcaatctcgacgagcttgcagccggatctgtggccgagcccgatacgctcaaggcaagcctcgatgcgatgcctgcaggcgatgccttccgtcttgtgatcgtctcggaggcagacaggctcgccaagcccgttcaggagatgcttgtctcctatctcaagaatccgaatccgacgaccgtgctcatgctcgttgtgggtgcccttcccaagggatcgggcttcacgcgctctgcgctctgcaaggccgtgaagacagcaggtgcgcattctgtcatcgactgcacgccaccgaagccctggcagcttgcaggagagctcgttcagaaggtggcaccccagctaggcatcacgctcgaccgcgatgcagcagaagagctcgtgaagcgctccggcacctcgctcatgctgctcagaaacgagatctcccagctcggcaatctggcatccgagccagggcatgtgacgcttcgggacgtcgaagcgcatatcgtgcgcacggagggcatcaagccctgggagcttgccgatgcggtgtcggcccgcaacgtgaagggcgcgcttgagctgctttccggcatggaccagggaagctatatcgggtctctgagctatctcgagggcaggatgcgcgagctcatctgtgcgaagtgcctcgatgagcggggaagcggggcaagccttgccgcagagctcggaaagcaggactggcaggtgaagaatctcaggggctgggcgaggaggttcacgatcgaagagctcgtctctgccttgaagtcctgtgccaaggcagattccggcctcaagagcggagccgatcccagggatgcaatggtgcgccttgtcctcggcatcgcccagggctagtgtccaaaagaaaggccccggtgccagcacgcaccggggcctttgcattgcctggaatgaagaagcctacttctggagggtattcacgagcttctggacgcccgacttgcgctgggcagcctggttcttgtgaatgacacccttggatgcagccttgtcgagcttgcggttcgctgcgtaggcagcggtctgtgcagcctcggcgtcgcctgctgccacagcctcgcggaccttcttgacgtaggtcttgagctcggagcggactgcctggttgcggacgcgggccttctctgcctgcttgatgcgcttcttctgcgacttgatgtttgccacggtgcggttcctttcagtgctttgagatgaggcctctctttgggtcggaagtggggttccgcacccggacacggcgaggtcaaccacgagagtatagcagactctcgagcgagccatcacgtgcactttgctagaatgtgccctgacatctggaaatatccatagctgcccagataatcgcagcagatgatgctgcagccatgctgggcccaggcagggcatgaaggacgtatgagcatagatacctcacatatccgcaatttctccatcgttgcgcacatcgaccacggcaagtcgacgatatcggaccgcatcctcgagctgacccatacggtcgaggagcgcgacctcacctcgcagatgcttgactccatggacatcgagcaggagcgcggcatcacgatcaagtcgaacgccgtgcgcgtcatgtatgacgcagatgacggtgagacgtatctcttcaacctgatcgatacgccgggacatgtggacttcacctatgaggtctcgcgctcgcttgctgcctgcgagggagccgtgctcgtcgtcgatgcgacgcagggcgtcgaggcacagaccgtctcgaatgcgacgcttgccatgaatgccgggctcgatatcgtgccgtgcatcaacaagatcgaccttccgtcggcgcaccctgaggaagtcaagcaggagatcgaggacgaccttgcgattcctgcagaggatgctgtgctcgtgtccggcaagacaggagagggcatccatgacctgctcgaggcgatcgtctacctgatctctcctccgaagggagacgagaatgcgcccttgaaggccctcattctcgactcctacttcgatgagtaccgtggcgtcgtcgcgacggtgcgcgtcttcgatgggcacatccgcaagggcgaccatctcaagatgatggcgatcggagacgagttcctggcagacggtgtcggctgcaagcgtccgctcgagacgccgctcgacgagctctctgtcggcgaggtgggctacgtcgtgacgggcctcaaggaccccgagatggtgcgcacgggcgatacgatcaccgatgcagacaatccctgcgccgaggcctgccctggctaccacgaggcaaagcccatggtcttcacgggcctcttcccgatcgacacgaaggactacgagaacctgcgcgatgccctcgagaagctgaaggtgaacgacccctccctgacctggtcgccggaaaactccgtcgcattgggcttcggcttccgtgtcggctttttgggcctgctccatatggaggtcgtgaaggagcgtctcgagcgcgagttcggcctttcgctcattgcgacaagcccctctgtcgaataccacgtcttcaagacggacggcacgatggagaagatcacaagcccgcaggacctgcccgaaccgacccgcatcgaccacatcgaggagccctacctcaaggccaaggtcatcgttccgcccgagtacatgggtcctgtcatgcagcttgtcgtcgaccatagaggcacgacgcaggacatggtctatctctccgagaagtcggtcgagctccacttcgatattcctttggccgagctcatcctcgacttcttcgaccagctcaagagcaggacgaagggctatgcctcgctcgactatgagatcggcgactaccgcacttccgacctcgtgaagctcgatatcctgcttgcaggggaagaagtcgacgccctttccttcatcgtccacagggacaaggcctacgaccttgcacgagggctctgcgacaagctcaaggagatcatcccgcgccagcagttcgaggtgcctatccagggcgccatcggcaacaagatcatcagccgctcgaccgtgaaggcagtccgcaaggacgtccttgccaagtgctacggcggcgacatcacgcgcaagaggaagctccttgagaagcagaaggaaggcaagaagcgcatgaaggccatcggcacggtcgaagtgccgcaggaagccttcctcgccgtcctcaaggtggacgacgaatgagcatgagaccgcaagagcttctggaagagggggcagcatctgccggcctctcctcccatatcgagccttttgaagaaggggaaagcctgcgcgagcgcctcgcgtcccatcccttcctcatggctcccatggcaggggttacggatgcggcctggaggctcatggcacgcgcaggcggtgccggccttgcctataccgagatggtctctgttgcaggcatccactacggcggagagaagacgtgggagcttgtcgtgcccgaagaggcagagcccgatatcgcggtgcagctcttcggctcgaagccagaccagttcgcagaggcggcagaggctgtaagggagcggctcggatcgaagcttgccctcatcgatatcaacatggcctgcccggtgccgaaggtgacgcgcaagggcgaaggctctgcccttatgcgcgaccctgaaacggcggcccagatcgtccgtgcagtgtgcgagcacacggaagtgcccgtcactgccaagatccgccgcggattcgatatgggcgaggagcttgccgtgccgtttgcacgggctatggaggaggcaggagtctctgcgattgcggttcatggcaggtatgccaagcagctctaccgcggcaaggcttcctgggagaccgttgccgatgtcgcagctgctgtctcggtcccggtcatcggctcaggcgatgtgcttgcagcacaagcggcacgcaggatgctttcagattgtggctgcgctgcggtgatggttgcacgcggatcctacggcaacccctggatcttccgcgatgctgaagaggatgctgcaccgacgcacagccttgaggagcgtcttgccgcattctcgctccatgtgcgcctcctggaggcaacggatgcacatcttgcgcgggcaaggagccttgccggctggtatctcaaggggcttccgaatgcagccgcatggcgcgagcgtgccatgcactgccagagcgcagaggaatacctcgagctcatcgaggcggcaggtgccacgatcccagaaacaggccaagaccgtgcgtgagagcagtgtctgggaagagcacacagaggcagatgcggcgtctgccatctatgtgcatatcccgttctgtgcgaggaagtgcgcctactgcgactttgcctcctgggcgacgcgtgcagaggatcctctcatgaatgcctatgccgcttctgtcctgcatgagctctcctgtctcgaagagacaggacttctcgaggggaccgagacagcctacatcggcggcgggacgccgagctatctcggtgcacgccttctgcccatcgtggagcggctctcatctttcggcgtcttggagctcacatcagaggccaaccccgattccctcacagcgtatttcgcctcatccctcaaggaagcagggcttacgcgcatctcgctcggcgtccagtcaacagacgacggagtgctggcggcactcgggaggatccatagcgctgaagaggcgcttcaggcgctttcctcagccgtatcagcggggctttcagtctcagccgacctcatgtgcgcacttcccggggaggccgacgagatcttccagaggagcgtctgcgatgtgcttgcacagggcgtctcccacgtgagcgtctatcctctgatgatcgaggagggaacggccttcgggcggcgctatggcggcgaggagctcccttcctggaacgatcccgacatccaggccaggcgcatggagtgtgcagagaagaccctctgcgcgcacggattccaccgctacgaagtcgccagctatgcgaaggcgggccatgagtgccgccacaacaaggactactggaccggcaggaactatctcggcattggcaccggcgcttctggaatgctttcgcgagcagcctataggcggctgcgcacgtgcctgccgcagcttcccgatatcgcagatgatatctatcgcgtgcggctcaggaatacctccaccaggacggactatgcagaagggcatttgcagcgcttccacttctcgctcgagcttctcgaccggcgccaggcgctcgccgaggacctcatgctggcggcgcgcatgtccgagccgattgacgaaagcctccttgctgctgcacgtgcagagcttggaggaacgctcgatcgcgctatccagacggcccaggaagaggggcttctgggagagggcctggcggtcacagaacggggctggcttcttggaaacgagctcttcgagctcttctgggaccttgcgggagaggctccgacacgcacgcttgcggtgtagagaagctgttttataggtcctgaagctgcaaagcttagccgttccgtgtctttctggcctccttcgtggatacaatcaggccatgtgcgtatcgatgagagaattactgagcaaggagcctagccatggcatccatgaacgaaaaggactactacgcaatcctcggggtctcgaaggatgcatcgactgatgagatcaggaaggcgttccagcagaaggcgcgcaagctccaccccgatgtgaacaaggcacctgacgcagaggagcgcttcaaggaagtctccgaagcctacgccgtgctctccgatccggagaagcgcaagcgctatgacgcgatgcgctccggctccatgttctcgcagggagcggcccctggcacacagggatatgccagcccctatggcaccgaccccttcgccggctggggcggctggccttttggcggcatgaactatggctattcgggcaggcgcacacagagcaagaggtcgcgtgcattcaacccgcaggcaggcgctgacttcgtcttccatatcgagctcgaccccgagcaggcaaggcacggcatcaagcgtggcgtgacctaccagcactacacgagctgcacgcactgccacggcaccggctccattgctgcagagcatccagagacttgcccgacctgccacggcacaggacatatcgacctcgatctggggagcctcttcggcttcggcgtgatggacatggtctgccccgagtgcgaaggcacgggcaaggtcgtggccgacccctgcccggactgcggaggctcgggccgcgtcctcacggcatccgagctcgtcgtcgatatcccggcaggatcgcatgacggggacgaggtccgtatcaagggcatgggcaacgccggcacgaatggcgaggcatcaggagacttcgtctgccgcgtcggcgtgccagcagagcgcctgacgccgcgtcaggccatgggcttccaggtgctcggcttcgatatcccgttccttgtcttcggcgccctcatggacgtgctttccggcctctggatcttcattgtcgtgcttgccgccatcggcttcatctttgctgcctcgggcggcgtcacaggccacggcaagacgtggtggaagaatgcgggatctgcgatgatgaacggggcggtgcagggcctcttcatcgccatcttcatcacggccatggtctcgtgcacggcaagcctcggcgcttcgggctatggatcgcgcatggtgccgcactactgatagaagcggatgataggtatcctatcgcgtgcaagacgcatggctttggtgggtacaccttgcatggtagatacagaggggcgcaagcgcgcccctcgctttgtgctgtgggagtatggtgagtgtgagttcgaacaaggattactacgagattctcggggtcgagcatgatgctgacgcccgtaccatcaagcgtgcattcctgaagaaggcgcgtgagctgcatccagacgtgaacaaggcaccggatgccgaagcacgcttcaaggaagtgaacgaggcctacaccgttctgtctgacgagacgaagcgtgcgaactatgaccgctacggcacgcctgacgggccttccggcttcggatccgactacgtggacatgtcggacatcttcaatggcttcggcatggacgatatcttcagctcgttcttcggcggccagggccgtggcggccaggcacgccgcgagcagcgctcgcgcggccgcgacatgggcatcacgctccatatcacgctcgaagaggctgccaaaggctgcaggaagaccatctcctacgaaaggctcgcaccctgcgacgactgcaatggcaccggcgctgccgaaggcggcaagaccacgacctgcccccgctgccatggcaccggacacatcacgacggtgcagaggacgatcctgggccagatgcagtcgacgacggtctgccctgagtgcggcggcacgggccaggtcatcgaccatccgtgcgagacctgctcggggcagggcaggacgccttcgcatgagaccgtgaaggtcgagattccggcaggcatccatgcgggccagaccgtgacgatcaaggacaagggcgaggcagggctccgcggcgctccaggcggcaacctcgtcgtgagcatcgatatcgaagacagcgagcgcttccagcgccagggcgacgacctctactgcaccgaggacgtcgatgcaatctctgcgatgctcggctgcacgatggagatcgacggcatccttccagacgagaaggtcgaagtcgaagttccttccggctgccagtatggccagcagatccgcataccgcgctacggcatgccgcgccagggaagccaggcaagaggctcgcttatcgtcgtcgtgcgtgtcaccgtgcctgatgacctcaccgaagaggatgaagaggcactcaggggcatcctcgagcggaggcaggcgaagagcgcgaaggcggatgccaaggagcgggcgcatgagagccacaaggcaaaggaaggccaccgcaagcatccgttcggaaggcggtagatgagcgagaaagcaccggtggtagccttcatcaatctgggctgccgcgtgaacagggtcgagacggatacgatcgcgcttgcgcttgaggaggccggctgccagataggcacgcctgaagaggccgatgcggtcgtcgtgaacacctgcgccgtcacaggcgaggccgaagcgaagacccgccataccctccgccataccatgaacctgccgaacaggccctatgtcgtggcgacaggctgcgcggcaagcctctttgcagacgagctctcagagctcggcgatacgctcgaggtcgtgccgctcaaggccgaggtgccgtctcatgtgcttgcaaagcttccggagacggcaaccgatgcgctgccctgcacgggtgctgccccgacgcctaccggaaggacccgtcctggcatcaaggtgcaggatggctgcgacaaccgctgcacgttctgcatcgtctggaaggcacgtggcgccgggcgttccgtgccgcttggccaggtcatcgcagaggtcgagaagacccttgccatgggcgccaaggaagtcgtgctcacgggcatcaacctgggccagtaccatgtcgtggaagagggggcagagctccgcctgccggagcttctggaagcaatcctcgagaagacagcggttggcaggatccgtctctcctcgatcgagccgcctgatgtggacgagcgtctcatcgatgtgatggctgcacatcctgaccggattgcccccttccttcatatctgcctccagtcgggatcggactccgtgctttcccgcatgggcaggaagtacgatacggcgctctatgagaatgctgtcagagctgcgaaggcgaagattccccatctggcgctgggctgcgatctcattgtcggcttcccgggcgagacggatgaagagttcgaggagtcgctcgaattctgccggcgcatgcagttcgcgaagatgcacatcttccgctattcgaagcgtcccggcacgcccgccgcagaggcacccgaccaggtcgatccccacatcatggcagagcgtgcaaagcgcatgcatgacctggcggcccagatgcgcgcagctgaggcgaagcgccttgtcggcgaggaagagctcgtgcttgtccaggcaaagggcagaggcgtcacaggcggcctcttcgaggcagaggtcgaccccgcgcttcctgtggatacgctcgagcgcatgaggatcgtctcttccgatgagcggggacatgtcgttgccgaacatctctaggaatatcgagctctttgttctcggcgagagtcgcgctatcctttgagatgaaccagcaaggaggagcatggagcccacacacgtccgtctgaccatacctgattctgtcgatgcagcgcttctcatggggcctgccgacagcctgctcaggcgtatcgaagctgccaccgaggcaatcatcacggtgcgcggcaatgtcgtctccatcgaaggcgaccctgaggagatccacgacctcacggctgtcttcacgcagctcatccagcttgccgaggcgggagaggttccgaacgagaccgatgtggacctggcgcttgcggcggtggcagagaagggcgcgccgcttctgcgcgagcgctatgccatcctcatgagctggaaaggcattgccgtcaagccgaagaccgagggccagaagcgctatgtcgaggcagtgcgcacgcatgagatcacgtttgcagcggggcctgctggcacgggcaagacctatctcgcggtagcgctggcagtggctgcactcagaagacatgaggtggagcgcatcgtgctcacccgtccggtcgtcgaggcaggggaatctctgggatatcttcccggcacgctcgaagagaagatcgatccctatgtgcggccgctctacgatgcactcttcgacctcattggccaggagacgacgctctcgcttgtcgagcaggggacgatcgaggtggcaccgctcgccttcatgcgcgggcgcacgttctcgaatgcctatgtgatattggacgaggcgcagaacacgacgccggtccagatgaagatgttcctgacccgtctcggattccattcacgcttcgtcgtcaccggcgacagcacccagcgcgacctcaagggtccaagcggcatggaatcggcccgccagatactttccggcataccgggcatcgccttctgcgatctcggccgtgccgatgtggtcaggcactcgctcgttgcacgcatcatcgaagcctatgacaaggcagccaggaaggatggtccccatggagcatgaggttgacatcgatgtggaggaaggcacgacccctgccatcgcggaagacgagatggagcggatcgctgcgctcgtgctcgatgaggaaggggtgacgcgtccctgcctcgtgtcggtctctgtggtcgatgatgacaggatgcatgagctcaacctcgagtggcgcggcaaggaccgtgcgaccgacgtgctctcgctcgaatgcgagcgtccagacgaccccgatctggctgacggggagccctgcgagctcggcgacatcgtgcttgcccctgcctatatcgaacgccaggcagaagagctcggcacgaccgcagccgatgagacgcggctcctcttcgtgcatggcatgctccatcttctgggctatgaccatatcgcagacgacgaggctgaggtcatggaggcccgcgaggacgagcttctccagaaggtcgcgaccgacgagaacctgggccatgtgatacttacaaggcaccgggaggatgcatgattcccggacagaagggaaaccatccgaccttccgccggagcttcctcttcgccatgcagggattccgcttcacgctcaggaccgagcgcaacatcaaggtcatgcttgcggcaggcgttcttgtcatcgtctgcggcctcatcgtgggcctcgatcctctttcctgggccatcgtgcttctgtgctgtgcctgcgtgatctctgccgagctcatgaacaccgctatcgagacagttgtcgacctggtctctcctgaataccatccgcttgcaggacacgcgaaggatatcgcggccgcagcggtctatgtgctctccgtgatcgtcgctattgtcggcgcgatcgtattcctgaatgccctcctgacctagaagaaggtgcccatgaacgagatggatgaagacgagctcgacctcgatgaggaagagcgtgcaatgatggagaagttcggggccgcagcagctccggcagaaggcgaggaggatcctgacttcaggagcggctttgtcgcccttgtcggcaggccgtctgtcggcaagtcgacgcttctcaatgcctgcatgggcgagaagatcgctatcacctctcctgtcgcccagacgacgaggaagcgcatgcgtgctgtcatcgaccgtcccggctgccagctcgtcgtcgtcgataccccgggcctccacaagccgaaggatgccctcggcaaggagctcaacaaggtcgccctggcagagcttgccgatgtggatgtcgtggccttcctgatcgatgcgacgcgtccggtcggcaggggagacgagtgggtcgcaaagcatgtcgcggcctcgaaggctcccttcaagctgctcgtgataacaaaggcagacaaggcagagcccgagaccgtgcagcagcagctcgaagcggcccgtgcccttgcccccttcgacgacgagcttgtcgtatctgcccgcgaaggcttcaatgtcgattccttcatcgatatcgtgagcgcacacctgccatatggtccgcggtggtttcccgaaggcatggatacggacatgacggacgaagacctcgtcggcgagttcatccgcgagaaggtgctcctgaactgccgccaggaggtgccgcactcggtggctgtgaaggtcgatgacatctcatggccgaagcgcgaccagctctcagtcacggcgacgatcctcgtcgaacgcgagggacagaaggccatccttatcgggcgccgcggctccatgatcaagaagattggcacggcagcccgcaaggacatcgagcgcctcttcggcgcaaaggcctatctcgatctcaaggtccgcgtccagcccgagtggcgccgcgatgcgaacgagatccgcgagctcggactcgaggcggacgagtagcagtgcgccgcacgctccacacgaaggcgatcgtgctcgatacggtaaagctcaaggagcaggacctcatcctcacgatgatcggggaggacggccagaagaggcgggcggtcgcgaagggtgccagaaagcccggcggccgctttgcatcgcgctgcgacatcctctgcgagtcggaccttctgctctctgccggaagaggacctcttccgattctctcagaagcctcgctggtaaacgcccatgcaccgctcagggaggatctcgacagcctgagcgccgcatcggcggcagcagagcttgccgagaagagctcctacgaggacatgccggaccccttcctcttcaagatcctgtcggccctgctttcctcgctcgaaggagcggatgcgccgcaccagatggtgctggtctctgcctacgccttcaaggtgcttgcacatgaagggtggaagccggagcttgagtcctgcatcgcctgcggagacccgcatccgaccctcttctctgcggctgcaggaggtgcgctctgtgcgtcctgtgcccgcgaggttgctggggcgcatgagctcacggagaacgatttcgcctggatgcgggcgcttctggcggcgaccttcaaggagctgaaggacgctccgatcgatgcagcgaccgcccgccttcttctgatgcttgcccatgaatgggggcagacccatctcgactgccgcctcaaggcatgggagttctggcgcgggctctaggacgtgcggcgtctgcttgtgcggagcctgtgagttcgcatgcggctcgaggttcttggacgctcacgcctttccctgtggtaaagtacttctcgttgtacgtaccctgtacctggtcgcacgttcatgccagacggcgaacccagttcagggcgaatctcatgaaaggtggttccacacatggcagttaccaaggagcgcaaggcagagctcatggctcagtacggcaagaatgagaaggactccggctccgccgccgtccaggtcgctctcctcaccgagcgtatcaagggcctgaccgagcacatgaagtcccatcagaaggacttccacacccgccgcggcctgctgatgctcgtcggcaagcgtcgtcgcctgcttggctacatcaaggcacaggacatcgaagagtaccgtagcctcatcaagagcctgggcatccgcgacaacatccagtaagtgggtcattggaagagggcgccatcgaggcgtcctcttctttcatatgcatccccgagaagcggggatgccgcatgcagagatgcatgcaagacggcccgtctgcaatggggcagacggagataaggggaaaaatgaaagtaacccatgaattcgacctgtacggcaagcactacacgctcgagacaggcgagctcgcgaagcaggctaccggttcctgcctcgtgaaggctggggattccaccgtccttctgacggcggttgtctccaaggagcgcaaggactacgacttcttcccgctgacggtcgatttcattgagaagatgtacgccgtgggccgcatcccgggcggctacctcaagcgcgaggcgcgtccgagcgagaaggcaaccctcacagcccgcatgatcgaccgtcctctgcgcccgtccttcccggatggcttcaggaacgaggtacagattgtcgcgacgacgctcgtcgcagaccagatcaacccggtcgacaccatctgtgtcatggcagcatctgctgccctcaccgtcggcggcgtgccgtttgagggcccgcttgcctgcgtgaggatcggccgcaacaccgagacgggcgagtggatcgtgaacccgacgtacgaggagcgcaagacgagcgacctcgacctcgagctcggcggttccgccacgttcatctccatgctcgaggctggcgcccaggagatctccgaggatgacatgctcgcagccatggcattcggccaggaggccatcgctgccttctgcgagcaggagaagatcttcttccagaaggtccaggaggccaacggcccgttcccgaagcatgactacatcctcgatgagcccatccctgaggtgcacgaccgcatcttcgcgcactacgacgagatgagcgcagccctcaaggatccggacaagctctcccgcatcgacaaggtcgaggacctcaaggccaagatcacggcagagttcaccgacgaggagcaggagacctggagccgtgccattccggtcgagctcaagagcctcgagaagcatgcaatgcgccgcatggtcgtcgagaccggcgagcgtgtcgatggccgcaaggccaccgaggtcaggccgctcatggtgaagccggactatctgccgcgcgtccatggctccggcctcttccagcgtggacagacccaggtcctctcggtctgcacgcttggcatgctcaacgagtggcagcgccttgacacgatcgagccggtcgagggcaagcgctacatccaccactacaacttcccgccgttctgcacgggcgagacgggccgcatgggcagcccgaagcgccgcgagatcggccacggcaaccttgccgagcgcgcccttctgccggtgatcccctccgaggaggagttcccgtacacgatccgcgtcgtctccgaggtcatggagtccaatggctcctcgtcgatggcatcgacgtgcggttccacccttgccctcatggatgcaggcgtccccatcaagcgtccggtctccggcgttgccatgggcctcatccaggaggaaggcaagaccgtcgtcctgaccgacatccagggcctcgaggacttcctcggcgacatggacttcaaggtcacgggcacgaccaagggcatcacggccatgcagatggacaacaaggctacgggactcacgcctgagatcctgcgcgctgcactcatgcaggcacacgagggccgcatgttcatcctcgatgcgatgctcgatgccatccctgcaccgcgcgagcacacgaagccgacggctccgcagatcatcagcctccacattccgaccgacaagatccgcgatgtcatcggctctggcggcaaggtcatccgtggcatccaggaggagacgggagccaccgtcgacgtccaggaggacggcactgtcttcatctccggcatcaatggtgcaggagatgcagcagccgagcgcatcaaggctatcgtgaaggtccccgaggtcggcgaggagtacaccggccgtgtcgtcggcatccagccgttcggcgccttcgtcgagctccttccgggcaaggacggcctgctccacatctcccgtgtcgcaaagggccgtgtcgacaaggtcgaggatgtcctgaacatcggcgacgaggtcaaggtcaaggtcctcgaggtcgacgagaagggcaagatcagcctcgatcgcctcgacaagcctgaggcacctcaaggctccggcaagggccgcgagaacggcgagcgcgacgagcacaggacgcgccacacgcgccgtccgggcgacaatggcggccgcagggcacagtccaatgagggcgatgctccccgtggacgccagccccgtcgtcaccacgacgcataaggcctgaagcaagccagaatcaaagttccatccagcatgggcgggagctcttcggggttcccgcctttgttctcaagaataatcatggcgctttgctggtagcgtcgtttggcactgcctgctcgggtactatcatagaaagccttgtgccggccctttggccgcacgctatcagcatgggaatgcagcctggcagaatcgacgcagctggctgcatgaaatgatctgcatcacatcgctacatggaaggagcaggcagatatatggcaagaactgaatccatacctctcaaagtcattcctctcggaggcctcgatggcatcggaaagaacatgacggcattcgaatacggcgacgatatgatcctcgtcgatgccggcatcatgttcccggacgacgatatgccgggcgtcgacctcgtgcttcccgactacacctatgtcctcgagaatgaggacaagctccgtggcatcatcgtgacccacggccatgaggaccacaccggcgcgcttccgtacctcatcatggacctcacgcaccgcgtgcccatcttctcgagcaagctcaccctgaagctcatcgagggcaagctcgaggagcatcgtctcaagaacccggacttccgcgaggtgaccgatggcacgaagatcgagcttggcgccttcacggtgagcttcttctcgatgacgcactcgattccggcatctctcggcgtctacatcaagacgcctgccggcaccgtcatgcacacgggcgacttcaagctcgatcagacgccgatcgacggcgtgcgtcccgactacgccgccatcaaccgcttcgcctccatgggcgtagaccttctgctctccgattcgacgaatgcgacaaggcccggcttcacgccctctgaagcagccgtcggccccgctcttcgccacatcatcaagaatgcgccgggccgcgtctttgtcgcctcgttctcgagccacatccaccgtctccagcagatctgcgacgctgcgacggccgtcggccgcaaggtcgtcgtgaccggcaggtccatggtgacgaacacggccatcgcacgcgagcttggctacctcaggatcgcagacgagaatatcatcgatgcctacgacgtcgagaacatccctgacgacaaaatcgtcgtcatgtgcacaggctcccagggcgagccgctctcggcactctcgaggatggcaaacggcgagcacaagtcgctctcgatccacaagggcgataccgtcatcatctctgcaacgccggtccctggcaacgagaagagcgtccagggcgtcatcaactcgctctcgaagctcggctgctacatctacgacaagagcaacacgctcgtgcatgtctccggccatggttcccaggaggagctcaagctcatgctcgctatggtgcacccgaagtacttcatgccggtgcacggcgaggcagtgcacctgagggcacacgctcagcttgcccgcgacatgggcatggacgacgaccacatcttcgtcgtcgacaacggcgatacgctcgagatgcgccgccacaaggtccgccgtggcccttcggtcgattccggtgtcgtctacgtcgacggcggctctgtgtccgatgccgatcctgtcgtgctgcgcgaccgcaagcgcctagcaactgatggcatcgtcacctgcgtcgtcacgatctcgagccgcacgcacaaggtcgccgatatcgagctttcgagtcgtggcttctcttcggcaaacgatgtggagctctccgatggcgcggtcgattccgtacgcacggcagtcatgaagattgccgatacggcaacggtcgatgccatgcgcaaggcggcaaggaacggcctttcgaactatctctggaacaagacgcacacgcggccgatggtgattccggtcgtgctggaggtgtaggttggcagcaaagagcaagacagcagcacagaaaaatattgccagggcccagaagccgcaggtgcagcatagtgcagcgcctgtgatagagccctctgtcaagcaggacatcctcgccgtgctgctgatcgtgcttgccgtcgcgatgatcgtagcgctcgtcacgccgacctctgccgtcgtgacaacgcttctcggacgtgcgctgtcgctgctcttcggcgttggcgccatactctgtccgctcgccattgcgctttttgctgcgacgcatttcatggaccgctcgatcctgggctcgaagcgcgtggcagtgggccttggcctcatcgtgcttgccgtcctcgccctgatctccgtgaatgccggcgttcctgaatcagcacctcagcaggtgctcgaccctgcctatatggagagggcaggaggccttctcggcggagcgcttgcctgggtgctcctcgtccttgtcggacgcatcgtttccaatgtcgtgctcgtgggcctcattgtcacgggcgcccttgtctgcggcctttcgctcacgaagctgaagtccgagatgcaggagaagatgtccgccctgaagcagagccgcgaaatgtcccgtgcccagaaggcggaggctgctccggcatctgttgcagatctcgacgagctctttgccgatgcgcaggatcctgatggcaccgcgccgacgacgctcttcgatcctttgggtgacggcaagacgacctatatcggcgaccgcaagacgaccgtgctcaagaggaaccgcaataaggctccggtggagaccgagaagcctgtcgatgcagaagagaatgcagacagcaagacggagaaggcacagaagaggcgccatccgcgtctttcgctcaagcatgtgcagcccgctgccgatatcgaggattcctccgatgcagcaaacgagacgcccgatgaggatgagcctgcagcgcaggcaacagcccctgcacctgcagcagcacctgcgcatgaggcagtgcctgacttcctgaaggaggcagcggcgcgtgccgagggcaagaagacgcagatccagaagaaggatgcgtcagctcccgcccagactgcggcagcttcctcagccgagcccggagagcttccgccgctttcccttcttgaatcgaatcctgattctgcccagtccatgagctcgcaggaagagctcaggtccacggcagagaagctccagagcacgcttgaggagttcggcctcacggccaaggtcacggggtgggtctctggccctatcgtcacgacgttccagatctccatgggcgagggcgagcgtgtgagccgcatcacgaacctcgaagacgatatcgcgctctcgcttgccgctacctcggtccgcatcttcgcgccgattcccggcacctcgcttgtcggcatcgagattccgaaccatgagaggcagagcgtgtgcctgggcgatgtcctgccgtatgcaaagagcaagagcccgctcgaggtcgccttcggccgcgatacggaaggaaagccgatcacggtcgatatcgcgaagcttccacacctgcttgttgctggtacgaccggctcgggcaagtcggtccttctgaacacgatcatcgtctcgatgctcatgagggcgacgccccagcaggtccgcatgatcatgatcgacccgaaacgcgtcgagttcacgggctacaatggcctgccacatctctatgttccggtcgtgaccgatccgcaccaggctgcaggagcgctccagtggggcgtctccgagatggagcgcagactcaaggtcttcgagcactacaaggtccgcgacatcaagacattcaatgcgaatatcgacggcgacaagtgggctgacatggagcatccgcccgagcacatgccgtacttcgtgatcgtgatcgacgagctctctgacctcatgatggtcgcccgcaaggatgtcgaagcctcgattgtccgtatcgctcagctcggccgcgctgcgggcatccatctgattgtcgcaacgcagaggccttcggccgatgtcgtgacaggcctcatcaaggcgaacatcgacaaccgcgtcgcgctctctgtcgactcgtccgtgaactcccgcatcatcctcgatgcgacgggagcagagcgcctgctcggctccggcgacatgctctaccgtctccgcggcaggaagccgaagcgtgcgcttggctgctatgtttcggacgatgagattgaatccgtcgtcgccttcgtgaaggaccacttcgagagcgacatgcacgacgagattctttccgctgtcgctccgggagctcttcctggagagtcgagcggctcgcaggggcctgaggacgacgacccgctcgtctgggaggcagcgcagattgtcgtggattcgcagctcggctccacatctggcctccagcgccgcctcaaggtcggctatgcccgtgccggaaggatcatggacatgctcgaggcaaagggcatcgtcgggccgcctgatggctcgaagccgcgcgaagtcctgctcgacgaggcaggcctcgaagagctcaggatagccgaggaaaagtaccgggaggtcgtatagcaatggcagcacgctatagcgctatacttcttgaacgccgcaggcagctgggcatcacgctcggcaaggcagcccgcgacctgcgcatgaaggagcaaatactccaggcattcgaggaaggcgattttgcgtccattccgagcaatggctatacgcaggggatgcttgcctcctatgcgcgctatcttggacttgatgattctgcagtcgtacgtcaattcaatgaggacctatacgtgtacgagcacggaaacaatgaaaggcgaagacgctcccgcgagcaggtgcgctcaagctatttggaccgcagcagccgtgagcgctcgggtgccgctgcgaggagcaggagcgctgctccgcagggaggatatggacgtccatcgcagggacagccctattcgcagcgtgtgccgcagcagggctatccttcgcagcagcgaaatccctacatcgatgggacagagcgcttcgggaggcagggccagcgcatagagacgcgccctgtcgagcggggctacaccgacgatatgaagtacggacagacgacctctccctatgaggcagcaaactctgtccgtggccgcgtgtcgtcgaggaacatcgcgaacgtccagcgtccgaatgtggacaggaggcgtccgcagcctggacgacatccccagcgtccgaagtcgttcctctcgaacgagaacatggtgatcggccttggcatactcgtcgcaatccttctgacgatcatcatcgtgatgtcggtgagctcctgcgtgaatatggcagcaggggagagcagctcggcagcaagctcctcggtaccggtttccacagctgacactacgagctcgcagagctcgacctcatcgagctctgatgcttccgggacgaagagctcctcttcgaatacctctgcccagacgacgagcacgaagtctgacggcacgtcttcgagcaccacgacgacgccggagaagacggaagtcgtcgtgacggtcgccgacagcagcgtctcctgggtggagatcgtcgtcgacggcaagagcgtcgtcgccgagtccgtgacgggtccctggacgcagacctacgagccgaagcagtcgatgagcatccaggtcggagatacgtctgcagtgacggtcacgaagaacggcgaaaaccagagcttcgatgcgaagacttcgggtcttggtaccataacgatcaaggtgccgcagacgcagacgaccacgaccgatggaacatcgaccgatgcgagcaaggattcgaagggtacggattcctcgagcacatcgaccgactccacgcagtccggcacgtccagctcgacgaacggcacgaccagcacgggcagcacgtctgccactacgaacggcgcttcggctacgagcacgaagagcgcctccaccacaaccagcaaggcttaaggagggaacatggcaaaggaatcgagcttcgatatcgtttccgaagtcgatctcatggaggtcgacaacgccttccagcaggctcagaaggagctttcgcagcgctatgacctcaagggcaccggctcttcgatcgagtactcgaagaaggacggcaccatcaccatcagtgcaccgtccgagttcgtcgctggccaggttgccgacatcatgaattcgaaggctgcaaagcgcggcatcgatctttctgccatcaagtggcaggaggccgtgccggcagcaggagcaactgtgaagaagtgcgctacccttgtccagggcatcgaccaggacacggcaaagcgcattgccaaggatatccgaggcaccaagcagaaggtcaaggcgaccgtcgaaggcgacaagctccgcgtgagctccgcctcgcgtgatgcgctgcaggccaccatcgcctatctcagagagcaggattatggacagccgctccaatatgtcaactaccgctagcaccgaagatccccgcatcctctatatcacgctcggctgcgcaaagaacgaggtcgataccgaccgcatgcgctcgcttctcggacgtgctgggtatgcggagacccatgaggtggcagacgccgatctggcactgatcaatacgtgctcgttcctcgcttcggcgacatccgagtcgatcgagacgacgctccagcttgccgaggaagcgacagacgaaggcgtccgtggccttcccatcgtcatgtgtggctgcgtgccgtcccgctatggtgcagagcttcccgaagagcttccggaggtctcggccttcgtgaaggctgacgaggaggacggcatcgtctcggtcgtgtcgaaggtcctcggccgcgaagtgcccaaggagggtcctgccatcgacgccggggcgctccgtacgatcgagggcgcaagcgtctatgtgaagatctctgaagggtgcgaccgcttctgcgcgttctgcgccattccttatatccgcggccgctaccattcgcgtccggtcgaggaaattctcgaagaggtgaggcaccttatggagggcggtgtccgtgaggtcgtgctcatcggccaggacaccggcatctggggctccgatttcgaagacaagaagacgcttgcctggctccttcgccaggttgcagaggctgtgcgtccctatcatggctggatccgcgtgctctatcttcagccagagggcatgaccgacgagctcatcgcgacgatccgcgatacgcctgaagtgcttccctatatcgatatccccatccagcactgctccgagaggatcctggcacgcatgggccgctccggctcagagcctgagctccgcgagctcttcgccaggctccgccgcgagattcctggcatggtgctcaggacgaccggcatggcaggattcccgggagagaccgacgaggaggcagaggagcttctcgatttcctgaaggatgaggagttcgactacacctcggtctttgcctactcgcccgaggaaggcacccgcgctgccgagatggaggaccaggtccccgaagatgtgaagatggagcgcacccagcgcctcatcgacctcgccgaggagatgggcttctctgcaacggccaagcatatcggcgagacggtcgatgtgatcgtcgacggcatcgaggaaggcgacaacggccccgagctcatcggacatgcctggttccaggcgcctgattccgatggcgcggtgcatatcgagagcggcgaggcatctgtcggcgatatcgtgcgcgtgaagctcgtggacagcttctgctacgagctcgtcggcgagcttctggggagcgagtgacgtggcagtatcgtcgaagaagctctggacacccgcaaacatcgtcacctgcatccgcatcgtcctcattccggtgtggttcatcctcgcagcacaggtaccagctgccataagcagcttctcggtgcctgccttcggcatcgcgctcttctacatcgcgatatcgggaacagacaagctcgatgggtatctcgcacgctcgagaaacgaggtcacgacattcggcaagttcctcgatccgattgccgacaagctcgtcgtgatatttgcccttgtctatctcctcatggagggttccatgggacccttcatgctgcttgttgtcatagtgcgcgagctgcttgtatcgggcctgcgcatggtcgttgcggctaagggggtcgtgattgccgcaagcaatctcggcaaggcgaagaccgccacgacaatggtgggcatctgcgggatgcttctggcgcgctcctttggggcgggcctcttccagacggtgctctacggcctcagctggtggatactcattgcggcgacgatcctcaccatctggtccggtgtggactatctcgtgaaatcttggagctacattacggagggatagatcatgcagggagatcaaggcgatatcgagcttccagacgagcaggagctctacaaggcagcagagcgcgtgctcgatctggggcacaggaaaggcctcacggtcggaacggccgagtcctgcacgggcggccttgtgacaggtgcgctcacggcagtgcctggctcgtccgctgtcgtgaagggcggcatcacgagctatgcgattcccgtaaagcacgccgtgctcggcgtgtctgatggcatcctcgatgctcctggtgtcggtgctgtctcctccgagtgtgctgaggccatggcagaaggcgccaggcgcgtccttctgaccgatgtcgctgtgtcggtgacgggcatcgcaggccctggcggcgaggagccgggaaagcctgtcggcacggtctggttcgggctttcctgcggcggcttcacgagaagcgagatgcacctcctttcaggcgaccgcaagaccgtacgcctgaaggcagtgcagattgccttgggccttctcgccgaggggctcgaatcgctctgatcgaagatcaagccggctgggggccaaggtctccggccggctttctgctcatggaagattcgtgccagaaacctgcgttcccggcgtgcgaaggctgtcaggcagttcctgtatgctggacaaagacgattgacggcgaacgattgttcgtctagcatggcagaggctggcacagagcaaggagtagcaatggctaagaagaccgtgacacgtgaagtccatcagaagatgtacggcgaagagcgcgacaagatggtggaagcgacgactgccgagatcgagaagaagttcggcaagggctccatcatgaagtacggcgacggtgcgcagaatctcgatatcgaggcgattccgacgggatctctggcgctcgacgcggcgctcggcatcggcggcgtgccacgcggccgtatcgtagagatctacggccccgagtcttcgggcaagacgaccctctcgctcgagattctcgctgaggcccaggccatgggcggtgttgtcgccttcatcgacgccgagcacgccctggatccgggctatgcagcacgcatcggtgtcgatatcgatgaggtgctcatctcgcagccggataccggcgagcaggcgctcgaaatctgcgacatgctcgtgcgctccggcgccatagacgtcgtggtcgtcgactctgtcgcagcgctcgtgccccgtgccgaaatcgagggcgagatcggcgagacgacggtcggcgcgcaggcacgtctcatgagccaggcgctccgaaagcttgccggctcgcttgccaagtcgaacacgacctgcatcttcatcaaccagcttcgcgagaagatcggcgtcatgttcggcaaccccgagacgacgccaggcggccgtgcgctcaagttcttcgcatcggtccgaatggatatccgccgcatcgactctatcaagcagaacggcgaggtcgtcggcaaccgtgtgcgcgtcaaggtcgtcaagaacaaggtcgcagctcccttcaagcaggccgagttcgacatcatgtatggcgcgggcatctcgaaggaaggctccatcctcgacatgggtgtcgattacggtatcgtcgacaagtccggtgcctggttcacctatgagggggagcgcttgggacagggacgcgaggctgccaaggagttcctgcgcgagaaccccgatctttcccaggaaatcgaccacaaggtacgcgttgcctgcggcctcgtgctgggagacgagcgtgtcggcgagccggtcgtggacgccggcaagaagccgtctgacgaggaataggcgagatggcaaccgaagcagaggcattcagctggtcctgcacgatgcccgagaagaaggcatcctccttcgaccgcaggcggccgcaggcgacgcttgaagccgatggcatgggaaagaggaagattcctgtcgaagtcgcccgtgccctcaagaaggctgaggctgacaggagctctggctatatgtcggcagacgagctccttgaagccgagggccagatcgaggagcagtgcgcctggcagaagacggccgagaccctgaacaggcgcgactgcacggtatcggagctcacagagcgcctggccgagcggggctacggacgtcctgccatcgactctgcccttgcgattgcccagaagaagcacctcgtagatgacaggagatatgcgaagcgcttctgcgagcagaagatccgtgcgggatggggaaggcgcaagatcgagctcgagctggcgcggcgcggcgttgcgctcggcgaggacatcggctggagcgaggcggcaggcgacgaggacgaggctgagcgcgcccttgcgcttgcgcgtaggaagcatgtctcttctggcaacgagtaccagaagcttgtacgctatcttgcaggcagaggctacagcttcgagctcgcgacgcgtgccgcaaagcaggcgcttgccgagaggcgcagctcagaagatatctgagctgccatccacaaaaaaagaagagcttgtgaccttacgaacatttgacagtatcagatgtcgaatatacgattgaattaccagctttggtgattcacgccttcggcaagctccgcaagacgttgtccatataacaatggtatgtgcgttctggcagtcttccatgctgccggcagtgacacctcaggtgggaggggcccgcatgtgcggactccgctgatgagaagatgaacgactgaggagtcaccatgacagtactagttgcgattgcatgtctggcggtgggtgccctcgtctgctatttcgccgtgacaaggcagagcagcacgaaggtgcaggaagcacgccgacaggtcgatgatgcaaaggccgaggcagaaaagcagctcggcgatgcccgcacccaggcagagaagatcactgccgatgccaagagcgcagccgagagcgcgaagcgcgaggccctgatcgaagccaaagagaagatcatgcagatgcgccaggcttccctcaatgaggaggagcagcgcaagaacgagatccatacgctcgagaaccgtctcgtccagcgcgaggagtccctcgacaagaggaacgactccctcgaccgccgcgagcaccagctccagagctatcaaggccagctcgaccgcaggaagtccgatctcgacaagatggaagagaagatgacaaccgagctcgagcgcattgctggcctctcgagcgacgaggcccacgacgagctcatcggcaagatccgccagcagagcgtgcgcgaggaggcacagatcctgcgcgagtccgagcagcgcgtacgtgccaaggccgacaagacggcacgcgagatcgtctcaacggccatccagcgctgtgctgccgaccaggcaggcgagattacggtcacgtccgtccatattccgtctgatgacctgaagggccgcatcattggccgcgagggcaggaacatccgcaccttcgagcaggttaccggcgtctctcttgtcatcgacgatacgcctgagaccgtcgtgctctcgagcttcgatccggtccgccgcgagacggcacgcgtcacgctcgagaacctcatcgcagacggacgcatccatcctgcccgcatcgaggacatgtacaagaaggccgagaccctcgtgaacgagcgcgtccgcgaggctggcgagcaggctgccttcgatatgggtatccacgacctgcatcctgaactcatcaggaccttgggtgcccttcgctaccgcacgtcctatggccagaatgtcctttcgcactccgtccaggtcgcgacgctctgcggaatcatggcttccgagctaggcatggacgaggcaccggcaaaacgtgcaggactcctgcatgacatcggcaaggccatcgaccatgaggtggaaggcccgcacgctgtcatcggtgcagaccttgcccgccgctacggcgagaagccggagatcgtccatgctatcgaggcacaccacgcagacgtcgagccggatacggtcctcgatgtgcttgtccaggcagccgatgccatctccgctgcacgcccgggtgcccgccgcgagtctgccgagaactacatcaagcgcctcgagaagctcgaggagatctccaatgcccatgagggcgtcgagcgcacctatgcaatgcaggctggccgcgagctccatgttatggtcgagcccgagaagatctccgatgcccaggcaacggtgcttgcccacgatatcgcgaagcagatcgaggacgagatggaatatcctggccaggtccgcgtcgtcgtcatacgcgaatcccgcgcagtggatacggcaaagtaggcaatgggcacagacgctgagagccttgccgccttcattgcaaagacgggacatgcagcttcgcttcgcgtcgaagagagctacggtgacggcttcgtccgccttcgggtggacgaagccgaacgtcgtcaggcgaagcatgatatccgttctgtcgaagacgcagcgatagagcttctgcggaatgcacgcgatgccggagcccatacgattctctttgcgctccagaagaccgaaggcacgcggacgctcacggttgtggatgatggcggaggaatccctcacgacatgcaggagcgcatcttcgatgcccgtgtcacctcgaagctcgatacgatgcatatggacgcctggggcgtgcatggaaggggcatggcgctcttctcgataaggcagaacgccgaagcatcccacgtcgttgcatcagatccaggcaagggcacctcgatccaggtttccttcgatacgcaaaagattcccgaaaaggcagaccagtcgtcctggcccgagtgcgagcgggacgaagacggagcaatcaagattgtccgcggcccgcataacctcctgcgctgctcctgcgagtttgcgctcgaggacaagggtgcctgcgaggtctatatcggctctcctgcagagaccatagcggcagcacgcagacatgtccgcattccgcgcgctgtacgcgaacgcatcctccagatgaagatctgcgacatgccgcttctgctccagctccggctcgcgcctgacgctgaggagcttgccgatattgcctcagctctcggcctcgaaatctccgagaggaccgcacagaggattctctctggcgagattgcgccagcgcagggcgcctatgcgtatatcagaggcaagaaggtttcagcgcaccgcagtccccggaaagtggacctcgagaaggatgcccgaagcatcaagatctcgaagaaggatctcgacaagttccgcggcatgcttgcgcgcgatttccagtatctggaggatcgctactatatcgagcttgcagcaccgcccgaggtccgtgtttcttcaggccggctttcctgtacgttcgaatttgccgaggatgactaggccgtaaagtataagatgtacgaagtggtatatggcaagaccatatgcagtgtgtcccgagaatgaggggcacaagatagagcgaacttccaggagcaggtatggacttcctcaaggtttcgagcaaatcttcccccgcatcggtcgcgggcgccattgccggcatggtgaaggacggcgtgcccgtgaatgtgcagtgcgtcggtgcaggtgcggtgaaccaggccatcaaggctgttgccatcgcccgcggatttctcataccgacaggagtcgacatctcctgcgctcccaccttctccgatatcgagatctgcggcgagaacaggacggcaatccgcattgcaatctacgtccacaagctgacgccgcagacactttcacagacagcccctactgatacgaggacggtttcatagcatgcagcattacccgcagttggcaggaaagacctactatgtaaagacgttcgggtgccagatgaacttccacgatgctgagcgggtggcgggcctgcttgattcgtgtggctgcctcgaggtcggtaccgtcgaagaggcagatatcgtcgtattcatgacgtgctcagtgcgtgaaggggccgatacgaggctctatggcactgcagcgaatgcagcaggggctgcgcttccgccttccggcaagcgcatcgtggccgtcggtggctgcgtagcgcagcgtgcaggtgcagagctcaagaagaacataccgagtgtcgatgtcgtcttcggcaccggcgccttggcatcgctgcctgagcttctcgtcgaggcctactcggagaagaagcacaaggtgctcgtcgatacgaaggaagacaccgagcatttctcgaccgagcttccgagccatcgagagctccgctatcacgcctgggtgccgatcatgacggggtgcaacaacttctgtacctactgcatcgtgccgtatgtccgtggacgcgagcgctcgcgcacgatggagtccatcctcctcgaatgcaacgggcttgtcgctgacggcgtgcgcgaaatcacgcttctgggccagaacgtgaactcctacggcacgaacatctacgggaagccccggttcgcagagcttctccgcaaggtaggagagaccggcgtcgaccgcatccgcttcacgtcttcgaatcccatggacctcacagacgatgtcattgccgccatggcagagacgcccaatgtgatgccccagctccatcttgctgtccagagcggctctacgagagtcctgaaggccatgaacaggcgctatacgagagagcagtatctcgaccttgtcggacgcctgcgctctgccatgccggaccttgctctcacgaccgaccttattgtcggcttcccgggagagacagaagaggacttcgaggatacgctttcactcgtccgcgaggcagccttcgatgcggcctataccttcatctactcgaagcgcccgggaactcctgcagcgaagatcgaagatacgacgcctcacgaggtcatccaggagcgcttcgacaggctggcacgcctcgtcgaggacctctcctacgcatcaaaccagcgcgatcttggtacggtctccgaagtgcttgtcgagggtccctccaagaggaatgaccagatgcttgtcggccacagccgcaagcttcagaccgtccacttcccgctgtgcgaaggccagaaggcagaagacctcgtcggcaagctcgtcgatgtgaaggtcgacgaagcgaagtcctggtatctcgaaggcacgcagacaggcgatccccggtgaaaggcgaccgtgtcctctgcatcgtcggccctactgcatcgggcaagagcgcgcttgcagatgagctggcatgccgtcttgcaacctccgtcatctctgtcgatgcgatgcaggtctatcgcggcatggatatcggcacagcaaagacgccggtatcggaacgcaggcgtccgctccttatggtcgatgtcgcagatatcggcgatgcctattctgcgcagctcttccaggaggaagcgcgcagctgcatcgatagcctttgctcggaaggaaagctccccatcctctgcggtggtacgggactctaccttgatgccacgatagacgatatggtcttcccgaagggcgatacgtcgtctgagacgcgcaaacgctatgagaagatggctgaagacgaaggcagcgaggccgtatatgcactcctcgagagccgggaccctgcttctgccgaactcatacacccgaacaatgtgagacgtgtcatcagggcgcttgagctcctcgatgagggaaagagctacgccgtgcagcacgctggcctccatgaacgggcaccatggtatgacgcttcgatctggggcatagccatggatcgcgagcgactctacaggaggatctcagtacgcgtggaccagatgcttcaagacggcctcgtggatgaggtggaaggtcttgtcgctgctgggttcagagacacgcttaccgcgatgcaggccatcggctacaaggagatcgtggactgcctcgaaggctcctgcacgcttcccgaagcgaccgaagagatcaagaagcgcacccgccgctatgcaaagcggcagctctcctggttcaagcgcgatggccgcgtgaaatggctcgatctggaccagatggacacgaacggcgctgcagatatgatcatggagaaggagatgctctgatgccccgattcaaggcgcagccgacaaagctcgaaccggatcgcgcgattcttgtcggtgtcgataccggggccggagaatggtctctcgacgagtcgctggctgagctggggcgcctggtcgagacagatgggggagaggttgtcgccacgcttgcacagcgtctcgaggttcctgtggcgcgcacctatctgggttctggcaaggctgaggagctcagggaccttgcccgctctctcgacgcggatgtcgtcgtattcgacgacgagctctctccgtcacagcagtcaaatctcgagaagattgtcggctcccatgcgaaggtcatcgaccgtaccgccctcattctcgatatcttcgctgcccatgcaacgacgaaggaaggacgtctccaggttcagctggcccaggcaaactacctgctgccgcgtctgagaggcatgtggagccaccttgtcggcgagcagacgagaggtggcatcggttccaggttcggccagggcgagagccagctcgaggtggaccgccgtcttgtcaggaagcgcatcagcttcctcacgcaggagctgaaggagctctcctcccagcgccatacccagtcaaaggcacgctgggaatccggtgtctggagggtcgccctcgtcggctatacgaatgctggcaaatcgaccatgctcaacaagcttaccggatcttcggtatatgcgaaggacgagctcttcgcgacgctggatccgacaacacgtgccatcgagcttgaagaaggtcgaaagatcaccatcacggatacagtcggcttcatccagaagcttccgaccctgctggtggaatcattcaagtcgacgctctccgaggctatcaatgctgacctgatactcaaggtcgtcgatatttcggacccgcatgcggagaaggaactctcggtcgtcgacagcatcctgaaagagatcggtgccgacaagatcagaagcgtcgttgtctataacaagagcgaccttgttcctgaggaggctctgcgccagctcgaggcaatgcatccggatgctgtcttcatctcggcactcgatggcaagggacttcgcggcctgctcttccgcatcgcacaggaagctgcgaagggcgatataacgatgacagtggaagtgccgtatgaaaagggcatcctcatgagcatgctccatgagagatgccagatacttcatgaggaataccacgaaggcgggctcagagccactgccaaggttcctgagcgccttgcaggcactttcgagccttaccgtctggagggctgagaaagcctcgtggtgccgggacgcatcataagagctgtgtcccagtagcagctgcgcagatgagaagaattgcaggctggtggaagatatagaacgcaagcgggtgcctgccgacgaattcgagcggcgggcaggcaagcttccttgcggcatcaggatatccctgccgcttccagagctttcccaacgctgctcccgagagatacatgaagaggaaagggagcacgggatagtagtcgcccgaggcaaagcctggtccaggaatgccgagccatgcaaggccgcgtatctgatagagggtgcgggggagcggcacggcaaggggaggaaacccgaaagatcctctcggcagtccataagagatgaagaaggcgacccagagaaggatggcagctttccatccatcaggaacatgccctgccctctgcaggagcgtatagatgagcgtgcaggcgcccatgcagaagatgatgccgaaattgatcggcgtatcgacagctgcaatggtcgtgacagcccagatggctgcagcaagtgccaagtagcgtcctgcgcgcttcaggttgttcctcgagaagctgcacatgacgcctgcgatgaagaggaaggtccaggagatggagtctcgccagatatcctcgaaaggcggtacaaaccatgcaagcctgaagccgaagatggctgtcaggtcatagcaggcatgaaaccccatcatcgaaatgacagagaagccacggatgatatcgaagaggcggagacgcctggattccggcacggcgctagctgattgaacggatgagtgccgtcacgcgacccaggatgcgcgggttctcggcgtagatcggttccatcgtatcgttctccggctggagacggatacgtccatcttcgcggtagaacgtcttcacggttgcagaatcgtcgataagcgcaacgacgatctcgccgtcatgtgcatcgtgctcttccttcacgacgatgtagtcaccgtcgaagatgccggcattgatcatggactcgccatgaacgcgcaggacgaaagatgatgcatcgccgacgatgctggtcggcagattgaggcgctcttcaacattctgctcagccagaatcggctggcctgcagcaacgcggccgacgagcggaagcgagatcgtattgctatctgggtcttcggtgaccttggcaagatgcaggccctcgtcgtgctcggaaggattgttcacgacctcgatggcacggggcttctttgaatccctcttgatgaggccctgctcctggaggacctggagatgcatatggacggtcgaaggcgatgccagaccgactgcggcgccaatctcgcgtaccgagggtggatagccatgctcggcgctataggagcagatgtactcgtagatgctttgctggcgcttgctgagcttcttcttcatgggagtcctccttttccctggttccatcatacgatatttcacattaatctgcaaacaaatgttctgataactattgacacgtactagtgttcgagcaatagtatacaaaacagatgttcgctcatgcaatgctgtcggcggcgattgctataaacgtcagcagcaacgatgagagaaaggctccaacatgatcgatggaaacagcgcactgttcgatggcaacgcagcacttgcaatggacccagcacccgcattcgtcctgcacgagggaagggcggctcgcgaggaacaggcaaagcctgtacgcggcagcaaggtcttcactgttctggctgccggagcaatcgctgctgccttcctcggcacctggtatgcaggagatgcactccagaatgcaaggcttcgccaggcagaggcttccatcgagacggagagctatacagtgaaggaccaggatacgctctggagcattgctgaggcacatggtgctgacggcatgagcaccgaccagatggtacactggctccaggacgagaacggcctggattcctctttcctccagccgggccagacgcttaccgtttctgctgctcaggcataagctgcgaccgtcttaacggcgaattgctgtattacatttcgactcaaatttaaatatggacagcgcggacctcgctttatgtgatatgttctttctgttgaagagcacaagggggattcatgcgctgtccaaagtgcgggtgcgaagaatcgaaggtagtagattcgaggccctctgaaaacaacgatgccattcgccgcaggcgtgaatgcatccagtgcggctacaggttcacgacctatgaaaggcgagaggagactccgcttactgtcctcaagaaggatggcaccaaggagacattcaaccgccagaagctcatgcgcggccttgttgccgcaaccgtcaagaggaacattcctatatcgaagctcgattcgcttatcgatgatatggaatcggagcttcgtgattccggcgtctccgaagtgagctcgaaagagattggcgacatggtgctcaagcgcctcgtgaacctagacaaggttgcctatgtgcgcttcgcttccgtctatcgcgacttcaaagatatcgatgagttcaacgaagagctgaggagtctgagcaaatgagcgaagaccatatcatcctgccgataaagcgccttgacgaagaagtggaactgccgagctacgcctatgagggtgatgctggtctcgatctgcgttccgccgaagatgtggtcctgaagccgttcgagcgccgtcttgtgagcacaggcctcgccatcgccattcctgatggctatgcaggcttcgtgcagccacgaagcggcctcgcgcttcgtgagggcctgtcgatggcaaacaccccaggcctcatcgatgcccattaccgtggcgagctcaaggtctgcgccatcaatctcgaccccgaaagagagattcatatcacgaagggcgagcgcatagcccagcttgtcatacagaaagtcccccgcgtcagcctcatggaagtcgattcgcttgatgagacagaccgcggtgtgggcggattcggatcttccggcgcctgataggggcgtcgtcgatcggcatgcagcgcccgtttccgagccgggcgccgcatgctttccctgcaaggtttttcaaataggaaaggacctcaaggatggagcaattcttcaagctcaaggagcgtggaacgtctgtcggccaggaagcacgtgccggccttacaacgttcctggcgatggcctacatcatcgccgtcaaccccgcgctcatggtcatcgcaggcgtgcctgccaatgctgctgtcacggcaacgtgcatcggcgccggcatcatgacgatcctcatgggcgtcttcgcaaaccgcccgcttgcctgcgcttccggcatgggcatcaacgcaattgttgccttttcgctcaccgctcttgatggcggagactggcatgcctccatggcagtcatcttcatcgagggcatcgcgatcctcgtcctcgttctctgtggcctgcgcgaggctgtcatggatgcaatccctgtacctcttcgccatgccatctctgtcggccttggccttttcatcgcaatgatcggcctcaaggacggcggcatcatcgtcgccagtgagtccacgatggtgagcctcggcgaggtgacgagcccgaccttcatcgtcggcctcatctccatcatcgccacggtcatcctttatacgatggaggtgccgggctcccttctcatcggcatcatcatcgctgtcatcgctggcatccctctgggcgtcacggctgctcctaacggcgtcgtttccgctctcgacttctcgagcttcggcgctccgttccagaccgatgccaatggtgtcatgggcattgcgaaagtcataacgacgcccatccttcttgtctatgccttctcgctcatgatgtccgacttcttcgacacgatgggcactgccatggcagtcgccaagcagggcgacttcctgaacgacgatggctctgtcgaggacatcaagcagattctggtcgtcgactccgcagctgctgctgtgggcggcttctgcggcgcttcctccatcacgacattcgtcgagtcttcctcgggcgcagctgatggtggccgctccggcttgacctcggtcttcaccggcatcttcttcatcatcgctgccttcttcgcaccgatcatcaccgtcgtgagctccgctgcaacctgcggcgccctcgtggtcgtcggctacctcatgatgggcgacgtcgtcgacatcgactggacgaagatcacggatgccttcccggcattcctcatcatcgccggcatcccgatgacgtactcgatctccaacggcatcggcttcggcttcatcgcctatgtcctcatcaacctcgcgaccggcaaggcaaagaacatcaagccgctcatgtgggttgcaaccattgcctttgtggtctacttcctgcttgtctagcagatagggcctcaaatcgcctcttagagccttctggcatgcagcctatctgctgctggaaggctcttttctcttgcaaagatatattgcgcgcaatataatatggatatgctatgtgggggatagcattctcatgtatagaccatgcccccaaggggcatcctttgagcagcgaatacaagagcaaggagatatgccatgagcgataaagtactcgatcttgtcattgtcggtgcaggtcctgctggactcactgcatccatctatgcacagcgcgcaatgcttgacagtgtcgtcctcgagcaggaggccgtgggtggccagatcatgctgaccgccgatgtggacaactatccagcagtgccgcatacgtcaggcttcgagcttgctgacgcgatgcgcggccaggctgaggaccttggtgccaagatcgtatccgaccaggtgagctccatcacacaggaccctgagacgaagatcttcacggtcacgacggcggagggcacctatgagtccaagaccgtcatcctggcaggcggcgcgactcctcgccatgccggcttcgagggcgaagagaagcttggtggccacggcgtgtcgtactgcgccacgtgcgacggcatgttctaccgcaacaagcaggtcttcgtgattggcggcggcaactcagccctcgaggaggcgctgttcctgacgcgctttgcctccaaggtcactgtcatcgtccgcaaggaccatgtccgcgcccaggctgctgtcctcaagaagatcgaggagaacgagaaggtagagattcgctacatgacaagcgtcgtgaagctcgagggcgagacgcttcctgagcgcatcacgttcaggaacaatgagaccggcgaagagacgaccgagacatatccggctggctccttcggcgtgttcgtatttgtcggccgcgtgccggccacgaagctcatcgagggcatggcagatctcgacgaacgtggctatgctgtggcagacgagactggcaagacgaagacgccgggcctctttgttgcaggagacatccgcgagaagaagctccgccagatcgtgacggctacagccgatggcgcaaacgctgcgactgctgcagcagagtatctcggccagcacatcgattcgtgagaaggcttccgagagagtatatatgcttcgagaggggtctggagagagcagctccagtcccctctcttttcgtccagaaatgtctgataatatatcttatgtaaagtaagactctcagatgcctctacatagatgctccccttgctatcatgacagggccttcaaggcactttaggccatattcctctaagagcttctgagaggcattctaagacgccgatatcccaaacataacgatgtttcatgtatgactgtcagcgtggctcaaacaggctctcagagccttgttttgcagcatcccatatggatttttctcacggacgaatccaaagcaggaatatggctatgaatggtcctgcgggcttcgatccgcatctgccgtgccttcgatatcgcgtctgaagatggtcggccggcagagttcctgaatctttcggtcatcttccagcaatgacgatttggggactatggcagtgatgacatcagtgggttcgagcttcgtcgtgccgtgcggcgtgatacgctcgccggcgcgctccacaagtacgatgagcgtacccttcggccacggcagctctgccacggtcctgttctcagcctggctgccaagcgctacatgataggtcctgagtgcaatgccgtgctcttcctgtgccgcaatttccgggtcgaggttgcccagaagcttggtgagcagatgctcgtagaatgcgtcgattttgagcagattcgccgtgacaaaggcaatcattgcgacgatgcttacggacagcagattctcgaggcttcctgtcaattcgaacacaagtacgattgcggtcacaggggccctcacgaccgctgcaaagagccctgcgatgccgagatagatgaagttcatcatatagagcgtcgacgtgccgccgacagcgtttgcaagatggcagaagagcgcgcctgcaagcgaacccatgacaacaagcgggaaaagcgtgccgccgggtgcgcccgaggcgaagctgatggtcgtgaagagatacttccctatcagcaggaagaggattgccccccaggtgagtgccgtcggattcatgagcttctcgatgatggcatcgccgccgcacatgaggtcgggcagcgtgaaggcaatgatgccggagatggcaaaaggaatggcgagcctgctatagggtacccagtgcttgatctttccatagagcgcctggcagccgaacatgccagcgttgtggagcgcacccaggatgccgcaatagatgcccatgacagcgacgagcgggtatgagacgtgcggcaggttcgtgacgagcgcaaagttgagcgttggcttcacgccgagcacctgagagacaaggaagtctgacatgatcgctgatgccatcgccgtgatcaccagggatgccgagaagaccttgtggatctcttcgacggcaaaaaggacgccagtaagcggcgcatggaaggctgctgccatgcccgctacagcgccgcaggtcacgaacagcgactcgtggtcgcggtccttgtggagggccttcgagactgcctttcctcccatgccgccgagcatgacggaagggccttcgcggccaagcgagaggccggcaaaggcacagagcgtgccttcggcgaactttgctgacatgacacggtaccagggcatatcgatgcgccctatcgcttctgcatcggtctgcggaatgccagagccctgcgtatagggctcccagagcaggagcttcgagacgatgatgaggacggctgcgagcgtgacgaaccagagaaggatctggagcggatggcctgctgcggctccggtgatgcctctcatgagcttctctgcgcccgagagcgccatgcggtagaacacgacgatgccgccgccggcaaggccgacaagggcgccttcgaagacgagccgggcctggttcggacgggaaaggcttctctcgagatatcccagatgcttcacgcggcctatcctcccagataaagaaaaggaagctgccggcatgcattccggcagcttccagaaatcgatgccagctctaggatagccctactgcacctggatgagggtgaagacttcctcgtcgtacttcttggcgatctcctcgcgcggatggagataggtgagctcgagcatgaaggagaagccggcgaccttggcgccgctcttctcgacgagctctgccgtagcgacagccgtgccgccggtggcgacgaggtcgtcgacgatcagaacacggtcatcaggcgtgagagcgtccttgtggatctggagctcatccgtgccgtattcgagtgcgtaggtctgcgaatagacctcgcgcggaagcttgccaggctttcttgccgggacaaagccagcattgagcctgtaggcgacaggggcgcccacgaggaagccgcgggcctcggcgccgacgaccttcgtgatgcccttgttgatgaagtgatcggcgatatcgtcgatggctgcagccatgccctgggcatcggcgaacagcggggtgatgtccttgaagatgacgcctggttcaggatagtcaggaatgctgacaatcaggctctcgtaatcgacgctcgacaatgcaggtcctttccttgggtgatcggtctatctatgttccaggacatcttgctggtctgagccgagctccatgtccttgaaagccttgctgagcatgcggcggatcagcgtatcgcggatcgtgtccgtgagcgcaagcacctcgtcggtcgcctgcgcgaactcgatgcgctgggaagcggaggggtcctctcccctcttggcatagagcgttccgagcgcctgctcgaacatgccctcctcgcggtttgccgccacgacatacatgcggagatttctgggtcctatgccgtaatggcggagacgctcggctgcacggatgatcgtgaagtccttgccgtccaccaggtctctgccatggggcgatttcctgagcgtcaggacgccggcatcggcaagctggcgcacgaagctcacgggagctccggtaagctcaggcatgcggtcgatcggatggagcttcgagatcgtctcctcgtcgtccagaggaagagacgcgacggtgttggcgccctgtgcctgcgcttcctgggagagcgcctgctcgagctctgccgtcgttgcattctcgtgcttgctgagctcttccttgatgacggaaagcggcatgaagcgcgtcttctggaggtagagaatcgtctcgaggcgtttcacatcgcgctgtgagtagagacggtatccgccaggggtcctggcaggagtcaggagcccttcatcctcgagatagcgtaccttcgagatggagagctcaggatattcaggctgcagcttcttgacgaccttgccgattgtcagatatcccgcatctgccatgcgtctacgctccggtctcgattctcgaggggatgcggttcgtatggaaggtcaggcggaaggtgccaatctggatggtggagccatccttgatataggccttgctgatgattgcgccatcgacccacgtgccgttgagcgagcccaggtcctgaatcgtgacagctccggagtcgaggccggaaagatcgatcacggcatgatgcctcgaaaccgtcatgtcgttcaggaagatgctgttggaaggatcgcggccaagcgtgatctcgggatcttcaagctcgaaggtctcgccgctctggggacccttgacgatggtgagcgaagggtgcttccgccgtgccgcacccatgagatcgggaatcgtggcatcggttgctggcatacggaaaatttcagtcttatcgccctcgggagggtttgcttgaggctgcattgaggctcccttcacagtgcttcttcaacatttctattctagcgctatctgcaggcgacacagtccatctcgatgagggcatcaagaggaagtttcgagacctccacgacggagcgtgcgggggccggccttccgaaccgttctgcatagacggcatccattgcggcaaaatcctccatatgtgcaagatagaccgttgtctgcgcgacatcggaaagctggcagcctacttcggcaagcagctgctcggccagatcgatgacgcggtttgtctgatcttcgatgcctcctgggacaagacattccgggttgaccttgtcaagggcgatctgtcccgatatgaagacgaagcgtcctgcagtcgttccctgagagctcgatcccatagcgtcagggaagccgtgggcattgatggcatacttcatgaagacctcctcgagatgctatctcaggacagaagcgcgcgagcgccgacgaaatcatggtccttccccatgattccccaagcctttaggctcgatgcatccacctcatggggttctgcatcgagcaggagcttgccccagggcagcgtctcggaaagacgctgccggcagacaacgcgccccaccggtgtgagtgcctggaaggaaagaaggctcctccagacgatgcgtgcgtatgaaggaggaacgagcacgaggtagctcggccggctatcaagctcaggcgagagcacgagcgtcgctatcgtcccatcgagcgatacgtcggagatatgtccagcacggggcagctcatcgtctttcctcacatagtcgtgcaggatggatgtggcagcatcgccccagagaaggagcggcacgagtgcggtgctctcctcttcaagatcgagtgcagcgtagggacggtagccattctgctcgatatccgacaggaacgagagccatgctgcaagaagatcggcagaagggctcgcgtcccagagcacgtattcctcgtctccggtccttgccagaagcggcacggagaccagcctgccatcgcccataaagacaggctcgaaggcgcactccccgactgcaagcttactgccgccaaaggcagcagagcagaaggctcctgccgcagttcctgcgatcctcagcgcatagaggcccgaaagatcgcagagcgccgtgccatctgcaagcgctgttgcctctgcgtcctgatcggcatagcgaagaggcacgtccgggccttcttcgtccagagatcccatgagggcgccgagcagaagatgctctgcctcgaggacgatcttctcttcttcgttcacttcatctgccatgcggcaaaaccagcttccattggaatgagtatttcatcgatgctgcgctgcttgggatagggatatcccgccacataggtggcctcggcaacctggcgtgtgccctgcgtccagacgatgctctgccagcaggagccgggaagcgctgctgcctgcgtgctcgtgatgctggtctccacgatgtcgtctccaccgtactctgcatagcctgtgacagactcgataggtgtagcatcgagaacccagccgaagtggtcggcaaaggcaagcgtggctgccttcgtgctggcttctgccagcggcagcgtctcaaaggcatcggagaatgcccacgagatgagtgccttcgtatccgtgaagcggccttcttctgttgtgcagccaaggacgcacgtatagacccttgtgccgtcctgctcataggcaccgaggaaggccgtgccgctctcgactgcgccggtcttgatgccgagcatgcctgcagccgtctggagcagcgtatctgtgctcttgaacgtcttctgcgtgccgccgattgcggtagtgaccgaagagaggcgtatcgtctgcgcaatgacgggatagttcgcaagcgcataccggcccatgagggcaaggtctgcggctgacgagtagtggccatcctcctcgaggcctgagggattcatgaaatgcgtgtgggtcatgccgagctcttgagctttggcattcatggctgcgacaaaggcctcgcggctgccaaggacattggcagcaagctcttctgctgcatcgtttgccgaatagacgagcatgaccttcaaaagctcgcgcacggtcgtcacatctcctgcagcatagccggcagcctgggcgccttcctcgagcgtgatgtcagaacagataaccggcatatcaagatcatcgacattgtcgagcacgaccattgctgtcatgatcttcgtaatcgatgccatgggcatctcggcgtcggcattctcttcccagagcacattgccgtcgctatccgtgacgatggccgcctttgcctcagagagcttaggtgcggtccccttggaggcgctgactgcacgggtgatggtctcggtccttgttgctgaagcagaagattgggccggggtggctgagttccgaggcaggaagacgcagaccgccaggagcgccacggcagcagcggcgcagacaagagcgatgaggactgcttgcctgcggctttcagccttgctgcccggctgcttcgtaagatgcttcgcgtgctgctgcttcatgctctttgctttcctgccagaggcttcctgcttcgatcttctggcctcgctattgctcttcctgctcccgtgcggcaagcgcttcgtgcttgtagccgatgccttccttcgtatagatgacggcagtgattgtcgaggtgattatgccgacatagacgaagaagatgccgagaggcgccgcgacgctgttgagtcctggcagccaggaggcagagacaagccccagcccgtggatgacaggagcgccgagcagaaggtcgcagaagccgaacatcagaagcgctgtcgtgaccttgccgatatagatgacatcgacgggacgcttgcggtacttctggagggcaagcatgccgaagaacaggtagacgtcgcgtccgatcacgaagatggcaacccagagcggaagctcgccggtgatcacaaggccaaggacgcctgtgaagagaaggatgcggtccatgacggggtcggaaatcttgccgagccagcttaccgtctgcgtgcggcgtgcaacctggccgtcgaggaagtcggtgactgctgccactgcatagcaggtgagcgctgccaccctgtgctcatgctggatgaagagcatgaggaagacgattgtcaggatgaagcggcagagcgttatgacgttcgcaacggtgagaatctggttcgaagggttgtcgggagtgccaacaggacccagatcctgcccggcttcctgcttcgcaagaacttcgggtgcgaccttcgcctttgcgctgcgttctatctgttttctcaatgacaaagcgttgcctcatgtctttcaatcgagctcgtgacttatccatactacccaatgaacgtcgagaaacgcaattcaggacaccaggcgccacaattatcgtcgatgctccagaaaatcgggcatactaagcttgctttcacagactctgacaaagggggtcctatggccagaatccagggtgtaggtgtcgctttctgcggtggcggcttccgctcgtttgcagaagttgccgctatcgaggatatggagcgcaacaatatcgagatcggcgcagttgctggcacatcgatgggtgcccttgtcgctgcccttgccggtgcaggcatcgactcccggcgtatggaagagctccttgtcatgatggaccagaagatcgtcgatgagggcgtcctcaagatgaaccccatcaagctcttcaatgctgtcggcacgcatggcatcatcgactctgccatcatggagcgctttgcaagaagcattctcgatgaggcgggcatctatacctttgcagacttcaagaagcccgttgccctctgtgctgtggatgtggtcacgggtgagctctgcgtcttcacgaacgaccctgaactcttccacgacgagaatggcaactggcgcatcctctccgacgagaagctcgaggtcgcaaagtgcgtgacatgctccgcttcctatccgcttgtcgtcacgcctaccgcctatcttggccgtaccttcatggatggcgggtgccgcatgaatttgccgacgccgctcttcgaccgctccatggtggacgctgtcgtcggtgtcggcatgatccgccatgcccgcccgattcctgacatgacgccgctctcgattgcaaagaagacgatgaactgcggagccaaccagcttgaccgcatctactcgcaggcagcagacatctatatcaatctgccggtttcaggagacgacgcgttccaggcaggaacaggcgagcaggtcatagcggaagcgcgccagatgatcgaggagcaccccatagactggtccgctgcccgtccatctgcgctcaccgccgtgcgacgtgctgccgtggatgcattcctgcgcatggtcagacagcacgcagtagaataggccatcccatcagcaatcatggcagaaagaaagagcctcggtcacccggggctctttcctgtctctgctgcgtgtttgctgcgaaggctacttcgtgaactcggtgccggctgcaatcgcggaatcgagctcggcatccttctcggcgaggcgctttgccttctggtccacaggcatcatcgagatgttgtcctcgtagaccttctttccggtggggtgctcttcacgccacaggcgatcggccacaggagcccatgcctttgcgtagggagcggtcctcttgcagaggtggtcgacgtcttccggcgtcacatactcggtcgactttgcgcctgactcgtgcacgatctcaggaaggatctcggggttctcgagcatcgggcacggacggagcatattgtcgttccagggccagtgagcacggtatgcctggaagaccggctgctggaggcactcgaggagcgacttgtcgtggatgttcgcattcgagtagtggatgaagacgcagggctcgacatcgccgcgagcggtgatgtggcagaagacgcggccgcccgcaatgcagccaccgacgaactcgccgtcattctggaagtccattgccatgatcggcttgccgccctcgtagtcacgcacctcgcggatgcggtgcagcatgtactcgcgctgctcgagcgtcggcatgaggtcggcattggcgccctcgcccaccggcatgtagtggaagtaccatgcccagagcgcgcccttctcgatgatgaggtcgtagtactcatcggaagtgacagactcgacgttgttccttgtgtaggccgtggagacgccgaaggcaaggccgttctcgcgcatgaggtccatggctgccatgaccttgtcgaagcagccatcgccgcggcgaccgtcgttggcatccttgaagccctcgagggagagcgagaatacgatgttgccgaggcgcttgacgtcgtcgcagaccttctgggtcacgagcgtgccgttcgtgaagaggccgaagatgcagtcattgtgcttctctgcgagctttgcgacatccttccagcggaccatcggctcgccgcctgtcatcatgaagaagtggcagccaagctcctttgcctcggagacgatcttgtccatatcgtcgaaggaaaggttcagcgacttcgagtagtcagcagcccagcaaccgacgcaatgcatgttgcaggcgctcgtcgggtcaaagatgatgatccagggcacattgcactgatacttctcggcagactgcgtcgtctcgcgcaggccgcggaatgctgcctcataggcaccattgagcgttgcggtcttgaggatgttcggatcgagacggttggcaagcccgatcaggaagttttcccacttggagcctggatagaaagccttcctgagcgaaattgccatatccggtgcggtgtcggaaagaagcttcacgcccatatcgaggaacttctcgacagcctcctcggggcggtcgctcttgacgccctttattgccgcatcgagggcaaggctgaatgccttgcgctccgctgcatgtgcgagcttggattgcatggtcacacacgtcctttcttgccaagggcaagccctctcagatgacctttctgcacgttgctataataattgaatcggagtcaaaaatccaaaaatctttgaaatctttgcgccaaatatatttcggattgcacaaatctttcggtagccgaaaacatgcgtgtttccatggaacatgacttgaatgaaagacaggaattgcttatcgaagagggtgcaatcacatgaagctctttgcctatgctctgagaccatacgatgagcttggctatatggaagactttgcgaaggagcagggattcgagtttgcctggacggacgactatcctgatgcttccaatctcgaccttgccaaaggcgctgacgcagtatccatcatcacgaatccgatgacgcccgagatccttgaccagttccatgagcttggtgtcaaggccatcgcgacccgttccatcggctacgaccacatcgatgtcgcgtatgcacacaagctcggcatgaagatcgcccatgccgcctacccgccccaaggcgtcgcgaactacgcaatcatgctcatgatgatggcagcaaggaaggtcaagttcatcgagcgcgagaaccttgtccaggacttcggcctcaagggcaagatcggcctggatatctcgtctgccacggtcggcgtcatcggcacgggacgcatcggcgctacggtcgtgaagcatctctcgtcattcggctgcaagctcttggcaaacgatccctatccgaaggatgaggcggcaaagttcgcagactatgtctcgctcgacgagctctatgcctcctctgacatcatcaccctccatgcaccgggatcagccgacaactaccatctgatcgatgctgccgccctcgcgaagatgaaggagggcgtcgtgctcgtgaatgccgcgcgcggctccctgatcgatacagatgcccttatcgcagcactcgagagcggacacgtcggtgcctgcgccctcgatacgatcgagaacgaggcagggctctactacctcgaccgttcgcgcgacatcctcccccaccgcgatcgcgccatcctcgatgccttcccgaatgcaatcgtgacgccgcacatggcgttctacacgagggaagacgtgaagaacatgatcacaagctctacgggagcccttcttgccttcagcaggggcgaagagacgccgttcgaggtgaaatagctttcaccgaactctcccatgcatgcatgaggcccggatatcgctgcagatatccgggccttgccctatgccgcagaggacaatcagagcgtgtcaagcgcaagctgcctcgctgataccttgcctgtatcgtcgtgcacgaggatgttcacatgcgtgaagtcagctgcaatggcagctgctacggcctggtcaaaggcaccgaggagccgctctttctggtgggcatcggaattgatgaagatctctcctccgaagccatggagcgcacgcaggagctcaggccgcggatagagctccttcttcctgcccctgtttacggcgccgcagttgatctcgaagggaacgccttccgatacgaggtattccatggcttcaagggccgggccaagatagcgcttcgaggtctcgtccaggaagtgcatgtcgtcgttgaagcgggtcacgaggtcgaaatgcccgacgaacgtgcacttcgtcctgtcatagaccttcgcttcgagctcgtaataggctttcgagagcgcatagaaatcgccaccgaaatgctcatcggcaagctgctgcatcatctcgggcgtattgtcgacgctcatgggacgaggcatctccacatcgaggaaatgggtggagccaatgatgtattctgcaccagggcagcaggcggggtcatagagattgtcgagctcgacgcccatgaggatatccatgcggccctggtactgctccttgagcgcagagatggccttcacatagtcgggccatgccatatggatgtcaggatccatatgtcccgagaagccgagatgcctcatgccgcgagagtaggcttcggcagctaccgcttcgggcgtatccgagccatcgcagagcgtcgtgtgggtgtggtagttcgcaagaagcatggccagcttcctctctgctagtggcgttcttcttcgtggacgctctcgtacggcacaaccttcttgaggagccctgtcctcgtctttgccatgcggttcccgaaggaaagcaggaacgcttcggggtcgtccatctgatcgaagcgtgcgccgatgaagccttcacgcgtgaagcgcaccgagaggacgtaggcatcttcaagatcgccttccctgttcctgcgctgcgtatagccggaaagcgtgatggcaggaagcgctggattgtcagcgaagatggccgcagccagatagacagcaagactctcgatgcagcgcacatagtttgcatgtgcttcagccgcggggattcggtgctctgcgagagtaccttttgcggtcaagctctcctcctcgtcggggatatcctcgatctcagggaggtccacgtcgagcatgagcgtacgtgatgctgcatcgaattcgtaggaggcagagaagaggtagggcacctgcagctgcttcaggataacggcgcaggatgcttcgacggcctcttccgcaagcggcgccgcggaatcgggtgcggcgaccgaaggcgccttcctgtggagctcgagatagggcgagaggatctcctgaagcggttgcggctcttcctgtacggctggggcctccttctctctggaagaaagcttcttctctgccctcccttcgacttcgggctgctccttctccttgctcgctgccccttctatcttcttcacgacgtccttgaagttcacgccgacgcctttgtcggagagcttcgtgcgtgacgagaggcctgtgccaggcagtccagcgttgagataggtgcccttctgtccagtgctgaccgagaggcccttcatgccaggcacatgggccgagaacgagagtcccgatttcgagatattgatgcggaatgccggaccgagcttgatgctcttgcggaaacgtatggacatggccttcctcctcaaataggagacctaggaattgcctgcctctatcctatccgagatgcgggattctgcacgcatggaaaggccctccggctgcttgagaccggagggccacagaatcatatgcagatgcctgtcagacagcctggatatcccggatcatcacatcgcggccgctcacgaggtaggtatggtagccgccgcagtagggacatgccttgccatattctgtcgtgcggtaggtcttcctgcagtcctggcagtacgactttccttcgacgacgatgaggttgagctcgcactcctgcatatagcgggtcttcttgatggcccgctggtagcagtcgcggaaatagtcgggaacgatcgtcgagacctcccccacctcgaggtcgagcttcatgaccttgtgcacatggttctcctcggccgccttctcgaccatatcgatcacatggacgacgatgccgagctcatgcatgggcggattccttcctggaaggtgcgcctggattgcagatgtccaggcgcaccgagattcttgctagtgctttttctcttcgaccgcattgccggtgttcggatgggctgcctgccaatccttgccatgcgtgcgctcgtactccttgcgctttgcgcgcatgatcttcgcttcctcggagcccgagtttgcgacgatcttgaccatgcgcttcagctggtaggcagcaaggcctccgaccttgtcctctgccttcctcatcgtgctcatctcaggatggtcgcgatagaggtggatggcatcgaactggcagcgcgtcgtgcagatgccgcagccgatgcacttgttcggatcgacgaccgaggcgccgcagccaaggcagcgagagcactcgcgctcgacctgctcaggcgtgagcgtgccggagacatcgcggaagcggtctttgccctccggctttgcgaccggctcctggcgctggtaggtgtcataggagccgaaggagaggtcgtccttatcgaagggctggtagtcgtgcctgtccctgcctattgtcatcgatgcattctcatgcacgaagcggtggagcgactctgcagcatggtgtccttcggcgattgcgtcgatcacgaacttcgggcccgtgtagacgtcgccgccgacgaagatcgaaggctcagccgtctggaacgtgagctcgtcagcaatcggatagttgccgtggtggaactcgaccttcgtgccatcaagcagcttgccccaatcgatggcctggccgatagcaaagacgatcttgtcgcactcgattgtgcgtgtctcggactcgtcgtagagcggcgagaagcggtgggtctcaggatcgatcgtgcgcgtgcacttcttgaggacgatgcccgcgacatgccctgctgcatcgacgaggacctccttgggtccccagccgcactcgactaagacatgatcggcaagcgtctcctggatctcatcctcggaggcaggcatctcatccctggcctcgagcgagaccatatggacctcgtcggcgccacggcgtgcagcattcctcgcgcagtcgacagcgacattgccgccgccgatcacgacaaccttgcccgacattgccgggttgccctcagccatggactcctgcagataatggacagcgatatcggtgccttctgcggtatcgtttgcgacacccgggcgacgtccgccctggcagccgattgcgatatagaaggcctgatagccctgcttcttgaggtcttcaagggtgatgtccttgccgatctcgacgccgcagcggatctcgacgccctgatccttgatgaggtcgatctccttctggatgacatccttctcgagcttgtaggtcgggatgccgtactgcatcatgccgccaggaagctcatgcttctcgaagacggtcggcttatagccaaggagggccaggtaataggcacaggtcaggcctgcagggccggcaccgatgattgcgattttctcgtcgaagtgtccctcgacggaaggcacggccttttttgcagcaaactgcttctcctgggcaaggtcgaagtcggccacgaacttcttgacctcgtcgatggagaccggcgcatcgatcgtgccccttgtgcaggcatcctcgcagcgcttgttgcagatcctgccgcagacggccgggaaggggttctgcgtcttgatgaggccgactgcttcctggtatttgccctcgcgcgccttcctgagataggcctggacaggcacgtgtgccgggcaggccgccttgcagggagaggagcccgtcggccacgtattgtgcatgcgggccgtatcgcggtagttctcgtcccaggcatacttgccccagtggatggcatcaggcaggatggacttcggacacttcgggagcgtgccatccttcttgcagatcttctggccgagcttcacggctcctgccgggcaggactcgacacagaggccgcaggcaacgcagttctccggcgtgacctttgccgtataggcggagcgggacaggttcggcgtattgaagagcatgctcgtgcgcagggcattgcagatcttcacatcgcagttgcagatgtcgaagatcttcgtttcgccgtcgatgttcgtgatctggtggacgaagccgttgtcctctgccttctggatgatctcgagcgcctcatcggacgtgatgtagtgggcacggtgcgtctcgaccgtgtagtcagccatatcgccgacctggatgcaccagtcttcggggtcgtcagcgcagccctcgccgagcttcgtgcgcgagtagcggcaggagcacatgccggcagagatatgtccctcatacttcttgagccagtaggagatgcgctccttgtcgatggcctcgttctggaagttcacagcctcctcgacggggatgacatgcatgccgatgccgtctcctccaggagggaccatctcggtgatgccagccagaggcacgaacgtcatgcgctcgaagaatgaagcgacggcagggttcttgtcgatgcggtccttcgtcgaattgaagagctcggcagagcctggcacgaagtacggaagcctccagcgcttcgtgtgcggtgcatccttgatggggccgttgtcgtagtggtcgccgtagtcatactcgaggatgccgatgacggacatgtcgtccaggagcttctgcagatggaccggctccatgtccggttcgagcttcatgaggtcctcgaactcgtagaacttcctgaccttcatcttgttgccgagctcgaccatctcgtcggtcaggacctccttgaggccccagtactcggcatcattggtggagacgccggtgatcttgtgcttcacgacgtccgtgatcttgcggccgagcttggccacggccgcattgcgctccgcctcgttctggtagatggagcgaggggattcgaactgttcagacatgccttaggccctccatgtttcgtaggcgcgctcgatccaggcagcaagctcatctgtgccgtctcctgtcttggcggagatctggatgaggtcgcagctgtcgttccggtccctcagatacttcttgaacgtatcgaggtcgaagtcgaagtacggcaggacgtcgcacttgttgaggatcacgacgtctgccttctcgaacatgagcgggtacttgagcggcttgtcgtctccctcaggaacagaaaggatcacggcgttgatggctgcaccggtatcgaactctgccgggcagacgaggttgcccacgttctcgaggaagacgatgtcagaaggcgtgtccccgagagaatcgattccctgctcagtcatgccggcatcgaggtggcacatgccgcccgtgtggagctgcacggcatgggcacctgtctcttcctggatctcgtcggcgtcgatggcaccgtcgatgtctgcttccatgacggaaacggagtggttctgggcgagcttcgggatgagggccttgagcgtcgaagtctttccggcaccaggcgagctcatcatattgatgaggaaggtgcccctcttcttgaggctctggcggagcttctctgcctcggcatcattgtcggcaaagacgctctccttgagctcgatgatcttgatttcttccatgtgacccaagccttgtcgaatcagtgaagaagcggcgcacgaggtccttggagtactcgaccgtctcctccatgtcgccgaatgccatgacctcgccagcgaagtaggtattcttctcgccctggagcgcctcgaccttgtcgtaccagccgtcagcatagtccttgcaggacacgtgcgggaagtagtaccagtcatcgatgcgctcggtcttgacgacaggaaggcccgactttgccatgtcggcaagcgtcgtgtcgctggcctcttcgaacggcacgtgcttcatgccctcatggttcctgagcgtgaaggtgacgagcggctgggggccgcagtccggccagcggtgatagaagaccatgagatgtccgcgggtctcgggcgtcatgttcgcgaaatagtagtaggagatgtcaggcgacttctcgtcttctgtcctcactgtcatcgtgaagtattccttgttctggatcttggagaagagctcggtctcttctgcggtcgggtcgccgtagccgaggaacatctcgagcggcgtgcagatgatgagcttgtcgaagacttcctcctgcttgccgttcagcgtgaccgtgaccttgccgtcctcgcgcttgatgccggtgacctcggtattgaggactgccggatgctcgagatggctgttcacgccctgccagatggactcggtgccgttcttccaggtccagagcctgccggtggacaggaactgcttcaccgtgaaggcatcgaggtacttgagcacataggctgcagggatctcgtcgaagtagccatagccgaaggacgtgaaggggcccttccagacgagctctgcatcctcgcagtggttgagcttcaggaactccgagaacggcatcgagaggtccttgaggttcgggttctctccctcgatgtgggcaagcttgagctcgggcgaagggcagaggccctcatagcggccctgggcgactccacggtgtccgttcacgtcgtagcccttgtacttcgtggcaaggagcttcgagagcttgcgcatcttcatgaccttcttgagaagagcaagcttcgactgcttgatcggggtgccatcggtattcgtgaagcggcgtcccatggccgggccatcggcatgcgtggctccgccgaactcctcgcactcatgcacggcgaagtaggtatcgcagcccatgacagcacccatctcgatgatgcgctgctccttcttgccgtcctttgtcgtgacttccatcttcggcgagaatgccttgccgccgacacgtcccgatttctcatagatcgtgtagttgtggaaaccctgcttctgcagatacattgccatcgatgttcctgcgggaccgccacctacgatgcagatacgctgattcttgtccatacagaccatctcacgtctgttgctttcccaacacagcaacttcagtattgtacaaaagaagtacacaacttgaacaaatatcttcagcatttttgtaaggtatctgaaaattggcacctaattgagtcatggaattgcaaaaagggagcctgctgatgcagactccccagttcgtgatttcctgttcaggacttacgcaagctctgccattgcttcatttgccgtgacaggcttcgtgccgaagcacttctgcatatgctcgagcgccccttcctgcgtcccggcaaggaaggtcctcgttgcgtcggtgacgacctccgtcgcatagcccaggttccaggcgtcggcaagcgtgtggaggacgcagatgttcgtgtcctcgccgacggcaatgagcttggtgactccgagctccctgagcgtcaggtcgaggtcggttccgaagaatcccgaatagcgcctcttggggacgatgaagtcaagtgcgccagatcctgccttgagctctggattcggacgtgcatcgccctttatgccatggtctccccagagctcgagctccttgtccacgcccttgatatgctggtcgcagaggaagatgacaggaagctctgctgcacgtgcagcatcgacgaccgcagcggccttccttacgagagccgcttctgcggggtcctgcttgtagagcgtatcgtctgctccggaaacgaggacatcgatcacgaggaccgcagtatctttcttcatggctatcactccttagtatccgttgtgcctgatatgcgtgcgagaacaactacgggaatatctccgacggcaaagccggtcgagctcatgcgtgccacgtaggtgccaagctcatctgtgatcctggcagaatagaaggcaaggtggcgcccgtcacgctccgctctggcttctgcgatgaggcgggtgcccttcacggtcgtcaggaaatcgatcgagcagctcactgccacatgggccgtgcccgtggcattcgaggcgacggctatcgcgaagtcgccgagcgtgaagatggcaccgcccattacttcgttcctctggttcctgtggtgtctctcgatttcgaagctcacgcgggcatatccaggacgtgcctcttcgatcctgcagccgcaggtatcgcacgcgaaatggtcctcggcaaagagcctcttgagctcctctgtgccaagctctgccacgctgcctccctccatcggcgtttatgtttccagaatggcagcatatagccgcttatggaagaggcgcaacgaacaagaaacggaaatggcctttgtcagatggggcgtggcgcctgcttgaggtattgccgtgcgtgctgccagtcaggataggcgcgggtgagctcccgatagaatgcagcgctgtggttgggaacgatcagatggcatgcttcgtggcaggccacagcttcggcacagtatatgggataagcggagagtgccgaggcgagcctgatctggcatgtgccggtcgagcaggagccccaccgcgtcttcatgtcccgtacaagccagccggaagctgctgctccgacgcgtacttcggcctgctctgccagctcgggaagccgcgtctcgagtgcaagcttgcgcacctcacggatggcatcatgccgaatctggcacccctcatcgctgtcttcgagcgccgtgcggccgagtctgagcgtcacggtcttcttatccagatcgaaggagacggattgcctgcttgattggacttcctcgagcattacggtgcagggctcgccccagagcatcgtgtgggagccggaaaggtagcgctcggcggatatggcagagatccttctcctggatgccgccatcttctcctctatccatgcctggcgctcatccaggaaggactgggcaaaagcacgggagcagcgaagcgggatcgacatgacacagcgtccctcacgggttacacgcagattgagattcctgacatggcgcttcgtgacctccacgggggtgtcacctgcatagaggatgaaggagacgccttcctgcgaaggcatcctaatgggcacctgcgtgtgcaaggcctgcgaggagcgctgcacaggcgatgacagcggctatgaagggtacgctcagaagagccagcacgatgcaggcaagtatgagccagccgagtgccttgaaggcgaaggcaaaggtccaccaggcgagcttgaagaagaaggcgatgatgcagccgacgagccagagcccgaagaccgtagagaacaatgcaatgaacacggaaggttccttccaatacgtttgacgaatgaattgtacccgagagcggcttcggctatcggatgtcccgtaccgtggagcgctcgatgagagtgccgggaatgcggatgtcttggacctcgtagcccggctcccctgccttgagcgcttcctcgaaggcgcgggtgccgcgctggaacatatcgaagcgcaccgtcgtaaggcggtttctgggtacggtgccgccaagggaatcatcgacgcccacgacgctcacgtcttccggcacctgccttccggcatcctcgagcgcggcaatgacgcccaaggccatctggtcgtttgctgcatagacggcggtcattgacgcgtctgtcgcaagcgcggcacctgcttcgtagccgctgtctgcggtccagtcaccggccaggggctctactgcttcaatcccctgctcttccagcgcatctcgccagcccttttcgcggaatgtggagtcgaccgaatatgaggggccggcaacgaagcggatctctctgtgtccatgggaaaggagatgatccatagcaaggcgggagcagccatactggtcggaatcgattgtcgtgcagccggggtgcggatacatggtcagaagcacgcagcccaagccctgcgcgggacggaagacatcgaagtcctctgccttgatgctcatgctgacgatcatcgcatcgacaggaagggcaagcatgcgcctcgttgtcgcttcgagcgagacagggctgtcatcacgctcctcttccatcgttatggcatacccatgctcacgtgcagcagtggcgatgccgtcaagcgtcgagagattgccgtactgcgtgatgttgtagatcgtgaggcctaccgaatgatagcggccgctcctgagcgagcgtccggcaaagttggggcggaacccgagctcctccatcgcacgtgttacagcgaggcgtgtcttctcgctcacattgggctgccggttcacgacacgggagacagtctgctgggatacgccggcggcacgagcgacatccgctgccgacaccggacggtgcatctgctctctcttcgtcacacgaatccctcctgccgctcccgtgccatttggctccattggcgaaaacagtagcacagagcccataatctcgctgcaattgagcaatgcgtacgttaacattgtagcggaagcagggaggatgcatatggtcgagagctcgatgtttggcatgctgccagatggcagctgcgctatgaaatatacgattccagcaggcaacgctgccctgaccgtcaccgatttcggcgcaacggtgctgggcctttccgttccagacagggacgggaacgtggatgatatcgtgctcggcttctccgggcttgaaggctacctcgacaaccccgcctgctacggtgcgacgatcggacctgtcgcgaacaggacccgcggcgccgaactcacgattggctcgcagccctatacactcgagaggaatgatgggcctgacagcgcaaacaacctccactcgagcctgacgaaaggcctccacaagaggctctgggaacgcatcgaagacgagtcggatgattctctgacgcttgcctgcaatctggcagacggagagcttggccttccaggcaaccgccgcttcaccgcagcattctctctggcagaagagcaggatggctatagagtcgacatacgctaccggtgcgagagcgacaaagagacgttcgtgaacatgacgaaccacacgtatttcaatctcgcgagccatgcctcaggttctgccctcgatacggttgtcgcaatcgatgcagacagcttcctgccgatagcggacgaccatgtgccggatggacgcatcctgcccgtggcaggcactcctttcgacttcaggactcccaaggcattgggccaagatctcggtcaggcatcggtccagctcgagcggggacatggcatcgaccactgcttctgcgcaaggggctgggagcctgatggcaagctcaggcatgccctttcagctcatgattcgaagtccggacgtatgctcgacatctctgtgacgactcccggcatccagctctatcccggaaactggctcgatgatccagaggggaaagacgggacgaactacgtggcaggcgcaggctttgcggccgaggctgagtacttccccgattgcgcacatcacccgtcgtggcctcagcctgtctgcacgccagagaggccatacgagataggcatttcctggatgcttggcacgtatgcgcagcgataggctgccgaatgttggacagataagacaaggagagaacgagatggaatcctcaaagatgacggaaggacagatacgggcgcacgaagtcttcgacgaagcattcggcgagccagaaaagggagccaagctgcttcaggtgcatgcaccaggacgctccgagatcgccggcaaccacaccgatcatgagggtggccatgtcattgcgggtgccctcgatgtcgcaatcgacgccgtagccagaaagacagaaggcacacagatccgccttgcaagcgatggctaccctctcgtcacagtcgatgcctccgacctctcgatccgcgaagacgagaagaatacgacagctgcgcttgtgcgtggcatggcggcatccatggctgaggatggcagggtgccctccggcttcgatatcgcccttacgagcacgattcccgtgggtggcggggtttcctcctccgctgccatcgaagcggcgctcggccgtgccatggaggcgctttgggacggaaagagctacgatgcgctcgagcttgcccgcatgtgccagaaagtcgagaacgtctatttcggcaagccctgcggactcatggaccaggcttcggtctgcctcggcggccttgccttcatcgatttcttcgataaggagaatcccaaggcagagaagctcgtctatgacttcgaggatgcaggatacgccttgatcttggcaaaggtcggagcgagccacgaggacctgaccgacgcctatgccgccatccccgaagatatgcaggaagtggcccgcaccttcggcaaggtccgtctcgccgatgtggacgagaagaagttccttgatgcggtgccggagctcaggaaaaagctcggcgacaggccggtgctccgtgccctccattactggaacgaggaccggctcgttcagaagaggtggcaggcactccaggaaggcaatatcgaagagttcctggcactcacgcgcgcgtcgggcaagagctctgccatgtatctccagaatgtgacgacaggcaatgccgagcagccggcaatggttgcgcttgcacttgccgagcgccttctagaaggcaaaggcgcttgccggatccacggcggcggcttcggcggcacgatccagtgcttcgtcccgcttgcagaagcaggccagttccaggagaggatggacgcctggctcggcaaggatgccacgcgccgctatcacattgcagaaaggggtgcttttgcatcatgggagtagctgaagacattgcagcagagatcgaagccatctgcgactatgcagccgtgcacggcctgctagcctgggaagaccgcatctgggcctacaacagcgtgctttctgccataggacacaccggccctggacctcaagatgcatggacactggccgagaatgcagaagatcctgctgtctcccctgctgcgtcatctgacgtccccgacaagctcctggcagatcttgccgagcatgcgattgctgccggcaaggaggagaatactgcctcgggacgcgaccgcatcgcaatggagatcatggggctcctcatgccaaggccgtctgagatagcaaagaagttcgctgatccgagaagcaccaagggcgcccaggccgcaacagactggttctacagcctctgctgcgatgccggctatgtgcgcaggtcagccattgccagaaacatctgctggacatatgagagcgaattcggtcctctcgagatcacgatcaatctctcgaagccggaaaaggaccccagagagattgcagcagccggcaaggcgcctgcaggcgagaaatatcctgcctgccagctctgcatcgagaacgaaggatatgcgggccgtcctgcgtccgatgccttcggcgcccatccagcgcgccagaatctccgcatcatcccgatcgagctcgggcacgagcggtggggctttcagtactccccttatgcctacttcaacgagcactgcatcgctatgagcgcgcaccaccgaccgatgcatgtggacagggcgtcgctttcctgcctgctcgatttcgtggacctcttcccccactacttcatcggctcgaatgccgacctgcctatcgtcggaggctctatcctctcgcatgaccactaccagggcggcaggcatgaattcgcaatgatgaaggcagagacggcagagacattcgaggtcccaggatatcccgacatcaagggcgaagtcctcaagtggccgctctcggtcctgaggctcacttctcagaaccggggccagatcctcgatgcagcagagcacatcatcacatgctggagagcctggagcgaccccgatctcggcatcatcgcccacgacgagaatggcgcccacaatacggtcacgcctatcgtcaggaagcatgacggcacctatgaggcctacctcgctctcaggtgcaatatcacttcgaaggaccatccgctcggcgtcttccatccgcatgagcagtggcaccatatcaagcgcgagaacatcggcctcatcgaggtcatgggtctggccatccttcctccccgcctcgtgcccgagctcaagcgcactgaggagctcctcctgaagggtgcctccctcgaagagctcaggcaggacgagctcgcttccgcccatgccgtctgggcaaaagggcttgcgcaggcgcatccggagcttgcggaagacaacatccaggccatcgtgaaagatgctgtcggcgaagtcttctcgcatgtgctcgaggatgccggcgtcttcaaatgggatgaagccgggcgcgaggggcagatgcgcttcatagcgtcgctgtagcagctgtgcaactgcatgcaggaactgccggcatagggcacgcagatcgaacacatgctccggcggggcattcctgcatgcgatgccgcgtcattgacggaaagctttgcaggacatgtcctgcagcgaaaggatcatggcctgggtgttcgtgcagcccttccctaccgttcctggacttccttgccgctcatatgctcgatatcgatcacgaacatctgcacagcgcgccccgagcgcacgatctcttcttccaccagagcaggatcgggatagtatttcattgcgaactgtctcacgtacctgatgttctcttcagggctgtctatcagatggcatcttccgaagatgaccgtgctctgcatatatggtgcccatggctcgtccttgatcgtttcgttgccaaagaccgtgaagcataccttgtcgctcctcttcagggaatcgaccttatgccctgcctttgcgccatgaaagatgatctgattgcgctctccgtcataaaggaagttgatcggaatggcatagggatatccgtcgtcaccattcacagccagaactccccgtctggaacgagccagcagatcctttgcagcatcgatgccgatctcgtttctcttcttccttatctttcgaaactccatagcccgcattccttatcgcttgcccgtcccgctgcttggttcaatgcatccagaagacgcttggcgggaccgcttctgcgtctccgtccttccagaacggatatggcgaaagtccctgttcagagtcatcagtcgcgcctttatcatactggtatctgcagcttgccagaagaacagggtctccaatgcctggaatcgcctggctcttggaagctcgcccgggtctcgctctgccatggaagggccatcggggcatcctgccgccatccttcttgccaagcacccagagaaatggtgcggcttgatcgaagctccagcaattgacatgctcggctgctgcatggctggtctcgtatctaggcagctcatgaaagccacgcatcctgggtgcatgggcgggcggtctggatctgctgttccgtcatgcttcttgttgcatccgttgcggcagcggctgccaggcgatcagcgcaagaccattcatgcagccaagcgccacgacgaccgcaagcagtatcagctttccgagcggggcattgcgggtgcgtgctatccaggcaacaaggacaaagatggatgggctcacaccaagcactgcaggcacgctgagcgcgagctgggaatcacgatcttcaagcgcacgagccgcggcgtcagccccaccgacgagggcctcgaggcaatgagctgcgcgcgccagaccgtcgatcaggcagatctcatgctgtcacgcttcaccgagggcggcgaatccgaaatgcgctttgcggtatcgtctcagcactacgaagtcgtcgtcgaagccttcggcgtcctgctcgatgcccacgctgaacgtgcctgccatctcaccctgagcgagacgagcaccatcaaggtgatccaggatttccatgaccacaggagctcggtgggcatcatctacctgaacgactacaacaggcatgtcgcagggcactccatcgaatcgaatggccttgaattcaggctgctgttcatcgcgtgtccgcacatgttcttccgcgccggcagcaatctcgcgcagaaggaaagcatcaggcccgaagagctggcaggcgtgacgcgcttcgcccatctgagggcacggaagggtcggcctatttcgcagaggagccgcctgccgacctttcctgccacagccatgtcgcgctcagcgacaacggatttctggcgcgcctcttgtcggagcatgatggctacaacaccgcaatgggggtctatccatctgaccgtggcatcattccggtgccgctcgagaccgatgagatcatgaatgtcggctatctcgtgcgccaggatgctgcggccgatgcgataaagctgactgctcagttccttatccatgcggttaaatgctcgttatcagttgcagctcttcctccacctgtgccctctcatgaaactagcatctgttcatgtatcaatcctgcgccgccaatggagccggcagggcttgcggagagagcccgtctgcacttcgggcggcacgctcacaatgaggaggctgtcagcatggccagaaatatcacgcgtcgcagcgcacttgcaatgttcggaggtgctgcagcatttatggccacaggcggccttgctgcatgctccggcacaagcggcgaaaagaagttcaagatcggtgtcctgcagctcaccgagcatgaagcgctcgaccaggcaaacaagggattcgtccaggcgctcgacgattcgggcatctcttatacgatcgaccagcagaatgcgcagaatgaccagtctgcctgccagaccatcgctcagaagctcgtgaacgacggcgacgacctgattcttgccatcgccacccctgctgcccaggcagtggcaggtgccacgaccgagattcccatcgtcggcactgccatcaccgactttgccgcatccggcctcgtcgcctcgaacgatgctcctggtggcaacgtcacgggcacctccgacctcacgccggtcgacgaccagttcgatctgcttgtccagctccttcccaatgccaggaaggtcggcatcctctactgcacggccgaatccaactccgatgtccaggtgcagatggcagaggaggctgcagccaagcgcagcctcgaggtcacgcgctactcggtctcgagctcgaacgagatccagcaggtcgtcgagtccatggtcggcaaggtcgatgcctgctacgctccgacggacaacacaatcgctgccggaatgacgacagtcgctatggtcgccaatgagaacaagcttcctgtcatctgcggagagaagggcatggtcgacaatggcggccttgccacctacggcattgactacaacaagcttggctacaaggcgggcgagatggctgtgaagatcctgaagggcgagtcgaaacctgccgacatgccgatcgagaccctcgatgccagcgagtgcacgctctcgacgaacgaagagaccgcgaaggcgataggcgtcgacctctctgtcatccagtaagaggacagagctctggcaggaccttcctgccgtccagtatcgctgctctattctgtgcccggcccattttcgccgggcatgcttttggaaaaggaggaaatctcaatgcttctcgctcttaccggggccgtctaccagggaattctctggggcatcatggtcctgggcgtcttcatcacctacaagatgctcgatatcgccgacctgaccgtcgacggcagctttgccttgggcggctgcgtcgccgcgaccgcatcggtcacgcttggcctcgatccgtttctcgccattcttcttggcacccttgccggtatcattgcaggcgctgtcaccggcctgctccatacggtcttcgatatccctgcaatccttgcaggaatccttactcagattgccctctggtccatcaacctgcgcatcatgggcaagtccaatgttcctctcctgaatgtcgacaccgtcttcacccgtcttgcttcgcttctgggtgtctcccagagcgtcgcatccttcatcatcggcatcctggtcgccgtgctctgcatcgtgcttctgtactggttcttcggcaccgagattggctctgccctacgcgccacaggccagaatgagcatatgtgccgcgctctcggcatcgatgtgcgtgtgacgaagcttcttgccctcatgatctcgaacggccttgtcggtctttctggcgctcttgtctgccagagccagaagtacgctgacatcaacatgggcactggtgccatcgttatcggccttgctgccatcgtgatcggcgaggtgctcggccgtctcaccccgggcaagctccaagccttcggcagccgcctcacttccgcggtcgtcggctctgtcgtctacttcctgatccgagccatcgtcctccagatgggcatggacgcaaacgatatgaagctcttctctgccatcatcgtcgcccttgcccttgtcattcccgtcatcctggagcgcaggcagcagcgtctctcctactcgaagggaggcgagcgctgatgctcaagctcacgaatgtcacaaagaccttcaacaagggcacggtgaacgagaagccggctctgcgcggcgtgaacctcgatcttgcagacggcgatttcgtcacggtcatcggcggcaatggcgccggcaaatcgacgctcctgaacatcgtcgcaggcgtcttcccgcctgatggcggcacgatcgagctcgatggacaggatatctcgcgcctgcccgaatacaagcgtgcagccgatctgggacgcgtcttccaggaccccatgcgcggcacagcagctgacatgcagatcgacgagaatcttgcccttgccgcacgcaggggccagcaccgcggccttgcctggggcatcggcaagtccgagcgcgaaagctatgtcgaccgcctgaaggaactcgacctcggccttgagacgcgcatgacctcgaaggtgggactgctttctggcggccagcgccaggcgctgacgcttctcatggcagtcctcaagaagccgaagctgctcctgctcgacgagcatacggcagccctcgacccgaagacggctgccaaggtcctctcgctcacgcagaagcttgtcgacgagaacggccttacgaccctcatggtgacacacaacatgcacgacgccatcaggctcggcaaccgtctcatcatgatgcatgaaggccaggtcatctacgatgtacgcggcgaagagaaggcaaagctcaaggtcgcagaccttctgacgaagttcgaggaggtctcgggcggcgagcttgccaacgaccgcatgctcctgtcgtaatcgtttcctttcactgattgcaatagagagcctctcccattccatcagagaacgggagaggctctttcattcatgatgcaatggggattatcgctctcactacgggatggaatctctgcactggattactgtccccgctcttcctgctttgcctgcctccagagctggtcgaactcctcatcggagcatgcatccagaggctttcctgaagcctcgacagcacgctccatagaagcccagcggctgcggaacttgcggttcgcgaaggccagtgccgcttctgcgtcgatatgctccttgcgtgcgacattgacaagcgagaagaggacatcgccaaactcttcgaaggcgcgctcggagccagagggctcagcttcgaactcccccacttcctcattgaccttgtcccagacatcatctgtggtcttccagtcaaagcccatcttggcagcacgcttcgatatcttctgggcctgcatgagggcaggaagcgatatgggcacagaatcaagaagtccaggctcctcgccggtggcctcgcccttcgcttcgcgctcttcacgttttgccttgtcccagatgtccggcacctcttgagtgccttctgctgagacgcggggcacgtctccttcaggcgttccgaatacatgcggatgcctgcggatgagcttccgattcagatccccacagacgtcgtggatatcgaaggagccttcatcggccgcaatctgcgcatggagcagcacctgcagaagcacatcgccgagctcctcgcgcatatgcgcatcatcgtgcgcctggaaggtgtccactgcctcataggcttcctcgatcatgttccttgctatgctctcatgcgtctgcacccggtcccagaggcagccatcggcctgtctcaggcgccagaccgtgcgcgcaagctcttcgaactcgggctggctttctggagatccttctcggctgcgggtgtctgcgtccacctcgtcgcagagcctgccaagcttgtcttcacccttggtcgctctgccagcctgggccgcagcagagacatcaagctttgcgtcttcgcccatgaggccatcctccctctcgtctgttccgcaccatgataagtccagatgcactcttgagtcaggcccaaagcggatggtggcagcaagctgctcagatgcatattgctgtctgttggcgcaagaaggctatatcggcacctcctctgatgctggcatagaatcagagcatcagatatgacgcatagcgagctgggagaaggatatggcagcagctagcatccgcatcttcgatcttcattgcgatacgttggacagtctttctatgcacgacgtggagcccttttcacgctctgcctcgaatgcacgagagggagacgacctcgcgcataacagcctgcagctttcgctcgggcgtatggcgcaggcaggaagctggtgccagtgctttgcggtccgggtgccagatgacctctcaaagacaggactcaagccgcatgagttctaccgaaaggtcgcatcctatttcagggaacagctcgaggagcacagaccagaggtctgccaggtattggatggcaggaaggtggaggacgccttctcggatggacgtattgccgcaatgctcacggtcgagaatgcctctcctctcgagaatggcctctccatcctggatgagatgcgctctgacggcgtcaagatgatcaccctgacctggaacgggcagaactgcatcggctcaggcaacgacacgcgagaaggcctctcctccttcggcatcaaggccttgaagcgcatggaggagctccatatcgtggcagatgtctcgcacctgaacgatgccggcttcagggatgtcctgtcccatgccacccgtccattcgtggcgacgcattccaacagccgctctgtctgtgctcatccccgcaacctcacggactacgagttcgaggctatcagggaccgcggtggccttgtcggcatcaactactgccgctccttcatcgccgatcgcttcaaccagggaagcggcaaagactcaggccagcctgacgtcaccttcgatgagatgagctatcacattgaccacttcctcgagctcggaggcgagcacatcatcgctctgggcagcgacttcgatggatccacgacgccgtcctggctctcaggtgcacaggacatgccagccttccatgctctggttgccagacgcttcggagaggacatcgcagaggccatgttcttccagaacgccgcgtcgttctttgcgcgcaacgaagaggattaggaaaagagaggatgcagctctctgcatgagctgcatcctcctatctgtacgatgaattgcttgcctagatcacgtggcacttcttccaggcactgcgcctgaagcgcacccagaagatgataccgcgcacggtccagtcgatgcccatagcaagggcaatgcctatgacgcccatgttgaagcagatgccgagaatgatcgagaacagaaggcgcacgacgatggtcgtgaagagcgagacagctgtcgtgaagaatacatctcccgtcgcacggagtcccttgcccagaggatctgcgaacgtgaaggcaagcgcattgaagacattgtggatgaggacaagctggatcgtgagccgctttgtctcctcgctcagggcatagagccccacaagcggcggcgtgaccgcaaaaatcaggatgttccagccaatcgagaaggcaagcgtgatcttcgtgagcttcttgaagtagaactctgcctgttcgatgtcgcacgctcccatgcactgtccgatgaccgtgatgtatgccggtcccatcgagaccgagacaagtgctgccatggtccagatgctctgcgccactccgtttgcggcaatctgataggttccgaagagcgcggcgatgctcgaaagtgcaaccttcacgagctggaagaggccgctctcgatgccattcggaacggcaatgcgcaggatcttcttctggagttccccatcgatcttgaagatccaggagcgcacatactgcaccggattattctcggagaagcagaacatagtgatgaggacggcagagagcgtgcgggagatgagcgagggccaggcgacaccttcgacaccggcatgcagcaggaagacaccgatgcagttgccgacgacattcacgatgttggaaacgatcgagatatacatcgtcgtgctcgccttgccgaagctgcgatagagtgcggcccctgcattgtagatggcaagcatcggataggaataggctgagatgcacaggtagttgacactccccacggctgaagccgggggattctcgcttcgacgcagatagccttcctccgccttgcggcggaagccggtcttacgcctgctccacgagcgttcgggacgctttcgcgtccccggttcccgcaagccctgcggtaccgtctgcttcattcagaagccgcgctccttcccgcgcgatgttcagggccgcattgagatcgcggtcgtggcggcacccgcatacggggcaggtccatgcacggacggagagcggcagctcatcgagcacatgcccacaggtggagcacgtcttgcttgatgggtagaacctgcccacctttacaaagccacggccatgccaggcgcacttgtattccagctggcgggccatctctgacagggaggcgtctgagacggattttgccagatggcggttcttctccatccctctgacgttcaggtcctcgacggcgaccgcttggctctcgcggacgatcgaggttgttgccttgtggatggcgtccttcctctggttggctatccgctcatggatgcgggctaccttcctcttctgcttctcccttctcttggaccccttctgcttgcgggacaggcgcctctgctcccgggcgagcttcctctcgcctttggcaagcgccttggggtttgcaatcttgatgccat

SEQ ID NO: 43 - DNA, 89073 bp, Unknown
  Metagenome-assembled genome
gggcatcggaaggatgaggttcatgatgatgccgacaagatgttgccatgcccggcagggcatagtcgccgatagggatggagatgccggaggtctccatgccgacacccaggatcacgacgaccgaggcgatcatgaggttgcggttgaggccgaagtcgaccttgttcgtcacgtacatacgaaggccgttcgaggcgatgaggccgaagagcagaaggctcacgccgcccatgacaggcgaggggatggagcggatgacggcggcaagcttcgggcagaggccgccgatgatgagagcaaagcctgccgcataccagaagacctgggtcgagtagacgcgggtcacggacatgacgccgatgttctcggcataggtcgtggtcggaggaccgccgaggaagccggagatcacggtcgagatgccgtcaccggcaagggagcgcggaagcatcggacggtagtccttgccgacaatctcgccgacagcaagaaggtgaccgatgtgctcgattacgacgacgagggcaacagggccgatgagggcgacagcgccccagtcccagacgggatgatgcaaggtcggaaggcccacccaggcagcttccaggacaggctggaaatcgaccatgccgagcatgagggcaatgacatagccgacgatgatagcgagaaggacgggaatcgtgccgatgaggccgcccatgctcgagaagatgacggctgcgaagagcgtgatggcggcgacgatggcaccttcctgatagaagattgtagagccgtcggcggcagtcgtctggaatgccatcttcgctgctgtcgcagagaggccgacgccgatgacgaccatgacagaggcaacgaggacaggagggagcagacggtcaagccagccggtgccgacaagcttgatgatgcctgcaacgagcaggaagacgcagcctgcaacgactacgccggaaagcgctgcatcgaggcccttgcttgcaccgatgatcacgatcgggctgatgaaggcaaaggagctgccgaggtagctcggaatcttgttgcgggtcacgagcaggtagcagatcgtgccgatgccggagcacatgattgcgaggttcggatccaggccggtgagcaccggaacgagcaccgtggagccgaacatgctcatcatgtgctggatgccgagggggattgcacggctgacggacacgcggtcgtctacgccgatgatctccctttcatggtgtgccatgagtctcctttcgaggggagggaatacggtccctaccactatagggagcaagaagacagaatgcaggcaaagtgtcgcgctttttaccaaggaaggacaaagaaggacatgccgcttgccgaaggcgagcggaaattccggtgatgttcccagaagtagagcaattcctgtcagatgccgtatcagcgcttattgcgtggcttgtctgattgctgcgagttcttcgcttatcgatgcaaggctctgatctgctgctagatggccttccgtggtagcttgcaaaatgcatcagcagtgtccggatgcgggtggcgcttcaagagattggagcaaagcctatggacctagtccttgaaatcctgcaagccctcgcgctctctgcggggatcctcaagaccgtcctcgagatcgtggaggaggtggagaggatcagaagggaacataaagcatcataaggatgacgtacggagatgaatagagcccggaaggcgaccgggctccataagtcgtaacacctgcgccgcccgcgaccatcaacccaatcgggcattgctggtgcacctgtattgtacccgcttgcgccatctaacagcaacggtgttggcattgctgcaaggaatctttcgatgtggtcgcaggaaacccgaaacaagccttcaggagaacgggggaagcttgttctgtgagcagatatgaatgaagcccgtaggctaccgggcttcattcatatctgcgccgtccacgcctgcaaacgtggctgcgctgagattggagtccaaccagtgtatcagctgggatagctagccgcaatgaagccttctgggttctgcgaatacatggggtgaaggcagcagaagaaaatgcctggatgcagcgtgtactgtatccaggcatctgtatggttctggagcgttcctacagggcgtggcgtgcgcttctgatggcgcccttcacgacgccgtgtgccatgcggtaggtcagtgccaggtatccgccatagacgagcgcgaatattgcgatgccgaggccgacattctcgatgatgcttgactgaccgaacatgaggaggagcttgttcacagcggcagtggcacagatgctgtgggcgataccgacaatgagaggcagcgcgaaggcaaagatgacctgggtcctgagggaggagaagatcgtcttctccgggcagccgagctcagagagcgtgcggtagcccatggcagagtcggaggcgttcgagagctgctggattgcaaggatggcagcacaggcaatgacaaggacaaagccgatgtagattgccatgtaggagatgaggcccgttgtcgtggtgccttcaagggctgcattggtcttggtctctgagccgacgtagagctcgtcgttcgaggcagcaatcgtatcagcgaggtccttcacggccaggtcgccgttttcggtggagacgcggtagttgatgtcgagtgcccagcggtagttcgggagctcttcagcgatgtcgtctgcgacgacgtagatgccgggggtcttgccgatggcatcgttctggaggatgcaggagtcatcgtcgatcacggagctgcgggcaggggtgagcgtttgtcctgctgcggtgatcgtgaagccctgctcgagtgccgtgttcacgaagctctcgagcgtatccatgttgcagagatagaggtactggtcctcatcgagcgagaccgggtcgagtcccttgaaggtgcgcagtgcattgtagtcggaaagggagatggcttcccaggcaacggccttctcgtatccctgcgggatgctcttgccggtgaaggcagacatctcattcagagaatcgatagtgaggtatccctcgccgtttgtcatgtatccgacgcggaaggagacggtatcgccgacagcatcgaggtcgactccagcctgctttgcataagctttccagtcgagcgtcttctcctcaagggagcttccgacgacgccgatcgatgcatcgaaggggacgcctgcctcataggacttgttgagcgtcgcgcagatgctcatgcctgatgtcattgccgtcatcgcgaagaagaggatgagagcgataagtcccatggatgcagctgccgtattgatgcgggaggcgatctggcgggtcgtgaacatgtggaggcctgaccagtagtgcttcttcatgcgctggaggatgagcgtgatgccgcctgcaaagccatagaagaagatgaacgtgccagcaacgacaagtgcggtcgtgacaaggaagtcattggtcgtcgtctgtcccggctcggggttggagccgccgagagggaagccctgggtcgtgaggcgccagtaagcgtatcccatgagcacaaggccaagtgcggtgaggacgaaggagagcggcagatgccttacgaactgcttctcgttcttcctgcctgcgctcatgaggtcgatgagatgcacgcgggagagcgtgatggagttcatgaccatcatgacgaggaaggtgatggcaaagcagaagaacgtgagtgccagcgcatcgggggagaagaagaaacggaagttgtcgaccttcgtcgcgaacatgtctgccgtgacgaagaggaggagctgggagatgagggcaccgagtgcgatgccgacaatgaaggagatgagggcgaccataagggtctcgagcgtgaggatggcgtttacctgtccggcacgcatgccgaggacctggtagaggccgagctccttcttccttctgcgcatcaggaagttgtttgcatagaccataaggaagcccatgatgacagcgaggaagactgtgaggccgtgcatgatctcgcctacctgcttcaggacatcggagagcgagttcgacaggaagtctgcctgcacggagatcgtgttgaatgcatagaagacggcgacgcccatgacgagcgtcaggaagtacacggcatagtcatgcatgagcttgcgcatgttgccgaaggcaagcttagcgagcatcgtcgacccctccctggactgctacgacctgcatgatcttctcgaagaactcgcggcgggtatctgctccgcgcacgagctcgcagaagaccttgccgtcacggatgaagaggaccctcttgcagaacgaggctgccgtctcgtcgtgtgtcaccatgagcactgttgccttctgggcgcggttgatggcgtcgaggctctcgagcaggagcttcgcgttcttggaatcgagggctcctgtcggctcgtctgcaagcacgagctgggggtgtgtcacaagcgcacgggcgcaggcgatgcgctggcgctggccgccggacatctggtagggatacttgtcgaggacctcggcaacacccaaggactttgcaatggcctcgacggatttcaggatctggtctgccggtacatgcccgatcgtgagcggcagcgcgatgttctcgcgggctgtgagcgtgtcgagcaggttcgagtcctggaagatgaagccgagctgggtgcggcggaagtcggcaagacctgagcgggagatgcgtgccgtatcggtgcctgcgatgcggattgtgcccgaggtcggcgtatcgatcgtggcaatgcagttcagaagcgtcgacttgccggaaccggacgggcccatgattgcgacgaggtcgccgcgctgcaccgtgaggctgacgccgttcagagccttcgtcgaggcattcttgccgccgtagaccttcgtgagggcagagatctcgaggacaggcgatgtgctgtcggggacaaaggcggatctggctccctggagatggcgaggcatggtggactccttctttcgtgttgctttctgtcgcaatcatattcgccgaaagaagcttggactgccatcgaagccacttacactgccttacagttctgtaagcttggttccttcctcgaaacgggagcgctcctgcgggaagacaatctcgaaggccgtaccctttccttccctcgagcgcacagagacggaaaggcccatcttttggcagagagttctgacgaggtagagccccatgccggttgccttgccgtggctgcgtccgttctcgccggtaaagccccgctcgaagatgcggggaagatctgcctcggatatgccgcagccattgtcggccaccttgagcaccgcatgctcgttcgccgttcctgcttcctcgatgcgtgcagagaacgagatctggggattctttgcctgccggtacttcacggcgttgtcgatgagctggcccaggatgaagtccatccacttcgggtcgcagatgaggacaggggaggtgccgtcttgaacggtgagccctgacatatccacagtcatatgggcctcgatgagcgtgcgggcacgggagcgtacggcctccttcacgaggctgtctgccggtacgctcctgacgagatagtccttctcgacagacgtgctcctcgcatagtagagtgcctgctcgacataggaatcgatccgggcgatctcgcgggatacggctgcggtatcgggggcgtcggcattggcaagcatgaggcgcactgctgcaagcggcgtcttgatttcgtgcacccaggtctcgacgtactggcggtattcctcgaccgcagcctctgcctcatggctatctgcctgggcagctctggccaggctctgcatggcctgccaggagagctcgccttcaggatatgagggctcctcgatgcttctggcataggcaagggtatcggggccttcgtctgcaagcacttcgagatcgtgcatatactggcggcttcgcgcgtagccccagaggaaaggcacggcttcgaggatgacggcaatgatgaggatgaggatcgtgccatcggtgctgacgccgagaggcagaagcagggctcccagagcagcgagcaggatgaggcttgcagcaaggcgcagggcatggcttctcatgtaggcagcaaagttcatgcctgctccagcctgagcgcgtagccctggccacggaatgtgacaacggcagacttgagccccaggcgcgagagcgtctggcggagcctgttcacgttcacggtcagcgtgttgtcgtcgacgaaggcatcgcttgtccagagggcttccatgaggtcctcgcgggagcagatgccgcccttcttcctcatgagctgttccagaatcctgagctcgttccgcgagagctcgacggtcttgccagcgtagcttgcctcggagcgtacggtgtcgagtgcaagtcctccctccgagagcacagcagacggcgcctggctcttgccacggcgaagaagcgcatcaaggtgtgcgaggatgagctgcggattggcagacttctggacgaagtcgtctgctcccatcgtgagcgccatgagctcgtcgagctctgaagcgcggcttgtgagcaccatgaggggaacctgactctgctggcggagcgcccttgccacatactggccatcggtgcccggaaggccgaggtccaggaccacggcatcaggctctgcggcgaggatgtcttccggcaggtggtcgaagcactcgagcgccgtgacctcatgtcctgcgtgctcgagcaggagcgcgagctgggcgcgtacggcagggtcgtcctcgaccaggcagatctttgccatctctcctcctaggcgtcgtctcttccccataccttagcgcaagagggcagatatggtgagccagcagaaggcaggtgctgttctcttcgttctgccacgtatcaaacagctgtttttgggaaaaacgacactaggtgaaattgcgacaggtgctacccctcatgtcttaaggctgccctgtcgccatatgcggtctggaaggagagccagatggctgatgtgccggaagaggaaacgcccaaagagacggctgaagcaaaaccgaagcgtcaggtgaagaggagccctgagggcagcaacaggaactctctgcgctccctccatcttctcgagcagagctacctctctctcatcatgaagaagccgtctgacaagatcacggtcgcagacatcacgcgcgaggcaggcctcaacagaggcacgttctacgcccacttcagctcggtctcagagctcgaagcctatgtcctccaggagctcgtggaccgcttcatgagcatcggcacaagctggttcgatatctccttcgtgcaggatcccgagcccctcttgaagaaggtcggcgccttcgtcgaggagcaccgcgagctcatccagacgatctgccagaactcggccacgaaccccttcactgtggcgctcgagcagaacctgaagcgccgcatccgcgatgagatcgtgcatgcctatgcagatgacaaggaagcgctgacgcttgtcctcatctcgaccgactatgtgatgcacggaatactcagcgtctatgactcctggctcttcggctcctatactgaccagacgctcgacgaggtgaacgagatgctcgagcgcctcatcaagggcaccggcgtcatgatccagcagcgtgctcagatggacacccaggacgcagatgctagctgactgagggcgttccagcgaaatcggcaatcgccgaagccgcaaagtcgagctgctctgcattcgcaatctcaggcgtgccgtctccctcctgcaggccatagcttccgaagtaggagtggatgccaccaggaatgatgagctcggtatagcctgaaggcaggttctcaaggcattcatcgtatttcgtcctgttgaggacaccatcatgctctccgtacatgaggagcacggaaagactgctgctgtttatgtctgaagtctcgtaggcgcccaggagcacgagcccccgatagctctcctcatgccctgcaacataggagcctgccatggcgccaccaagcgaatggccgccgatgagccaagggagtgccgaggaatcctctcctgcgtccgagagcgcctcttcgagctcgggcctggcgtggtctgcggcattgggtgcgagcacggcaaggttttccggcatcttcacgagcacgcaggcaacgcctcgatcggcaagacgtgcgaggagcggtgcataggcggtcgcctcgaccttgccgcctgggtagaagacgaaggcagcatctgcgttcttgggcacgaagagcacgtcgccgctgtcgagcgtcgtcaccgtgacatctgtggtggaggcaagtgcctcctgtgcctcgggttccgcatgatagtagcccgaggcatagatatggatgccgagggctaaagccatagcgacagctgcaaggacaatgaggatggtcctgagtatatggcggcgaggcttcttcgatgccttcttctctgccttgccctttccagaccacttcatcgtgcatccttcctcatggcctccgagagcccttcctcgatcttcggtgtccaccacttgagatagcctgcctgggtgggatgtatggcatcggccatatagagcttccgctcttccggcgtgatgacattgaatccctcatcgtcccagagatcgatgatggagatgtcccacttgcttgctatctctttgaggagcgtgaccatctctccgtaggcagcgctctcatagcgcggattcgtatagaacacgatagggcagccccatctgttcctggcataggcaatgatatgctcgatggcgcccgctacggttgctgtatcgaagccttctctctggctgggtggcgtgacctgccccagcggctttccctgcgtcgcgtcgctcgtggagagctggcagacaaagaggtcggcgtggtctgcatcgaggcgctcaagacgcctgatataggagctcttccccgtatctgcgagcgttgtcccgctcacagcttccttgatggcagtgcagccatccctcttcgcgatatagtccacgaaggatatgcccttcgatgctgctccataggtgacggaggagccaaggaagatgatggttgtgcccttgagtgcacttccggcaagcggctccacccgctcgatgctatacgcagctgcattgccgggaaggcgttcggcatcgagtgggtggagcttggcgaaaggtccccaaccccatgtatagccgcagaatgcaatccagaggagggccaggagcagaaggacgagaacgatggcgggcatcttatacctgtttcgggatagggacgggacagtgctgctcagctttccagttcaaggcgatgccgtgcgcttgtcaagcaggagcaggctatgagagatgtggctggattgtgccggaaaccatcttctcctccaggcgctttttcgccatcatctgatgcatatgcatgaagctgtgccagatttcctccagaaaggatgcccctttcctcgacgagttctgtgccgagaacttcacgctcgtgccgaaggcaatagccgctggcgcaggcaggatcgagctctgcgacaacctggcagctggcggcacgacaccttctctcggcgtgcttgaccacacgcttgcctatgcgcatgagcacggtgccagggtcatgtgcatggtgcggcctcggggaggaaacttcgtctacacctcagacgagctttccatcatggaagaggatgctcgcattgcggctgagcacggagcggatggcatcgtccttggctgcctggcaggttcaccgggaagctattgcatcgatcttgctgtaacagagcgcatcattgaagcagccagaaaggcagcaggcggacgcgggctcgatgtcacgtttcacatggcattcgatgagctcgatgtacatgagcagctcgacgcgccgtcagagctcgcggcaatgggagtcacgcgtgtgcttacgcatggtgggatagcaggtactgctatcctcggcaatgttgcgcatctgaaggctctcatcgaagcggcaggagatgggctcataatccttccgggcggcggcatcacctggaagaacagggatgaagtggcagcagccgcgggagcctcggagctccatggaacgaagatcgtggatctggagagcatggcctagagacaagaagagcgcctgtccttccgggcaggcgttctgaggcatatgggttgatgccaggcaatcagtcgcttgtgtcgctgtcaagcgtgatcacgatatcgtatgccggatattctgcacggatcttcttgaggacatcggcgcgcacggcttcgcggtcgggagcatcgaagtccacgacgatatcgaatgtcatgagctgccgctcctcgtcaagatggaagccatggacctgcttcacatggtcttctgccagagcgatgccgtaggccttcttctggatgcaggcagccttgtggttgaggctcttcgagtagatgccgaccgtggccaagatgaccttgccatccgtatcccggaagacctgctgctggattcttcttgtcatctcgtcgatcttgccggcgttcatattgccgggcacttccacatgaatatcgccgacgagatgctcgggaccataggaatggagcagaaggtcgtaggcgccgaggacctcgggatcctttctgaccgattcctttaccgtatgggcaaggtctgcatcgatgcgttcgcccagaatctctgagagagcatcgcgcatcatatcgatgccggccttcacgatcacgacggagatgatggcgccgacccaggcctcgatcgagatatggcagaggatgtagacaagcgctgccgccagggtcgaggcagaaaggatcgcgtcgaagagggcatcagagcctgatgccacaagggcgtcggagttgtgcttctcgccctgcttcttcacgtacctgccgaggatgagcttcacgacgacagctgcacccacaaggatgagcgttatggcagagtagtctgcgacctcgggggagacgatcttctccacggactctatgagggacgtgatgccggcatagagcacgatcattgcgatgatcgtggcagtcagatactcgatgcggccgtatcccagagggtgcttcttgtctggctgcttgtgggcaagcttcgtgcctgcaatcgtgatgatcgaggacagggcatccgagaggttgttcaccgcatcgagcacgattgcaatggagttcgaggcaaggcctatggctgccttcatggcagcgagcgccacgttggcagcgatgccgacgacgctcgtgcggacaatggctgcctctctctgatcggcggccagtgctgtgtcattcatcaatcaacgcttccttccagaagcttcgtaagtatccgcttcagctcctgtgcatcctctttggtgagggaagggaacgtgcaggcaaggcggaacggtatggcgagggcacgctgcttcagggcagcgccttcaggcgtcagggaaatcatgacctgacgggagtcatccttcgagcgctcgcgcttcacgtagcccttctgttcgagcttcaccaggacgggcgtgagcgtgcctgagtcgaggaacagcctctcgccgatctctcctaccgtcgaggtgccctgttcccagagcacgagcatggagatgtattgggtgtacgtgaggcccagaggatcgaggagcggcttgtatctcctcacaacctctttcgaggcagcatagagcggaaagcagagctggttctcgagcttcagctgtccctcgtctgcgggcgtgctctctgcgtggcaggatgtgccagccattagaggaggtccttcacggcctgctcgacttcggccatgtctgccgtcggctcgaagcgggcgacgagcgcgccattgcggtcgatcaggaacttcgtgaagttccacatgatgtaggcctcatcgccgaacttctttgcattggcctttgcgaacttttcaagcgccttggccttgaggccgcttccaaagcccttgaacggtgcctcggtcgcaaggtcgcggaagagcgggtctgcaccttcgccgttcacctcgagcttcttgaagcgcggaaaggcggtgttgaacttgagggagcagaaggagttgatctcctcatcggattcaggtgcctggttcgcgaactggttgcaggggaagtcgaggatctcgaagccctggtccttgtatgctgcatagatgcgctcgagatcctcatactgcggggtgaagccgcagccggtggcagtgttgacgataaggaggaccttgccggagaaatccttgaggctttccttcgtgccatcctgcttggtaacgctgtaatcgaagtagctcatggctgtcctttctcttctgtctgacacccacagtatatcccattgcgcgcaaaactattgtgcaaaatacaatagagcacaactaaataacggtacctgtcagatccggaaagggaatagtggagctagctgtcctgagccctcttcccgactagggcctgccgcgcttcttctgcctgcatgctccggaaggtgcgcccgaagagcttgccgaagagcgctgcaaagaactggttgaagagcgtgcctgtcatcacagggaagagcgtgatggcagggaagtactcctgggcgatgatggcgccagcagagatgttcttcatggcgcagaggaatgtcatgcccacggcatctgccctcttgagatgcatgagccgtgctgcaagaaagccccagacatagcccgaggaggcaagaaatcctatgaggaccaggacgcctgcaagctcgggcgtgaggttgaagatgaaggtggagaggctcgtcgagttcgtggtgatgacaaggatcgtgaggatgcgggccaagggcgcaagcaccggggagacttgcttctttgccctgcccttcgtgcggtcattcaatgccgtgcccagaagggcagggatagcgatcatgaagagcatgtccaagatcatgccggcagcatccacctcgactgtggctcccatgaggagctggagggtggcaggaatcgtgaatggtgccatgcatgtagagatcagaagcgttcccagcgtgagcgacatgttgccttcatacagggagacccacatcgtcgaggtcacggcaatgggcacggtgtattcgagcacgatgccgcagatgaggtccgtatccgtaaagaagagatgtcccatggcccatcccaggaccggcatgaggagctgggagatcaggatggccaagatcatgggcgaaggatgcgagaacgtgcgcttcaggttcccgaagtcgttggaaagagatccctggaaggtgatgacggcaaacatcggggagacataggttgcaaaacgctggaagaaagccgggaagaagatgcccgccacaaggcagagcggcacgatcacgatcatgttccgcgagatgaagcttccgaacttctgccatgcttccatgtgccaatcctttctgcagcgtgcacagccttcattatcacgcctgcatgcatgtgtggccacaatggcacaaagcgtacaagcagaggagaggcagaagggctccatcgggtcccagggcgtctccccggggaaggtgccgaagccctttcccgttgccttcgtgatgatgaagtacggaagtatgtggccaggaccggagcagaggccttcgtctccggttcctgcaagggcttttccataaggtttccctgttgtgcagtttggccggctttccagatgctgcatacatgcacgaagagctctgttaccatgaacgtgtgcagagcctcgtgcacgcggaggcccgcacatgcgtggaagagccgatgcagcagaggagctctatcgctatggccagcagcacccgaaagctcacccttctgagctgtatcctgaaacagccgagtccccagaaggaggtgctgcttcaggcgttcacgggcgtccagctcgaagactgcgccgggcgcaattcgatgagcaggagcgaggtcatggatatctgcagggactttgcagagcatgcccccgagctcgaagaagatcggtatgagatggcataccacgcctcgaaggataggtacgacttctgccagaccacagggcagaacgagggcgtcttcctctatatggagctgcgctacggcaagaagaagcctgtcgtttcccagcccgccgtctctgtggcagcacagcctgcagacaggcccgtgacgtcccagcccaagaagaagcgtgcttcccgcaggaagggcacctctgcttccaagagcgaacctgcgcaggcggcagcgcctgcgccagcaccggcgcccagggtcctcaccgaggaagagaaggcagcagcagagctcaggcgccagcagcgcagggctctacgcgagcgtgacaagggttcctggtactaggaaactaggatcacgctgcgctggttctctcgtcgttcaatagcccttctgagatcttctcgtttgaaagacaggctccatcccggaaatgaactgcaccccgaacttggacttggaaatgaaagttcgggttccgaggtgcagttttcatggagaggcatgatctcgagacacgccagaggccgctgacatgatcagcagcgggcatgggaggatgacgatcgcatcggcccttgccatatcgcctgcatcgcggaaaaatggatctattcgttcaaggccgtcgggagagaggctttcctcgagatgggatccaggcacaggaagtacgactacgagaccaagctggcggcggtcctcggcttcacggaaggcggcatgaccaggcaggaggtcatggccagtatggcatccctggcctcacgacgctcaagacgtgggtgggcaggtaaggtcgggcggcccggaggctctcaggccgaagcccaagggaaggccgccgaaagcagccgcggaggcgcagcctatgagcgcgagcaggatctggagaggcgcatccatagctcgagccgagaacgcctacctgaaaaacgatagccctgaaggcggagaagcgctcacgaaccgcgagaaggcagcagccgtgagcgggctttcagggcgatatcccctgtccgacctgctcgagtgcgccgggctggcaaggtccagctactactatgcgccgtcgcacccaaagcggcccacgaggccggagctgtgggacaagccgcagagatcttctcgcgcacccccaacgggtgcggccacagcagatagccatgtgcctgcgcgccgaggagggcgtgcgcatagcggacaagacggtgctgagatgatgcccgagatgggcatcagctgcggcatcaggccgcagacggactaccacaggtacaactcatacaagggcgtggtgggcaggacattcgagaacgtgctcggccgcgacttctcggcagacgagccgtggagaagctcggcacggacgtcacggagttcaggcagccctggggcaaggcatacctggctccggtgctggacttctgcaacgacgagatggtcgcctggtcgatctccggcaccccaacatggagcagcagcacgagatgctcggcatgctatatccaaatgcccgaaggcaagacccccatcctggccagcgacatgggctggcagtaccagcacgagggctggtgcaggaggctcgagaggcgggcatcgtgcagagcatgtcgcgcacgggcagctgccacgacaacgccgtcgccgagggtttatgtgctcagcaataactgcctaatgcgctggatgcgattattgccgagtgggtgccggacggcaggcggaggggcccggccatccggcgcccacacataatgcatcgcgctacagggattcgaggaagctgaggatgtccccctgggctctgtagcgcctgcagccggattcctgccgctgtccgatgcaccttcgccagcgcatcttccttcctggacatgcttgcgaccatgtatcgtgcgtcgtctgcacgctctcatgccccagccatatgcgatcgtcgagaggtcgactccggattccagcatgccatcgcgcagaatggcggaacacgtggggcgtgatccgctttccggcgagggcaggatggagctccgaccccggcgaacggctgcatcgatccgcgaccttgcgcccgacctgctcagatgctcgacattcctcccgggaagacgaagtcgtcggctccgagctgcctctcctcggcgaatgccgtgacctcgccggcaacctctggccaaaggggcagcgtgcgctccttgcgcccctttcccgcaagatgcaccagcctgcccccgcgcctctcgaagctgcgcatcctgagggcgacgcctcgcttatcctcgctcccgtgctgaagagcagcgacagcggagatggtcctccggcccgcgccgcgaggcggcatcgcatccatcgaggagccagccgacctcctcctgcgtcagatagccgacctcgcgcctcttctccgtgcggcgggggatgtccgagatccgcttcatctcggcaagccgctccggagccctgtatgccgcatatgagcagaacgcctttatggccgcgagcctgcagttcacggtctgcgccgaattgccgcgcctctcggcgaggtacagcaggaattcctcgacgttctctgccgtgaggtcgtccatgcccacctccgatgcatctgtgcccctctcgtcgcggaaccatctgagcatgagcgagaacgcatcgcggtaggaggcgacggtctccggcgagagctgccttccggcagccatccactggaggaagaaccccttcaggagctgtgggaggatgtccttcatgcccggtccgcctccatccgcatcgcgcggcggaacgagtctgccgccactgccatgagctcggggacgcctgtcagataccagtaggtatccgagagcctgcggtgcccgacataggccgagaggcagggcatcatcgcgttcacatcctcgccttccgcatgccagcgcagcagggtcgacacgcagaacgaatggcgcaggtcgtgcaggcgcggcctccttcctgagaaggcctcgcccctcccgatgagcgtccagcggatctccgagaacatgccttccgcagagtccctgctgagcggccttccgccggccgagacgatcatccgggccggagccctgccgcctgccttcccgctgcgcccctcgacgtatcctgcgatgcgctctgcggtgcccggcgataccgggatcgtcctggacgatccgaacttggaatcccttacagcaagggtcccggcatgcgcatcgaagtcggcatcctcgagaccgagcgcctcgcctatgcggagcccgcatgaccacatgagcccgatcgggaacgagaggcccttgcccctgaggccgtctggcgagccttccgagagcgcagcgcgcatgagcaggcagacatcctcctcgctgtagatgtacgggacgacccggtcggatgtgcgtccgaggagcccgggccgcattgcgggaaaggcagggtcgagcgcatgggcgaatcccgagaagcgcctgaccgtctcgtaccgctgtgcctggtacgacctcggatggccggcgccgctgcatgcccaggcgagcgccgactcctcggtcgcatcgtcgccgccgaggaaggctgcgaaggcgcgcagcctctgggcctctccggcgaagtcgaacccgagcgcctgcttgtactctatgtatctgctggccatctcctcgatcccgctcatcgcagcccctctccgggccacggcgccgcagccctgcggaggttctccgtgctgaccttcacgtatcccatcgtcgtgtccacgcgctcgtgccccagcacgtccgcgacagtcttcgcgtcgatccccgcattggccatgttcgtggccaccatcctgcgcagcccatgcgtcccgtggtacgcctcgattcccgcacggccggcagccagcgacatcgccgtctggacctggtgcgaccgcatgggcgttccggccgtgctcaggaagagggagcgggttccttcggccttcccccgcatcgtggcatagcgctccagcgccgctcctgtccgcccgtccaggggcagcaccctccctgtcctgctcttcgacccgcgcacggcaatcgtgccgtctgcccatgagatgtcgtccagggccaggttcgcgacatcgcatgccctgagtccgagcatgcccatgcacagggccatcgccgcatccctcgccccgcgcaccgtgccggaatcgcaggatgccagaagggcctcgaaatcctcctcggaaggccgcccgggaaccgtgcgcccgcggcgcgcagggccgttcagcgacaccgcatcgagtggcacgcactccatgcccttccatctcaggaagcggatgtacgatctcaggtcgcttccctggagggcgcgcatcgacgcgccttcggccgtggctgcggccgtatggtagtcgacgaagtcatgcagagtgatcgccctgcgctcgaaggcgccatcgggaaagacggcgtgcaggaacagctttatggaggcgatcctgttcctgatggtcacgggctttatgttgccgtggatggagagatacttcccgaattccgcaagctccgcatcgatggctgcatccggccggagctccgacgggacgatgcgctcgcggtagggcttcccgaacctgtaggtccaccatctcctcacagccgctgcagggatggtcgacgccgtgttgcgcggcagctccgagatgtagccctcgacgatccccctggcctcgtcctctcccgctccgagcgcttccggcctcctcttcaggaacgtgctgacccggaagcggtagttcttcgatgcagtctccgagtagccgttgtcgagcagatgcctgtggaagccttcaagctgctgtatcctgtccattccgtctcctctctgcaggatgcagtcccgacagggaagacgttacagcgttatgtgctcagcggattgccgatatgcccctccgcctgccgtccggcacccactcggcacataatcgcatccagcgcattagaaataggagagtcgtcttcgggacgccaggaacgggtggtgccgccacgaggcctctcggatgcctccgacacgaagcacagggcgatcgagttcatcgagtcatattacaaccgctaccgtccgcacgagtccatcggggaccgcgtgccggcagaggccatgcaggagttcttcgaccgcttcgagagggccctcgcgtacgatccggaggcgatggaagccgcataaaattggaaatggctgagtacctccggcatagttaggctccctgaacgtaaacggcttaggcaagctcgcaggaagcttcggctggacgtggccgtggctgcgatgccggagagcgggacatgcatgaggcacatctcgtggaggagctccatgcaggcatcggaggagctcctggggctgtatctccagctgtaggagtccgcatatgactgcaggtgcttcttggggaggcgtggaaggctccctccacgtagctgaagttggagatgaccctgtggaccatggggagcgaggcatcgccgtccgagctgtcggattccttctgctcgaggccgcggaaggacgagagcccggcagctatgcgctccaggcatccgcccttatcctcgatgcatggcagaggtggtcgtgcccgaactggcgccatgagtctccgagcagtcctgcgcgcaccggatggcgcaggagcccctcccggcaggggccctgtcgacggcggcaagcatcggctgtgctccgtgccccttcccctcgtgcctccggccctcgcgcctatatagaagtcgtccgcctcgatgcacgtcagcagcgaggacgttgaaggcactccgatctggccatcgcgcagcggatgcgcgcaaggacggccctgccgtcttgtagctgcagcctattggcgggtggattgaatttgtaagcgcaacactgcaatccgaagcgcaacggttgcagcaagtcctgcaaaatgtgccggaagcgttgcggcaaggcgtgcaattcggccttccggagcaccgggaagccggatggcatgcattccggccatggcaatatcggcccctctccaggattgcaagacttcatgcaaaggaggggggcggaggattcgctgctgccggctcggccgacgtattctttgtccgctgcctccggctgcgcacgcaggcagcgcatgcggctatgctacctcagatatgcatgcgggacgagcgcgggcctgagcaccagcgctccgcagggatgcgcacgatcccgagccttccgagcgccccttccggcaggagcgacccagctcgccgaaggggcatccgcctatcgacgcgagcggatacgagttgacatggctgcaggcgagagccacgttgcgtctgagcgcgtccatgtccacatgccccttcgggaataacgcctcagctgctcgtggttgcgctcggcctcggatttggttggactcctgcgggtcgcaccagaagacgcggcatcctctcccgggctcgaggcagctggctcatgccctcccggtcgtcgaactcgtgccctgtcgaggagcatgatgccgaacgccgcctcgaaggccgcacgcgaccccagcgccctctcgatgcggtcgagcgccgcgacgtggccgaagggtccgcatgctcttgagatagagctggaagtgcctcgccacgatgtgcagcgtgaggatgtcgtgggcatcctgctgcctgccgcagacggagtctccctgcacgacctggccctctcctccaggggcagcgccaggaagtcggagagtactcgtgccggacctgtcgtagcgcggcctgcctggtccctcttcctcttcctgggcctgagctcgccttcctcggcagctcgacgctggatatgtccggatcccgtccgcctggtagtgtgagagcgagcgcaggcagaccgagcccgtccccgagctcggtgcagatcgcccgaagctccatccctgccctaccaggggcgccaccacccgattcagccgctcgagctcgtcggcggtgaggtctagccctccgcgctcgaggcgagcctggcatcgtgcgccgcctgcgcctctgcgcggtacctgctcctggatagctgcgtctgccgcttcctgcaccctcggggcagacgtagggccatctctccgtcacggggcacatagcagctcgaagtccgggcatgatctatgcagctctcgtcctgcagtccctgcaggcactgcccggctgctgcatcctgcgcatgcagtgcccacctcgggcactccttcctgcgcgcgcagcgcacgacagggtcgtcccggcgcctcttcttctccttcagggtctgttcgccttcacctccctcgtcacggtggaggggctcacgcctgcctcccgggctatcttccgtgcggaatcgcctctccgtatgctcctcgatgatcaccctgctatcctgtccatgtgctcttcttgccgttctcatcgctgtctcttccggcgggagccagcagcagcaaaagggatgctagaggaaagcgggggcaggatggatgcggaatccgtcctgcccccaatttcttctgtggccgctgcacgacttggtgcaacaggattgcttttcgaaattcaattcacgggaagcgtcggggcgggtgacggagagcacggccttcacgtcgtctgccaggggacggagacgtgccgagccctcgtcggcgagctcggtccccccggccatgcgcttgtggaggagcaggagcgtcgctatctgttggagtcgcgggtttctcatgcgcgaggagcgtgaccgcttcgaaaaccccgcctcgcggagagcggtcgtgagctcgcttggcgccggcctcgcaacgtggccgttggttccgagcccgttgatgatggcggccgagtgggcacaggcgttgcggacatccctggcctttttgagcatgtagtgctcgtcgagcatcgccgcgtcgtcccagcggcttgcgcagtagcggtacacgtccgcgacagtgccgaaggaggagagctcgagcagcacccatatcggcatctccccggcatagtgcctctggaggtcgcctgagtactcgtcgcgccggagcctcgatatctctgcctccctccgggaacgctcggagggggagagcgccgccatgtagtcgcgcacgatggagtggccatcttcggaaggccgcctcgccacctcgtcgagcacccgcgccttcgcgaggtgctccgcgtcgagcgcgagcggaaggagtgccgccctgagatcccggtcgagccgctcgaggtcgaccaggtcgcagaagtcgaggttcgcgtactcgccgtcgtgtgcccctccgacgcgcctggggaagagagtccgatatgcgtacgtggcgaagaggtaggactcccgcgagaggtagcgcatggcgtctgcctcgtccatccgctcgaacgtgacccccttgcctctgaggaaggctatctgcccctcggggtcgagcttcggcttcccgtccttgttctgttggtccatttccaaacccgcccatctggtcgtcctgcggctggcgatgcctgattctgcggcctacgagagccccgcggacatgatcctgcccatgaggcccatgatcaccttcttgctgtcggcgagtgcatccgcgtagacgttgagggtcatcgcggcgttggagtggccgaggatggcgctcacggtcttcacgtccacgcccgacgggactgcgaaccgcccccatccgcaccaacgcacattcgccagtcccgtcaccgcgaggcgccggaatctcaccgccggcatgttcgagtgcgtcgtccacgagcgcagacggctgagcgcctccaccgccgacggaatcatcccgcttgcggggtcggatgggcagtctttgctacccaccagaagcttcagagagccctttttctgtgcacggttaaggcagcggcacggcagaatggatagcgcagacggctcccgtggcagcgggaatttggccgctcctttgactgctgtaaggtttggagagtggccgctatccgctcaggcaaaggacggctcttttccgcttcgtccggtgtggcagcccacccagagtccgattgtcattgctgcgaacaggacggacgcgaaactgaaaagctcctcgtaggcagccatatgtcgccccactctcgcgattggagcgacacgagtgcccttgcactgcatatacagcttttgaagaacaattgttctaagaacaattgtacgtcttgcagagatgcctgtgcaagagtgcagggacatttctggatctggggctctgcctgcccggctttctgtcagacgggtgcgcgcgtatactggactgagcacataccctccctccaggagaccagatggaatcgctctacagaaaataccggcccctgaccttccaggatgtcgtcggacagaagcatgtggtatcgacgctcgagcatgctgtgctcgaaggcagggtctctcatgcctatctcttctgcggccccagaggcaccggcaagacgacgatggcaaggatcttggccaaggccctcatgtgcgagaaggggccaggccagcttcccgatggcacatgcgagcagtgccgcctcatcgcggcaggggagcacccggatgtctatgagctcgatgcggcaagccgcacgggcgtggacaacgtgcgcgaggagatcatcaaccgtgtgagcttcgcgccttccatgggctcctacaaggtctacatcatcgacgaggtccacatgctcacgacggcagccttcaatgcgctgctgaagacgctcgaagagccgcctgagcatgtcgtattcatcctctgcacgaccgacccccagaagattccgcagacgatcctctcgcgtgtccagcgcttcgacttccacgctatctctgcagacgacatcaaggcgcatctggccgatgtctgtgcgaaggagggcttcgaggcagaagatgagggcctggccctcatcgccgcccatgccagaggcggcatgagagacgctctgggaaccttggagcagatcgccgtcttttcggacaacaggatcacgctccaggcggtcagaagcgccctcggcgaggtccagagccagacgcttgccaatatcgtctctgccatcgcccgccgcgatgtggcagagctcatgaacgagacagcggcactcgtggatgccggacgcgatctcctgcagttcacgcgcgagcttgccgcccatgtgcgcgatgtctacgtcgtctctgtcgctggggcagaccccaagcttgtccccgctgcggcaggagatgtgacaaagcttcaggaggaggcagatgccttcggcacgcctgacaggctggcacgtgtgctctctcttctgggagacacctcctcggagatgcgcacggcgccgaaccagcgcctcgtgctcgagattgccttcacgaagatggcaaggccgcaatcggatctcacgctcgagtccctggcagagcgcgtgcatgacctcgaagagcaggtcgcagcgctcactgcccctggtgtggtcatggcatcgccggctcctgtgccggtgagctcgagagtcgtggcagagcccgccgcagcacctgtacctgagtctccagccccagctgtccaggcagctcctgcaccggttccggtacaggcgcctgcgcaatcatcagctcctgctccggcacctgcctacacgccagctcctgctccgaggacggcagctccggcaccggctcctgcagcagcccctcaggcacgtccgcaggcagcggctccgaccgctcctgtgcaggacacagcgcgtctccagcgcatgtggaagcaggtccaggacagcctccggaagaaggaccctgcccgcgcctcgcttctggcttcgagccatgcggtcgcagacgacggcgagagcctcacgatcgagtttccgaagggctcctcgttctcgctccatatgctggccaggggagacgtcgactccatcgtccgtcctgccatcattgcggtcttcggccctcgctatccgaactatgtggaggcgaagagctcgaagccgaaggcgcgtgccgcagcgccacgtgctcctcagccacccgtgcagcaggcgccggtggcggcagcgcccgctccggcccccgctccagtccaggcaccggcaccacagccgcaggcagcgcctgcaccggctgcgccagcgcctgctcccgtacctgagcctcagccggcagcttcacctgagcccatgccgtgggacgagccgccagcagatgagcaggtgccctatagcgatgcagacgtggcgggatatgcagaagaggcaccggtggcagcgccggcccctgctcctgcgccgaagcccgcacctgcaccggcgccagcggcagctcctgcaaaggaagctgcctcgagcggatttcctgtgagcgatgaggcagagccccagaaaggcacgcctctcaaggagaccgagggtataccaaaggacattgccgacatgctcgagtcggtcttcggccccggcatcaatgtcgtggtcgagccttcccctgacgaggaggaagtcgaagacgacgatgcagataccggcatcgaggaagccgcagacgatgcggacgacgaagacgaatagatagagtcactgaagacaggaaaggcaccgcgatggcaaagcgcaatctcgatatgaatgcaatcatgcagcaggctcgtgcaatgcaggagcagcttgcatccgcagaggagagcctgaaggacaaggaagtcaccgccaccgcaggcggcggcaccgtgaaggtcgtggcaacgggcgacatgaagctcaagtcgatcgagatcgaccccaaggcactcgatcccgaggacgtggacctgctccaggacatgatccttgctgctgtgaacgatgcgctcgactctgcccagtctgcagcatcctccgagcttggctccattacgggtggcctcaacatcccgggactcttctaggatggcggaaaggacggagcatgccctgcagcggcttctggacgagctgggacgccttcctggcatcggcccgaagtcggcgcagcgcattgcctactatctcctcgaagcggatgcgaaggaggcagagcgcctcgccgatgccatcctcgacgtgaagcgcgaggtgcacttctgcccgatctgcttcaactatgcgacaggggatacctgcgacatctgcgcagatccgacgcgcacccgctcagaggtctgcgtcgtggcagagccgcgtgacgtcgaggcgatagagcgcacgggaagctatcacggcctctaccatgtgcttggtggcgtcatcagtcctatggacaagataggacccgcgcagctccatgtgcgcgagctcatggctcgcctcgcggacggagaaatccaggaggtcatcctggccacgagccccaatgtcgaaggcgagacgacagcctcctatctgagccgccagataaagcctctcggcatcacggtgagccgccttgcaagcggccttcccgtgggcggagacctcgaatacgcagacgaagtgacgcttggccatgcaatagaggagaggcgcgtcctctaggcttagagggttgtgctgacctcgcgctttattggacggggcagcatgagcccccgccgcttggcagaaaatgtagacaggatgcctgtgtccatccgggtgcaggcatgaaacctgaaacgaggaggcagagaagtgcctttcgacaatcagaagcatgcaccccgccatgccgcacggcatgcgcagggaggattcggccccgatgtgatgggctatgcatcctcgacgtccccctattctgcaggacgtccgatggtaggggaggacccggttgcaggcgagggagacgcaccccgccccatcggtgtcgaccctgaggagaccggtgccttcgagaagctctcgagcggcgagggcgctgtcctcacgtcgagggacaacgccgaggaggcagcggctgctgcccgctcgcacatgatgcgcaagagcagaaggggcaatgtccgcctccagggcaggaaccgcccgaaggtcaggagcacagctccccgcatgcagacgaacaagaagctcttcgccggcatcgcgattgccgcagctgtcgtcgtcattgccatgatcgtcatcttcaacaatgcgctctcctcgacgacgcagacgcagacgggcgaggatgcccagacgcagcaggaagagcagcaggtagcctcgaacgacacgatgacataccacgacgcgtcgtatggcctcatggagcagggaggcggctgggtgcttgcgaagctcgatggctccggcaactacagctcgacggtcgtccagctctccggaactccggtctcgctcatcctctatcagggcgccttcatcatccccgagaacctcgatggcacttgggatgtcattgcctatgtgccggctgacggctctgttgcatcggctgtcgtcgactctgatggcaaccctgtgggcggctcgggccagatcagcgaggctgtgctcgacggctcgaacctcgatgtgacgacggattctggtaccgtccatgtcagcctcatgtaacgacaattcctccacaagtcgttctgtcagggctctgagctgcggcaatgcagcgcagagcccttctcatatccagaagaaggtgcctttgggaaagttttacaaattggggcttgccttcgacgctcgatttcgcgtaatatagctctcgcaccgaacggggtattagctcagctggttagagcgccggcctgtcacgtcggaggtcgcgggttcgagccccgcatatcccgccattgcaccttcagggctccttcgggagccctttttcgtatgcagagaagtttctgccggaagccaagatgctctgaaagctgccggcggcaggagggcataaacagggcgagttctggtctcggtgtgccaggacgaaggtggaagggatcttgcatgggggaagccccgaaagaggacaagaagcgtgtccagctggccgtcttcgactacgatggcacgtgcatcgacggacagtccggtgccctgttctcgctctatctcttcaggcataactatctcggagtggccacaggcctgcgccttggctggtggggtgcccgctacaagctccatctgccctatcgccaggatgaggctcgtgaggtcatcttctccgccctttcccgctacagccctgaagagatccgccagatcatggtggacttccacaacgaggtgctgatgaagcgctaccgcaaggaagccatcgccgaggtcgcaaaaaggaagcgtgaaggctgcgtcaccgtgctcgtctctgcgacgttcgaggtcatagccctctgcgcccaggaagtgctcggcacggacgccgtcattgcgacgaagatggaagttgaccctgagggcaactacaccggcagggtcgaaggagacgtcacccagggctcggagaagccccgtgccgtcaaggaatgggcagatggtgccttcggaccgggcagctgggaagtcgcctatgcctacggcgaccacttctccgactacgcgatgctcaagactgcgaagcatggctatgcggtcacgcccggccagacgctcgagcgggccgcgaagcgtgaaggcttcccgattctggagtggaaatagggaagagtgtccctgattgcagtctggcaaaaacagatgctgcgcaatttgtgacaattgcccacatgacgcatgaatatcgctatccttctgaccagtgatactgagctggcagagcgtggagggcacgttggatatctcgagaaagaccgattacgcattgcggatgatggcggcactcgtacgtgaccccgatacggtgctgtcggtcaggaccgctgccgaagagaacagcatcccctattccttcgcccgttccatccagcacgatctggcagaggccggcatcatcgcaagcacgcgcggtgcgcatggcggcatgagcctcgcagtggacccagagaccgtgacgcttctggacattgtccaggcagtgcagggccccatgatgctcacggcctgcgatgtctgcggcgagggccagacgccctgcccgaggaagcccttctgtcccttcaatcccatctggtgcggcgcacagacgctcttggaggcctatctctcctcgttctccctgaaggaggctgcgctcggcacagatcctgccaagacacgagagctcgtctccgacctcaatgccttcatggagaagcatgcggcagagaagaaggatgctgcaagcggcgaagctgagtgatgggaggctctgtcacagacgaggagctcggatctttccggcatctcgtgctcgagcaggggcgcatcctctggcgcggtcttccgtggcgggagaccagagacccgtatgcgatatggatctccgaggtcatgctccagcagacacaggttcagcgtgtgcttggccgctgggaaaggtggcttgagcgttttcctgatgtggagtccttggctcaggtgcccacggcagatgtcctccaggagtggcagggcatgggctacaacaggcgtgccctggcgctgcatgaggcagcacagaagatctccgagcttggctcttttccgacagacgcaaaggagctggttgcccttccaggaatcggccccacgacagcagcaggcatccgtgcttttgccttcgaccttccaggcatctatctcgatacgaatgtccgtacagtcttcctgcatgagctcttcccggatgatacagcggtgcctgacagggcaatagcgcctctcgtcgagaggtgctgccccaagacggcagaagaccccacagacgatccgaggacctggtactatgccctcctcgatttcggggcctatctcaagcatgtagcgccgaacccctccagaaggtctgcctcccatacgaagcagtcgaagttcgagggatcgcatcgccagaagagggcagccctccttcgccttgtccttgccgcaggggatgccggcatcacggccgaggaggcggcacgttcactctcttcccaggaagaggcgcaggggcgtgcccctgtcagccaggagatggcagagtcgattctcgatgacctcagaaatgagggattctgtcgaaaaactcttgcaaaataccgtgcttaatgggtataagaatcaataagtatgcggagagggccagcaaggggctggcaaagcatgcatgattgagaggggaaacccatggctgtcgatttcgagaattccgagacaaggaagaatcttgagactgccttcgctggcgagtcccaggcaagcatcaagtactcctactatgcatcccaggccaagaaggatggctatgtccagatttccgacatcttcaccgagacgtcgggcaacgagcgcgagcatgcaaagctctggttcaagtatctgcacggcggagccatgccggacaccgatacgaacctcaaggatgctgctgcaggcgagcactacgagtggaccgatatgtacaagggcttcgctgagaaggccgacgaagagggcttcaaggagattgcagccaagttccgcatggtcggcgctatcgagaagcatcatgaggagcgctacaacaagctcgaggagcatgtcgcagcaggcgacgtcttcagccgtccgggcgtgaaggtctggaagtgcctgaactgcggacacctccatgtcggccctgaggctccgaaggtctgcccggtctgcaaccatccgcagtcctacttccaggaggaagtcgtcaactactagaccagatgggggcagcctcaaggctgcatgatatctgagcgatgctctggtcccgtgcgcactcgacggcgtgcgggaccattcttatgggcaggcagcgggcagccgagacctggctctcagcagggcaagcgctgcagaaacggaaacgcgcgcatcatggacgccatgacggacggagagatggcaccagggaagcgggaggcgccttccggcagtggctctgacaaggatgcatgcagggacagcatcgatgccaggacgctggcagagatggacagagccattgcgaacatggaggctggtgccgtggggaaggagatcgacctgtctgatttcctggatgcgtgaggcctggaggcatctgctgcccccacggatccagaacgtggcatgcggtcgtcccgatgggcctgaagagctgcatgcggaggcgctcctctggcggacgtgcgggcttctgtgctggaaagctcctgtgtgtgcagcatgtatggacggaagatcttcttccggcagagagacccagagaccgaggctcccgaaggaccgatttttcgagtctgaatgcctcttttatctatatatgcgcagataaatcaggctatctattcgagagataactacgaggtggatacaggtatagctctgagctgcctcgagcgttcggcttgcgctaacatgcagcgcatggaaaagacgacgacatatcggatgcgctgcatgcaggggcccgggctcttgtgatgtgccttcagatgaaggcatagggtaccgggcgtgatgcttcgctgaagaaaaaagacacgcgctccggcgccagaaagagagcacaagatcatggcattcgaactcgaccccaccttcgcacaggaccccgagaagcacttcgacacccttcaggtacacgcaggctggtcgcccgatccagtgactggctccgcagcacttcctatctatgcatccgcagcattccagttcgatgacgccgctgatggcgcagcaaagttcgcccttgccaagccgggcaacgtctacggccgcctcacgaacacgacgaccgacgccgtcgcagcccgtgtcgctgccatcgaaggcggcaccggagcagtagctgtggcttccggccatgcagcagagatcctcgcactcacgaacctcgtcggtgcaggcgaccacatcgtcgcttccgactccctctacggcggcacctggaacatcttcctgcacacgctcagcgacctcggcgtcgagaccacgttcgtcgagaacaacgatatcgacggcttcgtcgcagccacgaaggagaacacgaagctctggtacgtcgagaccatcggcaacccgctcgtcgacgtcgctgatgtccccgccatcgtcgaggcagcaaactccctgccgtctccggtgcctgtttttgtcgacaacacgttcgcaacgccctacctctatcgtccggcagaggatggcgctgcagtcgtcatcgagtccctcacgaagtggatcggcggccacggtgccacgctcggcggcgctgtcatcgataccggcaagtatgactggaaggcacaggcagacaagttcccgaccatcgcaggtcccgatccttcctaccacggcgtcgtcttcgcagatgcagcaccggctgctccgttctcgacccgcgtccttgcgaacaagctccgcgacttcggcccgaccctttccccgtatgcagcacagctcatcggcatcggcatcgagaccctgtccctgcgtgtccagcgccactgcgacaacgctcttgctgtcgcgaagttcctcgaaaaccatccgaaggtctcctgggtgcgctactccggactcgagaacgatccgtcgcatgaggtggcagcaaggatcctgaagcacggcttcggcggcgttgtggtcttcggcgtcaagggcggccgcgaggcaggactctctgtcgtgaacaatgtgaagctcttcacgcacctcgccaatgtcggcgacgcgaagtccctcatcatccacccgacctctacgacccactcccagctcacgcctgagcagctcaaggcagcacacctctccgaggacctcatccgcctctccatcggcatcgaggatgtcgacgatatcatcgccgacctcgaccaggctcttgcccgcgtgtaagcgggattccgtacaagcacaagcacagattctcccctgactcggctgggccccgcaggtgctcttgcatctgcggggcctttctgcgccggtgggggatatgatgggagggcagaaacggatgccggtgctggatgcaccggagaagggatggctatgagcaagctttgcgagtactgcctgccagggcttcttgtggaggaccactcgattccagtgccgcttgactggcgcgggaccacgcctgccgagctggcgggcgtgagcgcggacgatatgaccctcctggcgcgcgagagcgccaatgagagcccagaccctgccttcgcgggcaagtccctctccctcttctaccgcattgtcagaagccccgagaaggcgtccgagcatttcccgctcatcgtctacctccagggaggtccgggaggggcagagccgaggccgctcgatcctcatagcgatggttggatggcagaggccatcaagcacttccgcatcgtgcttcccgaccagcgaggatgcggccgctcctcccgtgtcgagggctctgtcatcaatcgcatcggtgcagaggccaaggctgaaggggcagaccctgcacgccgtcaggcagactatctcaagcgcttccttgctgactccatcatccgtgacttcgaatatctgagactttctgagttcgggggcgagaggtgggtgacgctcgggcagagctatggcgggttcttgaccatggcaaacctgtcaaccttccctgaaggggtggcggcagccttcacctgcggcggcatcccccatatcccggcagacgcagcagatgtctatgcccatacgttcccgcgcatggtgaagaagacccaagggttctacgagcgctatccggaagacgagaggcgggtcgcgcttgtcgcagaccgccttgccgcaggagacgtcacgctgcctgatggctcgcccttctccatccgccgtctccagctcataggggcaggcctcggcatgaagccggcgcccgagcgcctgcacagcctcttcgataccgccttcgtggtaggggatggctcggcagatgcggctcttgctgcagcgggcggagacgttttcaaggtagagctctcggatggcttcagacacgccgtgatggagatgaccgcatcgccttcaaaccccctctactggacgctccaggagttcatctacgcagatggcaggatggcacatcccatcaggtgggcagcagcccaggaagcggccaagaggcctgaattcgcaccttctgtgcgtcctctgatgctctttgccgaggccatgtttccctggatgttcgatgaggatccggccctcatcccattccgtcctgccatggatcttctgatggaagatacggagttcggacacctctatgatcaggagcagctgaagcgcaatacggtgcctctccaggctgccgtctacttcgacgatgcctatgtggactccggcctccagctcgatacgctctcccgcgtgggcgcctcccatgcctgggtcacgaacgagttcgagcatgacgggctgcacggaggaaaggtgtttgcccatcttctggcagaggcatgcgacaggggagacctcaaggacgtgctctgagagcttgccgctcctgccgcttccgcattgaaggctgctgctccggataagggcagcggccttcttgctaaggacggctcgagctaccttccaacgccagcactatcctataaattgcaaaaaatgatttaaataactttaggcaagcctcatggacatctaacatgaaccttacaaaataccagctcagacattgaatatatacaagcttagaatgccctgaccgaaggcacaggatataaccagctcgcatcgcgagcgtcaacggcgagagggatgtggcatatggctacttctagcatcggccagatagtggtcctggacagcaaaagcgcaaagtggatgactgaggttttcaagcggtcatgccagccaaagaagcagagaggctgcaagctgcatattgtgaccggcggaatcgatcctgcccagttcaacatacagcaggcgctatgggagccgagatagaggtgcgagcactttctgagctgctcgattgcggaatgagcaggttgagtatcaggaagtcattctcgagattcccctgcagaaggaatagcgaggcctcgttcttcctcaaggcccgtgcagtacagaatgagcggagccagccgcacctatcttgctcttgacaggcagtctttcgatgagggaaggcttgatgttgcggcgttcttcacgcttgcaataactgcacccgattttggtggcatctccagagaggcgcgcacagagattcttggaagaacgcctgtgagcagagtcgcagcggctctttcctggctatcttgctgtgcagcttgcggcgatggcatggtgcggctttggaagggcgcatgcgaagatatggcgcagcgggatttagctagtccggaagccacagatgatgggcaaggaccatctttgccaaggaataagagggcggatcttcgctccgagtgcaacgcctcctgagcacgtgaaatggctcacggcagtcctgcgatggtgcttgcgaagacacatgcatcgcaggaggggtagtgtcggcaatgttggtgtaatggcccttcctgtctggcacgaggaggccgtcctggatccggaattgctgccgctatcctatgccgactccatcccgtccgcaagctcgaggctatcgccttgcgcgcggttctcgagctctgccagcctctcggcgtgggcgggagggatggcctcctctcttcgagagctctgccatcctctcctccgagaagtagcgcttgtcggcccagatctcgtcctgctctgcaaggacggcgcctgcgagcctcaggagcgacctctccgaggggaatacctgcacgaccttcgtgcggcgcttgatctcgcggttggtgcgctcctgatgcttctattggtgtcaatccccatttgggcccttatcgggatccatcgggaatccatcgtctatccagcgccggtatctctgcgcaagctccctgaatggtggtgtccagctcgagatcacagagcggggaggcgtaacgccgagagcagatgctgctgccttctgcgtcacgcggcagcgatcctctcatacctgagctccgggcctgcactggcctcgcccagatcgaagggtgcatgaggcagcggtatgcttcgcgcgctatgtagcgcttcaggcagcggcgtatctccctgtcggagaggccttccctgcgcctcctctctgcataggcgatggtcctcgggtcggtcctcatctgtggattgcgatcacgtgcagcgccctgttcgcacgcctgtcccctccgcgcggctgacctgtgccgcctggtcttcgctcgatgccctgaggggcgagacgccgcagagcgctgcgaaggctgcctccgagtgcatgcgctccgggttgtctcggctgcgatcgcaagggccgctgcggcaatcggcccgcatccatacatcgacgaaggccggattgccggccctgaccatctccgcattgcgccgctcgagctcgtctgccgacttcttgcctgcagccatgcctcgctgagcctgcagagcgcaagcatcacagcgcctgccacgccgctgcagccggcaggcatgccggatgaggcgcactgcgcattatgcccgctgctcccagccctgcgaaggcggacctgaccggatcgggcgcctcccgacgatggcgatcccgaggttggcaaggaggtgcatgccctacgaggctctcgcgcacgacgcagagcgcacgcactccctcgacccatccattgcgtgccttcgggactgcaagatcccttccggagagcgccgcagcgctgccctgagcgcatctgggcactgtcttgctgcatcgcgcccacggccgggacggccgggagtgacgacctcgtagcagcggattccccttgcggaaagctcctggcaatccgcgcccatacgacccggtgcattcgacgcccaccgacaccgggcgcccatggcaagaatgatttcggcagcctgcctgcgacgtccgccgtcgccggcagctgctccgagcgcagctcccttccgcgcgcatcgacgaccgagagccagttgggtctgcgtgcgtgtcgatgcctgcccagaccgccccttcgggcacattcccatagctgacatccatgatggccgcccccttctgccgatggccaggatggccggcgcatcccgctcgggcggacagcgtggagggaggggtgcagcttccgcagccagcaatccgtccccaggcttctatcagtcaaggtcggcgggacacggctgtgcggcatgggacacatcaggagaaggacagcgatgagacgtcaccacattgtagggtcaccatgccgcatgcagtgccatgcagctgcgtctgcaggcctggattaaacatctatcggagcaaattgttcgtgcgcaggcgcttccagtgcgatgcggggaagtccagataggctagggcatcggcctccgcctcctcccagatctccgccgccttcgggcagcattccccgagcatctccgctgcgaggtggcagagggcgcgcacctggtctgcctccttcgccctgaagacgggcttcatgatcctcgcgacgcgcctcttcaggctcctcgatcctgcagcccctatgcagtccctcatgaggtggacggcgcacctctgccatgcagcgccgaggaacacctccgatatggcgcgcttcaggccttcatgggcatcgctcgtgaccagctggacgccttccacgcccctctcgcgtatcctctccaggaactccttccaggatgcgtgcgattcggtgtcgacgaccgcaagccccaggatgtgcctccagccgtccgcatcgcagcctatggccgtgacgatggccgtggaggagacgtgcccctccctcctgcacttcacgtaggtggcatcgagccagatgtagggcatgtccagccctcccaggggacgtgccagcagctcctcgacatccgcatcgaggctcctggcaatcgagctcacctggtccttcgagagcctgtctatgcccatcctctcggctatcctctggaccttcctcgtgctcgtgccggtctcgtacatctccgccacggccgctatgagcgccctgtcggtcctctggtagcgctcgaggatgtcgtcggggaagaagcttcccttcctgaacctcggtatcctcaggttcagcatccccacgcaggtattgagggtcctcggcctgtagccgttcctgctgttgccggaggccgagcacatctcctcggcctccgcatccatcacggcattaatgaccgactccgccagctggcggaagagctcctggaggctggtgctcccgtctgcgaacttcggcatctctcctgccgcggccgtgcacacggcctgctctgctatgctgtccattgggccttcgtcctttccacgaacctgtaatgtcgcgattccagattctaggacggaggcctccttctttcccgcaggagcgccttcaggcaatcaggtgcttacaccaacttctacgacacgatcttcggctggtatggacagctcatgccggctgcgcttttctacataggaaatggggaggcgtggccgcctccccatgatccggcgtatgacttcaacgacgcggtgctgccggtggcagcaaagatgtttgccaggctggccgagagctgatctcaggcgtcctgcctcgagccggcattccgaaggcagagcgaaagcgcaagtatcacggtcgtgcagagagcgagggcgggaatatcgctcagacaggaacccagaaagccgagacagagccccgtggagaacgggatgagccagatgccccagagaagcatgcagaacgtcttcagccttccaatatctgaatggtgcatccaggcagcctgcgtccagaaggcgctgatggcagggagcagcacgaggaggatagcgatggagatacgcaggggcgagtctagagtgccctctgcgatgggtccagccaatgtgctggccagaatcagggtaaaggcagcccagaaagatgctgcctgcaaggcatgaagcgtgcggcttcgtcgcacagagagcgacgaagccgtgtagaggatgaatgccgtcatgccggcaatcatcgccagccatgaaggtgaatccatagagttgcccccgaagaaggtgcaccggatggtgcgccggtcagtgcgcacagagtcttatcaggacactctctttataccacttcctgcataccctatgcaggcggagcgtttcaggacgtgtcctgtgctgcctagaagaggacgcctaagacgatgaggagaacacagagcacaaggacgcacttgtcgattgctgccatggggtagcgcttgaagctgctctcgcgggtcctcagatagaagccgcgctgctctgcagccagagccgtcgcatcggtcttgccgacagaggtcacaagcaggggcacgcagagcggaagcatgagctggagcttcttgatcgggttcttcgtgtcgtactcaacgccgcgggcgcactgtgcctccatgattgcgttcatctcctgggagaagaccggaacgaagcgcagtgccgtcgtgaacgtgaaggcgtagcggtaggggatatggagcacctcgacgcaggcatttgcgaggtcgttgagcttcgtgacggagagcatgaggataaggggaagggcgacgccgagaagcctcaggcaagccttggaacctgtgatgaggcccgtgcttgtcatccacaggaagaccggctcgcctgtcctcacgaaggcggtctggagcaggagcatgacgatcgcgatggggacgaggagcttcatgagggagaagagcttgccttgcgacttggcatagaagccgagtgcgaatgtcaggaccagaaggcccaggagcatcacgtaggaatcggacaggaatgtcgccacgatgatggcagcagcgattgcgagcttcgtcaccggattgagcctgtggaggagcgtcttgcccggtacataatcgatcacattaaccacgctggaccatctcctcggtaaggtcgacgatgccggaaacctggctcacgccggcaaaggccgggctcacggtgcgcgagagcacctgcgagagctggacgatctgcggcgcctcgatgaaggcttccttcatgagggaggtgtcgctgaacatgtcgagcgtggcgccacggtccaggatccttccgtttgccataacgaccagacgctctgcgaagtcggagacgacctccatatcatggcagaccatgatgacagcgcagccgcgattggccatctcggagacggtgtccatgacagtcatgcactcgcggtagtcaaggccgcttgtcggctcatcgaggagcacgacatcgggctccatgacgacgacggaggcaagagcgacgacctggcgctggccacgggagagcgagaacggggattccttctcgggaaggccgaagcgctcgatgacgcggagtgcccgcctctttgcttcctcctcatcaatcccctggagctcgaggccaaaggccacctcatccaagaccgtatccttgcagagctggtagtcggggttctggaagagtgttgcgcagtgggctgcgatgcggcttgtcggaacctccttcgtcgagaggccggagatcctgacctcgcccgaggagggcttcagaaggccgttcaggagcttcgtgagcgtcgtcttgccggcaccgttctggccgacgacggcgaccatctcgccgggatagacgctcatctcgaggtctttcacggtagcgccgccgttggggtactggaagcagacgtcgcggagcttgacaactggctctgccccttctgcatagggcctggctgccacgacgtgcttcgagccctggcggaaggacccctcggccggagcagttctggaagcctcagggatgaggcgctcctcgatggcagcggcctcctccacggtgagacagggcttgccttgaggaagcaggccatcctttgcgaggctgttgtagacgcgggcgacacggggagagtcgacgccgatggagcggagcttctcggcatgggcaaagacctcgcggggcgttccatcgagcaggagcttgccctgatccatcacgaggatgcggtcgcagtacttggagagaagggctaccttctgctcgatcacgacgacggtgacaccctggcgacgcacctcttcgagcgtatcgaagacaagggtcgaggaggcagggtcgagggcggctgtcggctcgtcgagcacaaggacgcgggggtgtagggccaggatggcagcgattgctaccttctgcttctggccgcccgagagcgttgcgatctcgcggtcacgcagatcggtgatgccgacagttgcaagcgtctcttcgatcctgccttcgatctctgtatggggcacgccgaagttctcgaggccgaagagcatctcgtcctcgacgacggaggcgaccatctgcgtatcgatgtcctggaggaccgagcccacaatctgggagatgtccgtgagcgtgatgtcgcaggtatctttcccatccacgagcgtcgcgccgaagagcgtgcccttgaagtggtgggggatggcgccagacatcacggatgcgagcgtggacttgcctgctcccgaaggcccgatgataccgacgaactcgccggtgccgatcgtggccgtgatatgggagagtgccggcttcggagcctctgtgccgtcggatgcggccgaggcgtaggtgaaggagacatccttgagctcgatgatgggctggggcgtattcgtgctttctgccatgctgccctttcttgcttgctgcttcatatatataagtgcatgcatggagcatgccgtggtacagaagagggccgcaggtgctcctgcggccctctctatggtagctgatggaatcctagcggttcaggaccttattcaaggggaaatagagtgcctggacgacgattgcgttgaagacggccgtgccgaggacaagcgggaccttcacggctaccgtggcaagagcagcgcccatgatgagggtgccggcaacagcgaagagggcgccggagagaagtgtcgtcacgaaggcggcaacgagcggggtgacgttcctgccggcgaccttgaggtcgagcttgatgagggcagccatggccagcgcagcgacaagctcggtcacgaagttgaggcccggaatcgaggtcgtgaactggatgacggcagcggagatgaggccgaagatggcagcctgcttgaagtcagccttcgtgagcaggatggcaagggcataggaagcgatgatgaactggggcttgatgccgaccatcgcaagcgagtttccgaccgtgaggttcaggatgaagcctgcggccagaaggacggccagaaggatgagggacgtgacatcggtgccggtgtgtgctgctgcggtgacggtgcgtgcctgggagttcgtgtctgccatgatgtgcttctttctcttgctaactctgtgctctgatcgatgtgctctgatggctgctatggatagatgccttatgcctcgaccttgagtgccttgcagatcgggaagtagagggcctggacaaggattgcgttgaaaatgccggtcgcgaagacgacagggagcatggcagctgcgagctgggcagcagcgccgaccattgcgatgcggatgagcatgaagatgacgccggagacgacggtcgtgacgaaggtgccgatggcaggggtgatcttcttggcggagcccttcatgccagctgcaacgatgacggacatgagcatggcggcaacgccttcagctgcgaagtcgacgaagggtgcggtcgtcgtgatctggatgacggctgcggagatgaggccgatgatgagggcctggccgacgtttgggcggatcacgaggatcgtgaggcagaaggccgagatgatgaactcaggggagatcatgccgccggagacagacgatattgccttgccgaccgtaaagttcaagatgaagcctgccgctagaaggactgcaagaaggacaagtgcgcggacatcgagcttgccgtggtcctcggtggtgatgctacgtgcctgctgggtgtttgctgccatgatgaatcttcctttcgaatggaacttctgaattgcttgctttgcttgcttgatgggattggacagacaaaaagagggccccggtcataccggagccctcaaagattcgcgtatgtataatggcgcgagagactcacgattgaccgatcgtattcacatcgcgccaccaccagttcatattcatgttgtctgcggtgtaggcgatgcgaatcatctctggcgctcctctcaaatcgaatcaatgtccagatttcctggacgtcctgtctgttgcgcacactataagccacagccatcttgggatgcaagcaagattgtgtaaacgctttgtttcacgtagcagggtggacctacggcttcaggagatggagctggcgctccatctgagaggaagagctgaccgctgaaaagaagatgccctgcttgctgggcatgctgggtatatccattcgggatgaatgagaaaggggattcagccatggaacagaagatcctgaagcttctgggagcagtgctcgtcatcttcatcgcaatcgatctggtcttccagatagcagagcagctgggaacgaccgagcgtgccattgcctgctccatcgcgatcgtccttatggcaggctttcccatcatcgtcctgcgggcaatcttcggccccggcacctggatcgtgcgtggcttctggccaatccttacggttcttgtcttctgcttcggcatccctcttgtcattcagggaatgcagggcacgcttgatggcagcgcggcagcagcgcttgtgctgctgccggcgttctttgccattgcagcaagcttcaaggggataggcggaggtcctcagtagcccatggcctgaaggatgaacatgatgactgtgaggatcgtcacggcaatgacgatgaaccaggtcagggcgttccagatgcggccatttgcatgcctgcccatcacatagcggtcagaggctatgagcaccatgcagacaagcaggattggcaggatcacgccgttgatgacctgggagaccatcatgatgccgaaaaggtcgacattcgggatgcagcagatggcagcagaggcaatcgtgatgaccgtgatgatgccgtagtaggcaggagcttccttccagctgcggtctgctccgcgctcccagccgaaggcttcgcagacggcgcttgccgtgatgcctggaagcacacaggcagcaaggaatgacgcgccgacgaggcccagggcaaagaggcctgaagcatactcgcctgcaagcggctcgagcgccttagctgcgtcagctgcggtatcgacggagatgcctgccgggaaaagcaccgttcctgtcgtcatgatgatgaaccaggtcacgatctctgcagcaatggcgccagagatgttgtcggcacgctgggcagtgatgtccgttgcatcgaggttcttctccacgacgttgcttgacaccatgaagatcatgtacggcgagatggtcgtaccgatgtttgcaacgaggagcgagatgtaggaaggatcgttcgatacctggggaatgattgtggcgctgagcgctgctccccagtcaggctttgccaagacgccggagacgatgtaggtgaggaacacggccgaaagggcaaggaggatcttctcgatctttcggtaggagccgccgatcgtgagcatccagcagatgagggcagagaccggcacgcttgcgatgatgggcacattgaagagctgcatgcccgaggcgatgcctgcaaactcggagagcgtgactgcgaagttcgagatgatgagggcaatcatggcaagggcggagatgcggacgccgaactgctcacggatgagggaggcaaagcccttgccggttgcgcatcccatgcgggcagatgtctcctggacgacgatcagaagaaggcacatgagcggcacggtccagagcatgccatagccataggacgcgcccgtcgtggagtaggtggcgatgccgcctgcatcgtttccggcgaaagctgtgaggatgccaggacccatggcacccagtattgcaagggcccctgccttcttcgcgacatcgtggctcttcttgggagctgctgaagacgtctgggacgtggagctggaagagctctgagaagccttgggggcatcagactgcttctgtgccctgggcgcgggagcctgaggcgctgtcggtgcggcagccatgatcttcttttctgccatgcatacgcctccctagattcccatgctcgcgagagcgattgcaaggaagaggacgatggcgacagccatgtagatgatggcaagggtcgtgccggaggtctcgaggttgcgctcgtcgcgggcgcgcaggaccttgagggctatgggcgtcgtcgcgaagcagacaaacgccgcggctgctgctgcagccacgcccttcatcgtgtactgcatcggagcatccatgatgttcgcgatgatggaggtcgcgatgagggccacaaagattgcgatgatgaggccgaggccgacgcccttgaacaccatgccgagcatcgagggagcatcctcgtcgtcggagtcgtactcgaggaagttcttcgtcacgaaggcagcagcgtcgtttcctgcaatgaccgcaaccggcatgcagaaggagacaagcgcgatatcctgccagggcaggcgggtgtggaagacggcagcaaggatggcaacgccgagcatccagacgaagaaccatgcctcgttgcgcatgagccaggcaaggtctcccgtgcgtccttctgctgcggtgtcgttgtggccggcgcctgcaatctgcaggtcctcggcgtgctcttcgttgaggacatccagtgcatcgtcgaccgtgacgttgccgagcaggtgtccctggtcgtccacgactggcatggcaagaaggttgtactttgcgatgtcctctgcgacatcctcctggtcatcatccggattggcggtcttcaggtcctcgatatcggcaatgtccttgaggtggtcctcatccttggccagcagcagggcattgagcgacacggcacccgtgagcttgtcgtccttgtccttgatatagatgtagtggatggtttcgaagtcctcatcgaggttcgagagcacctctacagcgtctgccaccgtatcgttctcgaagaggtccacgacctccgacgtcatgatacggccggctgtatcttccttgtagcccaggagctgacgtactgcgcgctgctccttcacgcccatgaggcgcaggagcttctctgccttgtcgtagtcgagctcgcccacgagctctgctgcatcgtccgggtccatctcggacagcatctgcgatgcgtccgtatcgttcatggaggacatgatgtcggcggcaatcgtgtcatcgtcgaactcggcgatggtgcctgccttctgctcggcatcgagctgggcgaagacctggccacgaaggcgcggatcgaggcgttcgatgatgtcggcgatgtctgccggatgcatgtcgtcgagcgtcttatgcgtgaccgagagcttcacgtcggaaaggtcgcggtccagaaggtccatgtagttccaggcaatgatcttctcggggatggtcttgcccatggccttggcgatcttgagcacagcatgctcgagcttgggggagagcgtgcgcagaaggccgcgagctcccacctcggcgcccagaaggcgcagctgcgaggagttcgtgtcagagagcttcaggtcgtttacgcgcacgacacggacaccacgcgtatcgacgatctgcttgttcaggaggtcgcgtgcaatcagcacctcgtcaggctggaggtagctgaatcggatgtcggtcttgacgaccttcaggcgcacttcgttctcgttatacgtgtcgacatacttgcgccacgagagcatgaacggagtgcggctggggccttcgattgcgagcgaggtgacacgcggaaagacttcacctgtggcaatgcccaaatcgttcacgcggccgatgttttcgccctttgcgtcgtagaccggattgcccaggagttgggacagatagatcataggtgctccttggttcggattgttgtttgggggtaccccgcggcacaactcgcaagaagcaccgaggggtcatcgactgtgaggtcgaggtttcatcaatgaccctttctctgcatatgtgttgcttggcttctggttcatgcccagcgatactcgcattgtactctccaattccgccagattctgtcttgctctttcaagcttgtgtcaagaaacatcgtttgtgcgcatggatagctgctcttgtgcctttctgtggcactgttcgtaatttgaaaaggcaggcaacaagaatgttgcaggttcggcaactgtagatgttgctgacaccatccattcgggtttgctgcctatcataaattggtatcattcggacggttccaggaagcacccaccctgcagatctggagcgcctgttcccggataggcagacatctgggaggtactggttacgtacgtttgatcgagtctcgaagcgggagtccaccagctcccagccgaaaaggaactactccccttgaccgacgctgcccagagatgcccctccgaccgaacatacgtaatcagtgtctgaatagtcctgctctatggcgactgccattctttgtccgccgaatgggcgcattgcttcaagattcttcgttttccagaagctcttccatcgtgcagctgagagcctgtgcgagcgcaagtacgcttcgtgcctgtgcatgggatatgtccttcttcctctgctcatactgctgtatggagcggagcgtgacgccggaagccttggccagtcctgcctgagacaggccacgttcgcgcctgatgcgagcaaggttcgtcgctgtgctctcatgggtctcggggacagagattctctgcacgacctctgccgggggaagctcggcatagtctgcatggagcttgcggagacgctcttctgtgagcgtgcggaagacggcagggaagggaaggcctgtctcccattgatagcggcagacaagctccgcttcccatctgagacgtccggtctcctgcttcgagagcctcttctcgttcatgaggagggtatcgatagagacatcctcattcacatcgagaacgagctcgatagcagatccgccaatctctggatgtgcatcggggcctgtgcaggtagcggcgaccgaagagttcgcgaagcgccgatagaagcctgctgcaccttcgggcaggcatttctctgcgaactcgaacgccttgccaagcgtgctgatgacctgaggcagctccttctcgtcgtatgccttgcctgccatgcaccctccaaaagatgtgtacgaaagatggagaaacggttacggattttgccgttcaccggtaaaacaccgatgaacagatacaaaagagcaggtatctccaaatgttttcagatatatctcttgagagacatagtaccctccgagctgagattctgctgaatctgcagcaccgaacggagctttcttcactctgaatggcacttttccgctcagcggcactccaatttcgataccagacagagcgtgctagcatccggcccatgctgaggctcggttctgctgcaatggggcggcggaacccagacagaaaggagcgagcatggcaacattgcaggtcatcctgatcttcgccatcttcattgcaggcgttgtcctgatgatgacaaagaagctgccggctatcctggcactgcccttgatgggcatcctgattgctgcggttgcaggcgtgccgttcgtatcggctgatgccgatacccagtcaatcacggacttcgtgctctccaagggcgccgtgaagctggcaggcacgatctctgtcacgatctttggcgccatcttcgcgaaggccatccagaaggagggcatctccgacgcaatcatccgcaaggcagcagagcttgcaggcgacaagccgacggccatcgccctcgccctgaccgctgctatcgcgattatcttcactgccatgagtggcgctggcccggtcatcatggtctcccagatcgctatcccgctgttcctctctgctggcatcgagccggtcgtggcagcaagcctcatcctgttcggcctcaatatcggcctgctcttcaacgtctcccagtaccagctctacgtcgataccatcggcatggacatgaacgtgattctctcgacctctgccgtcatgggcgtcatctgcgtcatcgtcacaatcgtctacatcgtcgtgaacacccgctctgccaagaagagcgctgcctgggcagccaaggctccggccaagactgatgtgaatcctgtcgctctcatcatgccgctcgtgcctatcgtgcttgtcttcttcctcaagtggaacgccgagacggcactcctgatctcgatcatcgtgaccgtcctcatcacgaagccgaaggaggctatccaggtcctctcgagctccgtcgtcgagggcatcaaggatgttgccggcgtcgtcggcctcatgatgggcatcggcatccttctgaacggcgtgtctgctactcagacctcctcgctcatgcagccgatcatctctgccatcgtcccgtcgaacccgattgtctacgtgatcctcttcacgatcctctcgccgcttgcgctctaccgtggcccgctcaacatgtatggcctcggctccggccttgcaaagatcatggtcgccgcaggcacgctttctgcttctgctgtgggcatggcgctgcgttcgacctctgtcgtccagtgcgtgtctgacccgaccaacacccagaacgttatcgttgcggattacgcgaacgtcgacgtcaacgatatcctgaagtccacgcttccgtacacgatggtcatggcattcttcatcctgctctatacggcaatcgcactgttctagagtggccgctttcccgggcgcagcagcgcccgggaggctctgattatgcgcgttcggtttatctcgaagcagaaatatcccggtcctcgctcagaggggcggctgcccagagacccccttccaatcgaacgtgcataatcaggaccagaaacgagggaggatacacgctatgggacacagacaggtccgcattggcatcgatgtcggcggaacattcacggacgccgtcgtcgtcgacaacgagacctatgagatcgtcgcgaaggtgaaggttcctacgacccaccatgcaaagcagggtgtggcacagggcatcgtcgatgccatccgcaaggtgctcgacgagggtgccatcgcaccggaagatgtcgtcttcatcgcacacggcacgacccaggcgaccaatgccctcctcgaaggagatgtcgcacgtgtcggcattgtcggtatgggcaagggggctggcgcgggccgcgccggcaccgagacgacagtcggcaatatcgagctggctccgggaaagtatctcgagaccgagcatgagctcatagattccgcgaagcttaccgatgaggcgatggaggctgccatctcggcgttgcgcgaacgtggctgcgaggtcatcgtcgcctccgagtcctattcggtcgacgaccctgccgacgagcaggcagtggtccagaaggctgaggacatgggcatggtcgcgacgggcggctatgagatctcccagctctatggcctggcggcacgtacccgcacggctgccgtcaatgccgccctcatcccgaagatgatggagacggcaaacatgaccgaggatgccgtgaagggctccggcatcgagaagccgctcatgatcatgcgctgtgacggcggcgtcatgtcgatcgacgaggtcaggaagcggccgattttgacgatgctctccggccttgcggcaggtgtggcaggcgcactcatgtacgagaagatcacggatggcatcttcctcgaggcaggcggcacgtcgaccgatatctctgccatcaaggatggcaaggtcatgatcaagaacgcgacagtcggcggccacaagctgtatctgacctcgctcgatgtccgcacgctcggcatcgccggcggctccatgatcaggattgagaacggaaagctcctcgatgtcggtccccgctctgcgcatatcgcggaccttgcctatgaggtgttcacggatgcagacaagatcgtctcgcccgagctcgagctcatcgcgccgcgcgaggacgaccaggctgactatgtggccgtgaagtgtgctgatggcagcaaggtcgcgcttacgctctgcggcgcggcaaacatcctgggctatgtgccagaagacgactatgcacacggagacgtagaagctgcacgcaaggcctggcagcctcttgcggatgcctgcgcaacgacggtggacgatatctgccgacaggtcatggattgtgccatgaagaaggtccaggcaattgtccagggcctcatcgatgactacggtctgaacccgaacctgatctatctcgtcggaggaggcggctccgcatctgtcgtggcacctgccctgggcgagcgcatgggcatccgtcaccgcattgcaaagaacgccccttacatctcgaccatcggtgttgcgctggcgcttgtgcgcgagcagatcgagcgcaacgtgccgaatccttctgaagaggatatccgccgcatcagacatgatgtgcttgaggtcatcacccgagctggtgccaatccggagaccgtggatattacggtggagatcgactcgcagaagaacatcctgcgtgccacggcgaccggagcaaccgagcttcgcacgaaggaccggggctctgctgccaagacggaagacgagctcaggaagatcgtcgccgagtcctcaagcgtcgatgcttcagccgtggaagaagtggcagcgacgggccgctggcatgtgttctgcgccacgaccgtgaagaaggcgttcttcggtctcgtgaagtcaaagaagcaggagatccgtgtcgtggacgaggaaggcgtcatccgcctccagaagaacgatgcgaaggtgctcacgttcacgaaagacgagctcggcggttccttcagcgagttcgtggacagcatgacgctctatacggatgcaggagccacgctgccgaagacctatctcttcttcggccagaagatgagcgacctctcgggtgtcctcaacaaggaacagctcatgggtctggccgagatggagctcgagtttgcgggcgacgatcaggagatcgtcgctgtcgcagccaaggactagcagtggcagccgcttcgtcagaaggcgcctttgccaggcttctccaggaagcctctgtcccagagcttgcgtttctgcagcttgaacaggattcccgtgtgcagaggctccttcctggcgaagccagccgcatcgtttctcaggcgcttggcgcaggcgaggaggcagcgcgagctgcgaatgcggacggaagcgtcatctctgcttcggacttcattgccagtcacggcggaaagcttgtccgggtacgggggcagaaggtgtcggctcctggcatccatcttgcggcgctcacgcaggaggctcgggatggcagcatcgaggtcatgctctttgaagatgcgctcgaagagaagacgggagtcctcgccttcttcgacatgcggggccttgcggtgccagatcttgctgcgctcgaagaactgacgctctggcatgaagccttccatgtcatcgacttcaggcaggatggaaagctttctgcaaaggtgagcacggggaagacaaaggtgctctttggcacaaaggagtgcaggataggctcagctgctgaaatctcagcccacagctttgcctgtacggctctgggaggaaagatgatgctcgacccctggaggtgcgatgctctgtaccttgcaggggtgggagagatcacggaagaggagctggcacttgagcttcaagatgccagaaggctcatggaagaagggagacgggatggagacctataggttcggcgcagaggatatcgaagtccttggaacctgggatacggtcgttgtcggtggcggcacggcaggggcttcctgcgcaatttcggcagccaatggcggcaaccgcacgctcgtcgtggaagcagcgtcatctctcggcggttctccctcccaggcgcttgtgacgccgatgatgccgtcatatgcgcctcacggaaagaaccttcatgagatcgagcggcgcctgaacgaggctggcatcgtgacccgcgaggacggggaccggatgggctacatctggaccacggctgagagctttgcctgcgtgctcgaggatatgctctacgaggcgggaggagaggtgctctacgatgcgccgcttgtccgcgcggatgtgaaggacgggaagatctctgccatcgaggcaatgacagtagaaggacccaaggcaatatgtgctgctcagttcgtggatgctacaggcgatgcggtcctctcgcgccttgcgggcgttccctgccttgcaggagacgatgacgggaacaaccagatgagctcgcttcgcttcgagatgggcggcatcgatgtcgactgctaccgcaggtattgcctgtctcttggcgatgagttcagccctcttgtggatggctatttctgggaatccgccatggttgcaggacgcggcttcaagctcgagccgatcttccagaaaggcgttgaagcaggcatcctggagccgtcagatctggtctactatcagtgcttttcgcttccgggggagccgggatgcatggcattcaactgcccgcatctgcccgacctcaagaagaacagctctgcccttgcaaggagccaggctctgcgtgaaggaaggcagcggattcgccgtctcgtgaagttcctgacggcctatatgccaggcttcgaagatgcctatcttatacgcatcgctcccatgctcggcgtgcgcgagagctggcgcatccagggaagctacgtgctcgatgtggacgattacgtgaagcgtgcgaagttcgatgacgcagttgccaatggcacctggtatatcgatgtgcactccgctaccaaggggctcgtgcatatggagaagtaccagaagggggagtactatcagattccctatcgctgccttacgaacaagacgataagcaacatgctgacagtgggccgctgcatatcgacaagcttcctggtacaggcatccgtcaggatccagcagacggtcatcgatatgggagactctgccggacgtgcctgcgcgaaggccaaaaagcagcatgtgccgctctccgtgctcgatggcacgggattgctggtggctgagtagcccgaattcccgatctatagtgccgcctgttcttcttgtcggagaacgggcggcatatcattttattgactgccatgaggggaaatgcgtgctgcatagcggtagctggatatcggtgcttccgccgtcattccatgcttctgcagctcttctgaggagatatccgtctcatcatcccagacggctttccattctctctcgctgaccccaactcgtcgaagagattcatctgcggatgctctgaaggctggaaggttcgattttggcggatgggcttgacggagctctgctgtgtcgttctggaatccgacaacgagctgcatgtctgacggggactctggatttgcggtgcggcgaaagcttgccttcgtgcaagcctctgcaacgtagggttgcagctactgcgggaaacatctatgagtgtaatagaacaattgtactatacagcaggtgcatgagccgttagaatggaggtacgagagtatagggggtgcgacatggtgctggcaatcagcgaagaaggagtcatttcgccctataaggagctcatggcatacgagtatctgtatgctgtcgaaggaacttcccgaagcaaggtatcgaacctcattcagcgaaatggtgggtttccgagcacggctgctgatgcaatcgacggtatcgttcccgacgaagaaaagcgttccgaagtaattcggtatgtaaagggaaggcttggaacattttctgtcctggtggatggaacaccgcagtttccgcatggtctgagggcacagaagaatccgctcccggtcttctactatcgcggcgatatcaacctgacgcagtcaagatgcatttctgtcgttggcactcgtcataccagcgagcgtggcgagcatgcggcgcatcgcattgctgctgcactcgtccggcatgacttcaccatcgtcgatggacttgcgactggcatagatacggtagtagccaagacagctctggaagcagaaggcagaatcatcggtgtcatcggcacgccgatagatagatattatcctaaggagaatgaggacctgcaggaactggtggctacggagcatctcctaattagccaggtgcccatctatcgctatgatcatcagtcaatcaagacacagcgcttctactttccggagcgcaatataaccatggctgccttgtccgaagctactgtcatcgtggaggcaggcgaaaccagcggaacaaggacgcaggcaagggcgtgcatcgaacagcacaagaagcttattttgctgccctccgttgtcgagcagacaacttgggctgcgaagatggctgaatacggtgcggttctggcgaactcagttgctgatgtgcacactacgatcggatgcaattcagctgactgagattgcagagcacggatgcttgtaccattgggatgagagaggcttatttcagaacggcttgctgcgaggcaagtcttgtaccctgcataagactgtgctaaattctcatggctgcatagggcagagacgctgctctccgaggaaaggaatggagccttgcgcaggtagacactgctcttcatgagcatacgggaattgttcgccaggacacccctgtgtcccctgtccctgtgtctgcgaggtccatcatgcagctttctctttctcatgtgacgtattgctatcccggctccgtcaattctgtcttctctgacatatcctgcacgttttcatctggctggcatgccgttatcggtgccaatggctgcggcaagacaacgcttgcccgcatcatttccggcgagctcgagcctgatgaaggaacagtgaccaggggccttgtgacggccctctgtgcgcaggatgccactgccgaaccagcagatcttgccgacttcgcctgcgactggagccctctggcacagaaggtgcgccgcacgcttgcgatagaggacaactggctctggcgctatgagacgctctcttcaggccagcagaagcgcgtgcagattgcctgcgctcttgcagcagagcctgatgtattgattctggatgagccgaccaaccaccttgatgcaccgtcacgcgagcttctgctggagacgctccgtgatttctccggcataggcctgctgatctcccatgacaggacgcttctcgatgagctggccacctcctgcctctgcttcgaggcaggaggcatcaggatgcggcctggaaactacagtgctgttcgtgagcagcagatgcaggagcatgatgcatcgctccatgcaagggatgcagccagaagggaataccgccgccttgcccaggaacagcagaggcgccgcgaggaggtggaccgttctgctgcaaagcggagcagacgcaatctcgatccccatgaccatgacagccgggagaagatcggccgtgccatcgtctcgggcaaggaccggaaagctgcagacaaggtccgccagctcgaccagcgcatggatggcctcagcaagaaggcaggagcctcggttgcgcagagctatgacggggagctgccagccttgggcgtgcgctcgaagagaaacaccgtggcgcatctggatgcacagacgattcctttcggcgatgcaggatatggactggagattccggagctcttcgtgggaccggacgagcatatagctgtcgtcggatccaatggcgccggcaagtcgacgctcatcaaggcgcttgtggcagaaggcatccctgacggcgtgaaggcagtctatctgccgcaggagctgaaggcagaggagacagaagagctgcttggccgcctgcgcgggcttgaccgcgcagaacagggtgcggtgctctccttggcagcacagctcaatgcagagcctgagagctaccgtacaggcagctcggtcagcccaggcgagctcagaaagcttgccctcgcctttgcggcgctcgacggggcagagctccttgtgctcgatgagccggcaaaccatctcgatgtgcatgccgtggaagcgctcgagcgcttccttgcgggctttgcaggggcgcttgtcctcgtctcccatgaccggcatcttgtcgaggcagtctcttctgccgtctggcgcacggaatctctgccccctgggggagcgaagctccttctttcatagatatgcatacggctattcggctcatgcaggtatcactttggctacaaggcgtttctgtgcaggatggatgggtacagtggagattaaagcaaacggcagaaccatgccggctaaggagtagctatgtataatttcgcgttccatgtacccacgaccatccacttcggcaagggccagatctcgcacctcgcagatcttgcgggatacggcaagaaggtccttctgtgctacggcggcggctccatcaagcgcaatggcatctatgaccaggcaacgaagatcctctccgatgcgggacttgagatcttcgagctttctggtgtcgagccgaacccgcgcatccagactgtgcgccgcggcgtcgacctctgccgcaaggagtctatcgatatggtcctcgcaatcggcggcggctccacgatcgactgcgcaaaggtcgttgcagccggtgcgaagtacgacggcgatgcctgggatctcgtgatccatcctgagctcatcaaggcagcgcttccgatcttctcggtgctcacgcttgctgctacaggctctgagatggatgcctttgccgtcatctcggacatgacaaagaacgagaagtggggaacggctgctgagtgcctgaagccgaccatgtccgtgctcgacccgacctacacgttctcggtcccggcacgccagaccgcagctggcacggcggacatgatgagccacacattcgagaactacttctcgatggatgatggcgcatacgtgcagaagcgcatggcagaggccctgctcaagaccatgatccactatggtccgattgcccttgagaagccggatgactatgatgcccgtgcaaacctcatgtgggctgcaagccatgcaatcaatggccttgtcggcgagggctgcgctcctgcctggtgcgtgcacccgatggagcatgagctttctgccttctacgacatcacccacggtgagggccttgctattcttacgcctgcctggatggagcatgtcctctccgagaagacggagaagcagtttgcgacctatggccgcaatgtctggggccttaccggcaccgacgatgcaccggttgcccgcgaggccatcgcccgcacccgccagttcttcacggagaccatgcacatgccggcaacactccatgaggtgggaatcaccgatgaagagcacttcgatgtgatggcccagaaggcagcagatggctcgaagggctcgttcgtgccgctcacgaaggaagacatcgtcgagatctatcgcgctgcgaagtaatgagaatcatctgatatgcaggaagggagcttgctttcgggcaggctcccttcttgtgaacacctctctaggcaagattcgatgaaggcctatcagcatgggagcaatccgagatagccaagacctcttgcatctgcatctagcctgcatgtcagtgatgcggcgttaagcaagctggctcgggtctgttcgctggcatgcgcctgaatgtctggcatcggaatacccgatttgaatgaatatgtatggtccgatgttgggcagtatatatgatatagaatgtaatgacataaatataaagatgtacatacacgccatttggaaggagcaatgatggcttcatccacacttaccatacgtctcgatgagaatctcaagcatgacgcgtcggaagttgctgaatactatggtctcgatctctcttcggttacgcgtgctttctacaagcagatggtcaacacacaccgcattccgctgacatttgcacctgaagagccgaatgctgaaagcgctgatgccattgcggagggcaatgcatttctggcttccggaaaaccgggcaggttcacggacgctcatagcctcatcgaatcggcgatggagtgatgactcggctcactgttgactattcgaaagcattcagacgagacctcaagaagaaagctggaaggcgcggatgagacctgtctgagcttgagaaggtcagcggccttgttgtcgagaacactcctgacgcgcccgaagagctgagatgtcgccataatatgcatactctctcaggcaattgggaggggcgcaaggagtgccatgtcgcgaatgcagatggctggcttgtcatatggtcatccaacgataaggttgcattctttgagcgaactggaagccatgatgagctgtttggacactaatcgtgagggccgccgaccaataggcgcaccttctcaatctggtacgctgcggagtgacggatattgcaggcatgcggaagggagcttgctttcaggcaggctcccttcttctatatctatctctatcatctgttcttatgcaggcacgatctccacgtggaccgtatctcccggctccttgccgatggccttccgtatgtccttgcggatgccgatgatgtagcagatcgttccgtcatcgttcttcacgcccatgttcacgacgctgccgtcgtaggggacgccgtcgaaggctgcatgcaccttgagacggcccttgccgaagagtgcacggatgtcgtagggaaaggcgacataggcaccacccttctcaggcactgcctggatcgccgcatcataggaaaaggtctgcacgtcaggacctcacgctttcgggtagcgtgagccatgctgtggctacaatctctgcatggtcgaaggcaaggccctggccttttacgttagtcggacggagccttcctgtgacaggcgctgcctgggctgcaaaggatgtctcgagatgggcatctcctgcatcgagcgcaagcgtcgtcctgccagccttctggctcggtgtgaccttgaaccagatggccttggcagcatcgtctcctgcctttgcgatggcgccggtgtcgtcgagggcgcagaaggcataggagattgtccagcctctcgggtctcgtcctggcgtgctgaagaggcccacgggctcgagcgcaagacctgccacatgcgtctcctcttcgagctcgcgtgctgcggcttcgtctgccgtctccttcgggttcacgaagccacccggcgttgcccagcatccgaggaaggggtgtccgccgcgcttcacgagcaggagctcgaggccctcatccttcctccggaagacgcagatatctgccgtgagcgagggccttggatagttcttcggcgaataggcggccaggaactcctcctcggtgaggccgttcttgtcacgcagtggttcagtctccatgctgcctccttgatgcagcagacagaaatcagctttctgcctgagtgatacgcaagtgcctatatacccgtctcagcagaagcagcgtcttgagcgccagattctggtgcctttgcctcctgtttatctttgcatgctgaggtaggctttccttgcagctccatttcagttcttgtcatttggcaggcgatatcgttgggcaccggaacaggagacaagaaggcctccatcctcacgtatttccatgatgagtggaagacgcttctcgtcgtcacgatcacaggcatcctctacaacgttggcatggtcgcaggcccctggctcgagggcctcatggcacagtgcctggcagatatcctccaaggtctctctgatgcctcctcgatgcttcggctctgcctcttctatgtcctggccatcgccttcgtgcagggcatgagggcactcaagcgcctctatgtgcgcaggttcgcaaacgatgtggaccgccgcatgaagaagacgctctaccgcaatctcctttccggcaagattgcaaagaccgaatccgagcgcggcgaggtcatgaccaaggcgctctccgatgtggatgactgcgtcgagggcatgcgcaagttcacgaccgagctcttcgataccggtgtggtcatgatcagctaccttgtcgtgctgtttgcgcaggatgtgcgcatcacgctccttgcactcatctttccgccggtctcctatatcctggcggcacggctcaagggtgtcgtgacaggcgccgtggcaacggcgaagaaggaagtctctgccatgtctgccacggctctcgacagggcagaaggagcgctgacctaccgcatcttcggccttgaagaggtgcgtgaccatctcttcgaggatgagctcacgcgctacgagaaggcagaggccaaggccaatgtgctctctgcatccctgatgccgctctaccaggcagtagcgcttctgggcgtgctgccgatcttcatcctcggtgcccagaacgtcgtctcgggtacctgggatatcgcagtatttacgatgtatgtctccgtgttcctgaagctcgccgtgaagtcctcccatgcagccaagctcttcaatgcggtgcagagagcccaggtctcctggaagcggatcgaaggctacctgtcagagcatgaggaggaaaagtggaaggcagctgagccttccggcatcaggatcgagcacctgggctttggctgggaggggcagaagccgctctttgaggacgtgtcatttgctgtggcgccgggcgagattgtcggtgtctgcggtcctgtcgcctcgggcaagagctgccttgctcgctgcatagcaggagagctccctcatgaaggcacggtcacacctcagggagagggcgtcttctccattctggggcatgaccctgagcttctcgatgccacaatcgaagacaatgtctgcctcggaagcggtgcggatgccgctctggcacttcaggaagcgtgccttgcagatgaggtcaaggctctgcccgaaggggagaagacccttgccgacgaaggcggaagcagactctccggaggccagcggcagcgcttgggtcttgcccgcacgctctgccacaggcgttccgtctgcatcctcgatgaccccttcgcctcgctcgatgctggaactgaggatgaagcattccgcaatcttcagtcctgggccaaggaaggcggcacggccgtcatcctcatatcgcaccgtcttgcgcacttcccggagctctcgcaggtcgtctgcctggcagacgggaaggcttctgtcggcacccatgaagagctcatgaggacgtgtcctgcctaccgtgcgctcttcgagctctcggaaggaggcgaggcatgatggagaaggcatccgagagaaagacgcatccggtacgtgctgtctttgtcacctgcatgagggaacatgcgctcctcacggtggtactcattgccgtgattgtcgcctccatcgtgcttgcgctcctgccgccctatatcctgggcctcatcgtcgatgagctggtggcgaagaatgcctccgtgctcacgcctgcaatcctctatgtcgcagcggtcttcggacagggcctggcaggggcagggcaggaagcagccatcgctatcttcggccagaaggtcacgcataagctgcgctctgccacggcagcaaagctcgacaggcttcctgctgcctatttccatgagcatgacgcaggggcgatctctgcccgcatcgtgaacgatgtggatgcaatcgaggcgctcttcgcctctggcattgtcggcatgatcaccgatgtttttcaggtcataggcatcgtcattgccatcttcctcgaaagcaccggtctcggcatcctggtcctcatcgcgcttcctgtggtggcgctctggacgcgctggatccagaagacgacgagagaggcacggcgcgatgcgcgctctgccatcgcccgcgagagcgcgcagattccagagaccctgcgctgccttcgcatggtgcagctcatgggagccgagcgtttcatggaaggccgctacggcaaggcggtggatgacgggtttgcggcgcagacccgctcgaacttctgcgatgccgtgtactctcctgttgtcatctccctctcctctctggtcattgccctcatgatgtgccttgctggctcgggtggtgcctgggcagcattcttcggtgtcagtgtcggcggcgctgtcacggccatcagctacgtcggcaacgtcttcacgcccatctccgatatcggcatggagatccagtccatccaggatgcaggagctgccatctcccgcatcggagagctcctcgaggctccggaggagaagcttccggaaaagacaggcgcggaagacaggcaagcagctgtcgcactctcgcatgtgaccttcggctacaagaaggatgcaccggtgctcaaggatttctcgcttagcgttgcgccgggcgagcgcgtcaccttgatgggacgcaccggtgctggcaagtccaccgtgctcaatctcgttatgggcctctaccagccggatagcggcacagtctctgtcttcggcgagcctgcgggaagctttgcagcagatgagcgcaggaagactctgggctatgtggagcagggattcaggaggatccagggcacagtcttggacgagctcacgctgggagatccgcgcgtcacagaagagcaggcgaaggcagcgctcgagcacgtcggcctctgggagagcgttcttgccctgccagagggcctggcgacgccctgcacgcagggtacgttctcggaaggccagttccagcttctgggcattgcccgcgccatcgtcttcgatccgccgcttctgctgctcgatgaggtgacatcgcatctcgatccggcaactgaagcgcaggtgctctccgccctcgatgcagcagcggagggcaggaccacgatatcggtctcgcaccgtcttgctgcagcaggccacggcggcaggatcgtccatatcggggaagatgcagactgagcgtggcctctctgtgcgcttcctcatcacgtctttgcagccgcccatcttcgggtacgcttctctctgatggatggaccagcaagggagagacatgccagatttgagacagccccagggcggcacgaagaagcttcacggcatccaggtgcgctcgaaggcagatatagatgcccagaatcagatgatcgaggccaggaaggcccaggaggccgcaaagaaggaacgcgagcgcgagcgtgccaagctcgacaacgcaatcaatccttcagctgcagagcgcggagaggatggctttgccatccccgatcctgagcacatgacgcctgagcagtctcaggagatgctccaggtcttcgcactccagcagatggaccggctccagaaggcggcaggccagttccagcgcgagcactatgagctggcgctcgatacgctcgagcccttgatcacggtgctcgacgacctggctgacaagggccccgatgcagatccttcggtctatgacttcaaggacgaggtcgatatcgagctggcacagctcacggatgcctcattcaggccggatgggtatatgccatcgctcggtgtccaggcgctgggccgggagctcaaggcagactgcctctactacctcgaccgtgccgatgaaggcctcgacacagcgacaaaggcgcttcgctgggatccctggaatgcgcagatccatctgaggcgtgcatctttcctcgatatgaagcgcgacgaggatgagctcgagaaggaactggagcgtacctatcccttgattgcccgcgatatcgatatggcgggctaccacttctaccgcgcgctcaacctgattcacacccagaggattccgctcggcgtcgcacacctcgttgccttcaaggacttcgataccgaccacgaactcgccgatgtggatccgatgcttgcgcagctcgatgaggggctccatcatccgggcgtctttgcaggcatcgactccagggaggcgaagcgccgcctcaggcgtgcaggggagcactacggtccgagcgagaccggcaagtgcgccctcatgcgtgcgctcgagaaggcagttgccacaggccagcgcgacgccgtgcaggacctggcgtcacgctaccggaggctcctgaagacgcagggcgaccatgacaggctcgaagagatcctggcgggcaagaaggtttcggaattctaggaactgcgggaaggcgaggggccttcctggaaggagagggaacatgaaggtcgtgcttctgaacggaagcccgcgtgttcatggcaacacggcgcttgcgctttccgagatggagaagatctttgctgcggaaggcgtcgaggcagaagagattgctgtcggcagcaaggccgtgcgcggatgcatggcatgcggaggatgcgcaaagaccggcaagtgcgtctacgacgacgtcgtgaacgagattgcgccgaagttcgaggaggcagagggcttggtcgtcgccagccctgtctactatgcctcggccaacgcgaccgtcatcgccgtgctcgaccgcctcttcatgagcacgcacttcgacaagcggatgaaggtcggtgccgccatcgccgttgcacgccgtgctggcaccgtggcaacgctcgatgagctctacaagtacttcacgatctccggcatgccagtcgcctcgggcagctactggaccgacgtcttcggccagaagaggggagaggctgctgaggatgaggaaggcatggcagttgcccgaaacctcgcccgcaacatggtcttcctcatgaggtcgatcgagctcggacgcgagcgctatgggcttcctgagcatgagagctaccacatgacgaacatgatccactgagcctgagctccagagatgaagaaggagggtccgctgcagcgcatgcagcggaccctcctgtcattgagccagaggccttgcttctatgcctcgaggaagccgaggaacgtgttggcctgggcctcgagcgcctcttcatcagcagggccgaggacaagcttgccggagccccaggactcgccggagagggcgatgccagcctctccctcttccataacgaggacaccgacgaagcgcaggagcttgtcgagcatctcgcgcatctcggccgtggcggtacggccaccggcaccggagaccgttgccttcttgccggcaatgacgacagagtcgcggccctggcccggaagcggacggctgagccagtcgacgaggttcttgatgtgtcccggataggagccgttgtactgcgggctcacgaaccagatgccatcggcttcgcgcacggcgtcacggatgcgcttgacggattcaggctcagggtcttcgaggtcctggttcatcagaggaaggtcggcatagtcgagacgggagacctctgccttgccctcgaggagcttctcgatcttctctgcaagctgctcgttgaagccgttcttgcggagtgttcccacaacgatcaagatcttcggttctgccatggtgatcattcctttccttcgggccgcattgcggcccctttcttgctatattcccgattctcagagcccgaacgcgtagcttgtcatgctgatcgagccaaggttctggatatggttgaagacttctgcctcctcgccctggactgcgccgaggacggtcacgagcggcaggaagtggtctggcgtcggcacggcgtaggctgcctcagggagcttctcgaagtctatgacagcgtcatcgtcgcgcttcttcacagcctcgaggatcgcatcgtcgaagcggaggttctggggtgtgccatgcgggttttcccagtcggcctcgcgcaggttgtgcacgacattgccggaacccaggacgacaaagcccccatcgcgcagggcgctgagcttctgtccgacctcataggcgtacttggcattcttgaggccattcacggagagctcgaccaccgggatgtctgcctcaggcagcatgtgatggagcggtgtccagacgccgtggtcgatgccccaggtatcatcgacagcgacatcatcgcccagaagctcgagcacgcgctcggtgagctccttcgagccagagggacggtagtggattgcgtagagctcaggcgggaagccgtacatgtcgtttacctggcggggtgtcgggtctgactgcacgagcgtgccgcgcgtgaaccagtgggccgagacggcgaggattgccttcggatggtgtgccttgaggcgctcgccgacagaggccaggccttccgagattgcgtcatgcctgagtgccatcatcgggtcgccgtgtccgatgaagagggcgggctggcgtgtttcggtgctggtcatgctcataagtaccctctcgcttccaggtatcaattctggacttgcttgttgtcctgtactataaatgacactaaagcgatagcaataatgttttttctcgctacctggtatgttttcagatacctatggcagaaaggagatggatatggcacgacagaagccagagcatttcggcacctgccccttcgtgacggcacagtgggtgctccaggggaagtggacgatcgtgatcctgcatcatctgagcgaaaggacgctccggttctcggagctccagagcaggatgccgcagcttacgcactcgacgctctcttcgcagctgaagcagctcgaggcagaagggatggtgaagaggaccgtctatcccgaggtgcctccccgtgtggagtatgagctcacggagcttggccagaccttccagccggtgctcgatgcggtgggcagctggggagagcgttatatagaatatcttgatgcacaggagaagaaggaaggcacgaaggaggacgtgaaatgacaccagagatgcttggctatatcctcattccgtttgctggcacaagcctcggtgcggcgcttgtcttcttcatgaaggacgggctctccgagaggacggagcgcattctcggggctttgcggctggcgtcatggttgcagcttcgttctggagcctcctggccccggcgctcgagcaggcggaagaggcgctcgggagccttgccttcattccctgcgcgataggcttccttctcggcatggccctgcttctcatcctcgatacgctgacacctcacatgcatctcgatggacaggaggagggcgtgaaatctggcctttcccgcacgacgaagctcgtgcttgcggtcacgatccacaacatccctgaaggcatggcggtaggtgtcgtcatggcagcggtcctcgaaggctctgccggcgtcgggcttgcaggcgctgctgccttggcgctgggcatcgctatccagaacttcccggaaggagccatcgtctccatgccgcttcgtgctgaaggcatgagcaaggctaagacgtttgcgctcggcgtcctttccggcgcggtcgagcccattgccgccatcatcaccgtggcagcctcttcggtcatcgtctcggcgatgccggtccttctctcctttgcagcaggcgccatgatgtatgtcgtcgtggaggagctcatcccggagatgagcgaaggggagcattcgaattgggggaccatctcctttgcccttggctttgtcgtcatgatggtcctcgatgtggcgctgggatagaaggggcggaacagcgaaggcagaagctctgacttcttttgtcagcggagtgtaaggtatcggcgagcggcttacgatggatttacgcaatgcgtacaattccattacgtaagccgcttctgcctatatcggagcggacagacgcagtctgtggaggcaacctttgattaccttctcgcagttccttggcatggtctcggccaaccccttcctcgctctcgtgatcatcctcgttctcggcaccatcttcgtgaatggcgcgacggatgccgcgaatgcgattgcagagccggtgggtacacgctcgatcacggtcgagcatgccattgccatgtccgttgcctgcaacttcgtaggcttggtagccatgaccatgatctcgacagccgtggcagacacgatgtccgatatggtcgacttcggcggcgatacccatgcagcgctcatcgccctggctgcagccacggtcggcatcgttgcctggggtgtcggtgcctggatcttcggcatccccacttccgaatcccatgccctgattgcaggactcaccggtgctgccatcgctgtctcgggcggcgtcgaaggcgtcaatttctctgaatgggcgaaggtcatctacggcctcgtgctctcgaccgtgctcggctatcttgcaggctgggccatcgcgaagatcatcccccatgcctgccggcatgcagaccgaagacgggccaacaacttctttggcacgatgcagattgcaggtgcagcgggcgttgccctcatgcacggcgcgcaggatggccagaagttcatgtctacggcaatgcttgccatcgccctctctgcaggcacgagcatctcggaccttggcggcttcccgctctggatcgagatcctctgtgccggcgtcatggcgctcggcacggccgtgggcggcaagcgcatcatcaagaaggtcggcatggagatggtgacgctcgagaagtatcagggctttgccgcttctgtctctgcaacggcctcgctcttcattgccacgctcaccggccttccggtctcgacgacccatacgaagaccgccgcgatcatgggtgccggcgctgccaaggacgtgcgctccgtgaactgggccattgcgaaggacatggtctacacctggctcttcacgttcccgggctgcggcatcatcggctttgtcctcgccaagctcttcctcctgtggttctagacgcgaatccctatctcgaaaggaatggtggcccatggcccgcatgaagaaagaagatccgttctacacgaagctcaaggactttgcggctgcaatcgaggagtgcgcagtcgactacgagaagctgatacgcggctatcccgagacggagatcatgattccgcagatgaagctccatgagtcggaatgcgaccagcgcgtccaggccatcatgaaggagctctatacgtccttcatcacgccgttcgacagaaacgatgtaatggaccttgccctcaagatggacgacgtcgtcgacaacatgaagggcgtctcgacgaggctcgatctcttcaacgtctcccatatgcgctcagaggctgtccagatggcagagctcacgctcatcgctgccaagcagatgcatgagatgatcgaccgccttccgcactacaaggacgatccggaatgcatgcagatagccatctcgatgggacacatcgaggatgagggagattccgtgtacgagaacggcgtgaggaagctcttccaggaagagaaggagtcgagaccaggtcatatcgtgggatggctcaggatattcgaccgcatggaggagtgcctggactccatcgatgcggtggcaggcgttgtccgctccattgtcatgaagtctgcctgatcttctgagacataggaaacgtatcgaggggtgccggaaggtgcccctttctctgttccagacatgcttggtatatgcttgatgacctatggaggcaaggagggcacatgagccgcgtggcagacgagatggacgatctcttcgacgaggaagaaggggagagcctggacgttctcctcatggcagaggatgccgacatctccggccgcgtgtttgcgcgcgagacgctttccggatcctttggccatgcagagttcgagcgctgcacgttccgccaggtctcgtttgcagatacccgctgggcacgggcaagcttcgatggctgcacgttctcgtcctgcgacttcacgggtgcgcatatggcaagaagcttcctgcgtgattgcaggctttctgactgccgcttcacgggagcagacttccatgggtcctatatcgagcgcgtctcgttcagatcgtgccttctgggctatgccaacctctccgagtcgaaggcacagcatgtgaagttcgtctcttccgcactccgggaggcaagcctcgaccatatgaaggcgaagggcctcgcatttgaagatgccgacctcacgcgtgccgagctcttcggcacgagcctcaagggatgcgacctctcatcctccacgatcgacagcatccgcatctccgatacgtttgcagagctcaagggagcttctgtctcgctcggccaggcgccgcttgtccttgcgatcctgggcgtgcgggtgaaagagctctgatctggcaagcggagaaatttcccgaagggctgaattaatcggcagacggttctacgtgcgcatttacgtgcggaaacgattccagcgtgctatcgtggccacgtcggaagctatctgtacaggcggcgatgcctgcctgtttctatcggaaagggatgttgctccatggagaagaagatgcatacccgcaaggtcgtgatcgtcggcgctggccgcgtcggttcgcactgcgcgctctgcctgatgttccgtcacctcgtgaaccagatcgtcctcatcgacgtgaaccgcgaggcagcagaggcccaggccatggacctgcaggatcttgcaagcggcctcggcgagtcgttcgagattcgtgccggagactactccgactgcgccgatgcccatttcgttatcatgactgccggcaggagcaggaagccgggccagacccgtctcgagatgctcggcgccacgatgcaggtcctggatggcatcgtcccccagatccgcgactccggattccagggcatcctgatctccgtctcgaacccgtccgacatcgtcgcagagtacctgtaccgcacgatgaagctgccgcgcggccacgtgttcggcacgggtacggcactcgactctgcccgcctgcgcggcatcatcggccgcgagatcggcgtcgattcgcgccaggtcaatgcgttctgcatgggcgagcacggcgattcgtcgttcatcccgacgtcgcacatctccgtcggcggcatccagctccgcgagtacctgtcgatgaggaaaggcggagagagccagctcgacttcgacgatatcaagaagcaggtcaaggaggccggcagccgcatcgtgaagggcaagggctgcacggagttcggcatcgcctccatcgtgagccagatcatcatgtcaatcctgcacaacgagcgtgccgtcatccctctttcggctcacctcgaaggcgagtacggcgagtccggcatctcgatcggcgtgccctgcatcctgtctgaccagggcgtcgagcaggtgctcgagatcgacctcacctacgatgagcgccgtgccatgaggagaagctgcgacatcgtccgcgagaatctcgacaaggtgttccccgaagcctgagggaggcacaaggaagagcgggagggcttccggcatctgccgggagccctcttcatgatgtggaggaagctcttctgtttgcgaggatgattcctgctgcaatcaggacaagggcaagcgccgttgcagggccgacaggcgtgccctcgctgccgatcgtcgcgagcgagagcgcgacgccgaagacaggaatcaggaactggtagggcgcgatgcgggagatatcgttgtccctgagaagaaggctccacgaagagaagccgacagcagataccaccgcaagccagacaaggaccgcaagctctgcgaaggtggctatctcgagcctgccgccgaggatgagccccgccgccagaaggcaggctccgcccagcatgaactggaggccgcagagcttgagggggtcctctgactgtgccttcttcctcatgagcgcggtcgctgctgcacctgcgacggaggaggcaagcatcagggtctcgccccagccgaagcggctggactgtccgatgcctccggtcgcgaccaggaggccggcaaagccgcagagacagcccagggccttgttcagggtcatcttctccagacggaagacgaagcaggaggccagaagcatcatgaagacgcctgcacccgacgcgatggagcccgagacgcctgttgcatgggcaaggccgacatatcccagaagctgctgggcgaagacctggaaaaatccgatctgggcagcagcgcgaagctcggccggggtggcgtgccagctgccggtccttgcgccctggaggacatagacgatgatgccgcccaggacaaagcgcggtccggcaaagacgagctggtccgcaacgtcggcagaggagatgccgaggagcgcatagccgatgcggatcgcaggaatcgcagatccccagagggcacagctgaggactgcaagggcagagacggcataggcagaggagagcctctttctgtccgagacactcatcctcggctcctgagagtggaggcgaaggcggaaagctcgtcagcatcctccatcttcgtagcccagctcgtgacgaatcggatgatgcgcctgccatcggggagcacggagatggtctcggcgccgcaggcaccgcggaaggcaagctcttctgcttctgtcacatagaagaagagctggttcgaatcgtgtccgccatagggctcgaagccgagcccggagaggccttcgaagagccgctctgcgcaggcatttgcctgccgtgcatagcggagccagggaaggtcgccatccgcgtccggcgtgaaggcgcgctcgaactggacgcccagaagccttccttttgccatgaggccgccgcgctccttctggacataggggaacgcttccttgaggcgttcgtccgtgaagaccagcgcctctccgaacaggagcccatctttcgtgccgccaagcgtgaaggcggccgcgcgcttcgcgatgtcttcgagcgcaaggtccgcgtcccgggcttcgagggcgcttgcaagacgggctccgtccacatagatcgggatatcatgggcatctgcccagtctgccagcgcaaagaagcgctcgtgggaccagacgccgccgatctcggtcgtgtcggcgatgtagatgagcgccggctttgtcatgtgcctgccgccagccatctggcgcccatagacacgctcagccgcatcgggggagacgaagccatccgtatcgtcagtgagcaggatcgtcctgccggctgctgcgacagctccggtctcatgtgtcgcgatgtgggcaagcggggtcgcaatgacgccttcccagtcgcggagcatgcctgcgattgcaatgaggttcacggaagtgccgccggcacagaactcgaccgcagcatcgggaaggccgaccgctttgcggatgagcgcgcgggcacgctcgcagtggatatctccttccgtgtagccggggcactgctcctcgttcgtgtcgatcagggcctggagcacctctggggcagcaccttccgaatagtcgttcctgaacatgcgcatggaaagatccttcctgtcgttttggctatcgtagcaggacagctgcggaaaatggcggaacctgcgtggccatgaggaacttgatggcagggcactgagatgtaggcgacgtgccgtctttgtttcagagctgttccacctaccgccacattatggttacggttgtagactcttcacacaatcggagccgggcaagaagggctggctcccgagtcgattgcgtgaggagcgtgtcatggttcagaagaaggatatcgactggcagagccttggctttgcatatcagccgaccgattacagctacgtctcgaactataaggatggtgcctgggacgagggcggccttacccctgaccacactgtcacgctttccgagtgcgccggccttctgcactattgccaggaggtcttcgagggcctcaaggcctatacgaccaaggatggccgtgtcgtctgcttccgtcccgatcagaacgcccaccgcatgcacgattccgcagagcgcatcgtgatgccgccgttccctgaggaccgtttcgtcgaggcagtcgacgaggtcgtccgtgccaatgcagcctgggtgccgcctttcggcacgggcgcaacgctctatatccgcccgctcatgttcgctacgggcgacgtcatcggcgtcaagcctgctgacgagtaccagttccgcatcctcgtgacgccggtcggcgcttactacaagggcggcgtgaagccggtcaaggtgcaggtctccgagtacgaccgtgcagcaccccacggcaccggcaacatcaaggctggcctgaactacgctatgtcgctctatccgtctgtcctggcgcacaaggcaggctatgcggacaacatgttcctggatccccagacccgcacctacgtcgaggagtccggcggcgcgaacttcctgttcgtcgacaaggagggcacgctcgtcgttccgaagagcgccacgaactccatcctgccgtccatcacccgccgctcgctcgttgatgtggctgagcactacctcggcatgaaggttgtccagcgccaggtgcgcttcgacgagatcggcagcttcgtcgagtgcggcatgtgcggcaccgcagctgtcatctcgccggtgggcgaggtcgacaacggcgacgagaagatcgtctacggcatggaccacgtcggccctgtcatgaagaagctccgcgagacgctcaccggcatccagtccggcgagatcgaggacaagttcggctgggtccacgagatcaaggtcgactagcttcaggattcacggcactttcgggcgctctgctacggcagggcgccttttcgtatgtgtccaggccctttctgttccggctatgccaaactgccctgattcgtcgcgcttccaggctgaaaagtgccatacagttgagggacctaaggcaccctacgaaggagaggtctggcaatgagcagcttcatcaaggaattcagggagttcgtgtcccgcggcaatgtgatggacatggcagtcggcatcatcatcggcggcgcattcacgaacatcgtgacatcgctctgcacgaacatcatcaatcctctgatctccttcatctccggcggcggcgccgaggtcacaggcctcgtcgtgccgggcacctccatcgacttcggtgccttcatcacggctgtcatcaacttcttcatcgtcgccttcatcgtcttctgcatggtcaaggccatgaaccgcttcaaggaggcagaggacaagctcttccacacgaaggaggaagaggtcgagaagaaggcaccgaagtgcccgcactgcctcgaggaggtcaaggaaggcgccacgaggtgcccgcactgcggcggcgagattccgggcggcgcgcacgccgagtaaggaaagacacttatcgaaccggtcgatgcctgtctcctctgtggggcaggcatcgtgcatgatgggggaatgaggcgaaagcgctatactttcgctcacggccgtggaaggcaggaagcaggagctcctctgtttgtggccacggctgagagcatgcttcagcatgcaggaaggagcctttgatggcacagaagattcagggtaccgaggacctctatggcggatacatgcgcagctggcagcatatgcaggatgtcgcacgcgacctcttcggcacctatggcttcgatatgatcgagacgcctgccattgagcaggtcgatacctttgtccacggcatcggcgagtcgacggatgtcgtgcgcaaggagatgttccgcgtcgtctcgggcgccctcttcgagaacctgctcgaggcaggcacggagaagggactcaagccgaagcagcgcatggccatgaggccggaaggcacggcaggcgtcgtgcgtgccgcggtggagaacaacttcgtgccgcagggagcggcgcctgcgaagctctggtatgccgaggcgatgttccgtggcgagcgtccgcagaagggacgcctgcgccagttccaccaggtcggtgtcgaatggctcggcgcggcagatcctgcagccgatgccgagtgcatcatcatgctcatggagttctacaagcgtctcggcttcgatccatcgaagctcaggctctcgatcaactcgatgggcgatgcagcctgccgtcctgcctaccgcgagaaggtgcgccagttcatctatgaccacaaggacgagatgtgcgaggactgcctcgagcgtgccgacatcaacccgctcaggagcttcgactgcaagaacgaccactgccgtgaggtcatgaagtccgcaccgctcgtgacagacaacctctgcgacgactgccgcgagcactacgagaaggtcaagaagtacctcgacgaggcaggagttgcctacgtcgaggatccgacgctcgtgcgcggccttgactactatacgcgcacggtcttcgaggtcgaggcgaccgatgccggcgtcggcgctatcggtggcggcggccgctatgatggcctcatggagctcgaaggcggaaagccgacaccgggcatcggctttgccgtgggcttcgagcgcatcgcgcttgcgcttgctgcccagggcagcacgctcgagacgccggagcctgaatgcatctatgtggcaggcacgtcggcagaggagcgcgaggctgtcttcaaggcgacgctcgccttgaggaacgccggtgtccgtgcggaggctgactaccagggacgctcgctcaagagccagttcaagcaggcagacaagctccatgcacgtctctgcgtcgttatcggtccggacgaggtcgcagcaggcgaggcgacgctgcgcgatatggatacgcatgagcaggtgcaggtgcctttcgaagatctggctggcgctgtgaaggcccgtctcgcctaaaagagagaagcagcatcttgatgctcccgctggcaggtgccggcgggagctttcttgtgccaagacaggatgagcaagcgttttccgcaagcggttttgattgccaagaggatggcttccctgcgtccactctgctataaaaaaggagcagatccgacgcgattcagaaagggcacgcatgcatatccccgaaaactatctgagcccctcgacctgcggcgtgcttgccgctgccatggtccccgtctgggtccatgccacaaggcgcgtgcgcgagaccgtgccgaagaacaagatgcctcttctgggcctcgctgctgccttcagcttcctcgcgatgatgttcaatgtgccgattcccggaggcacgacagggcacgccgtctgcggcaccctgatcgcgatactctttggcccctgggcagcgacgatttcgctctcggttgcgctcgcgctccaggccatccttttcggcgatggcgggattctggcattcggcgcgaactgcttcaacatggccttcgtcctgccgcaggtggggtatggcatctatacctggctcatgcaccggaagaaggatgcgtcctcgttgagatccgagcttgtggctgcaggcattgcctcctacgtcgcaatcaatgcggcggcgctctcagctggcatcgagttcggcatccagcccctcctcttcacggatgcggcaggcaatgcgctcttctgcccctatccgctctgggtctcggtcccggcgatgcttgcagggcacctcaccgtggcgggcgctgcagaggccatcttcacggtcggcatcctggcctacgtgaggaaggctgctccttccttcggaatagaagggctcggtgcgaccggcaaggatgcctcccgctcgagcagggcgatggctgccttgatgtgcgccttgatcgttcttgtccctgtgggccttctggccgaaggcgatgcctggggagagtgggcacctgaggacgtgagcgcagcggtcggctatgcgcctcaaggcctttcctctggctggatgtgggaggcgctcattccggactattcgttcggcgcgcttccggattgggctggctatgtcctttctgctgtgattggcaccgctgtgctcgtgatcgtgttccgccttttcgccgcaggaggaaagcagaaggtcgattttggcacgcgatagggaggatgcgcaggagctgcccgagtggctgctcgcagatgagcgctacgtgccggcagctgaccgggattcattcatacgaaagagcatggaggcagtcgcaggggtgctggcacgcctgaggcttgatggaggcaggccctgggcactctcgccatctgctcccgtgaagctcgtgctcggccttcttgcgatcgtcctcggctcctgcgccacgaatttcgcgttcacgctcctgcttcttgctgtcgcgctcgtgcgcatggcactgcttccgcagaaggcgcttgcacgctgtgccaagactgcagcaggggcagccatcctgagcggcctcctgatgcttcctgccatccttctggggcaggcaagctcggcgcttctcatcggcacgaaggtcttcgtctcggtctcgattgcgatgatcgtggcgctctcgacgccgctctccgagcttaccggggcgcttcgtgccttccatgtgccgaatgtcttcatcctgactgtcgagctggcattgaagagcatctatgacctcggacagacggcgctcgaggtgctcggatctttgaagatgcgaagcgttggcaggaaccacgagaagggaagcgccctgggcggagtcggcggcgtcgtgctcctgaaggcgcagcgggcagcgaagacgacctcggatgccatgcgctgccgcggcttcgagggggactatatcgtgcccgacacgctcgcattccgtccggccgatgcgctctgggcggcgggtgccatcctgcttgtggcggctttccttgtgctggaaggcgtcctctaggccgtctggtcctctgcgttcttgaaatagtcggggaaggcagagaggacctcttccttttcgtcgagcatcacatggagatggtgctcgacgaggtaggctgcctcttcgggatcgtggcgctcgagggcgccaaggagctgctcgtgctcgtccaggatggattgccagccgaggccgcgcgccttcacatggagccagcggaagcggtcgaggtcgacagcgccgcgcgcaagccaggcccactcgtaggtcctgccggcaatcgtatagatcgcttcgtgcatctcgttgtccgcatcgaagaaggccctctggtcatggctcctgacggctgccttctgagcttcgatcgtgtcgcgcatgcccgagaggctctcttccgtgcagcgtgctgctgcctcgcgcacgacgggacgctcgatattgaggcgcaggaaatgggcactcttggccgcatccatatcgatgagggagacatagctgccgctcttggccttcgtatagacaaggccttcctgctgcaggcgcacgatagcctcgcgtaccggagttctgccgacgccgaaggtctcgcgcacatccttggcagagaggcgctgcccaggaagatactcgaactcgatgatgccgcgcttcaggcgctcatatgcctcgtcctgctgcttgtcgggaagctcggccgcttcctggccttcctgcatctgctctgtcgtccctgccatggatggaatctcctctcgtacctttctcggctagcataccacgcaaactagcatccaagaaatagagagagctgcatctgtcggccaaacggcggcattcgggcaattacttgtgcgtcagcaggaaagacgtggactgcagctgaggcagctcctgaatatccgttcgcatagatttcctccatctggcaagatttcctctatacaacggataactaacatgctagatttggaatcgttgagagagacagaaccgcaggagcccagaggggcaggcggatctgtgccggaaaggatggatcatgaagcttgagggcaaggttctgaccttcggagagatcatgatgaggctgtcgcctcccgatcatctgcgccttgagcaggcaaattcgttcgatgtgcggtacggcggggcagaggcgaacgtcgcgttctctctggcatatcagaaggatgatgcagcattcgtctccatcgtgccggaaagccgcatcggcgactgcgcattgaggagcctttctgcctacggcgtcgacgtgagccgcgtcgtgcgcaagggcgaccgtctcggcagctacttcttcgagatcggcgcttccgagcgctcgaatggctgcgtctatgaccgcaagtactccgcgatgaatctcggatcccacacggacttcgactgggacgagatcctcgacggcgtcagcgtcttctatgtgagcggcgtcacgccggctgtgtgcccggagatggcagaggctgcctatgaggcattggcggctgcaaggaagcacggcatcgtgaccgtcgccgacctcaactaccgcaagctctggacgccggacgaggcaaagaagttctggaagcgtgcccttccgctcgtcgatatctgcatcgcaaacgacgaggatgccccttcctgccttggcatctcctatggctcgggctcccttgccacgggcatcgaggagaaggatgcctacgtccagattgcagacgagcttgtccgcacctacggcgtcaagatggtcgcttccgtcatccgcgacatccgctccgtcgaggactccgactggatgggcatgatctatgcagacgggaaggcgcacttctcttcggtgcatcacatgcatgtgctcgagggggtcgctggaggcgatgccttcgcagcaggcctcatccacgccctgcttcacaggatggactacgatgcagctgcatcctacgcgattgccgcatccgtcctgaagctcacggtcaagggcgattcgaacttcgccacggcagaggatatcgcagcggtagctgcaaagggtgcaggcctcagggtcagccgctagaaaacaagtgaggagacggatatgtcttacatggattctttctacgagaatgtcgagaagatgggtgtcgtgcctgtcgtcgtgctggacaaggcagaggacgcaaagccgcttgctgaggtcctcgtcgagggcggccttccttctgccgaggtgacgttccgcacggacgccgccgccgagtcgatcaagatcatggcagacgagtgccctgacatcatggccggtgccggcaccgtcctcacggtcgagcaggcaaagcgcgctgtcgatgcaggtgccaagttcatcgtctcgccgggctacaacatggacgtcgtcgagtggtgcctcgacaacaaggttccgaccatcccggcaggcgtcaccccgaccgaggtcaccgctcttgtgaacaagggcctcgaggtcacgaagttcttcccggctgcccagtatggcggccttgccacgatcaaggcgcttgcctccgtctttgtgggccataggttcatgccgacaggaggcgtgaacgcccagaacctcgcagcctatctcgcagatcctgccatcatcgcctgcggcggcacctggatggtcaagccccagatgatccgcgagcaccgcttcgacgagatgctcgccctcacgaaggaagcggccgagatcgtccgctccacccgcgcatagcccctcttcctggcttcctcctttcccccaggaagagccgtacaagctttgaaggcgccctccggactgattgcatccggagggcgccttcatgtgcatagaaggaggatcggctgaggcaataggctttcgtgcctggaaaggatttctggaggcagaggcgatgccctggcccttgaagagcctgcttcatcctgtctgctcctgctcgtctcggagagggggagagcaggcctgctcctgccagctctcctgttccaggagaggatgggagccgagatggagttcccctctgcaaggcaggggcgtgaaagcaatgcagcctccccggacgtgccggagaggccgcaggcaatagatgctctggctaggacatgctaggcagcaagcggaagctgtgcaggctgtgcgacgtcgtccgtcgtgaggccaaggagctggcctggcgtcttcttcacgaagctcttgtcgtggtgcaccgcataggagatgaggagcgtccagagcggcaggaggtagaggaagcaggcaaagacgaccgaggtcgaaggggcaccgatgaaggagagcacagccacgcaggagaggctccaggggatgatgccggcaaggacgaccgcgctgttctcgaggtcgagggcaagtgcggtgccggtgccctcggtcgggcggcagatctggtcggtcagcatgatcgagagcgtctggttgcaggccatgcagttcgcgatgaagctcgttacgaggacgccgaggaagggcgtcgagcgcttcgagagctcccagaccttcgagcagacgccacgcagaagccccgtcccatcgaagatgcccgagtaggtcgagctcacaaggatgatcgaagcgacgttcatcattgacagcacccctccgccatcaagcatcgaggcgatcgtgcggtccgtcgacgtatagccgaagatgaggaggcctggaagatcctgaggtgccacgccctggacagcgacgcagacgatgcaggcaagcacgagcgatgcaagcatcgtcttcttgacgggaacgcgcgtgagcgagaggacgacgattgcaagggcaggaatggcaaggacccagcccatgtggaacgagcgggagaagatggatgccatctgcggcatcgaggaggcgtgctgcgtcgtgaagccgaaggctgcatagatgagacaggtgagcgcgaagggcacggcagctgtctttgccatcctgagcacgttcttcgtgacttcggtcttcgtgaggccggcaacgaggagggcagagccgctcatcggactcatgcggtcgccgaagaaggagccggcaaggattgcgccgcctgcgaggaccttgtctgcacccattgccgatgcgatcgtcatgcagatgacgcccatcgtcgcagcggtgccggtcgaggtgcccatgagggtggacatgaggcagcaggcaaggaaggtcatgaggatgaagatgccaggggtcatgaggcttgcgcagacgctcacggtataggggatcgtgcccgaagccctccaggctgcgcacatcatgccgacgatgaggtagaggatgaggacatcgcggacggacttcatgccgcttcctgccatgtgcgcaacctcgcgcaaactatgtccctgcttcagcgcatagccagagaagagggcaaagcccgctacgaggatccagacgatgggcacgccggcggcaatgcctgcgacaagcatcgcggcaaagacggcgagtacgatggattctgtcatggcggaccttcctggattgcaatggttcttctctgagtgcgttttgcaggatagggcccttgaaacaatgagtccaactgttatattcagttatgaatacaaagaaatcttgtaactcgacagttcctttgtttcaggcacgtttccgcaggtcatagacagtacggatcgggaatgtcggaaacaggacgcatggaatgggctgctgtctgcatagagagaaggagactctgtgaacttctccacgatgagctatttcatagcgctcgccgaagagcgcagcttcacgaaggcctcctcgcgtctgggcatcacccagcagacgctctcggcccatatcgcaaatgtcgagcatgagctcggcgtccgtctcatcatccgcaaggtgccgctcgagctcacctatgcaggcgaggtcttcttgggctatgcccgcaggatgcaggacctcgagcgatcgatgcagcaggagttccaggacatcgcaggagatgagcgaggccttcttcgtgtcggcatcgcctcgacccgctcccatttcatcatgccccgctcgatcgctgcctaccagcgcaggcgccccggcatcgaggtggatctcgtcgaggaggagaacgaggagctcatcgagagccttcaggcaggccagctcgacctcatcgtcgcgaccgtgccgaaggacatccccggcctcgcggtacatgacctgtacaaggaggaggtcgtgctcgtcgtcgcgaaggagctgctctcaaggctcttcgggggacatatggatgaagtcgtggccgaagtggagcgcaagggcacgctcgagcctctcgccgactgcccattcctgctcttgggcaagcgcgacattccgggagatctggcacgccaggccttccgcgagtcgggcatcacgccgacgatccaggtcacctcgtccaatacagagaccctgctcgacctctgtgcgaagggggcaggtgccttcttctgcccgaggaggctcgtcttctcctctctttcagaggaggagcagacgcaggtccggctcatccatctcggagacaaggcgctctactggatcaacgttgcctggaggaacgcagatcatatctggagcgcgaccgaagccttctacaggacgctcgccgaagaagtgggagagatgcaccatgagggataaggatatgcgtccgtaccatatcgccgaggctgatgacgcaagggtctcattcgttgtggatgcggacgtgacagcagatgcgctcctcgaggctgccggcgtctcgaagacgcagaggaaggagatctttgaggagaggcgcctctcgagagatgccgggccgctcaggccagcagatgctctggatgcaggagatctggtcgagcttgtcctcaggaaggacgcagcagaaggtcccgatgcgccggatgcagcagcgtgtgctgccgatatccttttcgaggatgcattcctgctctgtgccgacaagccttctggcatcctcgtgcattcggatgggacaggcggcaagacggatacgctcgcagcacgcgtcaggaagcatcttctcgaggaaggcaggagcacctctgcccaggccgtgcagcggctcgatgaggatacgacaggatgcgtcctcttctcgcttgccccggagtttcagggaggcctggacacgctcgtcgcaggacatgcaatggagaagctctatctggcctgcgtgcggggatctttgcctgaagggccgcatgtgattgcagcgcctctcgggcgcgaccgccacgatgcaagacgcatgcgcgtctctccttccggcaaggatgcgaagaccacggtctgggggctcattcggaagggcggcctcacgcttgccctcgtctcgctcggcacgggccggaagcaccagatccgcgtgcatctggcatccgagggacacccgatcctgggggatgcgctctacgggacgaggggagggcctgctgtgcctggatacgaccttctgccgaagggcgggcatgagcgctacagcctccagctccactgctggcgggagtcattcgtgcaccccgtgacaggggagaaaatctctgtcacggcacccgtgccggagagcttctgccagcttttcggcgggcgcgagatcgagcgtgcgcttgcagcctgggagtcgcggaagcgctgaggcgccaagctggaaagtgcaggttttcgcaccctcgagcacgccatatctgccagagttcggtagacttggaaacagggaagcaacgtaaatctgttccaatgctcggagaggggcattcatggctgacaccatgcgtggcgtctatacgaacctgacggcaatccgccggtccgtattccgcgaagtagcaaaagtcatctacgacaacggcaggaatccgaactggacgcttgccgacttcgacaaggcattcgaggagctgccgtacaagatcattccgggagacgtggccacctaccgcgagtccgtgttcctcgagcgcgccatcgtctcggagcgcatccgtctggctgcaggcctttcgctccagggcgtcgacaggccggcgcatatctcggagggccttgctgacgccgcaggtcctgagcactactacgagccgcctctgatcaacgtgatcaagttcgcctgcaatgcctgcaaggacaacatctacgaggtcacgaacatgtgccagggctgccttgcgcacccctgccgcgagatctgcccgaagaaggccatctccttcaaggacaagaaggccttcatcgaccaggacctctgcatccactgcggcatgtgcgcccgcacctgcccgtatcatgccatctatcactacgtgcgcccgtgcgctgacgcctgcggcatgcatgccatcggctccgatgcacagggacacgcagagatcgaccaggacaagtgcgttgcctgcggccagtgcctcatcaactgcccgttcggcgctatcgcagacaagtcccagatcgtccaggtcgccatgtccatcctggcaggccaggaggtcatcgcaatcgtcgctcctgccttcgtcggccagttcggcggcaagggcaatgtcggcaagctccgcgaggccttcaagctcctcggcttctccggcgtcgaggaggtcgcactcggtgccgacctgtgctcggtccaggaggcagaggacttcctcgaggaggtgcctgacaagcttccgttcatgggcacgtcgtgctgcccggcctggagctcgatggcaaagaaggagttcccgaagtacgctgactgcatctcgatggcactgacgccgatgacattgacggcacgtatggtgcgctcccagcatccgaacgccaagatcgtcttcgtgggaccgtgctccgcaaagaagctcgaggccatgcgccgctccgtgcgctccgaggtcgatttcgtcctcacgttcgaggagatggccggcatgatggaggcacgtggcatcgactacctcgcacttgccgacgacaacaagtccgacttcgatgtcgcatccacggatggcaggaacttcgctgtcgcaggcggcgtcgcgaatgctgtcgtgaatgtgatcaagcgcgaccatcctgatgtcgaggtcaagacggcccaggccggcggcctcgaggagtgccgcaagatgatgaaggacgccgtcaagggcaagtatcagggatacctgctcgagggcatggcatgcccgggcggctgcgtcgcaggcgccggtaccctcgtcgcgatcaacaagtcggcagcagccgtgcaccgctatgcggcccgctcgccgcacaagaacgcggtcgacaacgagttccgtggcctcatccacgacctcgagtacgcagatgacggcgtgcatccggaagatctgccgacggcaccgaaggccgagtagcacctgatgcttcgaagggcgccctccggaaggaaggcgccctttctcatgagacgatggcatgaaaaagcaggcctgccatctggcgggccctgctgcatgtcttgggtctggagtgtctacccttgtctcccttgatggaggcatagaacgtggcgccggtcgaagacgtcc

SEQ ID NO: 44 - DNA, 13686 bp, Unknown
  Metagenome-assembled genome
cttcaaacgctccatgacttcgtggaccggtcgacctctcaggcaaaccgccgcgtcgtcgaggcgctgatcaagagcggtgccttcgactcgacgggctacacgagcgccagctcatgcacttcgtggacaagaacaatcccttggaacatcacgactctgccgcaaagcgccagagggaccgcgccgctggccagtcctcgttcttcgacatgttctcggaggttgagggctctggcttcgaggatgaggtgccggcgcctgatggcatcgagtgggaccgccgcacgcaagcttgcaaggaatacgaagtcctcggcatctatgtctccgaccctccgctgccccgtacgtagtacgcgctctcgaaggccgcgactacaagatttccgacccgaagtctccgaagagtcacgaacagctataccgcgccacctcgacgcgctacctcgtcgaggaaggcaagtcaatccgcctgccgcatggtgacagccgcgcagaagaagacgacgaagaccggcaagtccatggcgatcgggacgcttgccacatggaggcagaggaccaccatcgtcatcttcccgaagctcttcgaggatggcgcagaggccctgcgaggagaggtcgacgaggagaacaggcgagaccgtcggcgtgtcttcatccagtgcggcggcaagctcgagcgcttccgatgagggcgaccaggtcattgcccatagcgtagagccgctcatcctgaacgatgcgacgaaacgtccgaaggtgctcgaaggtgaacctgccgaaatcgatgctctgcgcgggcacatgagacgctcgactcgatgcttgttccgctatcctgccggcctcgaccatgtggagctcagggtggggcgacgacaggcgacattctctgcttcgacttcctgccaaggtcgatgcaccaacatggtgcttctcgcgaagtctcgagattttcttggacatgacggaaaagtgatagtacttagaaaataggctatactcctgtttagaagcccgaaaggcgggaacaaagagactaagtcacgtcccaaagagagggaatacatcatgagtgaagtcacgttctatcgctgccaacaaggcgcaacctgtcgctgtcgtcatgagggtgcctgcacaccccgtgctgcggccagctgatgagagctcgtgccgctccaccgatgctgcccccgagaagagtttccggtcgcagttgaggagggcgcagatgtgaagtgtcaccgtcggctcgtcgagcacccgatgctcgaggaccactcgatcacgtggatcgctcttgccagggcgaccgtgtcgagatccatcacctcatccgggcgagaagccggaacgtcttcggcttccgtggcaagcccggcgacggtcacggtactgcaaccccacggcctttggaagtgcgagctctagcgctactattctggcaagaccttttgtttcgagcagtatgggccccggcgcaaggcccgggcctttttttttggatggtgcacatgaagattgccatagcccagatgtcttcggtggcgggcgatttcgaggtgacggccaagcgcatggccgaaagcgcgaagaaggcagccgatgcaggtgcccgcctcgtctctttccgtatgcgtgtgacaggcccctctcctgagagagcgatatcgaggcatgtgggggatgcggcagagacgctgcgccgtctggccgacgatatccctgtgctgcgatcgtgccggtcgtggcaggaaccggcaccggtctgccgccgaagccttcctgatagacggtgggagcttgtctctgcgcatgggtgccatgacgcatcgtgagcgcgcttgccagctcggggcagcttccccaggcaggcagcatgccggccaccgatcttcccgagttttcgagctcgcggcacgcatatcggcgtcgcctcacctacgacgatccgacgactaccgacgactacacttctcgctcgatgtctgctctaccttccgcaggatggctatgttgccagagatcccgactcggcgctttcgctctctcttgcggagaaaccgctttgcaaaggatgcgaagagatcggctgctggcttgcctgcgccgactctgtcgcgctatgggcctcagctctttgccgcggaagcttcgtgctcgatgcagaagggcgtctccaggcgaaggcaccgcttctcgaggagagccttcttgtcttcgatacggaagacaaggctgaagggatgcctgcggcagagcctccatccgggcatccgggagaagaccatgtgctctgggggcttctcgtgcgtggacttgccgatcttgtccatgcagaaggggaggacaaggtcgcgctggcgctcgacggaagccttgcctcagggcttctcgctgcgcttgcctgcgatgctttgggcccccgcaaggtcgaggccctcgtcgtggacgaagctcagctgccgcagagcttgcgaccggctccacatcgagacaaggatgcctgatttccgcctgcccgtgccgcagccgggtgccgggcccggagtcgcctctgctcctcaagggtgtcgaggcagccttcctggcggagcttgcccgccaggagcatgcgcttgtgctcgtgccagacgacaagacacctgcgctcggagaggagcgtatgggcgttctccggcaaggcctgggcgcccttcggcgcatctggaggtcccagtctcctcgatctggccgagacaggatgcgtgtctctccgtgcttccggacgaggtgctcagcgcctacgctttgcctgacatctctcggcatccccagacgctgcgcacgacaggggcaggctcgaggctgcttaccgcatgcttgccgcacgcatcgaggatatgcatgatatggcagctctctctgatgaggctatcctgctgtttccgtgaaggcagcgctccatcgcctccatgatgctgcctcacgcgccagatcttccgccctgcttagagtctcgaactgcacgctttccgagcttgagactcccgtcggcgttgcctgggtggaccatgagcgcgaaggggagtgaccgagaacctcgaggatatcgtgcatgagctcgagcgcatgctccaggccagaatgcaggggctctcccgcctcagtgactcagatgccctcgcgcccgattctcgagctcatcccgagctctcgaacacgccggtccgaaaaggtgccgggcatgccggaaggcacggacaggatggcttcacgatccccctgcttcccgtcgtgggggcagccgttcctcggagaactgatatctcgtgcgctcctgtgccgtgtgctgcaacatgccggtctgtgctaccatggtatgagtcagaacggttgttcgggggttaccatgtcatcatcggcatcgatcccggccttgcgcatacgggctggggcatcattgagacaaggggcacggtctgccgtgcccgtgtcctatggctgcatcaagacggggcagacgaccgctccacaagcgcggcccatctaccagaccgtgaacgacgcgatcatcagttcgagccaccgagcttgctacgagaagatcttcttcgcagagacagccgctcggccatagcgacagcgcatgcaagaggcggcacttgtctgcgggcagaaaggggctcaagtcggcgagtacacgccgatgcagatcaagcaggctgtcgtcggcaccggtgccgccgacaagcatcaggtgatattcatggtgaggcaggtggcttgcgctcgatcatgacccgcaccccgaccactgcgccgatgcgcttgctgctgccatctgcccactggaatctgagcgcacgcaggacatttcccgctatgcaaaacggcaaccaaggacggcagcgctcgtgcgcgagggcggagatcgcccgaaggagcagaggcgccggagaagcatgaggagacggcggcagcaacggctgcccgcctcgagaagatggcacgggaagggcttcaagatgatcgtgcagctcaggaacgcttgtggaggtctgccgacgacagctgtgctcgatgtcggcggtgtcggctatgagctcggcattcggcaaacacggcagcgtcgcttccccaggcaggaggcgggcgtcgcttctgacccgcatgatcgtctcccaggatgcagttcggctctatggattcgcgacgaaggagagcgcgcgctctcttcgaccggctggtccaggtcgcaggcgtggggcctcgccttgcgctctccgttctctcgacattcacgccgcagactctatccgtggtcgcagcagacgatgcagcgggcatgtcgcgcgtgccgggtgtcggcaagaaacggcgcaccgcctcatcctggagctccagggcgtctttgcgaaggatcctgtcctcatgggccttgccgcaaggctgccaccgaggttcccgctggcagaatgcgcctctgccgctgtggagttccccttccgaagaggttgcgcaggcgcttctctccatgggatttaccccaaggaggcagagcttgcgctcaagggcgcagcgaggcgggagctgtgaccgtcgaggcagcgctcagctatcgcggaagcgtctggaggtgcatctaggattggcaggccaagcaggacgatctcttcgaggacatggcgcggccaggacatgcccgccaggtctcggggagctcaccggaagacgatatcgaggtcgaccgcacgctcaggcccgcacgctcgagactaattggccaggagcgtgtgcgcgacaacctccgtgtcctcatcgagcagcgaagaagcgcggcgaaccgctcgaccatggttcttctcgggccctccgggacttggcaagacgacgctcgcgaacgtgctggcaaatgagatgggtgccaaatgcatacgacagcggccctgccatcgaaccacaggcgatctcgcggcaataccttacaaatctcgagccggcgatgtgctcttcgtcgacgagatacacgcctgaaccatcaggtggaggaggtcctctatcctgccatggaggatttcttcctcgatatcgtgatcggcaagggcctgcagcccgctcgatccgtctcgatattccgaagttcacgctgtcggcgccacgacgaggacgggccttctgacagcctctccgcgaccgcttcggcactcctaccgtctctgactactacacgattcccgagctcacgcgcatcgtcgtaccctctgccggcatcctggtgtcgggatcgacgaggaggtgcgcaggagatcgcgtcgaggagccgcggcacgccgcgccttgcgaacaggctcctgaagcgcgtgcgcgactatgctcaggtgaagagcgatggcacgattacggaaaaggttgcccgcgaggcgctctcgttcttcgagatcgacgagctcggcctcactggatggacgtgaagatcctgacagcgctctgcagcacgttccgcacgtcggtcggcctcacgacgatcgccgagtgccgtcagcgaagatccctcgaccatcgaggacgtctacgagccgtatttgctcagtgtgttctgtgatccgaaccccgcagggaaggaaagcgacccgtgcggcttcgagcacctcggactcattccgccaccgacgctaggagcgattcatgctgcaacgcgactatatcatgatgctcatcacccagttcgtcgacgccgtcacggacccctgctccacgcagcagcgcatcaggacctgaaatcgatccacgagcagaacatgccgttggcgacctcctgctgcagctcgatcccgagacggcgctcatgctgacgcctgaatcgctcgtcacgatgatggatctctccggcatcggcgatacggttgcaggatatgctgcctacgtgctgaacaagctcgcctcgctctatgagaggcgcggagatgacaagacgtccgagttgaggcttgcccaggcgcgtgccgttgctgtggcattcggctgggacactcttcgaacataccggacgagcttgccgacctcgacaagcagcttgcatagatgtgatattccctgccgttcatgggctgcattcaggcgctagccgcacctgttcagccattggcaactttgttcctgaattgctgccactttctctcacaaaagccctagagtgatggcgcgggcgcgcggtggaaggacggggacatggcatgctatgcactctctacatacatggcagatgaagacgctcgaccgcctcctcgagaagttctcgcctgccaagacgacgagatctaatcctgggcgacatggtcgacgaggacctgactctgtcgaggtcatgaagctctgccgaacctgccgaatgcgacgtcctcttggcaaccatgagcagctcatgctctcacttcttccacaatccgcaggatcaggagcgctctgaactgggccatcaatggcggcgtcccgactgcccgggggctcatgaagaggaaggcggacgcacgccacgatttgttctcgactgggcgcaggcctggcgcgcggatcgtgaagaccgttgccggaaggacgtacttgctcgtgcatgccggctgcggacagagaagctcgctccatgcgcggaccatatctccgcagcgcttgcgcgcaggatgcgatgacctgtctggatcccgaagggtatctcgactcgccgccgacggccttctcgatgcaaagggcgaaggcccccgtcatcgtcggcggacatacgccgacacaagcgcttgcagaaacgcttgccgatgtggcagacgaagtgccctgaacacgatggcaatgccatgctctctcttgtcgcgaacggaggcacaggcggcgttgtcccgacctgctgttatcgacctgcggggcggggtcgtgctatgactcattggcaggcctgcattctgaggctcgacgaccgacgagttctacgaggccgtgccttgagggagactgagacgatcgtcctcctctgaaaccgattctgctgccggcaacgcccgccgtcccttcatctggggagccttccggccccaagtcccttgaagccggcattgtactatgccaaatccgcagaaccgcttctggtccgtcatgggcagggatctggaagatgacgagccgctcatcgaacgaagagcgcattgccttctgtgctgcgcaccataaatcgcgccctctggacgtgatcctcctgcctttctccgacatagcgccggtaagcgcatgcgctcctcgtgcccgtggtgaaacacaatccgatctggttctgaaagaagcttcgctatatcgttcggcacacgtcggtgatgcttgcctcagagcaccctgtatgcggcatcggaatggattcaccgtcccaaggcatatggtgccatcacatagagagcaatgcgctcttcgtgtcgtgagagctcgtctcttccaggccctgccatacagccagaagcgttctgcggattgcatgtacaatgccctttcacgggacttggggctcggaaggctccccaggataggactcggccgtctgccggcagaatcggtttttcagaggatggacatcgtctcagtctccatcaagcagtctcgtaagaacgctttccggtcgtcggaaatcctcagcatgcagacctgccatggtcaggcaccgaccccccccgcagtcgataaacaagacggtcggcaacgcgccttcgcctcctcgcgccaagcgagagcatcttgcgatctgcccatcgtcgttcagggcacttctgtctgccacatcggcaagctttttctgcaagcgctgtcggcgtatgtccgcccagccgatacggggcctcgccctttgcatcgagaaggccggtccggcaccggcgagatacccttcgcggatccacaaggtcatccgctcctgcgccgcagcgctggcggaggatatggtcctctgcatcgcagcgagcttctctgtccgcagccggcatgcacgagccgtactttccttccgcaacggtctcactatccagcgcgccagccttccgcccatcgacaaatcgtggcgtgcgtccgcctttcatcttcatgagcccccgggcagtctgggacgccccattgatggccagtttcagaagcgcctcctgatcctgcggattgtggcgaagtcgagcatgatctgctcatggtccagaggaccgtcgcattcgtcagttttcctgcagagcttcatacctcgacgagtcaggtcctctggtcgaccatgtcgcccaggatgtagatctcgtcgtcttcggcagcgagaccttctcgaggagggcggtcgagcttcttcagctgccatgtatgtcagagttgcatagcatcatgtccgcttccttccaccgcgcgccctgccgcccatcactctgggcttctgttagagaagttgccgcaattccagaacaaagtccctgccaatggcctgaacagtggccgctaagcgcctgaacagcccatgaacgcagggaatatgccacatctaggctaagcgtgcttgtcgatcggcaagctcgtccggtaatgtttcgaaggtcccagccgatgccacagcaacggcacggcgcctgggcaagcctcaactcggacgtccttgtcatcatccgcgcctctcatagagcgaggctagcttgttcagcacgtaggcagcatatcctgcaaccgtatcgccgatgccggagagatccatcatcgtgacgagcgattcaggcgtcagcatgagcgccgtctcgggatcgagctgcaggaggtcgccaacggcatgttctgcctcgtggatcgatttcaggtcctgatgcgctgctgcgtggagcagcgggtccgtgacggcgtcgacgaactgggtgatgagcatcatgatatagtcgcgttgcagcatgaatcgctcctatgcgtcggtaggcggaatgagtccgaggtgctcgaaggccgcacgggtcgctttccttccctgcggggttcggatcaccagaccacactgtagcaaatacggctcgtagacgtcctcgatggtcgagggatcttcgctgacggcactcgcgatcgtcgtgaggccgaccggacgtccgcggaacgtgctgcagagcgctgtcaggatcttcacgtccatccagtcgaggccgagctcgtcgatctcgaagaacgagagcgcctcgcgggcaaccttttccgtaatcgtgccatcgctcttcacctgagcatagtcgcgcacgcgcttcaggagcctgttcgcaaggcgcggcgtgccgcggctcctcgacgcgatctcctgcgcaccctcctcgtcgatcccgacacccaggatgccggcagagcgtacgacgatgcgcgtgagctcgggaatcgtgtagtagtcgagacggtaggagatgccgaagcggtcgcggagaggccctgtcagaaggcccgtcctcgtcgtggcgccgacaagcgtgaacttcggaatatcgagacggatcgagcgggctgcagggcccttgccgatcacgatatcgaggaagaaatcctccatggcaggatagaggacctcctccacctgatggttcaggcggtgtatctcgtcgacgaagagcacatcgcctggctcgagatttgtaagtattgccgcgagatcgcctgtgcgttcgatggcagggccgctcgtcgtatgcatcttggcacccatctcatttgccagcacgttcgcgagcgtcgtcttgccaagtcccggagggcccgagaagatcacatggtcgagcggttcgccgcgcttcttcgctgcctcgatgaggacacggaggttgtcgcgcacacgctcctggccaatatagtcatcgagcgtgcggggcctgagcgtgcggtcgacctcgatatcgtcttccgtgagctctcccgagacctggcgggcatgtcctggccgcgccatgtcctcgaagagatcgtcctgcttggcctgccacatcctagatgccacctcccagacgcttcagcgcatagctgagcgctgcctcgacggtcacagctcccgcctcgtctgcgcccttgagcgcaagctctgcctccttcggggtaaatcccatggagagaagcgcctgcgcaacctcttcggaaggagactccacaagcggcagaggcgcattcttgccagcgggaacctcggtggcagccttgccggcaaggcccatgaggacaggatccttcgcaaagacgccctggagctccaggatgaggcggtgcgccgtcttcttgccgacacccggcacgcgcgacatgcccgctgcatcgtctgctgcgaccacggcatagagctctgccggcgtgaatgtcgagagaacggagagcgcaaggcgaggccccacgcctgcgacctggaccagccggtcgaagagcgcgcgctcctccttcgtcgcgaatccatagagccgaactgcatcctgggagacgatcatgcgggtcagaagcgtcacgcccgcctcccctgcctggggaagcgacgctgccgtgtttgccgatatgccgagctcatagccgacaccgccgacatcgagcacagctgtcgtcggcagcacctccacaagcgttcctgtcagctgcacgatcatcttgaagccctttcccgtgccatcttctcgaggcgggcagccgttgctgccgccgtctcctcatgcttctcccggcgcctctgctccttctgggcgatctccgcctcgcgcacgagcgctgccgtcctctggttgccgttcgcatagcgggaaatgtcctgcgtgcgcctcagattccagtggcagatggcagcagcaagcgcatcggcgcagtggtcggggtgcgggtcatgatcgagcgcaagcacctgcctcaccatgaatatcacctgatgcttgtcggcggcaccggtgccgacgacagcctgcttgatctgcatcggcgtgtactcgccgaccttgagccccttctctgccgcagcgacaagtgccgcccctcttgcatgcgctgtcgctatggccgagcggctgttctctgcgaagaagatcttctcgatagcaagctcggtgggctcgaactggatgatcgcgtcgttcacgtcctggtagatgcggcccagcctctcgtggagcggctcgtctgcccccgtcttgatgcagccataggcacgggcacggcagaccgtgccccttgtctcaatgatgccccagcccgtatgcgcaaggccgggatcgatgccgatgatgaccatggtaacccccgaacaaccgttctgactcataccatggtagcacagaccggcatgttgcagcacgcggcacaggagcgcacagaagatatcagttctccgagaacggctgcccccacgacgggaagccagggcggatcgtgaagccatcctgctccgtgccttccggcatgcccggcacctctttcggacccggcgtgttcgagagctcgcggatgagctcgaaggcatcggcgagggcatctgagtcctgaggcgggagagcccctgccttctggccctggagcatgcgctcgagctcatgcacgatatcctcgaggttctcggctcctcccccttcgcgctcatggtccacccaggcaacgccgacgggagtctcaagctcggaaagcgtgcagttcgagacctcgaagcagggcggaagcatctggcgcgtgagtgcagcatcatggaggcgatggagcgctgccttcacggaaacagcaggatagccctcatcgagaagcgctgccatatcatgcatatcctcgatgcgtgcggcaagcatgcggtcaagcgcctcgagcctgcccttgtcggtcgcagcgctctgggagatgccgaagatgtcaggcacagcgtaggcgctgagcacctcgtccggaagcaccggagagacacgcatcctgtcctcggccagatcgaggagctgggacctccagatgtcgccgaagggcgcccaggccttgccggagacgcccatacgctcctctccgagcgccaggcctgtcttgtcgtctggcacgagcacaagcgcatgctcctggcgggcaagctccgccaggaaggctgcctcgacaccctttggacagagcgactccgtggcccaggcacccggctgcggccgggcaggcggaaatcaggcatccttgggttccctcgattggagccggtctgcagctctgcgtcagctagcttccggccacgacgagggctcgacttgttcgggggcccaaagcatcgccggcaaagcgagcgagaagcctgaggcaattcttccgtcgagcgccaaaaagcagcgaccttgtcctccccttctgcatggcaagatcggtcaagtccacgcacgagaagcccccagagcacatggctcttctcccggatgcccgatgcggaagctctgccgcaggcatccctcagccgtgtccttccgtacgagaccagaaggcctcctcgaaaaaaacgaaaaaaaaaaaataaaaacaagaacaaaaaaaaaaaaaaaaaaaaaacaaagaaaccaccaagaaaacaacaggggggggggggggggggggagaaaaccccctccctcccccacccccttccccacccccccccccccaatccccccccccccccccccaaccccccctccccccccccccccccccccacccccccccccccgccacccaaccccccccctcccccctcccccccccccccccccaccccccccacacactcccccccccccccccccccctccccccccccccaacccctcccaccccccccccccccccccctccccccccccccccctccccccacccaccgcccccccctcccccctctcccccccccccccccccagcccactcacccccccgcccccggccttttcccccctccccccccccccccccccccccacccgcattccctccccccccccccccaccccacccctccctgcctcccccccgaccctcccccccccccccctcccccccccccccccccccccccccccaccccccacccaaaaacaaaaaaaaaaaaaaagtaaacaaaaaaaaaaaaaaagcggtgccttcgcctggagacgcccttctgcatcgagcacgaagcttccgccggcaaagagctgaggccctagccgccgacagagtcggcgcgcaagccagcagccgtctcttctgcatcctttgcaaagcgtttctccgcaagagagagcgaaagcgccgagtcgggatctctggcaacatagcctcctgcggaaggtagagcaggacatcgagcgagaagtcgtagtcgcggtagtcgtcgagatcgtcgtaggtgaaggcgacgccgatatgcgtgccgtcgagctcgaactcgggaagatcggtgccggtgcactgcctgcctgggaagctgccccgagctggcaagcgcgcccatcgatgccgtcatggcacccatgcgcagagcacaagctccccaccgtctatcaggaaggcttcggcggcaagacctgtccggttcctgccacgaccggcacgatcgcacacaggaatatcggcgccaacgcgcagcgtctcgcgccgcatcccccacataggcctcgatatcgctctcctcgacaggagaggggcctgtcagcacgcatacggaaagacgacgaggcgggcacc

SEQ ID NO: 45 - DNA, 11973 bp, Unknown
  Metagenome-assembled genome
ctctggcttccacaagttcgtctggtaatctcgcttggctacggcttctccatggcagcgatcggtgtggcgctgaccgtctttgcagcgccacccctgcccctcgcctgtccccttccgatggcagggctcatggtgttcttgggatgaggcttggcctctatccctcatccagagcgcaggagcaaggcctataacatgtgatgaagacagcagtgaatgacggctctgggctctcgcttcccatccgtatcctcatctgggcgtctgttgtgcgctcctctatgctgccgaggcctccctatcttcttccgcatcgcgaatggggcagctgccgacgtctcgacctatatcggtgctgtcttgatgctctcaggcatcgtcctcgagtctgctgccgacctccgaagagcgcccagaagaaggtcaaccccagagcgcttctgcgacaaggggctctactccttcgtgcgctgccgaaactatctcggcgagtcctgacctggccagggttcctcatctccggcctcacggcactcgaaggccattccagtggatctttgccctggcaggatatgctggcatcgtctacgtgatgttcggcggcgcccgcgctcgagctcaggcagaacggagctacgggaaagaccccgagtatcaggcctatgtgagaagacgccatccttcttcccttcatcccgctctacagcgtggccaatgtcacctggctcaagggctagcgggcactccgatcaacgaccagccccggctgcagcgctttctgcagccggggcctttgctgtgcagggagccatgttgctggcagctatgcctgagccttcggagcatctgccttcttgtccgtgcgtgacggatgaggaaaacgcgcgagcgtctgcaatgcagacggcattcgccgccaggctgatcggtagacaagcatgattgtgcgaaggtcggatctgcggaagacaaggcaatccagaagaagcggatgccgcagataacgacagaagtgatgaggcaggaatggcagagatgccaagccgcggaggtagcccactgtgacctcgtagagcatcgagaatacgtaggacgagatgatgatcgagatgcgcgtatagccgagctctatgacctccgggtcgccgttgaagaggcgatcatctgatggccgaagatgaggacaagacgataccgcgatgtctgcgatgaagccttcgcgagcgagaccttgaagacggagcggcagtgcgcagctggcgggcgccattgttctggccgacgaacgtcgtgcaggcctgctgaaggagttcaggaggttgtagacgaccgactcgatcgagatgccggcgctcgatgctgccatgacggtggtgccgagactgttatagcagactggatcacgatgttcgcaagcgagagacggcactctgctggatcctgcaggaaggccgatgcgcacgatctgggcagccgagcggccgtccagtggagcttcgaaggctccaccctgatgggcgagtcgatttccaagagccgcacagcaggatgagtgcactcgcaaatagcaagatcgttgcaagcgcagatcccacaacaaaccagccgaagacgccgatgaagaggtggccgaaggccacattgagaagggctgcgatagcagggcctggagcggcagacgggtgatgcccaccgacgaagatggccgcttcgagattgtaaggcaggatggcaggaagcgcgagaaatagacacgcaggaacagcactgcctcaccaagtgtctcttcagcacaagcaggagcctgagcagaggcctgcggcaacctctccgacgatggtcatagcaacgcccacaagggtcatgagcatggggtatgcacggccttcgtgaccgcatcctggtcgcgcctgccgatagcagtggcatcgtcacgttggagccaagggcaatgccgacaaagaggccaatcaggaggccagagatcggcgtttcgagccgacggcagccatgccgaggtgcccatatcgcccgagagcctgccaaccatcatcgtgtcaatcagttcagagctgctccaggatgcctgtggctgcaaccggaagggcaaaacgcaggaccgatgtccagaagttgccatgaaggatatcgatcggctttgccgttccccgaaaagctgccataggatcctttcgctcaacatgcatgccccgccccttccccatcctgtgcagagcacagccagggctgggtggcgctatggaaatggaatgagtccattatcgtcctcgtgcaggagaacatatggcagaggactgctctccataaagagagcgagctgcagatgaacttcccggaccgatgccagacggcagcgacggctgccgtttgtcgaacatatgtactcttcaagcagatgaaacggctttcccctgccgtcagatttgcataggcgatatcatttcattgacaagaacatttgttctttttcgtacctaggcaatcatgcagcagcatacgggacagacgggggccgctccaatcgaaagaaaggaaaagccatggtgaacatcgaaaccgtcatacgtctcgcaggaatccttatcgcagctacagacctcggaatctggttgggctaccatatcggacgaagaggaaaatagccgcccccgcttaagcggaaacggccactctccaaactctaaaaaagtgcaaggagcggcttgaggcccgctggcacgggtgccgtccgccccctattttactgcatgcccgatgattctggcaacgctccatctcaaaaccagcttggccagcttcatccatgcgatgccgaggaatatcctgcagataggtcaaacccgccagttgagcatcacagagaggccacagggcctgctgcatagaatcccacctcaggctcagacctcgcaccatgaatccgcaggcaatacgtcagcgtattgtgtgtcgcacacccgcctcattctgctgcggcacgggccgcatcgcccagcgccacctcaaacagccagaaatcccctgtttcgcgtgcagcatcaagatatgcagctctgtcatcctcgcccacgagatgctgcatcatagggcgaggcctctcttgctggctgttccgcttcgctctgcatcgtgcaggcatctccctatctcgcagatccttccttctgcagctatcccacgcaaggcacccggcatctctacttatcgcatgcagccagcaaggccgggaacaacggccacggagcggggtcccatgcagggcacatcaatcatctctggccagctccaatctgagtgcctgtattctggtctctatctccttgatgacagagacataggtctcgtccgacttcccggtcgggtcttcgagcccccaattctcttcgaatggcctgccaatgaaggggcaccctacattgcatcccatggatatcgcgatatccggcgcaggtatctccgctatggccttgggatgctgggtcttttccatatcgatgccataaagctccttcatgatgcgtaccgcatcagaatcgatatgggacttcgtctctgttcctgccgagcagctctcgaagacatcagaggcaaggagcttgcccagtgcctctgcaatctggcttcggcatgcgttgtgcacgcagatgaatgctaccttcggctttcccatggcacgaaccagcttcctgtccagatttccgtctcggtgacccgtgaagcccttgcaacgcagatctccatgataccgagcatctgcatgccatgggacagctctcccgaacggacgtctgcgccaagttagccgtattttacttgatgagcaatcagtcctcctgccatctgctagcttatgagcaacagttaactcatcgtcaggaggcctctcatgcatgaagctggacatacatttctcgcacgtctcggcaagacgaagctccgtcccggcggcatcgacgccacgaactggcttgtcgagaaggctggcatcggtcccgatacaaagattctggaagtggcctgcaacatgggcacgaccatgatcatgcttgcaaagaagtatgggtgcagcgtcaccggactcgatctcgacgagaaggcgctcgcaaaggccagagagaatatcgagaagaatggccttgcagacaggcttcaggtcgttcaggccagcgccttcgagctccccttcgaggatgcctccttcgacattgttatcaatgaggccatgctcacgatgctcacaggcgacagcaaggacaaggccctctcagagtatgcccgtgtgctgaagccgggcggtctgctcctgacccaggacgtctgcttcagatgcgagagcagcacgctgcagaaggagctgcgcgcaggcctcagccgcgccatcaatgtgaatgtcgagccgctcaccagcgatggctggaagaacaggattgagtctcatggcttcgtcacggagcagaaggtgggagccatgaccaaaagcgcggcgcaagccccttccttcaggcttggggtcaagccgcgcatcgccgtcaggtgatagctatctgcaagcggtataatgctcgcatgaaatgcaagagcaacaacaacgtcgtctacagctgcaagtaccacgtggtcttctgaccgaagtaccgcaggccggtgctggtggacggcgtggacgagcgcctcaaggagatagcgctggaggtggcggacgagatgggcttcgacatcatcgagatggaggtcatgcctgaccatgtccacatgctcttggaggcagacccccagctggggatccacagggccgtcaagcgcatcaagggcaggaccagccacgacctgagggctgagttcccctggcccaggacccgcatccctacgctttggaccagcagccatttcgtctccaccgtgggaggggcgcccttggcaatcgccaggcaatgcatcgagaaccagaagagcgtgtagccatggaaagggcctacgagatccgcatctaccccaacgccgcccagcgcgaactcatcgagctcaccttcggctgtgccaggtgggtctacaacaggtgcctcgagaccaggaaggccgaatacgagaggaccgggagatcgccgtcggtctaccagctccagaagctcgtcacggcctggaaaaggacggatgcaccctggcttgccgaggtggactcccacgcgctccagcaggcggccgtgaacctggggagggccttcgatgggttcttccgccgctgcagggcgggcggaaagcccggatatccgcgcttcaagtcgaagcgggacgcgaggcagtcctaccgcaccaactggggaatctcggtgccggacgcgaggcatgtgaggcttccgaagctcggcctggtgagggcacgagtgagccgccccgtcgaggggcgcgtcctcaacgcgaccgtgaagcgcgtgccgagcggcaagtacttctgcgtgctcacgtgcacggactgtccgaagcccgatattcccgaagggcgcatcgaggtcctgggcgtggacgtgggcatccgctgcctcatggcccgctcggacgggaatgcgatcgcaaatcccaagagccttgccagatcggagaagaagctggcgcgggcgcagaggaggctctcaaggaagaagaggggctccagaagacgcgccaggcagcgcgcaagggtcgcccgcatacacgaaaagatagccagccagagaaaggacgccctgcacaaggccacgaccgaggcggtgcgcgagagccaagccatcgccgtcgaggacctggacgtcagagggatggagaagaaccgccgtctggccaagtccgtcgcggatgcctccatgtccgagatggcccgccagctggagtacaagtgctcctggtacgggcgaaggttcgtgaaggtcggcaggttctacccgtcgagcaagacctgctctgcctgcggacaggtcaatcaggcggtcgtgctgggcgtggaggcatggacctgccctgtatgcgggtgtcgccacgaccgcgatctcaatgcggccttgaacatcgcgcaggaaggagcgcggcttctaaatgaagcagacggtaccgcagggcttgcgggaaccggggacgcaaaagcgtcccgaacgctcgtggagcaggcgtaagaccggcttccgccgcaaggcggaggaaggctatctgcgtcgaagcgagaatcccccggcttcagccgtggggagtgtcaagctgatggatccggaaggcatgatccacgacgaaggcgtggaaggcgccttgaagatcatgttcaatgcaatgaagcaggagaaccatgagatgttctcgaacatgttccgtttcttcaactcccacaaggacgagctcggctacgtcgcgaacttcagcacaaagccgcttgcaggagctgccgcagcatagtcttcggaaagccgctgtgtacgaaaaggagctctctgccacacactctggcagagagctccttctgctctttgacacctctgaaacgggctctttaggccgtctcctgcagcctcgcgagataggcaagagatgtcttgaacgtctcgggcgttccgttctcgatgatgcagggaatgcttcgtccggtgcctttggcccagcgcacgaagggagcatagtcgaaattgcctgtgacgccggcgcccgtgcactcgagcctgcttccggacccgtcgcaccagccttccttctcctcgttcccgatgacgcggaagtcctttgcatggagaacagagatgcgctcccccagaagcgcaagctcgcgctcggattggacagcagcatcctcgagcattgtgggatgcaggagcgagacggggtccaggatgacagagacagccggatctcctgcctcgtccagcaccttgcgcgcacgctcaggcgtcgaggctgcctcgttccagccaggctctatagcaaggcgcgacccttcgtcctcgacgagtgctgcggcacgcttgacctcacgtgccagctcatggagtgcctcatcggttgtacgtgcctctgtgatctggttcttcggatcgggacgtccgcattcggtgccgacgacagaggcgccaagcacgcgggcaaagcggcctgaggcttcatactgcctcaagatcccctcgcgcttctccggatcgggctcgagcaggttcttgtagcagccgaagaccgtgaccgtcaggccttcctttgcaaagagatccttgagatgcttggcccgctcgtcgctgagcccgaagatatcggtatcccagctcttgcagaggagcttcgaggcaaggtggacgcacttgaagccaagctcagctgcgttatggaccttctcttcgagcgtgtctcccgccacatcgtggagcctcacaccagggacaatcctgcccgtcatgactccttctttccgttgatgcctggcgtatagccgtcgaaggggtcgtcgagcgagcaggtgccgcagggagaggcagggtctgccgctcccttcagtgcatcatgctgcatggtctcgatgtaggccagaatcaagggtgccacgccctttgcatcgttttcgacgatgggctccctcatgtagtagtcgaatgtgccctcgcggtgcgtcttgttgccgaggcctgcaacgaggcagatgttcttcaaggcaagcttgccatcctcctcagagaggcaggtgcggcagatgccgtcaaaggcagcacggcccttcggatagtaggaagaatcgaggacgcccaagcgcacgcccttcatgatcgcgttcgcgaagatggcagagccggactcctcgaggtagttcggggcaatgttcggcaggttgatgacctgatgccacatgcctgtctccttgtcctgatacggcagcatcgcatcgacgagctcctggaacatctggcgcagagcatccttctcccccgacatcgaaggcggcatgagctcccaggtatcgatgaccgccattgcgaaccagccctcggcacggagccagaagctcgaggagaggccggtcaccgggtcgcaccagaactgcttcctcgaggcatcataagcatgggaatagaggccgttgagcgggttcctcatgatcttgtgcacggtctcgaactgatggaaggagtccgagcacgcccgcctgtcatggaaggcaagctcgtactgcatgtagaacggctgcgccatgtacatgccgtcgagccagacctggttcggatagatggccttgtgccagaagttgccctcgcgggtgcgcggctgatgctcgagctgcccatagatcgtgtccatcgccaagcggtacttgtgcttgccgaagatctcatagagccggtagagcgtctttccggcattcacgttgtcgaggttgtagtcctcgggacggtagccctcgatgtggccttcctcatcgacaaagtggtcgatgaaggcatcggcgaagtcgaggtatccctcatccttcgtgatgccgtagagctcgatcagggccttgatcatgcagccatcgatgtagttccaggtgttcttcttcccggcacggatcttctcgatgttccaggccggcgcctcgggcgtcgaggtctccatgagctgctggatgtagcggtcgagaatggcatttcctgccatgatcccctccttcactgccggcatctggccggcacaagtatcctatccgacgatagcggcaagtcctgctgcaatccttctggcaaggcgctcatatcctgcgggcgagtagtgcaggccatccggcatgtagcgctcgcgatgagctggcagaagcggcgagatcgtgctctcacggaagaggtcgatcgtgggtacgccgaagcggtgcatcacatcgaggaaggcatccgcgtagtcctcttccacgaaccccagatcgtttgccgcgttgtaggcaggaaggcccttcctgggaacgcctgccgtcttgcacggggtcatgccaacaaggatggactcagggtacttctctgcaatctgctccacaagccaggtgagcgccccatagaacgtatggacatctttgtcttccggcgcacccaccggcacattgcggcagaagtcgttgacgccgccgaagaggcagatcacatctgatgccatgtcatactcaccaaagcgctcgacaaacgagtcatcgcggtcggccttgacgccgatgcgggagcccttgacgccgaagttcagcaccttggcagcacccgtaagctctgccatatgcgaggtccaggagatggcaggaccgcccttccccgttccgttgtctccccaggtcgtggaatcgccgaagcaggcgatcgtctttccttcaaggctcatcagccatcattcctttccgtgcttgcgtgctgaagccatgcgatatcatccgcaaagctgaggacgccgagatggtgctcgcctggtatcacctcgtgcttgaagcggtcttcctttcccagaagctcataggcacgccacacgatatcggtctgctcgaagacattggcaaggccccttggccccatcaggtggtcatggtctgcgctctggacaaggagcggacgcggagcaatgagcgaggcgagatctcccatatcgaagagcttccagaggtccggcacatagttgcaggagcagttgccattgagatgcaggagcgcatccttcacgccgtagaggtagcccgagatgaaggcacacttcacgcgctcatccaaagccgcaagatagagcgtctgcatgccgccaccagagaagccgacgcatcccagatgcttggccgaaagctcaggctctgcctctatccagtcgatgaggcgctgaagatcggataccagaaggcccagcagcgtgagacctaaaggctctgccatccgtgcttcgttcaagcaggtgccacgcacataggcgtcaaccgtatctccctggcccttccagctcctgcgctctccccagcctcttgcctcagggcagatggccacatagccgtgcctggccaagcggaggccatagtcgtagttgaagcggcgaatcgcctcatcgactgcagggacgcccaggatgccagcgacgctcgccgctcctgccccctggtgtccatgcggacagatgaacgtgtagctgcgtccctcctcgtcacgcaaaggcgcatccggcatcagcacatagacaggcatccagacatcaggctcgacctcgaggagatactttctgcgctcgatatggcccggcaccgatgcggtcccgacaagacgggcacgaggctccaccttctcgatagcattgagcttgagggcctccgcgagcttctgcctggcgaccttttgccaggcgaggaagtcctccgccgtctggcctacaaacctgcactgccgtgcctcgcggtcgaagcgcttcgcgaatgcttcgtcgtctgcgcagtacgtatccgtatggacggtcctgccattttccgagagcttcgaggtctcggtgtctgctatgccgccgccttcagggtcccacccgtcttctcctgccagcacattctcgcggctatacctgacgagctgatcttcctggatggtcgaggcaaagggtacccattcatcggttgtggccccaggtcccgaaaggagcgctcccctatactctgcgcactcccgtgccttttccttgttccagtcccagaagccatcacgtctgatatggggaccgagccagcagtcgacaagcaccgtcttggcatattcgcgccaggggcggccgagatagaccgtgttctcagcgcactcccctgtgaacgagcacccatggaagacgaagccatagggcatctcttcaggcgtcgaggctgccgtcacgtagccgttcacgtccatatcgcggttgagcgaatgaagctcgcagctctcgaagaaggctgtggcaccaccgaagatgaagtcgacatcgccctcgatgtagcagcggcgccaatactgcctcgtcggtatcctcggtgcgtgctccttggggccacggaagccgccgggcttcacctcggtcggaggaagaggccccaggaagacggtgtcctgatgtcccaggaggcggcaggaatccacgacgaggcggtcgccgtctgcatagaacgcaagcgcctggccgacctcacgtccatcccctgccgcattctcgatcgtcaggttctcgaggcggcagtcaggagcatcgactaagacgacataggtacgaaaggttcccctcttggtgccatccggcatctcctcgaaggcgccatgggtgcccctgatcttgacctggtctgcacactcgcccagaagcgtcacatggggacggcggatctcgaccatctcctcgtaggtgccaggggctatatggatgatgcactcctgtgtctcatcaggtgctagctcacccagtgcatcgagtgcatcctggatgcgggagtacgcaccagtgccgtcggcagcaacctctgcgactcttgcctccatcgcatatccctcctctgaaagaagcgcgccatgagctctggggctcatggcgcgcggagtggatcccacaagctcaaagatgctcttgagaccctagtcagctgccttgatgtcttcctggtagccgacgttgttgtgggcgaagcacttctcatacgggaagccggagagatcctcgcagaccttcttgacctcaggcttgacatcctccatcttttttttttttgtagggttttgtcttcttgattgcgcaacgctctggtctgtgcccttgccatgtccggattcatctcctcgaccggcaacagcccaggtccagcagcctgcttccgtgcctatcacgatctgcacctacatgctcatcggtgcgccggcttcttcatcctttcctgcatcctcggctcccgtatccacgtcgacaagaccgagtgcgacatgctctgcgctgaggtcaagcgtgtccgtgagggcggca

SEQ ID NO: 46 - DNA, 73293 bp, Unknown
  Metagenome-assembled genome
tggcctgcggcgcctccgtgccctctggatggattatgccacggcctgctgtccgcgtgccttcatgctgccgctgcgcctcatatccccatagctgaagccaggggctttacggcgcttttggtaagagccagggacggatgcagcttcaggtatccgtccttttcctatgccggctttatgggtgctgaaaacatgtcgggcgtgtgttcggatatgtttcgagcatgattcgttcgaatgacaactccgagaagcctttctgtcttcccgggggtgctcactgggtggaaacaatccttgcgtagactcacatcgaagctgagagggaagacacgcaagggagaaaccttatgagttcagacaaccagctgcatgccgaccagcatgcgcaggcctgcgcttcttcagagaacgagggactctaccgtcacgagttcgagcatgatgcctgcggcatcggcgcgcttgcccatctgaagggccagcgttcccaccagatgatcgacgacgccctgagcgtccttgtgaacctcgagcaccgtggcggcaagggcctcgagcacaataccggcgacggcgccggcatcctgttccaggtgccgcaccgcttcttccgccgcgaggcacagcgctatggctaccttctgccggatgagggcgactacggtgtcgctatgctcttcttcccgcaggatgaagagggcctcgctgtcgcaaagcgcgtattcgaggatggctgcgccgagcagggcattcctctgctcttctggcgctcggttccgacggatgcccacgacctcggcgagaccgccagggcatgcatgccgacaatcgtccaggcattcctgggccgtcccgagaacgtggagcgtggccaggcgttcgagcgtgcgctctatgtctgccgccgcgtcatcgagaagaaggccgacgctgagagcgcgctttcgggcaagatcttctatgtctgctcgatgagcagccgcacgatcgtctacaagggcatgcttgtcgcgacgcagatgcgccgcttctatccggatctggccgatgcttcgaccgagtcctcgatcgcgctcgtgcactcccgctactccacgaacacgacgccgagctgggagcgtgcacacccgaaccgctacatcatccacaacggcgagatcaacacgctcaagggcaacgtgaactggattcgtgcccgtgagccgggcctgtactctcctgtcatgggtgcagacttgaaaaaggtcatccccatcatcaaccgtgagggctcagactctgccatcctcgacaacgtgctcgagttcctgaccatgaacggccgctcgcttccgcgtgcggtctcgatgctcctgcctgagccgtgggacaagaacccgagcctctcggaaaagcgccgcgcctatgactcctaccagtccatgctcatggagtcctgggatggccctgctgccatcgccttcacggacggcatcgtcacgggcgctgcccttgacagaaacggccttcgtcctgcccgctactatgtgacacgcgatgaccgcctgatcctcacctccgaggtcggtgcccttcgctgcgaccctgaagaggtgctccagaccggctctctcggcccgggccagatgcttcttgtcgatcctgcaaagggccgcgtgctctgggacgacgaaatcaaggaggccttcgcaaaccagaagccataccgtgactgggctgccgcagagacgatcgacgtcgaggacctgaagcctgcagactccgatcccttcgagcagcatgatgcaaaggtgccgctcgtgacgaggcttgcccgccacggctaccacttcgacgatgtggaagaggcaatacttcctatggcacagaagggcgcagcccctctggcttccatgggtgcagacattcctctggcagtgctttcccgccacccgcgctcattcttcgactacttcaaccagctcttcgcccaggtcacgaacccgcctatcgatgcgcttcgtgagagcttcgtgacgtcgaccctgctctatctcggcaaccatggcaacctcctcgaggacatgcgcgacaactgccgcctcgtgcgtctccagggcccgatcctcacgaaggacgagttcgaccgcatctgcgctatcgaccatgagggattcgaggcacgccgcttcttcgccacctacaagcgtgacggcggagatgacgcactggagaaggcgcttgacgagctcggcgacgagatcgtcgcagccgtgcgcgagggcgtgaacatcatcgtcctctccgaccgtgcagcagacggcgaagtctccatcccatcgcttcttgctgtcggctctgtccacaaccgcctgcttgctgctggcatccgtacccgtgccgacctcgtcgtcgagtgcggcgatgcaatcacgccgcatgacttcgcgacgcttgtcggctactctgcctccggcatctatccgtacatggcccatgactgcatccgtgcgctctccgagaagggcgagcttgccctttccgccgaagagggcatcgcgaactacaacaaggcaatcacgaagggcatcgtctccgtcatgtccaagatgggcatctcgacgatgcagggctaccactctgcccagattttcgagattgtcggcttctcgaaggagttcgtggacaagaacttcaagaacacggtctcccgtgtcggcggcctgggcgtggccgatgtcgagcgtgagtgcaacgagcgctacgacgaggcagaggctctgaagaagagcccggctcccgaccagcttgcaagctccggcctcacgaagtggaggcctctcggcggcgaggaccacatgatcacgccgcaggtcatctaccttctccagcgtgctgtgcgcgagggcgactacgatctcttcaagcagtactcgaaggcgctccatccgaagaaccgctcgatcgtcctgcgcgacctcctcgagttcgtgccgctcgcctcgggtcctgtgcctctcgacgaggtcgagcctgcctctgagatcgtgaagcacttcacgacgggcgccatgtcctacggcgccatctccgaagaggcgcatgagtgcatggccatcgcaatgaaccgcatcggcgcgaagtcgaacaccggcgagggcggcgagaacccctcccgcgagacgacgcttccgaacggagattcgaagctctctgcaatcaagcaggtggcatcggcacgcttcggcgtcacgagccgctacctcatgagcgcaaaggagatccagatcaagcttgctcagggcgcaaagccgggcgagggcggacacctgccgggccgcaaggtctggccgtgggtcgctgaggttcgccgctcgacgccgggcgtcggcctgatctcgcctccgcctcatcacgacatctactcgatcgaggacctggcagagctcatcttcgacctcaagaatgccaacccgggcgcccgcatctccgtgaagctcgtctccgaagcaggcgtcggcacgattgccacaggcgtagccaagggcggcgcgaacaagatcacgatctccggcgccaatggcggtaccggtgcagccccgcgcgactccatctaccatgcaggactgcccctcgagcttggcctcgccgaaacgcagcagacgctcctcaggaacggcctccgctcccgtgtcgtgctcgaggctgacggcaagctcatggacggccgcgatgtggccgtagcatgcctgctcggtgccgaggagttcggcttcgcgacggcagtctgcctctccatgggctgcctcatgcagcgcgactgccagcaggacacctgcccgatcggccttgccacccagaactgccgcctgcgcaagtgcttcgccggcaagcctgagcacgtcgtgaacttcatgatgttcgtggcagaggagctcagggagtgcatggcccagctcggcttccgtacggtcgacgagatggtcggacatcccgagtgcctgcgccaggtcaaggtggagaacaactggaaggccaacacgctcgacctctcgccgatcctggcccaggtcacgaacgagttcggcaaggatatcccgggcgccgaggcaaagcactatctgccgagcatggctatggactcagggctctcccagacgctcgactccacgctcttcatcccgtatacgaagacggccagggaatcgcttcgtcctatccacttccatgcggacatctcgaacgtgaaccgctgcgtcggcacgatgctcggctctgccgtgacggcgaagcatcccgagggcctgcctgagggctcgatcacgattgactgcgagggctcgggcggtcagtccttcggcgcattcctgccggcgggaatcacgctcaacatctcgggcgatgcgaatgactacttcggcaagggcctctccggcggcatcctgacggtggctcctcctgcatcggcgacgttcaagttcaacgagaatgtcgcaatcggcaacgttgccttctacggcgccacgtcgggcaagggcttcatcaacggtcttgccggccagcgcttcggcgtccgcaactccggtgccacgatcgtgtgcgagggcgtgggcaaccacggctgcgagtacatgacaggcggcgtggcactcatcctcggcgaggtcggacagaacttcgcagccggcatgtccggcggcatcgcctacgtgttcgacgagcaccgcacgctcaaggaccgcacaaacatggacatggtcagcctgaaaccggtcgacgaggacgacatcacgctcatccacagcctcatcgaggagcatgtccgccgcacgaagagcccgctcggcatcaagatgctctaccgcttcgacgatatcgtgcctgagttcgtgaaggtcatcccgcatgagtacgagcgtgccctcaccctcacacgcgaggcggagaagcagggcaagagccacgaggatgcagtcgagtatgcattcgagaccatgaggaaggagatgtaggccatgggaaagccaggagcatatctttcgatcgatcgccaggaacatggcatgcgtcctgccaaggatgcgctcaaggacttcggcgagcttgcccagcctctctccgaagagctgcaggagctgcaggccagccgctgcatgtactgcggtgtcgcgttctgccagaccggcatctcgttcggtccggcccgcacgtccggctgcccgctccacaacctgattcctgagtggaacgatcttctctaccgcggcctctgggacgatgcggctgcacgcatgagcctcacgaacccgttccccgagttcacgggcagggtctgcccggcactctgcgaggtggcctgcaacctgggcctccaccaggagccgatgacgatcagggacgacgagcgcgccatctccgatcacgcctgggagtccggctacatgaagccgcttgcgaagcacgcagacgacgcaaagagcgtcgccgttgtgggctctggcccctccggcctggcagctgcctgggagcttgcccgccgcggctttgccgtgacggttgtcgagaagtctgaccgtgcaggcggccttctcatgtatggcatcccgaacatgaagctcccgaaggaggtcgtcgagcgccgtgtcaagctcatggaggactccggcatcgtgttcgagacctcccgcgatgtgaccgatccggccgtggccgagtggctcaagaacagcttcgacgctatcgtcgtcgctgcaggcgctggcgctgcccgcacgctcagggtgccgggtgcagacggggagggcgtcgtcctcgccgtcgactatctgacctcctcgacgaagtcggtcctttccggcaaggctcctgccatctctgccaagggcaaggacgtcgttgtcatcggcggcggcgatacgggcacggactgcgtcgcaacggctctccgccagggtgccaagagcgtccaccagctcgagttcctgcctgctcctccggatgcaaggaagcccggcaacgcctggcctgagtggccgaatgtgaagaagaccgactatggccagctcgaggctgaggcagtccagggagccgacccgcgctcctgggcatctgacaccatggaggtcctccgtggcgaggacggctcgcttcagggcctcaaggtcgcagacctcgactggagcgccggcaagccgcagcgtatcgagggctccgagcatgagctgccggcccagcttgtcctcatcgcaatgggcttctctggctccacggccgaggtcctctctgcactcggcgtgagctcgcacgagttccgcggcggcgtccgtccgacgcttgcggcggaagactcccatcgcgcggaggcagaaggggagaccccggtctttgtggcaggcgacacgaggaatggctcctcgctcgtcgtcacggccatcgctgatggcctggcctgcgccaaggaagcagcggaagcactctgatctacgtccaggcgcagcctcaagcgctgcgcctggtttctttgcagcacgtccgagtcttgaaaggggcggccatggcggaaagagatctcacacagcaaagcggggatgcgcctcaggcaccccagtgggtcgatggcacctccgaagatgacggggaaagcgatattcccctggtatggatggaggacggcgacgagcatcctttcgttcccgcaacgggagacaacgaaccttggcttgatgtcatgaacacgatgctggaggacgagcggaagcgcgagccgaaagagaagcccaagcacgaggaggatcccgaagaggcggagcgccgccgcatgaaggacgatctcctgaagtgggtgtagaagatctggaagatacgagcggcccggggtcttgaggctccgggccgctcgtcttgtctcgggcatgtcttttgcgtctagcggatgatatcaggggcgccttctccttcggacatgaagtcgccgttgtagttcctgttgccagtcagagggaagaggtcctttccggcaaggaaggcatctgcagcctctggccagctcttctcggccgcctcgaagacatcgaggaagctctcggtggattcttttccggtagcaggatctttccagacatggtgctccgtattggcagaagcgcaggacgtatcgtggtgtgccggatgcacgagggaggcgagcatcgaatattcgcgggcaagttcctcaacattcgtgagcgtgatttcggagagcctgcctttcggctcgagtgcatggtagaggcgcgcatagtcgcgcacggcatggccatactgcttgccgtcgagcggaaggccatatacctcatgggctgtctgggagaagagggcagagcctatgcgcgagatctggggcgtcgtctcgagggcgcgttgcgctgcctcgccggtctccgctccttcttcttcccttgcccacaggagccaagagtcgatatcggcctctatcacggcatggacctcgctatgcgcggagacaaggtctggatcctgggcaccgagcgcctcctgctctgcatagacgaaggggtgcgcgtgggagtcgagccagtagtgggcaaagaggccgaccgtgaaggcacggccgatgccctggccctccttgggcagggccaggacagcagcacgcagggattcgagcgctgctgccaccttctcggcgtgcatctggtttgccagcacgcggcaggtgtggttgtgggtgaccggtcctgtccagcggcagaagaagggatcgggtccctgggagccgaggatataggcacgctgctcttcgccgttcgagaagagctcgtgcggcagataggggagcgtctccttagcaaagaggctgtgggtgatgagtgcaggcatgaagaacctcgctttcagcttatctgatggaaacgtgcagcgaaggccatatggcacctttcagctggcaaagcggctagaataggcactttgctgctgcgggaggcgcctcgagaacaggtgccagaaattcgaggccacgcgtgaacatagccgagatcgtccttctgggtgctgctctgtcggcagatgcctttgctgtcactgtctctgatgcttgtacctatacccatgaacggcggcgttgactgttcctgatgccggtcttcttcggatttttccaggcgctcatgccctgcctcggctatgtgctgagcggccttgcggcagatctcatcgagagatatgcaggcatcgttaccctcgtgatcttgggcatcatcggcggcagcatgctgattgaaggcatcaagtcgctcaagaaggagaagccggaagactgcgaatgctgcggagacacaagccggcaccttacggtctggaccttgatccttcaggccatcgccaccgctatcgatgccttcgcggtcggtgtgagccttcgtgccgagggtgtgcctatcctggcctcctcagccatcatcggctgcaccaccttcgcgttctgcatcgctgcgctcttcatcggacgccgcctcggcacgcttctgggggacagggccgaagtcgcaggcggctgtgtcctcatctttatcggcctcaaggcctgcttcctgtagctctgtatggattctgggcgcccgtctatgcaggtgggcgaatgggtaacaatggctctggcgcaaattggcttatgaatgctggcttttcctcaaggaggctttcctcaatggatttcctgaaacgcatattccgtcacggcaagtcgagcacgctgctctcgggcgcgttccttgcgctcctcggcgtcatctgcctcggctataccgaggatgccgtcctcggcatcgtccgccttgtcggtatcgtctcgcttgtcctcggcatcacgaagttcgtcgatgtcttcatcaacaagatgaaggacccggcgcttgtgagcgcaggcgtcgtcgaggtcgtcctcggcctcatcctgacccttgctcccgatgccttcatcgtgatcgtcttcatcatcctcggcgttgccgtcatcggctgcggcatcacggcggtcgaggagagcaaggaaggcacaggcacgcacgacaaggttgtcggcatctgcgatatcgtcctcggtgcgatcatggcgatcgctcccttcgccttcatcaacgcgatcggcatcatctcgggcctggccctgcttgtggcgggctccacgcagatcctcgcatcgatgaagatgccggaggagagcttcgcgaagaagcggtaggacagaaggaatcttggctggacgcccgtctgcacatgagcaggcgggcgtcttgccgaagaattggcgcattctggggccggcagctgccggctccttccgaatgtaggagaatggcactgaacagacaggatgcccgcgcataggcacaggatcggaagggttggccatggacaatatcacccgcagggacttcttcggtgcagccggcacgcttgcggcagctctgggacttgctgcctgcagctcgggctcatcctctggcacgacgacgaccacatccgatccggtcggtgcagggtctgacctcatcgaggcagcgcaggcagagggctcgatctctgtgctcggctcctgtggcgaggagtacctgaaggcagcagctgcgcacttcaaggagctctacaatatcaaggtcgactacaagcatctcgcgaccggcgaggcgcagtccttgatcgagtctgaggccggagctcccacctacgacatctggttcggcggcacgaccgatccctacaacatcgtctcggacgagaagctgttcgacagctcctatctgccgaagaactcctcgcacctcatgagcgagtcctatatgtcctcgaacaacgactggttcggcatctacaagggactcttgggcatcatgtacaacaaggaggagctcgagcgtctcggggcagatgcgccgaaggactggccagacctgctctccgattcctacaagggcctcatctggaccgcaaactacgagacgagcggcaccgcgcgcctcttcatgaacacgatcgtccagctctatgggcacgaccagggcatgcagtacctgacgcagctcgacaagaacgtccaggtctatacgaaggtcggcgccatgccagtcaagaacctcggcacgggggagtgcgtcatcgctgtcggcttcctgcacgacggaatcgcgcagatcgaggataaccactacgagaacatcgagcttgtccagccgacatcgggcgtttcctacgagatcggcgctacggctgcgctcaagggctgcgcgcatccgaatgccgcaaagctctggctcgagtatgcgctctcgcctgagtgcgtcgagctcggtgcaaagaacggctcctaccagaacctcgtgatcgacaatgcgacgcagccgtcccaggtgagcaagcacaagctcaacccggacaatgtgatggactacgatttcgagagcgcgaaggagcacacgactgcctatgtccaggagatcatgggcatcataggcggcacggactcgcgtttcgaacgctagatacgaaacaagaactgaaaccgacaagccggattcaagggcgccaaagcgggtatgagcctcatcaaggatatacctgaaggcgccctttgtgcgtcttcgagagaaggggcagctatggaattcagatttcagcgttcgaaggcaggtgcgatactctctggcatcgccttcatcatcctgggcatcgtcgcattcacgcatccagcgaatgcaacgctcttcctgaccgaggtcacgggctgggttctcatcgtgctcggcgtctgcggcctcgtgatggcattcacgcacttcagcatcatgctctcgcagctcgacttctacggcggccttctggcgctgctcctgggcatcctagtcgtgaactggccgcagttcttcgtagcctggatcttcgtgcttttgggcatctacgtgatgattgccggcttcaactccgtctttgctgccaactccctgcgcatgctcggcgtctccggttctggcggcgccatgttcggaggcttcctcatggcatttctgggccttctgctcatgatgtcgccgttcatgatggcaagcgtatcgatgatggtggcaggcgtcactctcgtctatgcaggcatcgtgagcatcgtcgacggcatccgcatgaagaagccggaggaagatctctagcgtaccttatgagcgaactctcagaggtcctggcccatcggaccggggcctcttttctgtttggatcgtggatacgtgtcggtcttgtgctggtatgcaatcttttatctgtgggaaacatgagaaaacaattgatgaaacaatgtggcggtagtctttgaatcatcagatgcggccgctggctgcatcctcctaccagatacgtaccacttgctcaagggagagaggcgtacatggcaacagacaaggtaacagcagagtatggcagtctgctctttaccgatgctgacatgcaggaacggctatcgaagccgacctacaagaagctgcagaccgtcatcaagaacggcgatcctctggacatcgatatcgcgaacgaggttgcccatgcgatgaaggagtgggcgctcgagcatggtgcgacccactacacgcactggttccagccgctcaccggcatcacgtccgagaagcatgactcgttcatcaacccgcgcgaagacggcaccgtgctcatggccttcagcggcaaggagcttgtccagggtgagccggatgcatcgagcttcccgtcgggcggccttcgtgccacgttcgaggcccgcggctatacggtctgggatccgacctctcctgccttcatcaaggacgaggtgctctgcatcccgacggccttcatctcctacacgggcgaggccctcgacaagaagacgccgctcctgcgttccgaggtcgcactcgagaagcaggcgaagcgcgtgcttgccctcttcggccagaatccgcaccgtgtcttcacgacggtcggccctgagcaggagtacttcctgatcaaggaggacgactacaagcagcgtccggacctgatcctcacgggccgcaccctcttcggctgcgagccggccaagggccaggagctcgaggagcactacttcggctccatccgtccgaccgtgaacgagttcatgaaggagctcgacgacgagctctggaagctcggcatcccggcaaagaccaagcacaatgaggttgcaccgtgccagcatgagcttgccccgatcttcgagcgcggctcgcttgctatcgacgacaacctgatcacgatggagaagatgcgcctgcttgcatcccatcacggtcttgtgtgcctgcagcatgagaagccgttcgactatgtcaacggctccggcaagcacaacaactggtcagtatgtgccgacagcaagaacctgctcgagccgggcgacgatccaaaggacaacctgcagttcctcgtcttcctcgcatgcctggtcgccgctgtcgatacccacgcagacctgctccgtctctctgtcgcctctgccggcaacgatcaccgtctcggcgcgaacgaggcgcctcccgcaatcatctccgtcttcctgggcgatgccctgacgccgattgtcgacgctctcatcaagaaggaggagccggagaaccacggccgcgaggtcatggatctcggcgtcccagccctgccgaacgtcctgcgcgacaacacggaccgcaaccgtacgtctccgttcgctttcaccggcaacaagttcgagttccgtatgtgcggctcccagcagaacctgtccgacccgaatgtcgtcctcaacaccgctgtcgcagagcagtgcgagcgcttcgtcgactatgttgccgaccgctccgatgaggacttcacgaccgtcgctatgcgcttcgtgcgccacacgttccgcgaccaccagcgcatcctcttcgacggcaatggctactccgaggagtgggaggaggaggcagcacgccgcggccttccgaatctcaagtccacgcctgatgcccttcctgccctcatcaagccggagaacatcgccttcttccagaagtacggcgtcctctccgactccgagatccatgcacgctacatcgcgaaggccgagcagtatgcaaagcttttgaacatcgaggtcaacacgatggtgtacatgaccaggcacatgtatctgccggcgctttccgactactcgggagacatcgcgcagaccgtggccacgaaggatgccatcggcatcgatgctgcaggcgagaagaagctcgtccagaccctcactgacggcatcaatgccatcctcgccgacgttgatgcgctcgagaagatgaacgccgaggtcaaggcagaggatgacatccaggctgaggacgatggctaccgtgacaaggtcatccccgcaatggcagagctcaggagcgatgtcgacgcaatggagaagatctgcagccacgagtactggccggttccctcctacaacaagatgctcttctacgtgtaaggaagcatttcttccctcaaaatgcttatgacggtgcccccggctgttcggcagccgggggcgctgctctatgtagacctcttctcgcacagggctgcgctcgcctctcccggtacaatggtggggaaaacaagcgagcaggaggtcagccatggctgaagaagcagctacccaggaagcggaagagaagcgccgccgcattgccgtgatcgacggcaattccctcatgcaccgcgcctatcacgcaatcatgcagccgatgagcgcaccggacggacgtgccacgaatgccctcttcggcttcttcaacatgttcatcaagatggtcgagacgttcaagcctgacggcgtcatctgtgccttcgacaagggcaagccgcaggtgaggatcgatatgctgtcgcagtacaaggcgcagcgccctcccatggacgaagcgctccacgagcagttcccgatggtgaaggagcttctgggcgccctcgatgtgccggtctgcgaatgcgaaggctgggagggtgacgatatcttgggcacccttgccaagaagggcgaggatgagggctgcgatatgctcctcttcacgggcgaccgcgacatgtaccagcttgcaacggaccatgtgaagatcgtctcgacgaagaagggcgtctccgacgtgcagatcatgacgccggaatcggtggacgacctctatcacggcatcacccccgatctcgtgcctgacttctatggactcaagggtgatacgtccgataacatccccggcgttcccggcatcggccccaagaaggcagcagccttgatcgtcaagtacggcaccctcgacaacgtcgtggcacacgccgacgaggtcaaaggcaagatgggggagaacctgagggcacacatcgatgatgcgctcctttcccgcaaggtcgcgacgatcaggcgcgatgcaccgatcgatatcgacctcgccgacgcgaagttcccgacgttcgacccggccaaggtcgcaaaggccttcggcgacctcggattcacgggcatgacatcaaggctcatcgagctcgaggggaagggtgccgaggcgccggcagagcctgccgcgctggagcttccagctgtcgtcacgggcaagaaggcagaggcagcactcgacaaggcaatcaaggatggttcgtgggtaggatgtgcgcttgagcctctcgaggacaagaagcagatgtcgctcgacctattctcggatgccccgaagcgcgtgctctgggcagcaaccgatgcggtcctcatgcgcttcgagggagatgcgtgcgaagaggcgctctgccgccttgtacatgaggggaagcttgccgcaggagatgtgaaggcgcttctccatctcgtgtgcccctatgactcggcagatgctgccgaagtggaagctaaagagatagacccttcccgcatcttcgatgtcggcgttgcagactacctgctgcgctcggaaggcgtctcctatctcgtacctgacatctgctcccgtgtgctctcggctcctctgcctgagccgactgacaaggcgccggcggccgcactcgaagcctatgggtcccagctcctcgtgcccgagctcgaaaagcatctcaaggaggatgagtgcgacgagctcttctgcgaggtggagatgccgcttctgccggtgctcctccagatggagaggacaggactccatgcagacgctggagagcttgcccgccagagccaggagctcggatccgagatcgatgctatggcagagaagatccacgaggaggcgggcgaggacttcaatatcgactcgccgcagcagctctcccatgtgctcttcgatgtgctgggcttgcccacagccggcctcaagaagacgcgcaagggcttctattccacgaatgcgaaggtgctttccgaccttgccgagtcgagcgagatcgtgcgcgaggtgcttgactaccgcgagcgcaacaagatccgctcgacctatctcgatgccctgccggaagacatccgcaaggatggccgcatccatacgactctgaaccagaccgttgccgcaacgggacgcctctcgagctccgacccgaacctccagaacatcccgacccgctccgagctcggccacagggtacgccgtgccttcacagtgcctgagggctcggtatttctggcctgcgactattcgcagatcgagctcaggctcctggcgcatctttcctgcgatgagcatctgatcgatgccttctgctccggggccgatttccaccgccagaccgcagcacgtgtcttcaacgtgccggtcgaggaggtcacgcctgcccagaggagccgtgccaaggccgtgaacttcggcatcgtctatggccagcaggcctatggcctctcgacgtcgctcaagatctcccgttccgaagcgcagcagatgattgaccgctacttcgaggtctacccgggcgtgcgcacctatctcgactggtgcatccagttcgcacgcgagaagggctatgcactgactgcctatggcagacgccgctatacgcccgatatcaagagctcgaacttccagcgccgctcgtttgccgagcgtacggccatgaaccacccgatgcagggcaccgctgctgacatcatcaagatggcaatggtggaagtgccgaagaggcttgcagcagagggcctgaaatcgaagcttgtcctccagatccacgacgaactggacttcgaggtgccgaaagacgagatcgaggcgctctcccagctcgtgaaggagacgatggaaggcgtggcagagctccgcgtgcccttgattgccgaagtctcctatggtgcgaactgggcggaggcgaagtagggaatggcatcgttcgacgatttccagcgccagcacccggaggatgtgtctcgggctccccggcgcatgcaggtcaccatctatacggatggttcgagcaggggaaacccgggaccgggcggctacggcgctgtgcttctcttcacggattcgaagggcgaggtccacaggcgcgagttctcgcagggatacaggctcacgacgaacaatcgcatggagctcatgggagcgatcgtcgcgctcgaggcgctcaggcgtccctgcacggtcgagctccactccgattcgcagtatgtcgtgaatgcgttcaacaagcattgggtcgaaggctggcagaagaggggatggaagaccgcctcgaagcagccggtcaagaaccccgatctctggcggcgtcttctcgatgcgatgcgtccgcacgatgtgagcttcatctgggtcaaggggcatgcaggccacgagttcaacgaacgctgcgatgagctggcaacgacggcagcagatgaccgtgcatcctgggcagaagatccgggatttgctggatagggtacaggcaagcagattctctcgaggggcgggatatccatcctgcccctcttttgtgtctgcgctaaggagggcaaggcagctcttgcatatacccctcaggggtgttaagttagcagcatcaaacagacagagacaaaggagtgcctatgagtgctgtcgatatcatcatcatcgcgattgtcgcggttgccttcttctttgcggcgcgccgtgccggccagacattctctggcaagcgcgactgctgctctggtgccaagaaggatggtgccaagacgttcccgacccgcaggatcgaggatacggatgagtcgcactacccgtatgtggcagatcttgccgtgaagggcatgcgctgcgagaactgcgcccgcaatgtgacgaatgcgctcgattctgtcgatgggacctgggcaacggtcgaccttgcttccggcacggcacatgtgcgctcgaagaaggagatcgacgaggcggcacttgcccgtgcggtcaaggaagcaggatacaggctcgcctaggcctcgccctttccatcaggcatattgttcagacagcccttctgggtgtcggcggcgtcaagatacgccacgatgcctgggagggcttctgcaaagctcaggaggtcgccgcggaacatggcgcgcttcggccaggcatggccgacataggctgtcggcagtccgatatcggggtgcgggaaatcgcggcgggcatcgtttccgaccatgaggcactcgtcaggcgtgcacccgatgcttgcgcagaactcctcgtagtagcgggctgacggcttcgagcgcttcgagttgtcaagcgtcgagatggcggcaaagtcgtcgtccgtgacgcccgcccagaccatgcggacttcgtccgtcgcaagcgagaacaggggattcgttgccagggccgagatgaggcccaggctcttcgtggcttcgagcgcctcgcggacgccggcacgcggacgtgcctggacaaggccgtcgcgcatcatcgggagctctgtctcctcgtagcacgtcacggcatcggcaatcgcaggatctgccagggggatgccggtacgggcgtacacgatggaatcgaagagctggcggttcgtgaggtcatcggtgcgctcctggctatcaactgccaggtaggcctgggtgattgcgagcatcgtcttcggataggggattcctgctatcttcgagagcagcttcgcctcgcccgagagatactgggccacaaacgcagtcagattgatattgagcagcgtatcgtccaggtcgtataggaccgccttgatcatcgaagcaccctccggaattgccgaaacctctactacaccgttccccgcctgcagctcatctatgcagaggataggacgaaggtgcaggaatagaccattcggaggtccagggcaacaggagcgtccctggctggaaacctgtctgcatccttcctttcatgcgcgggaagccttatatgccgtctgccgcgctatggttgtcgctgagcgggaaatacggttcccaaggcattcaggtgtcttgggatgcgctattttcaaagtgaaattaaacatgtggccagcaggttcttgagcaagtggaacgggggtgcactgtggggaagctgggtccgaccgaagtggtcatggcaaacaggcgcctcgtgattcagtgcgtcctcgatgccggccatccctcccggacagagattgccgagcaatcagggctttcgacggccacggtgacacgagtcgtcgcctacctcatgacggtcggcatcctcgccgaggatacggcgcttgtcgcgacagagggcaggagccgcatccctatcatcatcaatccaagctacggcatcgtcgccctgattgagttcgagtgctacggcctcgtggtccatctcttcgatttcagcctcaaggagacggcatcggtgccgcttgcctatgccgaaacggcagagaagacattgaagcgcatctgccatgtcctgcccgatccgacatccttcggacgggagctccgcggcatcggcgttgtctggtgcgatggtgcacctggtgccgatgacagggaggcacgtgcgcatcttctgcgtcagctcaaggaacgctacggggtgccggtatgcgaacgcgatgagcaggagtgtgcggaagcagagatcttgagccggcaggcggagaccgtgcgcgacaaccacctgctcgtggccttcggctcgcgcgtgcgggtgagcatcgcccagaagggacagaccgtgaacctgcgcggaggcagctctgccgaccttacagagacgctcggacccgccgcaggcccctccttcgcagataccctgtcggaacttctgtctttcctgatgcagcttttcacgatcgaagcgatcttcttcatgttcaccggattctccagcagccggacgggccgcttcgaagcggtacgcgaggctatggctggattcaggaagaaggggagcgcttctgtccccgtcatctatttcgaacagtcatccgaagggcgccgcgccatcgtctcggccgaggtgagggaaagcgtccttctgaaagccgctgcctagcgcagctggcatatgttccaggttccaggcggagctttggcgcgcagggctccgagagatagctgccagaggcgaggccagcttctggcgcactacaagagaaggaggagagatgatagcgcttgtacgctgcgatgacaggctcatccatggccagaccatgactgtcgtcgtgaaggaccagaagatcgaccgcatcatcgtcgtggatgatttcacggccacgaattctgttctgaaggcagtgttcaagacagccgttccgccatccatgcatgccaacgtctataccgtcgaccaggcggtgccgaagatcgaggcggcaatgaacgacgacgtgcgcacactcgtgctcatgaagtcgccggaggtctatgcccagctcctggagaaggttccgaacatgccgaaggagctcaatgtcggcccgatgtcgaagcgcaagggcacgacagaggtgcacgcagcctgccatctcctgcccaaggaggcagaggcagtgaaagccagcgtcgcaaagggtgcccacatctatttccagcaggtgccaagccagccccgcatcgaatgggctgatgtcgaggaccgcttctaggcggtctggctgaaagaagaactgaatgcatgagcgtctttgactccctgcgcagcggggagctggggacgtgctatcaaggaggcatcgtatgacattcttccaggcatttcttcttgcactcttcggatggatgggatcgatctattcgcctgtcctcatcggcggccttgccggctggtatacgatcggcaggcctctcgtctccggcatgatcatcggcctcatcctgggcgatgtgcagaccggcatcatcatgggcgctgccatccagatgctctatatcggcctcgtgaccccgggcggcacgatgccggccgacgtgaactttgcggcctggattggcatccctctcgctatggtcgcaggcgccggcaaggaatatgcgcttgccctcgctgtgccgctctcgacgctcggcgtcctggcagtctatggcctctgcgctatcaacctgttcttcgtccacaagcaggatgagctcgtcgatgcaggaaagctcgatcaggctgcccgcatcccggtgattggccagattacgaacttcgtcctgcgcttcttcccgatccttctcatcaactacttcggtgccgatctcatctcccagcttgtcgctatgatgccgacccaggtcaccgacatcctccagatcttcgcgaacatgctcccgctcgtcggcttcatgctcctcatgcgtatgatctgcaagaccgacctcgagctcatcctcttctgcgtcggcttcgtgcttgtgaagtctctgggcctcgacatgatctccatcgtcgttctggcgctctgcatcgcctatatgcagtacaagagcactgccgcccccgtctctgaaagcgaggaatagccatgtctgaagccaagaatatcgagcaggagatcgaagactcgaccgagatgggtggtgccaagcatctgagccagaaggcgatccgcaaggcctactgggactggatgttctggaacctgtccgtgcagaacttcgagaggatgcagggccctgccatcatcaagatgctcggcgacatccgtgaagacctctatccgggcgacaaggaagctcagcaggagatgctccagcgccatgaggtgttcttcaacaccgagccgtacctcggctcgatcgtgccgggcatcgtcgtcggcatggaggcagcacgcgcagaaggcaacgaggacatcacgcctgagttcatcaacgcgatcaagactgccctcatgggcccgttcgccggcatcggcgactcgctccttccgggcacgctcatcccgatcctgctttccatcgcactcggcatgtgcccgaacggcgagctcacgggaccgatcttctacatcgtcgtgttcctcgcaatcatgctgccgctcacgtggttcctcttcagctacggcgtgaaggcaggcgcgaatgcagccgagaagattctctctggcggcatcaaggacaaggtcacccgcgccgctgagacgatcggccttgtggtcgtcggcgccatcacggcttcctatgcccagttcaacatcggctggacctatacgagcggcgacctctcgatcaacctcggcacgatcctgaactccatcatgccgggccttccggtcctgattctgtcgttcatcacgtactggctcatggtgaagaagaactggtctgctggcaagacgatgctgctcttcctcgtcatcgcgatcgtcggctacttctgcggcatcctcacggtgtctgcagcataggttcagcgcaacaggagcttttcaagacctggcttccctggaaggggaggccaggctcttttatggagagtctctgatgcaggcatagtaagaatagatatatctagagttgccatataaagaaagcatgggtcacttcccagaaatatcgggagattcgccctgcgagcttgcaatttcttcgccgatgaagatactcttaatactgcatgacgataacgtcgtgtacctgtatctgttggcccccgagagcatgcaatttctgcggtctgtgtctggtgcaacgaagcgcctctccgcacggcaagcggcaatcatgacgaccggggccccgtttccgaaaggggtccacctttgagtgagattcagaactcgtccatcttctccctggatgatgtgtccgatgaggagatgaacaacctcatcgacggctccgtcaccgatttcgatgagggcgacctggtgaccggtgaggtcgtcaagattgagcatgatgaggttctgcttgacatcggctacaagtccgaaggcgtcattcctgcccgcgagctgtccatccgcaaggatgtcaatcctgctgacatcgtgaagctcggcgacacgatcgaggctctcgttctccagaaggaggacaaggaaggccgtctgatcctctccaagcgtcgtgctgagtacgagcgcgcctggaaccgcgtcgaggagaagttcaacaagggcgagaacgtcgagggcgaggtcatcgaggttgtcaagggcggcctcattctcgacatcggcctccgtggcttcctgcctgcttccctcgttgacctccgcagggtcaaggacctcaacgcctacctcggcacccgcatcgaggcccgtgtcatcgagatggaccgcaaccgcaacaacgtcgtcctctcccgccgcgtcgtcctcgaagaggcacgcaaggcagagcgctccgagatcctctcgaagctcaagccgggcatgcgtctcaagggcaccgtctcctcgattgtcgacttcggcgcattcgtcgacctcggcggcatcgacggactcatccacatctccgagctctcctggaaccatgtcaaccatccttccgaggttgtcaaggtcggccaggaagtcgaggttcaggtgctcgacgtcgacctcaatcgcgagcgcatctccctcggtctcaagcagactcaggaagatccttggcgctccctcgtcaagaagtacccggtcggcgctattgtcgagggcactgtcacgaagctcgtcaccttcggcgcattcgtcgacctcggcgatggcatcgagggtctcgtgcacatctccgagatggccaagcagcatgtcgacgctccgtcgcaggtctgcaaggtcggcgacaaggtccaggtgaaggtcatggagatcgatctcgatcgtcgtcgtatctccctgtccatgaaggctgctgccgagacgctgggcgtcgaggtcgaggtcaagccgctcgacaagccggaaggcgaggaggctcctgctgaggcagaggctgagaaggacgccgagtagcttctagctccatagcgctgcccaagcggcaggaagccaagtggcttcctgccgctttttctgtctcgttacggggcgtgaacgaatcgggacagctggctacgattcaggtcccgtttccatgaaaatgtaaactgcccgttaagctcctgcccgaacagctcctttcaggaagcaataggctactttgttacctgcataactctggaggcgtctgcttccagtgtggctttcgggccttgtgcccggaaggggagaacacagaaagggacaaacatgacgaatgtgacacgtcgcagcttcgtgaagggctctgccctcgcaggtgctggcgctgctgctctgggccttgctgcctgcggtggctctggcacggccacgactgaatccggcgacaagaagaagatcctgcgcttcggtcagtccaatgccaaggaaggcatggacatgcagaagtcgacgaactccgccgagtcctcgatctccgagtccgtctgcgaggctccgctgcgctggaacgaggacaacgagcttgtcacctgcctgctcgaggaggtcccgacgttcgagtccgacggcgtgacgctccactgcaagctcaagcagggcatcaagttccacgatgggaccgagctcacctcgaaggacgtcaagtacacgttcgagcgcatgatgacgccgtcgacgggtgccaagtccacctatatgtacgacatgatcgtcggcgccaaggagatgctcgcaggcgagcgcgacaacctcgacgaaggcatcacgtgcgaggacgactacaatttcacgttccacatcgtgtcgccgatggtcaccttcatcaacaacctcggcatctcctatgcccagatcttcccgcatgaggcatgcgaggcagcaggcgatgcctggggcaccggcacgaacttcatcggcaccggcaagtacaagatcgtctcgaacgacgatacgaccgaggtcgatatggagcgcttcgatgactaccatgacgggaagccggcgctcgacgagctgaagtatgtcttctacgacgacaacaacacgaagctcatggccttcaagaacggcgacatcgactactgcgacctgtccgcagagctcctgcagcagtaccagaatgaccccgaagtcgctccgctcatcaaccagtatgagacgctcggtgtccagttcgtgaacctgaacctctccgacggcatgggcctcacagacgtccgtgttcgccaggcactgtccctcggcatcgaccgcgactcgatcgtcgagaatgtcgtcaacggcgctggcacggtcgctacgggctggcttgctcctcagacgccgggccacgacgattctgcacctgccttcgagtacgacgtcgagaaggcaaagcagcttctctccgacgcaggcgctacgaacctctccctcacggccaaggtcaggagcggcgtcaaccagcgccagctcgtggcaatccaggccatgtggcaggagattggcgtgaacctggacgtccaggtcgaggacaacggcgtctggtcttccgactgggcagcaggctctcttcagatcaccgcactcggctggttcccgctctatgccgatgcagacaaccacatgtacacgtacttctacagcgccaacgctgcgaagaagtcctcgttctacaacaacgcgacgttcgacgatctcgtgagccgcgcccgcgtctcccaggattcctccgagcgtgcagacctctacaagcaggcagacgacctgctcacgcgccaggactatgcaacgcttccgctctactggccgaagaaccagctcgttgcaaaggactacgtcctgaacgcaaaggtcggcaacctgatctaccacatgttcgatgtggacatcgacacgacgaaggacgactacagccctgtcgagtaggtggtatcaagtctctgaaggttgcacgccgtatacgagatagaaacttgaactgtctatgctgattgggagggtgcctctccggggcatcctcccgttactttaggagagggctgcaggacagaaagaaaggacgagggccaagggagccgtccttcctttccgtgctgcgagccacagaacacgtgggaaggagcgacgatgaagggctacctcgtgaagaggatcctgcaggcactcggtgtcatcctgtgcatctctgcaatcacctttttcgtcctgaacatcgtgccaggcgaccccgtccgcatcatgatgggcgatatggccgatgagaacacggtccagcaggtccgccacactatgggcctcgaccgtccggtgtgggagcagtacctcagctggatcacgaacatgctgcagggcaacttcggcacctcatatacgcagaagaaggcagtctcggtcctcatgggcaatgctttcggcgtgacagcgcgccttgcaggctttgcgtatctgttcgcgcttgcactgggcctcatcttcggcgtgcttgctgccgtgaaccacggcaaggcgcttgaccgtgtcctcatgggacttgccatcttcggcatctctgcgccggccttctgggtggccatcatcctccagatcgtctttgcgctgaacctcaagtggttcccgctgtcaggcacgaagtcggctgcggccttcgtcctgccgacgatagctctgggcgtgcgctatgcagcatcgattgcccgtgtcacgcgcacctcgatgctcgatgtcctgaaccaggactatatgaggactgcagaggcaaagggcctcaagaagtggtccgtcatcctcggccatggcttccgcaatgccctgatcccgatcatcacgattgctggcacccagctcggcgacattttcacgggatcgatcctcatcgagtccatcttcgcgctgccgggcatgggcaagctcctgctcgatgccatcaatgcgcgcgacctgccgctcatccagggcggcgtcatgtacattgccgccatatgcgtggtcgtctatctgatcgtcgacatcctgtatgccgtggtcgatccgcgcatccgtctcggaggggaggctgctgaataatggcactcttgaacagcgacaagaacgacaagcgcacccagaatgctgagcgcattgcagacgatatcgcaaggggcaacctcgaggcttcggccaaggcaggatctgccaaggccggatcgaagcgcgcttccacctactgggccgtgtcctggcagatcatgaagaagaaccgtgtcggcatggtatgcctcggcatcatcatcttcctgattgccgtcgcaatcctggcgccggtgctggcaccctacgatcctgatgcccagacgctttcgaacatgctcaaggcaccttcggcagagcatctcttcggtacggacgagtatggccgcgacatcctgtcccgtgtcatctatggctgccgcgtctcgctttccgtcggcgtcgtctcccagctcatcgcaacgctcatcggcttctttgccggcgtctgtgccggatacttcggaggcgctgtggatgccgtgatctccttcatcatccaggtcttctcgagctttccgttcctcctcttcgccattgtcgtcatgtacgtcatgggtcctggcctcatcaacctctatgtcgcactcggccttctgatgtggacctcgacagcacgactcatccgcggcgatgtcatgcgcctcaagggctctgagtacatccagtcctgcatactttccggcggctcgagctggcgtgtcatcacccgccatctgctcccgaactgcgcctcgaccctgatcgtcacagccacgctcggcatcccctctgccatcatgagcgaggcatcgctttcgttcttgggcctcggcgtccagccgcccatgtcgagctggggccagatgatctcggcctcccagccctacatccagtccaatacctactacagcgttatcccgggcatcgcgatcatcatcacggtcatggcattcaacctcttcggcgacgccctccgcgatgcgctcgacccgaagatgcgttcgtagggggaggagcatcatgactgataccgtacatgccatatcggaagcggaccgcatctacgcgcaggagctcgagaggcagcagaagcaggcccacaagaaggatgtcctgctcgatgtggacgacctctgcgtcacgctcttcacggaagatggtgcccttcccgcaatccagcatctgtccttcatcatgcgccgtggcgagacgctcgctgtcgtcggcgagtccggctgcggcaagtcgatgacggcactttccatcatgggccttctgccccagccgcctgcaaaggtgacgggcggtgccatcaagctcgagggcaccgacctcacgaagctctccgaggatgagatgcgccagtaccgtggctccaagatcggcatgatcttccaggagcccatgacgtcgctgaacccggtcatgacggcaggaaagcagatccgcgagggcatcctcgtgcacaatccgggaatggcaaaggaggaggcagacaagcgcgctctcgagatgatcaagcttgtcggcatccccgccccggagaaggtcttcaagagctatccgcatgagctctcgggcggcatgcgccagcgcatcatgatcgctatggctcttgcctgccagccgtcgctcctgatctgcgacgagccgactacagctttggacgtaacgatccaggcacagatcctccagctcatcgaccgcatgaagacggagctcggcacagctgtcatgctcatcacccacgacatgggcgttgtctccgagatggctgactgggtcatcgtcatgtacgccggacacctcgtcgagtacacgatggcaggaacgctcttcaccgatccgaagcatccctactccgtcggcctcatcaactcgattccgtctctcgacaacgacgtggatacgctctatgcaatcccaggcaatgtcccgatgctgaatgcgctgccggatgggtgccccttcaacccgaggtgcccgtttgcaaaggacatctgccgcaagcagtgcccgaagctcgaggcaatcgacggcgacgagtaccacaaggtcgcctgctggaagtacaccgatgcatggaaggaggactagcatgagcagcgaggcagaaagcaatggagtcgtgctcaaggtcgagcatctgacgaagcattatcctgtgaaggcaggcgtgttcggacactccgacaaggtcgtgcatgccctcgaggatgtctcgttcgagctgcaccgcggcgagacgtttgctatcgtcggcgagtccggctgcggcaagtcgacgaccggcaagtgcatcctgcgcctcacggagcccacgtcgggcaaggtcatcctcgacggcgaggatttcacggcgctcaagggagaggcgctcacgaaggcacgccagaagatgaagctcatcttccaggacccctatagctccctgaacccgcgcatgaccgtctctgacatcatcgcagagccgatcgatatcgcaggtacctacaagacgaaggcagaacgcgatgcccgcgtcgaggagatcatgaaggccgtcggcctcgacctcgagttcaagtaccgctatccgcacgagttctcgggcggccagcgccagcgcatcggcattgcccgtgccatcgtcctcgagcccgagatcgtcgtctgcgacgagccggtctcggctctcgacgtctccgtccaggccaaggtcatcaacctgctcatagagctccagaagaagctcgggctctcctacatcttcatcagccatgacctgtcggtcgtgaagcacatatccgacaccgtgatggtcatgtatctcggccacacgatggagctcgcctccaagaaggacctctacgccaatccgctccatccctatacgaaggccctgctcgatgtcattccccgcatccgccacgagcgcatccaggacaagaagattctcgagggcgacgtgccatccccgacgaatccgccgaagggctgcgtcttccatacgcgctgcacgagctgcatgaaggtctgcaccgagcgtgcacccgagatgcacgaggtggagccgggccacttctgcgcctgccacctcttcgacaaggacctcaccgaggcagagcgccagctcgaactcaacgagacgcttgttgcagaagagaaggcagatgccctctcctagaagctgactccatagagagcaagcgcgccggcatcctgagggtgtcggcgcgctctttgtagctctgaagctgatgcttactggtagcggagtgcttcgatcgggtcgagcttggcagcccggcgtgcggggtagtagccgaagatgatgccgatcaggatcgagatgccggtcgcaatggcgatcgaggcaaggtcgagcaccggcgtgatgccgccgaagccggcagaggccagaagagagcctgccagctgcgccacggcaagagagccgagatagccgaagacgatgccgaagatgccgcccgtgatgcacaagatcacggactcgagcaggaactgcttcgtgatgtcggagctccgggcacccagcgccttcctgagtcctatctcgcggatgcgttcggtcacatttgtgagcatcatgttcatgatgccgatgccgccgacgacaagcgagatggaggccactgctgtcatgagcagctggaatgtcatcatcgcgctgttgacctgatcgatcgcagactgcatggctgatacgtcatattgccccctatggtcttccgagctctcgaggtggtagtgcttctgcacccaggcatcggtctctgcgacaagctccatcacatccttgtccttgcgggcgaggcctattgccgtgaatgccgggacgctggtgtatccgagacgcctctgacaggtcttgaacggcatgtaggacgtgaggatcgagctcatgcctgcctgagattcatacacgccgatgatcgtgaagttcgcattgacgaggcgtaccttctggccgacggcaccctctgcgtccatgccggtaagcctctttgccgcaccctcgtcgacgaggaccacgttcgcggcttcctcgtcctccatgtctgtgaagaagcggccggaaatgagcttcgtgcccataatcttgaagtagctggcctcgacgccctggacctggagataggagtcggagcttccgccattctgcgaggagttcgaaaggtcgacgccggcattgttcgtgaggctgatggcttcatagccgtccacgctctgcttgagcgagtcgatttcggtgctcttgatgcccgatcccacaccgatcgtgatgatccgggcacggtttgcgcccatctcgcccatgatggactcgcggacgccgccgatgagccctgtcatcgttatgacggcagcgatgccgatgacgatgccgaggattgtgaggagggagcgcccgcggttcgcatcgagcgcctcccaggtctcctcgaagtagtctcttgctctcatgtgcgccccctttcgtgggacccggactgggccacccaggcccgttcctcctcgtcggtgagcagatgtccgtccctgatatggacgcagcggtctgtccaggaggcgacctctgcatcgtgggtgataaggacgatggtctttccttcatccctgagcttcaggaaggtctcgaggataaggcggctcgttgcagagtcgagatttccggtcggctcatcggcaagtatgagcgccgggtcgttcacgagggcacgggcgattgcgacacgctgcatctggccgcctgagagctcgttcgagcggtggtcatagtactcggcaggaaggccgacggcggcaagggctgagcaggcccgctgctcccgctccttcggaggcagcgggccatagaggagcggcagcatcacattgcggagcactgtcgcccgcggcagcaggttgaaggactggaagacgaagccgatgcgctcagagcggatctgggcaagctcgtcgtctgtgagcttcgagacatcgaggccttcgagcttgtatgagcccgaggtcggcgtatcgaggcagcccatgatgtacatgagggtcgacttgccggagccggagggtcccatgatcgacaggagctcgccacgcttcaccgtgagcgagacgccgcgcagggcatgggtcgggatgcccccttcgtcgtagatgcggtgtatgccctgcatctcgatgatcggggtcatgatgagaccttcgtcgagcctgctgtggcaccttcgtccaaggcaggggatgaggaggaatcggaatctgctgcatcgtagccggagatatcgacctcgtcgccttccttcacgttcgtgatggcagcttcatcggcgttcttcgcaaggatctcgaccgtgcgcttctcccagcttccttcctgggcaggatcgtcgcccttgagtatccagacataggaggagccgtcttctgcctcgtgcagcgctgcgatcggcacgatcagtgagtcgggcacatcctgcgtcacgatggtcgcatctgctgtcatgcccggcttcacgcgcggatcgggggcggggatgatgagggagaccttgtaggtggctgtgctgctgtagccgtagccatagctctccgagctctcagaggccgtggcgacacgctcgaccgtgccttcgagcgtgacatcaggcagtgccgagaacgtgaccgtggcgctctggccgatagcaagcgaggagatatccatctcgtcgaccgaggtcgtgacgcggagctgcgaaaggtcggctatctggacaagaggtcctgtcgttgcgctgccggatgcagcggcggcaccccaggaggcaccattctgggcattgacggcgatgacggaaccggagacgggagcggtgaccgtgcgcttgtcagccgttgcctgggcatcggccacagcctgctgggcatttgccagcgtcgtctttgcagcatcgaccgagcttgcagcaggcacgaccgtcgagtaccagacatcgtccgggtcctgcatcatggtctgctcttctgcagtcttggcgctgttccaggtgttcagcgctttcttgtacgtgcggtatgcctggtcataggtggcattcgcatcgtcgagcgcgcgctgggcggaggctgcctcctgctgggcctgcgtcacggcgcggtcgaggctgtcgttcttgagggtgaagaggacatctcctgcattgacggtgtcgccttccgagacccgcacatcctggatgatgccatccgcttcaggcgtcacgacggtgctcgagaccggctgggcagagcccgagaccgtgaccgaggagatgaggtcgcccttgtagacgaaggtcgtcacgtgctcgatcgtgccggtgccctgagaggcgaagagctgcggcaggatgaacgctgcggcagcagccgcgatgacagcacagatgatgagggcacggatacgcttcttgcgcttcttctccctgcggacacgctccaaggcagcaaaggcagcaaggccttctgcatcctcttcggcttcggtacgcggcagctgtgtcgtggcagccgtctttccgagtccttcgccaggcgccaggacatcgaggggcttcggcgctctgtcttccggcacgtgcttgttctcagccatggtgcacgctcctttgtctgtctgagggaggggccattacacacaagagatagggaatgcagttctgaaagaaagcttgaatcaaaggtacccatagaagccagaaggcgcgaggcgctggaaccatatatcggccagcggatttttggcttctcgatgctatcgtctccttctgcctcccatctatccatcgatatgtccgtctctttccttacatctctgtaaggcaggcacaaagaaagggaggagggcgcatgccctcctccccaagaagcccaatctttgcctgccagctgctatgcgctgtaggtcattcccttgaagtggaagtcgaccaggatatcgaggccgtcgtagcccttgcgcaggacatacgggttctgcggccagacgacaggaatcgtgccgaagtcggtgcggacgagctggttgtctgccttgatcgtgttctccttcgccgtcgcatcgtcgagggaggcacgtgcggcatcgacgtagccgtcgaaggcagatgaattgtagaagctcgagcgctgggaggcattcgtgctgtagaagtaggatgccatgtgctcgacgccgacgaacgagagcgtcgaccaggtcacgagcgtgacctggagcgtgccgttcttgcgggagtcggcccagaggcccgcatcgatggtctggacatcgacattcacgccgatctggctccagtagttctggattgcgaccatgacagactggtcctggctcctgacctgggcggtgagggagaggccatccgctcctgcctcggcgaggagctcacgtgccttctcggggtcgtactcgaggatgtcggcgccttcgtcggagccggtctccgagggcgggatgaagcccgtgcaggggatggcagcaccggaaaggaccgtatctgccagctcctggcggttgattgcgagggagagggcctggcggatgcgggcatcctggagcttcggctcattgaggttcaggctcacgaactgcgttgcggcaggcgtgtagaagacgatttggtccttcacatcgtcgtccgattcatacagctgcaggagcgacgtgctgaagaagcagaggtcgatatcgccgttcttgtagttcatcatgcgtgtgttcgcgtcatcgatgtagagcacgtcgacctcgtcgatggcaggcttgccctggtggtagtcctcgaaggccttgagcacgacttcggaggactcatcgttcgactcgaggtagaagggaccggatccgatgaagttcgtgccggtgccccaggcatcccctgcggcctcgcaggctgccttcggatagatcgaggcatagaactggcagagcatgttgaggaaggaggagtagacctgacggagcttgatcgtgaagtgcgtatcatcgaccacggtgaagccggaaagcgtctccgctgtgccatcgagcacttcctggccgccctcgatgtagacgaaggagtcggcctcggccttcttggcaagaagacgcgtgagcgagtactcgacatcctctgatgtcatcgtcgagccatcgtggaacttgatgccgtccttgagctcgaaggaatacgtcaggccatcatcggacaccgtcggcagctgggtcacgagcagaggctcgacctcgagcgtcttcgtgttgagcgtcacgagcgtgtcgcagatgttctccgaggcaccccaggtgctcgacgtcgtctgtgtatcgaacgaggtcttcgagttcgtcgtgccgaccttgaggacgacggagtcggacgtggacgtgctggcattcgagccgccgcaggcggcaaggcctgctgcagaggcggcaacggcggcgccgagcgctcccctcaggaatgagcgccttgtgacgctttcgggcaggatgtggctgagcaccgtctgtctcgggctggtcatgcgggttcctctctcttggcggctctgcggcttggcagggcagcatccccggacatgcaagattaatggctacactttactaggaattagatagatttccatgcctcgagacccatcatgtaacaattccagcctctccgaaagatgctttcggcaatggagcagctttcggagaggctggagtgcagccggcttgcgatgtgtctttcgtccagttctaggcgctcttggacatgtccttgtagtggaagttcacgaggaccgagaggccatcgtagccttcgcgcaggacatagggggtcttcggccacacgacagggatcgttgcgaagtccgtgcggacgagctggcggtctgcggcaatcgtgtcttcctttgcctcgtactgtgtcaggagcgaggtgctgaagaagcagaggtcgatgtcgccgttcttgtagttcatcatgcgggtgttcgcatcgtcgatgtagagcacatcgatctcgtccaggcctggcttgccctcgtggcagtcctcgaaggccttgaggacgacttctgaggaatcgtcgttcgagtcgagcttgtaggggcccgatcctatgaagttcgtgccgatgccccaggaatcccctgcagcctcgaaggctgccttcggatagatcgaggcatagaactggcagagcatgttcaagaaggacgagaagacccgcttcagcctgatcgtgaaatgcgtgctgtcggtggcggtgaagccggaaagcgtcgtggccgtgccgtcgagcacttcctggccgccctcgatgtagacgaaggagtcggcctcggccttcttggcaagaagacgtgtgagcgagtactcgacatcctctgttgtcatcgtcgatccgtcatggaacttgatatcgtccctgagctcgaaagagtatgtgaggccatcgtctgagacgtcaggaagcttcgtcagaagtaccggcttcacctcgagcgtgtcaggatcgagctcgacgagcgtctcgcagatattctcagaggcgccccaggtaagagaggtcgtctgcgtatcgaaggaggccttcggattctcgaagccgaccttgagcacggcaggggaggagccggaggtggaggcagcctctccgccggagcaagcggtggcgccgatggcagctgctgccacggcagagccgagcgctcctttgaggaacgagcggcgcgtgagggatgccggaagcgcatgcgcgatggcaaaggtctgatggccggccatgaagatcagctccagcctctccgggatgcccggagctcgggttatcgataaagcgcataggatgaacggtacacgctgcagaggtgcagcactatcgatgtaggcgaagctttctgagattgcagcgaaatggaaacaggcaacacggagctgcaaacatgtccacctcgcaaaaattgatggatgccccgtgcgcgccctgccctggcggcgcacaatggagaggtctgagaacgagagaaaggatttccatgagcgatgtagtcgaccgctttgtccgctattgcgcaatcgcttcgcagtccgacccttcggtggatatcacgaagccggagaacatcccgacgacgaagacgcagttcgctgttgccaacgctattgcagacgacctcagggagcttggcgcggaggacgtctctgtcgacgagcatgcctatgtgatcgcccactggccggcaagcgcaggcctcgaggacctgccgtgcctcggcttctgctgccatatcgatacggcctggcagacctggggcgatgaggtgcatcccgagatcaagcactacgagggaggggagcttctgatcggcaccgggcgcgatggcaagccggtcacgatcagcccgaagacgaacccggcacttgagcacatggtcggctgggatctcgtgacaagcgatggcacctcccttctcggtggcgacgacaaggcaggagacgccgagatggtgagcctgctcaagcgtctcaaggacgacccctcgattccgcatccgcgccttgcgttctcgttcgtgccggatgaggagctgggacacggtgctgcccttctcgacctcaagaagttcggtgccgactatggctacacgatcgacggcggaccgctcggcgagttctgctacgagacgttcaatgccgccgaggcgaaggtctatgcaacgggtcgctcggtccatactggcacggccaagggcctcatgatcaatgcgtccgaggctatctggcagttccacagcatgatccctgcccaggagcgtccagagtacacggaaggctatgacgggttctactatctcgagcgcgtcgagggcaactgcgagatcgccgaggccgactacatcatccgcgaccacaagcaggagctcgtcgagaagaggaaggagctcatgcgccgcgcggtcgagctcgtgaacctccagtacggcgaggaggtgctcaggatcgagatccacgaccagtaccataacctcgcagatgtcgtgacgaagcccgagtacaggcacctcatcgacaatgcccgcgaggcgtacggcaagatcggccaggacatgcgctgcatcccgatgaggggcggcaccgacggctcccagctcagcttccgcggcttcccgtgctgcaacctgagtgccggctactataacgcccacggcgtccgtgagttcgtgccggtgccggagctcgaggcaatggtggacatgctcgtggagctcgtgcagctctacgcaaagaagcaggaggcataaggtggcagatacggcaaacgaggtcaaggcggagaaccttctcgccctcacgcgcgagctcatatcggtcgactctcctgtcggctattaccctgagatccatgcatggctcaaagaccgcctcgcttcctggggctatgagatgtacacggacaacaaggcaacggcctatgtgaaggtcgagggcgaggacacgtccaagaccgtgatggtgggagcccacctcgatacgctcggcctcatcgtccgtggcttcaacgacgacgggacgctccgcgtgcgccagcttggcggcgtcaactaccactcgctcgagggcgagtgctgccgcatccattgccgcgatggccgtgtcgtgccaggacaggtcatctgcgagaagcactcggtccatgtcttcgaggatgcgaagaccgtcgagcgcaccgaggatacgatgttcgtctccgtcataggcgacgtgaagtcccctgaagatgcccgcgcgctcggtatcaccgagggtgccatcgtggcacccgacccgcacttcgagtccttcgataacggctatatcgtctcgcgcttcatcgacgacaagggagccgtggcagcgcttctcgatacgctcctgtggctccacgagaccggccagaagcctgctgtgacgacgctcttcgccttcccgatctacgaggagatagggcacggcggagcatatgtgccccccgaggtctccgagtatgtggcgctcgatatcacgctcatcggtcctgactacgacgccgacgagcacaatgtcggcatcatctgcgcagaccacaagggcccctatgactgggagctcacgaaccgcctcatccgctgtgccgagagtgcctgcacgccgggacgctggaacacgcaggtctgcttccattactccacggatgcgaatgctgcctatgtcctcggcaacaatctcgcttccggtgccttcggcatggcctgcatgaacacgcatggccgcgagcgctgccatgttgatgcgctcgtcgagacggaaaagcttgcccgtgcctacctcatgggccagggccgcgcatagcctcgtggtgcttttcggtctttgggaaaacatggtggcaagagctgctccatgtgggcatcatagatagtgactgaacgacccgcgggagcggcactgaggaaggactggcccatgcagaaggggaacaagaacctgaacgatttcatgcgcggcaggaatggcaccgacgagcttgcggtagcatcgctctgcgctgcgctcattctcctgatcatcaatatcttcgccagccagctctggctcacgattgtcgtcctggccttcgtcgcctacggcctcttccgcttctttgcaccggcatccgagcagctgagggagcagaatgagcacttcgtgaagatcgtcggccccgttgcgccgtggctgcgcgacccggcagctgccctgaaggagtcgcagcagtacaggcatctccagtgcccgcactgcggccagatggtccgcgtgccgcgcggcaagggcgccatccgcgtcacgtgcccgcgctgccacgagaagttcgacacgcgctcctaggagaattcgatgtaccgccttttccttgccggaggcaccgcctccggcaagtcctctgccgccaggtatctggcccagaagggcgccctgcgcatagatctcgaccagctctcccgtgccgtcctggcgccgggagagccgtgcgttagagagattgccgatgccttcggatccgatctcgtcgatcctgcgaccggcatcctcgaccgccaccttctggcagagcgggccttcaaggatgcagcctcgacgaagaggctcgaagacatcgagcttccccatatcaccggtgccttgaaggccatcctctccgagggacaggccgaggtcgcggtcgtcgagattcctctgcttgacagggcagagtcctacttcgacgaggcagacgagattgcctgcgtgatcacgcctctggcactccgccgcgagcgtgccatcgcgcgtggcatggacggagccgatttcgaccatcgagtcgcccagcagccgaccgatgcctacctcgaaaagaaggcagataccgtcttcaggaacgacggcgacgaggatgcgctcagagcgcagctcgatgcatggtggaagaagcgtgaggctgccggctggcaggggagggcgcgatgagggcacatggctgcggcggctgccttctgcgcatcatcgtctgtgtcctggcggcaggcttcatctggcagctcttcggagccgatctcgagctctatgcgaagaaggcagagcgccttgcctatcctgtctcctacgacgaggcgatactcgcatcgtctgagcgccacaacgtggatccgcttcttgtctgtgccgtcatcaagtgcgagagcagctgggatccgtctgtgtcgtcgggtgccggcgcctgtggcctcatgcagctcatgccggaaactgcagaagagctcatacgccagggctatgtggatggcagcgtgtacagcgcagatgcactctatgacccggagacgaatatcgagttcggctgtgcctacctcgagcttgcaaggcacgagctcggcagcacggatgaggtcatcgcttcctacaatgccggcatcggcaaggtgaaggagtggctcgcattcggcatgggctccatctcggagctttcccaggagtatcccgagacggcgacctatctcaagaaggtccagaatgcctatgagcgctaccgggcactctatacggaaggccttgctgcgaaggcctgagctctgttgcaagaacagatgttcctgtatgatagctgcaggaggtcatgatggcagacaaggatgaagatcagttctcagagccgcttgccggctcgaaggaggcgcgcgagcgcttcggtgccgagctgaagcgattcggtctcggtgcagactcatcgaagctcgaggtcgtctcgccctatgagccggcaggagaccagccccaggccatagagaagctggcagacggcgtgaggcgcggccttcgctaccagacgcttctgggcgtcacgggctcgggcaagacattcacgatggcaaagacgatcgaggccgtgaacaagcccacgctcatcatggagccgaacaagacgcttgcggcgcaggtggcaggcgagatgaaggagctcttcccgaacaacgccgtcgtctacttcgtctcctactatgactactaccagcctgaggcctatgtgccgcagtccgatacctatatcgagaaggatgcctcgatcaacgaggaggtggagaagctccgccaccaggcgacctcgagcctgctctcccgccgtgatgtgatcgtcgtggcgtccgtctcctgcatctacggcatcgggtctccgcaggactatgcagggctcgctccgaacatcgacaagtcggagccgctcgagcgcgacgacctcatacgctccctcatcgatatccagtacgaccgaaacgacctcgacctctcgatcggcacgttccgcgtaaggggagacacggtcgatgtctggccgccctatgcagagaatcctttgaggatctcgttcttcggcgacgaggtcgagctcatagccgagatcgacaaggtcacgggcgaggtcatccgcgagttcgatgccatccccatctggccggcatcgcactacgtgacagagcgcccgaagatcaaccacgcactcaagaccatcaacgacgagctcacgcagcgtcttgccgagctcaaggcagacaaccgcctcctcgaggcacagcgcctgaaggagcgcacgtcctacgacctcgagatgctcgagaacatgggctactgcaatggcatcgagaactattcgcgccacctcgatggcagaaagccgggcgagccgccctatacgctcatcgactacttcccggacgatatgctctgcatcatcgacgagtcccatgtcacggtgccgcagatccgcggcatgcatgaaggcgaccgctcgcgcaaggtcacgctcgtcgagcatggcttcaggcttccgtccgctctcgacaaccgcccactgcgcttcgacgagttcgagcagcgcatcccgcagttcatctatgtctcggcgacgccgggagactacgaggagcaggtctcgcagcagacggtggagcagatcatcaggccgaccggccttctcgatccgaagatcgaggtgcgtccggtccgcggccagattgacgacctcatcagcgagatcaaggagcgtacggcaaagaaggagcgcgtgctcgtgacgacgctcacgaagcggatggcagaggacttgaccgaccatctcctcgacgaggggatcaaggtcaactacatgcactccgatacagcgacgctcgaccgtgtccgcatcatccgcgagctccgtgaaggcaagatcgatgtccttgtcggcatcaacctcctgcgtgagggcctcgatatccccgaggtctcgctcgtcgcaatactcgacgccgacaaggagggcttcctcaggaacagaaggtcgctgatccagacgatgggacgcgctgccagaaacgtctcgggcgatgtcatcatgtacgcagacgagatcacggactcgatgcgcgaggccatcgacgagacgaggaggcgccgctcgatccaggagaagttcaacgaggagcaccatatcgtgccgcataccgtgcgcaaggcgatcaacgatatctcggccttcctggcagaggcgcacgatacgctcgatacgaaggagaggaaggacggcgtcttcttcacgccggcaggatctgaagcaggagatgctcctgccatgacagaagagcagctcacggaggacctgaagaagctgccgcgtgccgaggtcgagcgcctcatctcgaccctccaggaagagatggcagcagcctccgagtccatggactacgaggaggcagcgcgcgtgcgcgaccagctcgtccaggtgaaggcgctcgtcgagcacacgaccgaggaggatgtgatgcgccgcctcaaggccggtgcccggaagggctccgagcacgcgacaaggcgccgctaccggggaccgcgcaagcattagaaggtgcagaaaagagccggggcagcacgcgctgcccccgcttcacatctgccagttctttctgcgccctattccctggtctcgcgtatcaggtgctcggcgcagctgatgccatccgctgctgcgctcatgatgccgcctgcatagcctgcaccctcgccgcagggccagaggcctcttgtagagacggactggccatccttctcgcgcacgacacgtaccggggaagaggagcgagtctcgacgccggtgagcacggcatctgccacatcgaagcccttgaggtgcttgcccatctgcggaatcgcagcgcgtagggtctctgcgatgtagggaggaagagctggctcgatcgtactccaggtgacgccacgcggataggtcggctggacggtgcctgctgctgacgatggctggcctttgaggaagtcgccgacaagctgtgccggtgcctgataggcgcccccgccaagctcgaatgccttcctctcgcaggaacgctggagcgacagccctgcgagagggtcgtctccgggaaggtcttcgggaaagacattcgcaaggatgccggcattcgcatttgtgccggcacggtcggagaggctcatgccgttcgtgcagacgccgccttcctcactggctgcggcaaccacatagccgcccgggcacatgcagaagctgaaggcgctcctgccggaaggcaggtggctcacgagcttgtagggggcagcgccgagtgcgaggtgtcctgcagcaggcccatactgcgccttgtctatctgtgtctggagatgctcgatacgggcacccatggcaaaggtcttgcgctcgagcgttacctgcttcttatggaggagctcgaagacatcgcgggccgaatggccgcaggcaagcacgacctcatgcgctgcgatatcctcgccgcgctcgatgccttcatgctcctgcgtcacatggatgcctgagattgagccatcctgggcaaggtagatgtcatcaagcctgcagcggaagcggacctcgccgcctgcttcctcgatgcggtgcacgatgttcgtgaccacatggggcaggatgtcggagccgacatggggctttgcgtcccagaggatgcgctcgggagctcctgcctcgacgaaggtctcaagtatcagcctatggagcgggctcttcgtgccggtctggagcttgccgtcagagaaggtgccggcgcctccaaggccgaactggatgttgctctctgtatcgaggaggccggtctcattgaagcggctgacccgcgtggtccttcgctccgcgtcatctccacgctcgatcagaagcggggagaggcctgcctctgcaagcgtgagggcacagaagaggccagcgcatccggccccgacgacaatcgggcgctcatcgagcgtcgaggtatgccgctgcgggaagcggggcggcacctcgtcgaccgtgcggacgtttctgtcctggcggtggtgggcaagacggcgcaggaaagcacgctccttctccttgccgcccacaagcgcgatgcgcaccgtgaacatcaggtggacatccgacttcttgcgggcatcgatcgagcggcgcctgagctcgaacgaggcgatctgtgccttcgtgagatggtatttcttcagcacatgctgctcgacgatgtgcttttcggactcgacggtcccatccagcgttcccagaggtattgctatgtttgagatttcgatcacagggagcgctcctttctagttccggatctctcgggcggctttggcagcctctgttccggccttcatgcccgaggtccaggcccagcccagattgtatcctccgcagggcccatcgatatcgagcgcctcgccgcaggcaaaaaggccacgggagccggcaagggcaggatctgcttcaagggtcggcgcgaatgaagagatggcaaggccgccgcgcgtgacctgagcatgtccggtatctgtgcgtccttcgaccgtgaaggaaagggccttgagcgcctgcgcgatgcggtcgggatctccgccttcacgtttccagaggagctctgcaaggcgtgggtctgagacgccttccgcggtatgtgccaggcggatgaggcgggacagctgcgatgcggcataatccggcgcgaggtcgagagcgagcgtatcgcctggttcggccagccgtgagagattgaagacagcgatgccggagagtccatagggcctgaacaggaactcccctgcttcttcggcgatcttttctgctccgcgcagaagcgtggctctgccatgggcacgcctgccgtcgagggcctcaagcggaagccccttgagcgcaagcggacagaggatgggctccggtgcgatgcggggaagctgcggcacaagcgtctcggccaggtgtccgccgcctgcaaggatggcgcaggaggctagaagcgcaccttcgccggcctcgcctgaaaacgagaccttccagcccttgccctgggattcaagcttcttggcaccgcgtcctggcagaagcaggactcctgcacgctgggcgcgggcaagaaggacatcgcgcacagatgctgcctgcctcgagaggggatagcagcgggtgtcgtctgccgtccatgccatgcctgatgccaggaagaaggcgaagacctcatctgccatgtcctgcccgacggctgactcgacgaaatcggggtggttgtagaaggagggagcaagatctgccgctgtgaagttgcagcgtccgttgccggtcgccagaatcgtgcggccgcactcgagggcttcttcgaggacgcatgctgaggcgccttcctctgctgccgtgatggcacaggcaaggcctgaggcgccgccgccgaccacgcagacatctgcaatctttggcggtgccaccttcatcgcagcatcgagggcacgctcgcgcagctgtgagcgtgcggtcttctgtcttctgcctcctgccatgggagcctttctatttcagtgcgtccatcacggtcgcagaggcgatgatcgcggcaatcgcatcggggatgaggccgtcggggaggtcctgctccatcctgccggcatcgcacatctgcgcgaaggaaggatcgatcggcagctggcccaaaaagtcgaggtcgtagcgctttgcagtctcctcggcgcggctcgggccatacggctcgaccttctcgccacagtgcgggcaggtgagataggccatgttctcgacgaggccgaggcacggcacttccatcatcgatgccatcttcacggccttgccgacgaccatctggacgaggtcctgcggcgaggagacgatgatgacaccctcgattgggagggactggaagacggtgagggctacgtcaccggttcctggaggcatatcgacgagcaggaagtcgaggttgccccagttcgtctggccccagaactgctggagggcgccagcgaggatgggtccacgccagagcaccgggtcatcgttgtgctcgagcaggaggtttgtcgacatgaccttcatgccgtttgcggtctcgcaggggaccatgttgtttccgtcagcggtgaccatatcgtcggcgaggccgaacatcttcgggatcgaggggccggtgatatcggcgtcgaggatgccgacagaggcaccgtgacgggcaagctcggtggccaggatgccggtcacgagcgacttgccgacgcctcccttgccggagatgacaccgatcacatgcttgatgttcgagttctcgttgagcgggaagatctggggtccctgctcggcctggggtgcatcttcgtgcatctggcccatctcttcgcgtatctgctgttcctcttcaggtgaaagcggcatggtgcgcctttctcttaggtaaatgctgtttcccacctatcataccccgcacggccctttcaccatgcttgcggtgcctgaaaagccgcctctgggtgcataatgggaggcaatgcatccgtctgaagggattgagcatgcttgcagcaacgcttggctatgtcgaccgctacgacttttcgaacgagcgattccagaaggcctatgccttcctgcgccagaacgacctcagcgcacttccgctcgggaagcatgagatcgcaggcgacgaggtattcgcgaacgtccaggaatacgatacggtgccggcagcccagaagcactatgaggcgcacaggcgctacttcgatatccaatacatcatctcgggcgaggaggccattgccgttacgccagtcgaaggcgtcaaggcactccaggagttcgacgaggcatccgacttctgcctctacgacgagccaaaggcctgctcgtgggttccgctccacgcaggcgagctcatgatcttgggtcccgaggaggcacacaagccaggatgtgcccttgcaggtcccgagcatgtacgcaaagtcgtcgtgaaggtcgccctgtagcgtacgacacagaatcaagcgtcttcggcccctgcctttgggcggggctttctcatgcctctcatgctttggcatgaggagaaagccgaaggctctctgtaccatgtttacgcccaggggaggaaggtgctgaattgaacggtggaaaggcaatttcaccgaatttctctggacgatgccttcctgggtgggcacaggatgcatcttaaggtacccttaagacataatgaaaagattgtccgctctccgggaacgcgtctgggcagggcggtgcagacgatgcgcgggaccaggcagcatggctgtggccaagacatgccctggactctctgcgctggatacggattgggcaaaggagcaagaacgtggccgcatcacgcatgggtttccccatcagattccgctgcgcgctggcagcctcgaagcttgtgcgcggcgtgctcaggaagaccggacatgtgggaggacagcttcccggcgtcgttgccgagaaggtggatccagacttccttgcacatatcccgatgccggagcacctcgtgttcgtatccggcacgaatggcaagacgacgaccacgaaccttatcgccgatatcctcttcgataacgggcggatgctcgtgacgaaccgcgcgggcggcaatatcggcaccggcatcgcctcgacgctcattgccaatgctgacgcgggcggccatcaacgtgccgatacggctgtcatggagctcgacgagatctgcttcaatgaggtcatgccctatgtggacccggagctcgtcgtcgtgacgaacctctactcggacacattcacgcgctcggcaaatcccgactatgtcttctcggtcatgagcaggaacatctcgccggatacgcgccttgtcctcaatgcagacgacctcatctcctgccgcatggcaccgcagacgaagagccgcgtctactatgcgatagcccctcagcccgaggatacgaaggagccccagggcatcgtctgcgacctgccggcctgcccggtctgtggcggcagtctcgagtatgactacgcccatttccgccatctcggccatgcacgctgcacgtcctgcggctacacgaatcccgagcccgactatgtgctcacgaaggtcgaccacgagaagcatctcctgacgatagaggagcgctgccacgaggaatcgcctgcgcatgagtactatcttcagtcgctctcgatcacgaacgcatacaacctgcttgccgctatcgtcgccgtgcgcgagatggggctttctgccgaggagattgcgcactcgctcgagcatggcatcaacatcacgaccgagcgctaccaggcacgcagcgtctgcgacaggcgcatcgtgacaatcgcctcgaagggggagaacggcacggccacctcggtcgcgcttcagaccgtcatgtcggagccgggcacgaaggccttgatcatgctcctttccgatggacacatggcagagaatgccgatgaagtggaatacccgggctggctctatctcacggactatgagctcctggacgatccatccgtgaaggagatcgtgctcgtcggcgcgacggcagatgagcaggcgctgcgcctgcggctggcaggcgtgccggcagagaagatcacaaaggtcgcaggctgggaggatgccgtcaatgccgtgcatccgatggaagccgatgcgacctacatcgcctttgccgtctcgaatgtcggcatcgcgagcaaggcagcagatgccctggcgaaaaggatcgaggaggcagatggtgagcgctgatacgacgatcgaagtcctctttccggagttcggaaaccagggcggagacaatggcaacgagatgtatctcagagcctgcctgcccgatgcccgcttcatccatacgcataggggagatgtgccctatttcgcagagcacgtgccctccttcatcctctgctgcaacatgacagagcagcagcaggacatatcggtcaaggagctcatgccctataaggagaggctcgccgagctggccgatagtggcgtccccatgctcttctgtggaagcgcagccgagctcctcggcacctggatcgtggatccggatggcacgacgaaccctgcactcgacctcttcagcttcacgacgcaccggaacatgccgaagcgctacctcgatgtcgtgctcggcacgttcgtgccggcaccgggggaagaccctatcgagattgccggcttcaaggcacagttcacgcagatggaagggcacaacgagtcctgcttcttctgcgaggacgaggtgggatccggcctcaacgtcgagacgaagctcgaaggctggagacggggcggcctcatcgctacctggatcataggtccgctcctgccggagaatcccgatttcgtgcgctggctcctggacgagatgggggagaaggacgcttcccttgccttcgaggaggaggcacgggctgcccatgacacgcgcgtgcgcacgttccatgtgccggggatgcatctcacgatatagccatttcttgttggttctttggtggcatgcgggtttcgggaccccgcttcggaccttggaggttcggggcggggtccttattgctaccatggatgtatccatctcgagatgggtgaagactgctcttcagcagcagggactgacagttcctgctgccgtttggatagaaggttggaagcatggcatcagattccatcgtcattcgcggtgcccggcagcacaatctgcagaacgtcgatgtgacgattccccgcgacaagcttgtcgtgatcaccggcctctcgggctccggcaagtcgtctcttgccttcgacacgatctatgcagaaggccagaggcgctacgtcgagagcctctcgagctatgcccggcagttcctgggccagatggacaagcccgatgtggactcgatcgaaggcctctcgccggctgtctccatcgaccagaagacgacgtcgaagaatccgcgctcgaccgtcggcactgtcacagagatctatgactacctgcgcctgctctatgcccgcgtcggcgtgccgcactgccctgagtgcggacgtgtcatcgagcgccagacgacggaccaggtcgcagacaaggtgctggcagccgggcagggaaggcgtgcgctcgtgctcgcgcctgtcgtccttggccgcaagggcgagtaccagaagctcttccaggaccttgcgaaggaaggcttctcccgcgtccgcgtcgacggcgaagtgcatgagctcaccgaagagatcgtgctcaacaagaagatcaagcatacgatcgaggtcgttgtcgaccgcatcgtgatccgcgagaactccctcggccgcatcgccgaggccgtcgagcaggcgacgaagctcgcctccggcaaggtcggcgtgctcctgcttgccgacaggaaagaccccgagcacatgccggaagagctcctgcagtactcgctcgcgcttgcctgccccatccatggccactcgatcgacgacctgcagccgcgcgacttctcgttcaatgcgccctatggtgcctgccctgactgcgatggcctcggcttcaagaagacggtcgatgcacgctcgctcatcgaggatccgcatctctccgttgcccagggcgtcttcggaagcctcttcaaccgctcgaactactatccgcagattctgcgtgcagtctgcgactatatcggtgtctctgccgatacgccgtgggacgagctgccccgcaaggcccagaatgcgctgctcgatggcctgggagacaagaagatccgtgtcgattaccgcacgctcgatgggcgcgacacgagctggctcacgaagttctcaggcgtgaggacgatcctcttcgagaagtaccaggagacgacgtctgagaccatgaggacacacctcgagaagtacatccgcgaagagccctgcccgacctgccacggcgcacgcctgaagcctgagtatctggcagtcacggtgggagacctcaacatcaagcagctctgcgacctctcctgcaaggaggcgctcgacttcttcgatcatctcaagctcgatgagcgccatgaggtgatcggtgggccgatcgtgaaggagatccgcgcacgcctgcgcttcctcgtgaacgtcggtctcgactacctgacgctctcgcgtgcctcggcgacgctttccggtggcgaggctcagcgcatccgcctggccacccagatcggcgccggcctcatgggcgtcctctatatcctcgatgagccctcgatcggcctccatcagcgcgacaacgaccgcctgattgcaacgctcaagagcctgcgcgaccagggcaataccgtaatcgtcgtcgagcacgatgaggatacgatccgtgctgccgactatgtgatcgatatgggtccgggtgccggcgagctcggaggccacgtcgtggcggcaggaacgccggaagagatcatggcagacgggaagtcgcttacaggcgcctacctcaccggcaagcgcatgatccgccttccgaaggagcgcaggaatcctggacgcggtgccctcaagatcacgggctgccgcgcgaacaatctcaagaacgtgaaggtcaaggtcgaatacggtaccttcacggtcgtgacgggcgtctcgggatcgggcaagtcatcgcttgtgaccgatacgctggcaccagcattgacgaacatcatccagcactcgaagcgtcctgtcggcccctatcgtacgctcgaggggctcgaggacgaggatggcaggaagtgcatcgacaaggtcatcgatatcgaccagagtccgatcgggcgcacgccgcgctcgaacccggccacctatatcggcctctgggacgatctccggcagctctttgcctcgacgcccgagagccgtgcccgcggctacagcgcaggacgcttcagcttcaatgtgccgggaggccgctgcgaggcctgcaagggcgatggccagatcaagatcgagatgaacttcctgcctgacatctatgtaccctgcgatgtctgccatggcaagcgctacaacagggagaccctggaggtcaagtacaacggcaagtccattgccgatgtcctcgacatgacggtcacagaggcgctctcattcttccagaacatcccgaagatccgccgcaagctcgagacgctcttcgatgtgggcctgggctatgtgcacctgggacagccggcaacgaccttgtccggcggcgaggcacagcgcgtgaagcttgccaaggagctccagcgtgtccagacaggcaggacgttctatatcctcgacgagccgacgacgggtctccacttcgaggacgtgcgccagcttgttcaggtattggagcgtttggtggatgccggcaacacggtccttgtgatagagcacaatctggacgtcataaagatggcggaccgtctcatcgatatgggccctgaaggcggcgatgggggtggcacggtcgttgcctatggtacgcccgaagaggtcgcgaaggtcaaagaatcgtataccggacgctatcttgcgccgatccttgcgcgcgaccgggcacgcatggagaaggaggatgcagcagatgtcgaagcgtgaggggcaggtcaagacgaatgcgatgcgcgagctcgaccaggcacacatcccctatagggtgcaggtcgtcgagggcgaagaagatatctcgagaggactcggcgtccgcatggcagaagaggtcggggcagaccccgagagccagttcaagacgcttgtctgcgtctcgccgacacgggaccacgtcgtgtgctgcatacctgtggcagaagagctcgacctcaagaaggcagcagcggcagcaggggagaagtcgctcgagctcatgccgataaagcagctcgagagcgtcacgggctatgtgcgtggcggctgcacccctgtcggcatgaagaagaagttcccgaccttgatcgacgagacggccgaactcttcgatgagatcggcatctcgggcgggaagcgtggcgtcggcctcatcgtggcaccggagcccctggccaagttcctggacgcacgcttcgtcgatatcgtgcaggaagggcgatgatggagaacagagaaatggacatcgaggagcagcaggctgacgaggaagaggcgctagccgagtcggtaggccgctcgtctgcaatgatgagcgtgctcgtgatgatctcgcgtgtcacaggcttcttccgcacctgggcgcaggcatatgccgtcggcgtcacgatgctcgcctcgtgctacacgatcgcgaacaacctcccgaatctgctctatgagcttgtcatgggcggcatgctcgtcacggcattcctgcctgtctacatgaacgtgaagcgcaagctcggacgcgaaggtgccaatgcctacgcctcgaacctcttctcgctcatcctcctcatcatgggcggcctctccatcctctgcatcatcttcgcggcgccggtcgtgtggacgcagacgttctcggcgaccaaggagttcgacttcgacctctcggtctacttcttccgcttcttcgcaatcgagatcatgctctactcgctctcgaccgtcgtctccggcatcctgaatgccgaacgcgagtacttctggagcacggcagcgccgatcttcaacaacttcgtgacgatcgcctccttcgtgctctatgcctggctcgttcccacgaaccaggggctggcgctcctgatcctggcgctcggcaaccctctgggcgttgccgtgcagctcctcgtgcagctgccgagcctccacaagatgggcgtgcgcatccacttcaagatcgacctccacgatcctgccatcaaggacacgctctccatcggcatcccgtcgcttctctgcacgatcgtgatgttcgtcacgtcctccgtgcagacatcctgcgagatgcagtcttcggtctccggctcctcggtcgcctactatgcccgcatctggtatacgctgccgtattcgattctctgcgtgccgatcacgacggccatgttcacagagctctcagacctctatgcgaagcacgatatgacgggatataggcgcggcatctcgtctggcacaagcaagatcttgttcctcttgatcccgatgatgctcttcctgatcgtgttctcgacgcccctgattaccgtgatggcaggcaggagcttctctgctgatgagatcgagatgacggcgagcttcctcatcgcccttgcgttctcgcttccgctctacggcgtctatatctatctccagaagatctgctcctcgatgcgccatatgatgctcttcgctgttgccaacatcgtggccggcgtcgtcgaggtcatctacctcatggtcgcgacgccgagatacggcctcaactgctcggcctggggcaacacggtcttctatgtgatcgtcgatatcgtggccttcatggagctccatcaccggatcggcggtgtcggcatccgccatatggcgctctctgccgtgcgctcgctcgcactcggtgccgcaggcgctgtcgctgccttcctcatcctccagctcctcggacacttcttcggccccacggacggctcgatgctcaagggcatcctctattccgtcatcggcggcatcccggccctgatcgtgacctacggcggagcggtcgccctgaagatccctgaggctgatgcaatcggccgcctcatggaccgcttcctgccggcacgcctgcgcaggtagagaacagccagatagcatcgaaacgatttcgaggcctccgcttggcgggggcctcgctgcatctgccgaaacaatggcacaggtgagatctcggcctttgcctgcttggtaccatgcgggacagaacccaagagcccacgcttgccggagaagatgtgccatgctccttgatctcttttcagaggactctctgccctcatctggattcccgtcatcgccttcatcgtccttgtcttctgcctgccgcatctcgcaatccaggcgctgaagaagtatctggggaaataggccgggctccaggatgggcaggcacgctccattgccgctacgttacagagcggtgtccttgctgcggcaagcactttagtgtgctaaagtgccaccagcagacaagatggatgcagaagcatcctggacatgaaggagcgacatcgtgctgagcggtacaccccaaggattccgcgacatcctgccgaaggaggcattggcgcgcgagcgaatctgcgacgcagtcaggagctgcttcgcgagccatggctatcttccggtcgagacgccgcttctcgaagaccgccataccctcgaggaggcaggacgcatcaagaacctgccgttccagctcttcgacgcggaggacgacgagctcctcgtgctcaggcccgatctcacgctgccgatcgcgcgcatggcagcagcaaggttcgcggcagggcagctgccggcacgcctcaggtatgtggcgcctgtcgtgcgcgagcgtgcaagcctcaagggccagccgcgccagttcacgcagctcggcgtcgagctcatcggcggagacgacgtgaaggcagaatccgaggtcgtctcccttctgggcgaggtgctccaggccctccatgtgccggcctggaagatcgtctgcggctctgcctcgcccctgaaggcgcttcttgccacatgcgcgccggatgaggcattcgcgaagcaggcgcttgccctcgtccatgagagcgatcttgtgagcctggatgagcttgtcgcagcctcttcgcttgcgcccgaggcggcacgtgcgctccatgagctgccaaggctcaatggcggagctgagacgatcgatgcgctcgatgagcttctggatggcgccggcgtcccgaaggagggaagaggcacctctgagctcagggccctcgtggcatcgctttccgaccttgcccaggcaggggagcttgccttcgacttctcgatcatcaactcattcgactactacacgggcatcatcttcaaggcctattcggaaggcatcgccgcatcccttgcttccggcggccgctacgatgcagtcctcaagaacctcggcatgcccgatacctgcgcctgcggcttcgccctctcgctcgagcgtctccaggaggtcctgggcgagatgggagataccggcgtcgtgacgccgggcgtgcgcctggcagagcgtccgatccgcattgccgtgccgaagggatcgctcttcggcgataccgtgaagctgctcgagaaggccgggcttccggtcgaggggctcaaggacccgggacgccgcctcatcgtgcatgaggacggggtcgactatgtgatcgtccgtgcccaggatgccccgtatttcgtgggctatggtggtgccgattgcggcatctgcggtaacgactcgatcctcgaggcccaggtcgagctcctgcagcttgtggacctgcgctacggtgcctgccgcttcgtcgtcgcagagccgagaagcgctgccggcaagaccgaccgtgcctatgcctggcgcggttacgagcgcgttgcaacgaagtacccccacatcacgcaggcgtactatgaccgtatcggccggcaggtcgagattctgccgctccacggcaacatcgagcttggcccgattgtcggcatggcagaccgcatcgtcgatatcacggcgacgggcacgacgctcagggagaacgacctcgagattgtcgacgacgtgctcgagtgcagtgcccgcttcttcgcaggccctgctgcctatcgctccgatgcccgcatacgttccctggctgaccacctcgcggctgcagccagcaaggaggaataatgaggaagatcgtgctgtccgagggagagaccctcaccaatgctgacctgaagaggacaggtgccctgccgaaggaggtcatggagtctgcccaggcaatcgtcgacgaggtgcgcgagcgcggcgatgcggctgtccgcgacttctgcctcaagttcgatggtgcctgccgcaagagcttccgtgtgcccgacgaggccgtcaaaggcgcgctcgagaaagtcgatccgcgcttcgtcgaggccgtgaagcgctcctatgcgcaggtgcgcgagttccacgagcacgagcgcgaggattcctggttcgagacgaggcctgatggcacgatcctgggcgtcaaggtcacgcctgtgccctctgttgccgtctacgttccgggaggacgcgcccagtatccctctaccgtcatcatggacacggtcccggcaaaggttgcaggcgtcgagcgtgtcatcatgctgacgccgccccagaaggatggcacgctctctgcctatacgctcgccgctgccgccatcgcaggggtcgacgaggtctacgctgtcggcggtgcccagggcatcgctgctgctgcctatggcacggagtccatcccgaaggtcgcgaagatcgtcggtccgggcaatgcctatgtggccgctgcgaagcgctatgtctcgggcgatgtcggcatcgatatggtggctggtccctccgaggtctgcgtcctcgccggctcgacggcagatcctgtgatcgtcgctgccgacctcatggcacaggcagagcacgacccgatggctgcgtgctacctcgtgacggatgcacctgagcttccggacagggtgcttgctgcaatcgatggctttctcaaggagagtccgcgtgccgagatcacgaaggcaagcctcgacaaccgtggccagatcgtgattgcgccttcgctcgacgctgccatcgactccgtcaatgtgatcgcccctgagcacctcgagctccatgtgccggaggccttctccattctgggcaagatcagaaacgctggcgccatcttcttgggtccctggagctccgagcctctgggagactacgtcgcaggcccgaaccacacgctgccgaccggtggcacggcgctcttctcgaatcctcttggggtctacgacttccagaagcgctcttccgtcatctcctatacgccccagggcctcatggcagatgccccggcaacccaggccatggcagaagcggaaggcctctgggcacatgccctctcggcaggactgagatggaagctcgtcgaggaaggccagaaccacatcgctgacgccgatgctgccttcgccggggcgcaggagattgcctggccgacgaagctttccacccctggccgcgtgcctctgggggagtagccatggggaaaggactctctccccgcgtgcgtgcgctcgcccgtccgagtgtcgccgatctcgagccgtacgatcccggcttcacgccggtacgcatcaacctctctgccaatgagaacacgcatgggatgcctgaagaggtcaggcgctccgtgcaggcggcgctggcgcatgtcgtcgtgaaccgctatccggcacccttggctcctgagctcagggaggcccttgccgagtggcatgaggtgacgcccgagcaggtgcttgtctcgaatggcggcgacgaggcgctcttcaacctgttcctcgccttcggaggcgccgggcacaccatggtgacatgcccgccgacgttttctgtctacaagctctacgccgagatggtcgagacgccggtcgtcgaggtgccgcgcgatccggtgacgctcctgcctgatgtggacgggctcgtcgaggctgcaaagactgcctcgcttgtggtcctgacctcgccgaacaacccgacaggagactgcatggctcccgccgatgtgaagcgcatctgcgaagcctgcccgggcatcgtcctcgccgatgaggcatacggcgagttcgcgcccgctggcatgagcgctgcccccctgctcgacgagtgcgacaacctgatcgtgctccacaccttctcgaaggcgctctgccttgcaggcggcaggatcggctatctcctgggcgcccctgacgtgctcgatgccctggtcgccgtgcgccagccctattccgtgaactcgttcagccaggcagcggcgcttgcatgccttcatgagcttggtgccttcgatgcggccatcgacgatatcgtgaaagaacgtggatggctcacagaggcgctctcggagcttccgggcgtgcatgtgtggccgagctctgcgaacttcctctgcgtgcgggtgcccaaggcagctgagaagtgggcagcgcttcgggacgagttctcgatcctcgtgaggaacttctcggcgacgccgggcctcgaggactgcctcaggattacggtgggcacgcatacggagaacgaagcagtagtcgcagcgctcgaggcgctgctctcaagggaggcctagatgggacgcactgccgaagtggcacgcaagaccggcgagaccgatatccagatcaggatcgatctcgatgggacaggagcatccacaattgatacaggcgtgggcttcttcgaccatatgctgacggcgctctcccgccactccctgatcgatatggatatcgcggtcaagggcgatacgtgggtggatgaccaccacacggtcgaggatacgggcatcgccttgggacaggcaatcgcccaggcgctcggcgacaagcacggcatccgccgctttgcggactgcgctgtgccgcttgacgaggcgctcatccagtgcgccctcgatatctctggcagaggagagctcttctgggatgtgccgatcggccctggcaaggtggggaccttcgatacggagcttgcccaggagttcttctgcggctttgcccgtcaggcagggattacgctgcaccttcgtgagctctgcggctcgaatgcccatcacatcatcgaggccacattcaagtcctgcgcgagggcactcaggtctgccgtcgagtccgacccgcgtgtgaccggcatcccttcgaccaaaggcacgctctagaggaggcatgctatgcccagacgcattgccgtcgtcgactatcacaaaggaaacctgctctccgtcgtccgctctgccaccgaggcaggcggcgacgccgagataacggacgaaccgaagaagattgcctccgcctctggcctcatcatccccggtgtcggctccttcgaggacgcgatgatctacctcgaggagagcggcgagaaggatgccgtgctggatgcggtcgagcgtggcgtgccgcttctgggcatctgcctggggcttcagctcctctcagagcgcggtgacgagcgcgtggcagagcctgcggatagcggacgctgggtttccggccttgctctcatcaagggctctgcgacccgtctcgagtcgagccgcctcaaggtgccgcatgtcggctgggaccagctgcatctcacagagcacggtgctgcctgcccgctcttcgaaggtgtgcctgaaggtgccaatgtctacttcacgcactcctatgcgctcgacgaggataccgatccttctgtcatcgcaggcaagacgttctatgcgtgtgcctttgcctctgcgatctggaagggcaacatcttcggcgtccagttccacccggagaagtcttcgagggtaggtctccgcatgctcgagaactacatcagaatcgtcgaagaagggggagtccggtgatcctctttcctgcgatagatctggtcggtggcaaggtcgtgcggctccagaagggcgaccgtgcccatatggacgtctacagcgagaaccctgccggcgtcgccgaggagttcagggaggcagggacctcctggatccacgtcgtcgacctctcccgtgcctttggcgaggacgaggaggcgctttctgccaacaggcgtgcccttgctgccatctgcaagacgcccggcatctcggtcgatgcgggaggcggcatccggtccgtccatgacatcgaggagcttcttgcgctcggcgtcaggcgtgtcgcgatcggcacggcgcttgtgcgcgatccggccttcgccgaggcagctgccaaggagtatggagacgcggtcgtggccgatatagcggcaaaggacagcgaggtcaaggtctcgggctggcgggatgatgcgaagctctctgctgacgagctcgcgcgccatctctctggtctcggattccgtcatctcgtctttaccgatatcgcccgtgacggcatgcagaccggcatcgatgcggctgcctatgcgcatatcgccgaggtcgcaggatttccggtcgtggcttcgggcggcatcgcccgcatcgacgatatcagggcgctggctgcgctcgggccggacaaaatcgaaggagccatctgcggcagggccctctacgaaggcgcattcacgctggaagaggctcttgcagcttcccgaggtgaggagtagccatgctgtgcaaacgagtcattccctgcatggatgtgaaggacggccgtgtcgtaaagggcgtgaacttcgtcgacctcgtcgacgcaggagatccggtcgagctggcaagaaagtatgaccgcgagggtgcagacgaggtcgtcttcctcgatatcacggcgacgtccgacaacaggaagacgacaatcgacctggcttcgcgtgcagcctcagagctccgcatcccgtataccgtgggcggcggcttccgcgacatcgcaggctgccgcacgatgatcgccgcaggtgccgacaaggtctcgatcaactccgctgccgtgcgtgagcccggcctcatcacggctgcggcagaggcattcggctctcaggccgtcatcgtcgcaatcgacgcaaagcaggtcggcaagggcgacaggtgggaggtctacctgaacggcggacgcgtgccgacaggcatcgacgccgtcgcctgggcagaagaggcagcgaggcgtggtgccggcgagatcctgcttacgagcatggaccgcgatggcacgaaggatggcttcgacatcccgctcacgcgcgcggtggcacgggctgtcccgattccggtcatcgcctcgggcggtgtcggcacgctcgagcactttgccgagggcatcatcgacggcgaagctgatgctgtgctcgccgcgagcgtcttccacttcggcacctataccgtgcgccaggtgaaggagtatctcgcgacccagggcatcccggtgcgtctggacttctaggaggacatgatggcagaaggctatgccgcaagaagctatgcaggagagcctgttcaggagacaaagctcgatctcgatgcgctgaaatacgacgcccatgggctcatccccgtcgtcgtgcagcagtgggacacgggcgaggtcctcatggtcgcctgggcgaacagggaggcgctcctgaagacgttcgagacgggcacctcctggttctggtcccgctcgcgcacagagctctggaacaagggcgccacgagcggcaacgtgcaggaggtcaagcgcgtgctctgcgactgcgatgccgacacgctcatctatgaggtggattccccgggccctgcctgccataccggccacagaagctgcttcttccgcgagctcaggagcgatatcgcgtaaggaccttcacgtgcttatctgatgcagggcacttatcttctgctttccgctgctaaaatggtgtgctcaggaagaaagcagatacagggaggccccctacacgatggatatccgcgagatctcgctcgacagcctcgaagaggaagtcaagagccagaacgtcctgctcccgatcgagcagtccgcaatctgggcgaagtatcaggcaacgatttccggacgcacgccctggggcgcgcttgcggcgagcgtggacggatccgacgtagcggtgtgctcgttcctcgatttccagacgcatggctaccactacctcaatgccgtccacgggcccatctggttccatgagccgacagaggaagaggaagaggagcttgctgaggcccttgccgactatctccataagcatgaccgcaggcaggtcttcatccgcatggccctcgtgcacgacatcgcagaatcgcatcctgccctttcgaccgtgccgtatgaccataccgtgatcatcgatgtcacgggcggagatgacgcgatcctctcccgcatgaagccgcgtggccgtcgcgatgtgaggaaggctctgcgcgagagcccggcggtctgcgctgatgagaccgaggcagcgaccaagtccttccaggactactacgatgtgatggtcgagaccggcaagcgcgatggctttgtgccggcaccgatctccgactacgaggacatgatccgtctcctcgggcccgagcactgccgcgtctatgctggcagggtctcaggcaaggtcgcgacctggtccatcgtcacgatttccggcaagcgtgccgtgcgctactatggcgcgtcgctcaacgagtacatgcgccagcatgtgacggacaagctcgtctatttcgagtgctgcgaccttgcgaagaacaagggcatcgaatcgtatgacatgatgggcatcggctccgatttcgcgccgtcgcttctcggcctcaacgagttcaagtgcaagttcacgaaggagacggcagaagttgccccctcccgcgacatcccggtgcgccgtggcttctatgcgctgctcgtgaaggcacgcgacatcgtcgtcgcccgccgcaagcgtgccgaggacgaggcggagcgcaagcacagggcagagctcgagcgtgcccatgcagaaaaggcgaagcatgagtcggagaagctcgccgaggcagacgctgagaagaagacagaagagtccgggaactagccatggcgcgcgcacctctgccctgggacatctcccacaacggagagccgtctcttagagaccaggtggaccaggtccccaccgatcctggctgctatctctggaagaatgcacagggcacggtcatctatgtcggcaaggcaaagaacctccgcaaccgcatgcggcagtacatcaacctgacggatgaccgcgcaaagatcccgctcatgatgcaggaggtgcgctcgttcgactacagaaaacatgaacaatctcaacacgtacggaattaatcggatttgacggggcctctgcagccgtctgtggccttgctgcatgcggaggctcgggctgagcagctcccagctcgtcttcttcccgctccagctggacacccaggggtggccggactcactatcacggccgggcaccgccttacagcacgcagactacgatccgtcgagcacgtcctccgctcctgccatgcggcacgaccgggcaggtcgcgaaggcctctctggcatcgatgccaatgggactacagcaccgttcaaacgagcttgctgccgacgacccaagataggtcgacacatcgcgtgaggtcacaatgcgtcgcggagcaaagttctccgacggcaacgctcgtgacgcctcgaggacgtcatcgagtccttccagcgcatcgtccggcaggcggccgactggagctggcaactctatacctcgatgcttgccccatcgccgacatatccagaagaaggatgacaagacaccactcaagacgaacgtccccgaaactctcgctcataaggagcgcctcgcatcatccgcgtccgtgccgtaagagctcgacgaaggggatcccgaaaagacaaagaagccgaatcggctcggtgtccctggagtggatgacacgatctccgatagctgctcgagctcgtcccacaacccgaactgacaacggcgagccatcctgccaagtgacggaagattcatacgagtcatgtctaaggagcgacggcacgcctgacggcatgagcaggaaggctccaacctcgtcatgggagatggtcacggccgacgcggtggcgatacgctcacgaacctcggcatgcaaccatcacaaaggtaccagggctttggcaccagattctgatgtcgatgtcgcgaaggcgcctgtggaacgacatttgggtccgtcaggtgtccatgtagcgcttggattacgaacatatgatcaaacaatcgcttcgcgggccttgccgcagcacggacagtgctacctgccgagaacattcacgaaactaccaaaaggcttcgaccgtctatagtcacgacacggacaaggccaagagccttgctcgccgaagcgtggcatcacaaccgggcgcgaagtgccagctccgcacgacggaccaataacggcaggtcgtggcatggcaagaggtcaggaagacctcgacgaccccttggcttcaatggccgatcgcgaccgatactgtctgcgggccacctactgccgccattcgaccaccggtgacaaccctatgacctcgtgctgcacagggcgatccgtcccgcttcggcgcccgatcctgaacctcctcatgacatgggtgtacggtgcgaacaacctgggattgaagacgcgtgccgtgaaacaccttccgacgagtggaagcagatccagtcgcttcatgagcaccgactctcacgcagagcggactccggcaacaggagacctggaacaagtgcctcgatctcatttgccgacaaactggtccttatacggtgctccaggtccagaccctgcaccggcatcctggcaggacacctcgataggccaccgatacggcgttgccgatcaagaactttcaagggcatcggcgacgaccggactgcgttacatcgcgactgtaccgtctctgctgatagtccctgggatggtccagcgaagatcggaaggcccgtcgatgcactcacagcggagcacggaggaccccagtttcagggctcacttctgtacgcagcagagaaagggttggaggcgcccggtgaacaatctcggccttatcggaccggcggctcatacgtatcattgcgatcatggccttcggtcgtcacgattccgtattcgtccctgatgtcgttctcgaaggtcgacatgcctacaatgcatttgggcgggtgcgagtctgccacgcctgaagccgtgagcccagtacatgaggagcacggcctcgacgatccatggaacagtccgctatgtccgctatatgggaggaagctcctgcatggagactcggtaactatggtgactgccaaaatctaccgtcggcgagcgcaatctcccaggccatgccgttcacgattgcagctcacgttcatcggcctcatcatcggcgccatcgtgtcgttctgtgggtgtccttgcggcactcatagggacaagtgggctgacagctgatccgcgctcatttcgattggcaggcatcgcgaacgccgtccttctggctcgccgtgcttctcatccttctcttctgaggaggagaggaaggaaaggacctcgcggggggggagggggggaggggggggggggggcaaggggggaggggtgggggggggggggggggggggcgggagggggagggggagaggggtttaatggggggggggggggaaggggaggggggggttttctttttttttttttttttttttttgtttctcttttttatttttctgtaaggcatcggccagctgccgggtctcggcaaatcaggcgctattggccgaatgctgatgccggccatcgccagccttcccgctcacgggccagatgacgcgtcgtgcgtaccgccatggtagaggagccgtgacaaaggactatgtcaagaaggctcgcaggtgccaggactgctgagcgtgtcgtgtcggacgcatgtcgcgcaatgtcctcctcacgccggcacgaacctcgcctcaagatcggctacctaatgggcggcgctgtcgtcatcgaggtcatcttacaacctgcaggatgggcacggccatcacgaaggaatcagggccaagagacgatgctcgtccaaggtgtagtcattgtcgtcgcccttcttcatcatcatcaacatcgtggttggaaatgctctacctcctcatcaaccgcgctataaggacggtgtagcatgcagaagattcgcgaagagcagacaagaagctcgaagagggctgcaggcccagaacaaaagttcgcggctggaagaagctgcgcactcttcgaagatctcgctcgtactcctcatcctcgtggcggcagcttcgatcctggcgtcccgatccttgcccagcacaccgaacgataatctcaaatgcccgcatggcaccaggaggatgggtcccttcgcaccgacgaaaagggcgagacattcctctcccgcatgctctacggtggacgctactcgggggctgatcatcggcttcggtgccatgcggggcggattgaagatttcggtagggtgtgcggggctaaggatgggcgccaggatcgaagcttgccgccacgaggatgaggagagtacgaggcgagatcttgaagaggtggcgatcttcttccagcgcgaactcttgtttgggccgcagctcttcgagcttctttggtctgcctcttcgcgaatcttctgcatgctaccaccgtcttatgcgctgggttgatgcggaggggttagaggcatgtcaaccacgatgttgctgatgatgaaggagaggggcgacgacatggacgacaccttggacgcagcatagtctcattgccctggattccttcgaggatgggccgtgcccatgccgcaggtgttgaagatgacctcgatgacaggacagcgccgcccctgaggtagccgatcttgaggccgagggttcggtgaccggcgtcgtgatgagggcattgcgcaggacacattgcgtccggaccgaccccacagatcagggaggacggcaccgcgagccgtcttgacatagtccttgtcaaagtcctcgaccatggcggtacgcacgataagcgtatctggaccggtgagcgggaaggcaagggcgatgggccgggcatcagcttgcgggcacgacgatagcacgccggatttgcggacgcccggcagctggccgatgccggaaggacagtgcagatacgacgagaaagacgaaggatgagaacacggcgagccagaaggacggcgtcgcgaaatgcctgcaaatcgaaatgacgcggatcgctggtcaggccacttgtccctatagagtgccgccgcaaggaccaccagcagaagaaacgacacgatggcgccgctgatgaggccgatgaacgtgagctgcatcgtgacggcagggcctgggagttgccgctcgcgacggagtgtttgcagccaccataggtaacgaggtcctttacatgcaggaggatctccacttatagcggacatagcggaactggccattggatcgtcgaggccgtgctcctcagggtatctgggctacggctcaggcgtggagactcgcccatgcattgtaggcagggtagaccttcgagaacgggacaatcaggaagaatacgagaatcgtgacgccgaaggcctgatggcaatgcgctgagccgccggccgataaggcgcagagattgcttcacgcgctccctttctcttgctgcgtcatgaagtgaggcccggagaactggggtcctcggggggcactcccggcggaggcatctaaagggcctccgagcttcgctggacaatcccaggcggactagcagagacggtgacgcgtctcgattgaacacaggccggtcgtgccgatgcccttgaattcttgatggcaaccgccgttcggtgccttcgaggagtcctgccagagccggttgcggtctgggacctgagcaccggatagaggaccgcaagtatgtcggacaatgagagcgaaagcactgttccggttcctgctgctcggcgccgctctgcgtgagagcggtgctgtgctcattgagcagactggagcttgttccacgtcggaggtgttcacgggaccagcagcgcgtcttcaatccaggtgttgtccgccgtaccaccattcatgaggaggcaggatggcgccgaagcaggaggatcgcccggggcgagcaggaggttaggtttgtcacccgggctgtcgatggcgccgctgacgccgtggcagcgcgtatcgtcgggggctacggcggcgcgcgctccccccgctgtggcctcgcggtccgccgctccttgccatggagtttgccgcccggctgtggttgttccgcgtcccaacggtcggcgtcgcgtgcgggctgccgtcaggcccttgccgcgcttgattcagttgcggcggggcggcttggccttgtcgggtcgtggcccccgtttccagccaggcggtggccggggacaggacgctgtcccacgtccccggccagcggacaagacaggtggggccggagaccgccgggcgggccgtgggcggctagggcgccggcgggccgcggtcgagctacggcccacgtggaggggccgtttccgcccaggccccgcacgccgtggtccacgctggcgctgtgccaccatgctcccttttgtgcccccccgtgggtacgcctggggacaccgccccggaaggattagtgcacagaacagaacgctgaccaggacgcaccgactcaggcatgagtgtagcgacgggagccagttatgataagggcgccgagcaacgcgcacgtcccgccctactgagcatgcgggaggaggttgagtgaggtacgaggtttgcccttgcctaacaaagccctggactcggaagcacagagcggaggtgccgaaatagggagtgaagagacaggggaacaggcaggaaactcaccctgacgatcccggagaataaaataccaggtattgagaggattagggaggcaagagaaagaggagcagaagtgcaacccacgctttcccaacctggacaccacactgtctagccgtgaccccccctcagcccggtaaggcgcgagggcgccctccaacctccaatttcccaccccccgcacactgacacggggacacaaactagggcgtaagcggacccaatgcgaggaaggtgggcagcgattgtaatcaccacaatgaatggacacaacggtacaatatcctaacacctcggggtgggttgaacaagcggagcggtatcgctgcttaagtagccaacgcaactcgaagggagaccggctaggacctcaagtaaaacgataacggggagggcagtggcacaagtattaaagacgcgtgcagttgttggaaccagagttacgtacggttgcggcgtgttttgcggttttagtatgtgccgttgtgtgtggttgaccatctccatttgacgagggtggatgggatggatcggggtggaggggggaggcgttggaggagagagtggagccttagcctctctgccggataggcgtcgcgtcgcatcctccagacgtcgtagtgaatttctcgtccttggcaggatggtcgccgttgtagttcgggttcgggacggctcgagcgaggctatcggagatcgtgtcatacatccagggacccgagccgatcggcttctttgtcatttcgtccttcgtcgagcttgaggcacgacgctgatgatggcgaggcgctccttgatgagcgagaagttcgggagtttcgtcatgaattgtgagtgtcttgtcatccttcttctggatgtcggcgatgggggcaagcagcgaggtaagatgttgccgctccagtcggccgccttgccggacgagcgctggaaggactcgatgacgtcctcagcgtcacggcgttgcctccggagaactttgctccgtcgcgcagggtgacctcgaacgtcgtgctcgaccttcttggggtcgtcggcagcaagctcgttgaacgtgctgtagtcaggaaatcgatgccaatagaggccttcgacgacctccagttcgtgccgcaggcaagagcggagggacgtgctcgaggatcgtagttctgcgtgctgtaggcggtgccggccgtgatcgtgccgccacactcggtgccagcctgggagctggaagaagacgagctggagctgctcgagcccgacctccgatgcgcaaggcccagaacggctgcagaggcacccgtcaatccgatgaagttcctacggatgagattgttcatggttctcccctttcgcagtgcatggtgcttggaactggccgcgtccgacgcttcctgtcacgcgtctgaggccggccctgatggcacctatttgcactcttgcagaagctggaaccttaccaattaggaaatggtagtaaccatcgccccaatggaaaactgcataatccagtgttgtgcacgatggcataagacggttgcactttctttttccacaaactgtagaacagcagcccagccttcctgcatcgctgagcttgccgtttattctaatcgctgatataaaaagctttccgttacagacaattgatgaattgttacttgagttttttcaggcttttgcccttcatcactcggcgagctcctgctttctggctgatgtcctcgtcgaagagccgggcgtctcgtataccgcctctgcgacccgcctgggatgccggcggcgtctcggccagctcctcgacgggaggcggccttgatcttcttgagcgacccaagcgacgctgaggcacgcttcctcgtcggccccacaccttcgatatcatcgagcacggattttgtcatagccttgtcgcggagcctcccgtggtggaacgtgattgcgaagcgtgcgactcgtcgcggaacgcgcttgatgaggtagagcgaaggcggcctgaaggaaggacgatcggcgctcgtcccaggggacaagacctttcctcgtcggacttggcaaggccgcaggccacgggatatcgaggcccaaaatttgagctgctctatggcagcttgagctggggctttgccacgtcgcagcacgagcaggtccgggcgagatccgaattcttgtctgccatcgtctttggcccatagcggcgcgagagcacctcgctcatggacacgaagtcatttgcctcggtgagcggcgtctggatcttgaacggcggtactgcgatactgtgtcggggcgtccgttcgtgaagacgacccatcgagggttaccgtgaagtggccatggatcgtcgaaatatcgagcactcgatgcgcatggcggcgcctcgagcgcacgcgctttcgagctcgagcaggcctggtgtgtgcggtcattcgcgtatccggtccttaacatgtaggggttgagcgatgatgggcatttgctctgccatcttgaggagattgctcttctcgcctctctgcgccgatgaaggcggcagatgtgcccccgcttctcggggccactgcgagatgttctccccgtcaggcagctctatcgcgacatcgacctcggaggggatatctgcagtctcgtgtagtagcgcttgagaaggactcggcaagctcggtctcggagacataaggcccttgtcgaggattgaattcaggagcggatcgtctgcctttcgcgcacgacgaagacgcaggcgcatgagatctctcctcgctggtagtagtagaacccgacgaggtcgaggttcacatcggaggcgaacatgactgctggagttacattgagttgctgagagcgacgactcgagccggtgcttgagcatgcctgccgctcgaagtcgaggtctgctgcggcttccttcattggctcttgagctcgtcggtgattgccggctcctcttgccctgcaggaaccttccacctggtccaccgttctgcgtaagtctccaccgtgtcgacggccgccgatgcagacgcccgggcccttgccgacgtggtagtcgaagcagggtcctgccttcagcgggccagacgcaggttcgcggacgtctatatatcgtcaggatgcgcttcgaggatgcgcttcgcgcgctccactcgacgcagttcgcagagcagatcggcacgaccttgcgcagaggtatcgaccgtttcccgtgccgcatgggatgccgatagggcgccgaagtaggcgtgtccccttgcggtggcgctcgcgtcgtgtatgtgatggccggaaacgcatccgattccgtgatggcgatataggggtaggactgtcgtccttgaagtcgacgttggtaggggtggtggtactgggcgatgagatttgctcgagcacgagcgcctcgtgctcgttctcgacgacga

SEQ ID NO: 47 - DNA, 66978 bp, Unknown
  Metagenome-assembled genome
ctgccgtcgtcaggagcgccgagacgcccggcctgtatcgggtcgacgtgatgcgctcggagtctgtcttgacttcttgatgagcttgcgtctcctccggtcatgctagagagatgcgttgccgtaggacttgctcatcttgcggcctcaggccgggaagaagcggcgtggaggtgagagtcctgctacctccgggaagaccttcgcgttgaagcgctcgttgaagcggcggccgatcttgtccgtgatctcgatgtgcggcagctggtcgcggcccacgggcacgatgttgcccttgcagaagaggatgtcgcaggcctggtggaccgggtaggtcagaaggaggccggtgagcgtatggcccgatgcctcctgctcggccttgacggtcgggttgcgctcgagctccgacttggagacaagcgagaggaagggcagcatgagctggttctcggcagggaccgccgagtgggtgaagatcatggtcttttcggggtcgatgccgcaggcgagatagtccatgaccatgttgtatacattgtcgcggatatgctcggtcgtgtcgcggtcggtgatgacctggtagtcggcaatcacgatgttcgtcttgacgccgaggtcctgcaggcgcacacgctcgcggatcgtgccgaaatagtggccgaggtgcagacgtccggtcggacggtcgcccgtgagcatggtatagccttcggtcttgccggactcgatgtccgcctggatcttgttggagcgctcaagcgccgcttcgtagctgccttcgtttggcataatggcatctcctcgttcaagcttgtgttacggttggatatgcctatccaacggaatttacgcacgtactacaatggtagcagacgttcgcgacggctttgccgaaggcaggaagagaaggtgccggaattgcctgcgttccggaaccacgatcgggaggagacggttgcatgcccagttcatgtggcttcgatgcagacaagaccgccatccgccagcagtatctgatcatgcggcgtgccacttcctcggtcgtgcgcaggaatgccgacgacctcatccgcgaggcagtggaggcgctgcccgagtatgaggcggccgggctcgtcctttcctatgtctcgtttgcagacgagatcgatacgcaccgtatcatcgaagatgcgcttgctgcagggaaacgggttgccgtgccgaagtgcctgccaggcaggaagatggaattcttcgagatcgggtctctcgaagagctcgtgccaggaactctcggaatcctggagcccgtgccagatgaagagcgtcttgtcaagcctgccatgtgcaaggggtccgtctgccttgtgccgggccttgtctttgacggagaaggctaccgcatcggctatggggcaggctactacgaccgcttccttgctttctatatgggggagaagcttggccttgcccgctccatgcaggtgagctcgaatcctctgccgcgcggtgtccacgatatccatgtggatacgcttgtcaccgatatgggctgcttccgcatcagctaccggtagggcctagatccatagctcaggctgtcccgatcgccgtccggcgcatgaagaagaaacaggctgcagcggcaagcatgccgcacatcacggcaggcggccaggtgcctgcagatgcagtcagggcgacaggcttgattgcgatgtcggggccgagaagatggcggtagctgcggaaagaagcgaggaggacctcgacatcggcattcggcttctcgagggtccgatggagcatccagtttgcaccggccacagcaaggaccacaaggccataggcgcactgcatgatgcgattgccgaaatgcctgctgacgaggtcggtcgtgtaggggatgagagaggcgaagaaaagcagcacgagcgtccacatgacacgcgctgtctatgcgcccggacgtgtcccaaacctcgttgaatcccgtccagagcgagcccagccagaagaaggaaaggacataggagaaacagctcatgcggaggttccagaagccctcgggcgtgggctcttccggtgcatcgagagcaagcacgagcatggtcatgatgagagcgaggatggcatcagcgaatgctgcaagccgttccttgctcatgggctgtccctccgagacgatctggctggatgttctcttcgagacaagcctctgcctcatgggacaggcttcagatgagaggctcagcaaatcagcatgcacgcagtgcatgctggcaggagccatgaagatgtgctgccaataaagaaagccgcccagaaggcggcttttctgaacttgtgctctgcagatgacagctaggcttcctgctcctgcctgtcgaggtagtcgcgcatatcgaggatggccttgcggtagccctggatgcccatgcccatgatggtctcgaacgctgcctcgcgcacataggagatctggcggaaggattcgcgctcgttcaccttcgagatgtggacctcgatggtcggaatctggatggccttgatggcgtcgaggattgcgacagacgtgtgcgtataggcgcccggattgatcacaaggccgtcgaatacctgccaggcatcctggatctcatcgacgatgtctccctcgtggttcgactggaagcagaagcagtcatcaaagcctgcctccttcgcggtcttctggcagaggacgagaagcgccccgaagtcctcggtgccatagagctccggctcgcggatgccgagcatgttgatgttcgggccgttgatgacaagaaggcggcgcttgcggggagcatccttcccagcagctgactgctctgcatcagcatgagcagagggagcaagcttcgggccacgcgtgatgttcggcacttccttctggggaacgctcttgggagcggagctttccgggaacatcgagcgaagcatgtcgagatcttcggattccatgtctgagcgggagcgctcggagttggccttgacctggatgctgtaggaacgcctgcgctcgggcgtcacggccggcgctgcctttgcaggctggctctcaggctccatatcctgcgagatatcgcagagctgctggaacgactggtagatatcgtcgatcacattcgggccgaacacgacctcgatgccattcgagcctctcttggtcatgccgagaacgcttgcgatggacgtcagcttctcccggtcgatgagatcggggttctccaccttaatcctcagccttgtcatgcatatcgtgttctcaagcacgttctgctttccgcctactgcagaaagcacaagttcggccgtatttcgttcatccatgaagcgccttcgtaattagaaacaagtagtttgccgttctcagtctatggagttcgacgccccaagggaagaggccagcggcggacgggccgaggggtctgcaaacggcatgaatcatccagctttcgttcggacctacagccccaggcgcgcaatgattgccgccgcatcgcccttcggcgtcccggtgcagggaagcacgaggtctgcccaggtacggtagagcggcaggcgttcctcggcgagcttctccaagcctttgctctgggagagcgggcgtcccttcgtctcgagcgtctcgatgggacggtcgagcatgatgatgaaggagttctggtggaggagcgggtagttctgaggaaccgtgacgacgcctccgccacaggagatcacaaggcccgaacgcgaggcagtctttgcaagaagggcgctctcctgctgtcggaaggccttctcgccgtcttccgtgatcgcttctgcggcagatctgccatattccatctggtaggcatcgtccatatcgatgaaggggcggtggagcacgtgcgccaggtgcttgccggtcgtcgtcttgccagatcctggcatgccgatgaggacaagattgtctgtcgtggccaggatgtcctgctcgatcttcgcaatggcctcctcggggatatccttgccctggaagagctcacttgcaaagcaggcctgggcgacaagcatggaaaggcctgaagcagacgggagcccgagcttctctgcagcaaggcagatgccggtacgcctggggttgtagaccacatcgaggacgccttcgaggcgggacagcttcgctagcgtctcctcatccactggcgttgcagggcaggaaggatacatgccgacaggcgtggtattgacgatgagggaggcatcggcgtggcgctcgagaagcgtctcgtaggtgtcgtctcccttgcgggagatgacagagacttcggcttcggcatctctgagagctgcctgcacagcctggctggcgccgccgcttccgagcacgagcacaggcttgccggagagcgcgcccttggcagatgctgcccccagctcctctctcgagaagcgctcgaggagatacgcaaagcccaggacatccgtgttctctgcgaagatcgagccatcggcgcgcttcacgagcgtgttcgagacgccgaggcgctctacgcgctctgagcgcacatctgccagacgtgcagcatccctcttgtagggaatcgtgacgttcaggccctgccaggagccctcgcgcacgaatggctctacctcttcgggctcgagctcgatcagatcgtacggtgcgcttcccagctccttgtggatgagggccgagtagctatggccgagcttcctgccaagaaggccgaagcggtgggcatttgtatccatggaactcctaaacgatctcgcggtagctgccgaggtagcggtattccttgcagatgtcgccgagcgaatcgatgagggtcgcaaattcgggggcttcgacagggcattcgatatcgaagtagaacatgaactcgaagtcgcggttcggaagcgggcggctctcgagcttcacgaggttgatatcgagggcatagaagcgggagagcaccttgtagagggctcccggctcgtggttcacgatcagcatgagggaggagcggtcggctcccgggtagatcgtgaggtcctttgcgatgcaggcaaagcgcgtgaagttgttgccggtgtcctggacggaacgggcgaggatatcgaggccatagagctcggcgcaggcacggctcgaaagggcagcgacatcggtgcggtcgctctctgcgaccatctttgctgccattgccgtgttctcgacgacgtgcaccttcatctcaggatgtgccgccaggaactgccttgactggcggattgcctgttcatggctatagatatcccggatgtccgagagctcggtgccatgctttgcgagcacgttgtgatcgatcttgatgcgtgtcgagcgtacgatcgagaagttgtgctgcatcatcaggtcgtagaccgcattcacggtgccggcggtcgagttctcgacgggaagcacgccgtactggcagaagccctgctcgacggcacggaagactgcgtcgaaggagtcgaagtatgagatcgtcgggtgcttgaagatgcggtctgccgctatctgcgaataggcgccctcgacgccctggcaggctacataggcggtctgcgggaagagcttcggctcatgctggatggcatcatagatgcgggtgccgacattgctcatgacaccgaggtcgtcatattcctgagcgcgtgctgcctccatgagaaggcccatgagtacctgtgcatagttgcggtactgggcaggcacggcttcggcgacggctgcgagcttctggcgctcacgggtcttgtcgaggatcggcaggttgtgggcgctcttgtaggcagccacttcgtcggcacacgccatgcgttcctggaagaggccgagaatgctggtatcgatgcggtcgagatcggcgcggatttcggaaagttctctcacggacgtcctcacttcttctggaagagggtatcggcagggtagctgagccaggcatcgaggagagacagcgctgtgactgcctcgacgaccggcacggcacgcgtgacgatgcaggggtcgtggcggccatggacctcgagctcggcgggctccatatgggcaaggtcgacggattgctgcggacgcgagatgctcgaggtcggcttcatggcaatcctgaagaggagcggtgctccggtcgtgatgccgcccaggatgccgccggcattgttcgtggccggcacgcatgcgccatcctcgaccatgaaggaatcgttgttctcggagccatgcatatgtgccatctcgaagccgcggccgaactcgatgcccttgacgccgggaatgccgaagatattgcgtgccaggatgttctccataccgtcgaacatgggcgagccgatgcctgcaggaaggccggtggcgacgcattcgatctcgccgccgacggaatccttggcgcgtcttgccttgtcaatctctccaagcatcgcttcggatgcaccggcatcgatcacggaaagtgtcgtctcatgcctctgtatcgtggctatctgctgggccaggagctctcgggactcaggggtgttctcgaaggcagcaaagcgcgcatcggccgcatctcctatgcgcgagagatgcgctgcaatggatatgccctgctccgaaaggatctggagcgcgatggcgccggcaaagcagagaggggctgtgagcctgcccgagaaatggccgccgcccctgatatcgtgggcagagccccacttcgtccaggcacagaaatcggaatggcccggacgcggaacccgggcgatgttcttgtagtcctgggagcgggtattcgtgttcctgatgatgcaggcaagaggggtcccgcaggtgaggccttctgcatcgaggccggagacgatctcgggcaggtctgcttccttgcggggcgtcgtccaggcgccctgtccaggagcacgtcttcccatgaactccttcacggcgtccatgtcgatcttgatgccggaaggaaggccggagatcacgcagccgatggcttcggaatgggactggccgaagacggagaccgtaagcgtctctcccatggtcgatggcatctaggactccttcctgacaaccccgccgagcgaggagaggtcctcgaagaaggcaggatatgatttctggacgcattcggcaccgacgatcttggtcggaccgtctgccttcgtggcagcaatggctgccgccattgcgatgcggtgatcgtttgctgcatcgacggtgccgcctgaaagcgaccccgtgccttcgattgcaagggaatcgtcctcgatcgtgacctgggcacccattgcgtcgagtgcggcggcacacgtctcgagacggtcggactccttgaggcggagcctccctgcattcgtcaggtgcgtcgttcctttcgcgtagcaggcaacggcagcaagtgccggcacaaggtccggtatgtcatgcacgtcgatcgagatggcatcgagcctgtcatgcacgatcgtgacgcgggaatccttgcgggagatccgggcaccgaagagggcaagcgcgcccagtatgctgcggtctccctggacgcttgcgagatccatgccggtgatggagacagggtgttcgctcagtgctcctgcgcagagccagaaggcggcattcgaccagtcgccttcgacgacgaaggtgcctggtgaggtcggaggggtcgatgccggcgatgccatgatcgcgaggcacctcgtcccatcctctgccgtctcaggcgcgctcatcacatcgatgccgaagcgctgcatcgtatcgatcgtgagattgatgtagggacgcgattcgaccggctcctctacgaggatgcgcaccggtcccgccatgagaggcgaggccagaaggagccctgagacgaactgcgacgagacgtcgcccggaatgcggaacgagcgctccttgagcttgcccgaaagggtcagagggaacgtcccctgaggagagagcgtgcagccgccagcggcgaggagctcgtagagaggcgagagcggacgctcagcgaggcgtccctgtcctgtgaagctcgcacccgatcccaaggcagcgacgacgggcagcatgaagcgcagggtcgagcccgattctccgcagtccagcacggcattcttcctgccctgacggatattgtctgtagcagaggtcccctggagcggctccacatggaagcctgcctcggtgcgcatgaccttggcaccaagggccgtgagcacgcgcgctgtcgcatcgatatccttcgacgtcgcattgcagacgatatcggacgggctcggacagagggcagcgaggatgagggcacggtgtgccacggacttcgaggcgatggcctcgaccgtgccgccaagctcatgggggaagacggtcatatccataagctagacgctccttccgcagccaaggtcgatgagctctctcagctcatcgagcgatacggtcctgagcgagaccttgcctatggcctcaggcacagcgatattcacggacgaggcatggcgcttcttgtcatgtgcggcaaacaagaggatcgtgtcatggggaagggaggtgtcggtgggcatgccatgggcctcgacaagacgctcgatgcgtgtcgctgtggcttcgtcgcaccagcccttcttctcggctgcccatgccatgcagcacagccctatcgctacgcacgtgccatggccgagctcgaagtcggaagcagcctcgatggcatgtccgatcgtatgtcccaggttgagtacctggcgcctgccgtgctccttctcgtcggtcgccacgacatcgcgcttgatctcgatgtttctggcaacgacgtctgcaagctcgccttccgagagacaaggcgtcgttagcggcgtcttctcgaggcggctgaagagatcggggccggaaaggacggcatgctttatgacctcgccgcaggaatcgcggaagaggtcgtgagagatcgtcttgaagcagtcgacatcggcgacaacggaagcaggctgccagaaggcgccgacaaggttcttgccttcggggaggtcgacagctgtctttcctccgacagaggagtcgaccattgcaagaagcgaggtaggcacctgcacgacctcgatgccgcgctggtagagggcagcggcgaggccgcccatgtctcctgtgacgccgccgccgacagcgacgacgatatcgtcacgcgtaagcgaggcatcggccatgtcttcgaggatgcgttcgagcgtcgagaggcgcttgtgctcctctcctgcaggaaagacgcttctcgcgacgcggtagcctgccttctcgagcgaggatgctgccttgtctgcatagagcggggcgacatgcgagtcgctcacgatgcaggcgcaattgccgccagcagccttccttgcataggtgcccacttcggagaggatgcccgcacccacatggcagagatagcgcttcgtgggagtggggacctctatcgtatgctcagccatgctaccttccttcgatctcgcgcttgcggcggtcgccgtcagcgagaagctctctcagatgcctgctgtcgcgtgcatcgattgcatccttgtattcctgcaggtgtccaatgaggcagccgatctcacgggagaggttgtccgcatcctcgaggaagagctctgtccacatgtcagggttgagccttgccacgcgcgtgagatccttgtaggagcctgcagagaagcccttgtgcacctttgcctcagggctcttcacgtaggcattcgatacgacatgggcaagctgcgaggtgaaggcgatgatctcgtcgtggcgctctgctgtcgtcagcgtgaaggtggcaaagcctagaggggccaggagctgcttcatgcgctcgaggaggtcaagcctctcgaagtcgtccatcttcggcggcacgattacgagcggtgccccatggaacatgtttgcgcgggcatgcgcgaagcctgagtactgggtgccagccatcgggtggcagccgacgaacgtgaagggatggttctctgcaaccgggaagcaggcatcgcagatgaccttcttgacgccaccggtgtccatgacaatggcaccgggggagacaaggggagcgattctcttgagctcggagatggcgaccttcgggtatccggcaagcacgataagctcgcaggttggaactatttcatctgtgagctcgcccttgatggtctcgatctctgccatctcgaggacgtcctcagagatgtcccggccatagacctcaacgccggctgcagcaaaggcctttgcgaacgagccgcccatgaggccaagggagatgatgccgacgcgtcctgggacaaatgtcttctccatcggcctagctcctgtcttcggcaagtgccgcgcggagcttggctatgcgttccatcatctgggcgaactgctccggtgtgagcgcgcgtccgccgtcggccagagactcttccatcggctggtcatcgatctcgattgtgaggccatcggcccctgccgcgcaggcggcgagggaaaggcccggcacgaagcgggcaaggcctgcggcgcgcgaggggtcgcagatgaccgggaggtgcgagaggccatggacggcgatgatcgaggagatgtcaagggtatgacggtagcgggtctcggcggtgcggatgccgcgctcgcagaggatgacctgctcgttgccttcgctcatcacgtactctgctgccatgagccattcgtcgacggttgcctcgaggccacgcttgatgaggatggggacatccgtgcggccaagttctttgaggagcgggaagttctgcatgctgcgggcaccgacctggataacgttgacgccagacgagacgaaggtctctacatcgcgcgggtccatgatttcggccacagcgggcatctcatggacgtgggcgacagagcagagctcggaaaggctctcaggcctgagtccgctgaaggagtagggcgaggtcttcgcattgtaggtgcctgccataagaaggcgggcacctgctgccttcgcctgtgtggcaagggcatcgaggtcgcgtccgtcaagcgcattggggcctgccatgacctggaaggagccgtcgccgatcttcacgccgaagccgcagtcgatcacggaattctgtggatggaacttgcggtttgccttcttgtagggctcggagacgcgctggacgcggtcgatgatgtccatggactcgaggaggaacggatcgatcttcgccgtatcgccgatgatgccgacaatcgtctcattctcgcctttggagacattcgtcctgaatccgcggttctcgatccaggatatgaaatgcgccagctggtcttcggtggcgctctggtttacgacagctatcatcggagaaactcccatcgtttcgtggcatatcgcgaaaaatcctactacaaatgtatgaaagccagatttcctgtatatgtgagtatctgggtcttgaaagttcgtctcgccaaatttaatgtttcggctataatcatgcacgcatgctcccttagctcagtggatcagagcgttcgcctccggagcgaaaggtcgtgggttcgagccccacagggagcaccatggcttgtctgaaagaagcgctctgccggaaggcagggcgcttttgcatatcaaacgaaagcttcgtgtcaggcgtcgtttaaccgccgacttcctttgcgcgtccatggtctctgcatgcgccttgataatctcgtcagccttctgcccattgccttgagcatcttccgggtgagtgccatgtaggccctccgtcccgcggcatttcctcgccgctccggtccatgggatgcgcgatgccttgcgcgttccccgtcacggaagatggtcgcacccgcttcacagccgctaatggccgagggattcctgcaagatggccttgtactcgctgccgtgctccgtcgcggcaggcttgaggaacggctgagcatcgtgcttcgaggtgccttcctcgacgtacttgccgtactcgacgttcgtgccgatgtagacggcaggggagatgccgcccttgagcacgtgcgtgatgctgttgcggagcctgcctgtgtctaccgggcacttggccttcgcgtagccctcggccacgagccctatcctctccacgctctccatgatgccgtagaaaatcgcatcctgtatcgcctcggtgttgtcctgctggacctcgacaaggccagacatgtcggatgccgtaaggcctgccgccttcgatgctgccatgctgcatcgcctccttggcccaagcgtgcctggaggctcacggcacaagaaaaggcccccgccggagcgagggccttgaggtaggtggcgctttgtgcgcggactcagaacagcgcgtcttcgggtgcgcctgtcacggcatatgggtcgtactccctgccgtcgcggatgcacctctcgatgatcgcggcgcactcggcggcgtcatcgggcatcgagaagtcgtggcccatcggcaacccgaatttcgcctcgtactcgtcgcatgccttcttgaaccgttcctcgtccgtcatatccccgccgcctccctcgtcatcttcaggaacatatcatacgattccgggaatatctgccttttttaccaagagactcctgcgatgtgaatgaggcggcgctcatttcggcgaaagccttcgtggacagatgcctgccctccttgtcccagtagccctttccgaagtgcccacccctcgcggcatcgcatgttcgtggcgccgccaagcaggtcggagacgtcagcgcgctcgttgtcggggagttccgagagcctctccgccacgtacttgtatgcgccggtaagcgtaggctttttgaggcttgccttgagctcgtcctttccgatgcggtgccatttgtagtcgttcacgacgtcatccgatatgagccccatgcctctgagcttgtcagcaagcctccccctcaggtatgcctctccgtcttcgctcccgtctatctcggacactgcccactgcgtcatctcgcccttggctttgacgcagtactccctcgcctcctcgcgaagcttcgccggaaacgctccgtttccgtattcgaatgacagcgtcgaccgggcattgccgctcggcgcctccagatggtcgatgttgtgcccgaactcgtggaaccacgtgttgcctggctccatcttcccgctagggtcgaactcgctgtccgggttgatggtcaccctgtcatctgatggcgagtaccacgcatctgacccagcgtgcaccgcaggagtcttgaaatcgcgctcatgcatcttgtacagccgcgccaccgtgtctggcgcccctcgcagcgcatcgtccacaacctttgcctgcctatcgtcgaggaccccgtagaccttcgctccggggtctatgccagcgcccctggcgctgtgcttctgcttcttcgggtctcgccctgccttccattcctcgtagctggcctctagcttcgatgtattgcgctcgccgaagacgtcgtggccgggaagcgccgcgaccatcgtgcagcggcagttccacacctcggatgccggccctgtcgggtcttccggatagctgaggccgttgctgaacctgccgtctatgtcggccttctcgccgtccagctccctgtggctgtcgcgcgtccgggagtccagcgttgccatccattgcttctggagctcgatgcccatgccgctggcgcgcctgtaggagcccatgcgcacggcgttctcggcgcccgtgatagacgtcctcgcggcacgcagggatgcgcgcctgtccatctccacgacggaacggatgcgcctggcggcatcgggcacgctctcgccctggaggatgccctgcgtcatggcagacgtgatcttgcgacgggcccatgtctcggccctgctcggcttcacggacacctgcggcatgaggtccggctgctgggacgttatcggcatcgaccagcgtgtagctcgtatcgagcttcgcgacgctctccacatcgaaggtgccgcagttcatgttcgcggcgtacacggcaggggactcgccgctgatgatggcagcggcgcagcgcggcgcggatgccgtccaagaagcccatctttcacctccttagcatagctacattgtagctacagtgtgaggcgaagtcaagctatgtcaattgtggtttaacagagccattcgatttgcggatccatgaggctatcgaagagcgtgctgcagaaggaatgcctgattgctgtgcgactctgcggcctatgggcgcagagataagccggcatgaaatgatggctgtctagtctgtgcatatatgtctcccaggaaacgtttgtttggtgtcctaggggatttaacgccctgtctctcgggctctggaaaccgcaggcagtttatggtttaccctgcagaaaaccgatctgcatggcagtcttgctggttcaatggcaatgcttggagctggattgctgcagcgccttttgtgctcggcgagatgatgcagagaagctttggcccgctcttgttaaaagctcttggcggctagcgaagtgagcttgaaacggcaataaacgttgcctcgcgttcaggagaaactgtgtcgttccctgccatgccgctcatgggcaagcgcaacttccagatcgtttggattgccgatgccgtgctccttggccagagaatctgtggcattatgagctaaatggcacatactgcgccttggcccagggcgcctttcatgtttcagagattagtgtcctcgagttgacggcaaaacggcaagactgccttcaccagtgatgaagaggatttccaggtcggatgtcttcttcatgcgtgcaatcgaaggcgcagactcgcggagcctgcaatgactttcatgtctggctggcatccccgtaaaatgcttacgtatatatccttgtcgaggcatggtgttctttgggcgcctgcatgctccatcgggctggctttgggtacgcatgataggatgcccgaaaagccgatatcgaggaggattcgtgtctcaagacaccagagaccagaagcttcaggggctgagcgctgccgaagtcgaggaacgcagggcaagaggcctcgtcaatgccaatgctgacgtgaagaccaagacgatcccccagatcgtggccgagcataccttcacgctcttcaacggcgtcaatgccgtgctggcgctgcttgtattcctgaccgggcggtaccgcaacatgctcttcatggtgatcgtgctggcgaacctcttcatcggtatcgtccaggagatccgcgcaaagctcacggtcgaccgtctgacgcttctgacggcaacggatgctcttgtcatccgcgacggggagaagcagaaggttcctgtctccgatatcgtccaggacgatatcatctgcctcgcgcatggtgaccaggtgccggcagatgccacgattgtccgaggctccgtctccatgaacgagagcctgcttacgggagaatccgatgccgtgcacaagggaccgggagatgagatactctccggcagcttcgtcgactccggatctctcatggcaagagtcacgcgtgtcggcgccgcatcctatgctgccaagatcaatgcagaagcgaagtatgtgaagaaggcgaagtccgagatccaggactcgcttcggatggtcgtcgagttctcgacgatcctcatgccgttcctcggaggcggcctcttcctgaggagcgtctttgcagaaggcatgacgtgggatgcggctatcctctctgtcgtggcagcgcttgtctcgatgattccgcagggcctcatgctcctgacatcgacggtcctggctatcgcgacgacgaggcttggcgccaagaacgtgcttgtgcagcagagctactgcgtcgagacgcttgcacgtgtcgatacggtctgcctcgacaagaccggcaccatcacttcgggcaggatggagctcatggggctcctaccgcttggcggatatgacgtgtccgaggtacgccaggcggtgcttgctatcacaggagccgcatctgacgatgcgaacgagacggcagctgcacttctgcgtgccgcggaaggctggcctgaagaggcgggtgcggtctcacgtgtcatcccgttctcgtcctcccgcaagtactcgggatgcgtgctcgaggatggacgctctcttgctctgggtgcaggccagttcgtgatgggggagcgctatgctgcgctttcccgcgatgtggcgaccttcggcccgcttgcccgtgtgctcgtcgtcggctcctgtggaggcttcgacgaagaaggaaagatcgaaggctcattcgagccttggggcctcgtggcgctgcgcgatgagatcaggccgacagctcaagagacgatctcctatttccgccgcgaaggcgtcgatgtgcgcgtgatctcgggcgacgatccgcgcacagtctctgccattgcctctgctgtcggcgtgccggaagccggacactatatcgatgcttccacgatcaggaatgaagaggagctcatcgatgccgtgcgcacgaagaagatcttcggccgcgtgacgccgcagcagaagcgcgagattgtccgcattctcgagtcgcatggccacacggtcgcaatgacaggcgacggcgtgaacgatgtcctggccctgcgcgaggcagactgctcggtggccatggcatcaggatcggcggcagcaaggaatgttgccgagatcgtgctcgccgacaacgacttcgcccatatgcccgaggtcgtggcagaaggcaggcgctccatcaacaacctgcagcgctcggcctccctcttcctcgtgaagacgggctttgccattgccctctgcttcatctgcatcttcttcccgccattcccgttcctgccgatccaggaatccttcttctcaggcctcatcatcggctatccgtcgttcgtgctcgcgctcgagccgaaccatgagaggctgcacggcgacttcctgacgaacgtgcttgcccgttcgctccctggatctatcgcgatcgtcttcatcatcgctgtcacgatgatgatggagcctctgatgggctgggacttcgcccagacctcgactctgtgcctgcttctcgtctgcatggtcggcgtcggcctcatctggcgcatctcgcgtccgctcacgcctctgcgctgcgcccttatcgcctccatcatcattgcaatcgctggcgggtcattgctattcggaaactttttcatgatcgagccgctcacgccctggatggtcgtgtaccttttcagtgcaggagcgctggcgctcgttctctttgccctcctgtaccgccgtttcgataagagcatcgaacatgaaggacgtcttgcatacgtcgtgaagaaggccgaggtcgcatatgctcagcacagaagccgtgtcagcagccgtacgagaggctaggaagcccaagcagatcgaggcaggtggcatctcgcgggctgcgaccatcgtgtcgaagattcctggcgccgagaggctgccccgagcgcttctgatcctcctcgagaatgtcgtgcgccgtgccaagacggatgaggaagccatgctcatgtgtgcccgcatcctcgaggcaggggagaagggtgcccagggcaaggagatcgagttcatgccatcaagggtcctcttccaggacttcacgggcgtgccggtcttcgtcgacttcgctgccatgcgcgatgcgatggcggcacgtggcggcgatcccgagaaggtgaacccccatatccccacgaccctcatcatcgaccactcagtgatcgcagaagaggcaggatgtgcaggcgcacgcgccgagaacgagcgcatcgaggcagaacgcaaccgcgaacgcttcgccttcctgaagtgggcaagccgctccttcgagaatgtgaaggtcgtccctcctgcagagggcatctgccaccagctcaacatggagcgcttctcgaaggtcgtcggcaccgatgcgctctggcagggcgagggggagatggcgtgcttcgacacgcttgtcggcacggactcccacacgaccacggtcaatggcatcggctgcatgggctggggcgtcggcggcatcgaggcagaggcggcagcgcttggccagtcgatcacgatgctcgtgcctgaagtcgtcgagctcaggctcgagggcaagctgcgcgatggcatctccggcatggactgtgcgcttacggtctgcgagctgctccgcaaggcacaggtcgtcggctccctcgtcgaggtcacaggaccgggcgtggccgagctcacggcaacgcagcgtgcctgcatcgcgaacatgacgccggagtacggcgcgacgacgacgctcttcccggtggatgcccagacattcaaatatctggcgctcaccggacgcgaccctgaagagatcgccttcatcgaggcatacctgcacgagcagggcatgctcggcgagcgcgatgcacactacgcacgcacctatacgctcgacctctcgaccgtcgagccctgcctggcaggaccttcacgtccccatcgccgcgttgcagttccggggctcaaggcccgcttcgaggagtcgtctgccgagcatggccacaagcccgagacggggaagatggcgctccagttcggcgacaggacgtgcgagctcgaccatggtgcgcttgcaatcgctgccatcacgagctgcacgacggcaaccgaccctgccatgatggtggcagcaggccttgtcgcgaagaaggccacggacttcggccttgagcccaagccctgggtcaagaagatcatggctccgggcagccatgcgacgctcgagatcctgaagcgtgcgcacctcacagcaccgctcgagaagcttggcttcttcacctgcggctttggctgcatgagctgcatcggcaactccggaagcattgcacctgccctccatgagcatgcagacgatctcgagctcacgagcatcctttcgggcaacaggaacttcgatggccgcatctcgcccgatgtcgcacagaactatcttgcagagcctgcgctcgtcgttgcctactcgcttgtcggcacgctcgacaccgatctctctgaggagccggtgggtaccggcaaggacggcaagcccgtcatgctctccgaccttctgcctaccgatgaagagatccgcgatgtgcttgcaaaggtgctcacgagagacctctatgaggaggcggccgagggcctcttcgaaggctcggacgcatggaaggccattcctgcatcttcctctgcaacctatgcctgggacgagagctcgacctatgtgcgccgcccgccctacttcgaggatgcaaagcacgagacagtgcgcgcggtgaaggacgcacgcgtgctggcactcctgggcgccttcgtgacgaccgaccacatctctcctgccggcacgattgccgaaggctctcctgccgcccgctatctcacggagcatggcgtgcccgagaacgagtggaacacctacggcacgaggcgcggcaaccatgaggtgatgatgagaggcacgttcgcgaacgtgaagctcgagaatgcccttgcccagggcaggcagggcggctacacctatgacttcgagcgcgatgaggtcacaagcatctacgatgccgctatggactacaaggcacagaacgaggacgaggtcgttgtcgccggcaagatgtatggctctggttcgagccgcgactgggcgggcaagggtccggcactcctcggcgtcaaggccgtcctcgcagagagcttcgagcgcatccatcgctcgaacctcatcggcatgggcatcgtgccgctccagttcgaggacggtgtctcagcaggcatgctaggcctcgatggcacggagcgcatcacggtcgagccaatcgacttctcgaaggggcttccggagccaaagatggttgctgtaagcgctgtcaagccatccggcgagaagatcgatttccgtgcgctcgtgcgtgtcgatacgccgagcgagggtgcctacatttcagaaggcggaattctgccttatgttcttggacaacttgtgtgacatggtcccatcttcggggagagtgctacagtctcgcttcagcatatgaatcgtgatttggaggattgcttgatctgcccattctgcggaacgcatatcgaagacggtctggatgtctgcccagcctgccatgccgatctgacggctatggcacatgtgtcccatccggaccggcgctattgcgcgagctgcggcgccctcatccccgaaggagccgatgtctgtccccagtgcggcatgccctgtatcgcagatgaggcggatgcagacgacggcgaggaagtcacctgcgaaggtgctcacgttaaggaagcgcctgagaccccgcgcatcatctctgccatccctacggcagatggaccgttctctgcgacgtctgccaatgagcgcctgccaaggaggcgtgtcttcacgcttgcgtttgtcgcagcccttgtcttcgtaggcggcggcatcctcgcaatcacgcagccctggaacccgaatgcctactccatcaaggccacgaccgcagctgatacatcgaaggcaggctacccgggcgagatcgacaagcttgcaggacaggatacgggcatcgatacctccgatgtggagtccggagacgcccagacctatgaagccatctcgggctactgggagcagctcggagacatcaggaagagcctcgaggagagcgagaccgcactcaaggcagatgtccaggattcctcgaaggacatctcgaccgactaccagacagccaagcagaatgccctggatctttcgaacctcatctccgatatcggggacgtggatgtgagcacgggcacgtacgccgacgatgtcacgaatctccagaccttgggctcgtggctcaggaactggtccgatggccttatggaggcctgggacagggcgcagtccggctcgtacaaatctgccgacacgatcctcgctccgctctcttcgagcgagagcacggatggctcgaactcctatgcgcagctcttcgatcagagctatgacggatggcagccgcaggagaaatagctttcatttccccgcaatgtctctgccgaatgtgtgaaagacgcgccgtgctggtactatcagaagatggaagaattgtatgaaggtgccacagggccggggaggttcagatgggctttttcaataggaacagcgtctatgtcccaaagcgcgagctcaagggaacggaagttgctgtattcaagaccagcaagggcacgatcaaggtgcgtctcgactgcaagggcgcacccatccattgcgccaatttctgcgagcttgcagagaaggggttctacgacggaacgaagttccaccgctatgtgccggatttcgtgatccagggcggagaccccaatacgaggaacatgagctctgccgatgtagcagcaggcaagcccggacctgatggcatgcccggcacgggcggtcctggctacagcatcaagcacgagtgggatgtgaatccgcgcaacagccatgaggatggcgcgcttgcaatggcacgctcgcagatgcccgattcggctggatcgcagttctatttctgccttggcccgcagcatttcctcgacccgaactacacggtcttcggccagacgatcgagggcctcgacgtcgagaagagcctgagggcaggagacgtgctcgagtctgtgagcatcgtcgacgaataagggcacgcatagcagcacctggaggtgtgacgcatgaaccagcaggcatatgaagcaggaaaggcggcctatcagcagggcgactggaacggggccgttgctctcctgcatcaggcaatagatgcaacagaggcaaatggcgcagcagagcatatgctcggcaacgcctatatgaagctcggcaggtatgccgaggcagctgacgcctatggcaaggctctggcagacgcttcctacggcaaggtgggagcgctctcctgcaaccgtggccgcgcctatctggccgcaggccagccggatgaggcaatcgccagcctcaacgcagctgtccaggaccagtcctatgccaaggcatacaaggcctatgtggccctcggcgaggcataccgcatgaagaacgatgtccggaatgccggcatcgccttcaggaacgccgccatcgacgagagcaacccggatccttcgtactcgcttcgcgaactcggtgcctgcttcatcgcactgcaccgtccggtcgatgctgtcgaggcctaccgtaccgcactcgacttcgcgacgccgatggagaaccagaacgccatctactccgagctcggcatggcatatgtcgctgccaaccgcatgagcgaggctgtggatgccttcgcgcatgcaacggccgatggcacctatatcctgccgaccgacatgcagattgcctacgactccgcaaagcgcgctgtcgcttcgacccaggcgaacaatccttccgagaccgatgccctgcttgctgctgctggctatggtacgtcccaggacacgttcgatccgctcgatcccctcggccagtcgggggagttcatgccgtcgcctgagaagaccggcttcttctctgtctccgagcaggacctcgtcgaggctgacaagaaggagcgcaaggtccgccgcaagaagaagcatacgggcctcaaggtcttcctcgtgctcctgatcgtcgtcgtggtcgtcggcggcgtcggtgcctatgcgtactggcgtggctatggctggcctacgcaggagacggtcatcacctcgctcttcaattcgaaggcatcgggcgacgatcctgcaagcttcatggcgccgagcctttccgactctgagcgtgctgccatcgaggacatcctgccttctggcgccacgatctctgtcgacggactcgacaagagcatggacagctcgacggcccgcgtgaccgctacgctttcttccggcacgacccagacctatacggtcacgctcgtccgcgacggcatcggctggagggtctcttcgctccagctgagctatgattccgtctcgagcaattcttagaagcgtcttcggcggaactagacatagggaatatcagggataggaagacatgtcctttatcgactccatatttggtgagtatggcggagaccttgccatcgatcttggcaccgcaaatacgcttgtctcggtccgtggccagggcatcgtcctgaacgagccttccgtcgtcgcaatcgacaaggagcaggagcgtgtccttgccgtcggctccgatgcaaagcgcatgattggccgcacgccgggatcgatcatcgccgagcgtccgctgaaggacggcgtcattgctgacttcgatgtcaccgaggtcatgctgcgctacttcatcgagaaggcgcgcgagcgcaagtatccctggtcgccgcgtccccgcgtcgtcgtctgcgtgccgtcgggtgtcacgtccgtcgagaagcgtgctgtcttcgaggcaacgatctctgcaggtgcccgccaggcgtatctgatcgaggagccgatggctgctgccatcggtgccgacctgccgatcgaggacccgacgggatcgatgatcgtcgacctcggcggcggcacgaccgaagtggccgtcatctcgatgggcggcatcgtcgtctcgcagtccatcaggaccgcaggagacgaattcgaccgcacgatcctcgagcatgtgcgcgatgcctacaatctctctatcggcgagcgcacggctgaggacatcaagatcaaggtcggctctgccgctcctcttgctgaggagctcgacgtcgaggtcaacggccgagacgtgctcacaggcatgccgaagaccgtgcgcatcgagtccgaggagatccgccgtgcactcgacaagccgctcgacgaggtcacgaaggccgtcaaggatgcgctcgatgtgacgccgcccgacctggcctccgacctcatgtactacggcatcctcctcacgggcggtggcggactgctgcgcggactcgaccagcgtctgcgcgaagagacgggcgtgcccgtcaacgtgagccccacagccctcgaaaacgttgtcaatggctgcgcgaaggtcctcgaagcgaatgccctttcgggcggcttcgtccagagtgctggcctgtagaccaaggatctgaagaatgcccgcaaatggtgctccgcatggcttccagaggacaggccagaattcctctggaggccgtctcgctatagtccttttggccctttccgtcatcctgttcacggtcagctgccgcatgggcgatgtcggcgtgctcggtgctgcccgtaccgtatggcagaccgtgacgatgccgataagctgcatcggatctgttgcggtccagccgttccagggcctcggcaacatcttcgcgaacctcacggcagaccaggagacgctctcgcagctgcaggaggagaacaagcagctcgtggcagagaacgccgagctcgaggaggcgcagcagaccgcaacgcgcctgcaggcgctgctcgacctcaaggacacctacaacctgcagtcgaccgcggcacgcatcatcaatgcgtcgtatgacaactggtcacgcacagtgacgctcgacaagggcagctcgtcaggactggctgtcggcatgccggtgacggattcctacggcgtcatcggccagatatccgaagtcagcgccacgactgccacggtacgcctcatcacggatgagaactcgggcgtctccgccatgatccagtcgagcagggcacaggggatgctcaatggctctgccgatggcaccttgagcctcaacctcgtgaggaccgaccagaccgtcaatgccggtgacatcatcgtcacctcgggcctcggaggcgtctatccgaagggcctgcctcttggcacggtgacctcggtcgagaagtacgacggcgccatgtactacacgatcacggtcgagcccttcacgaagacagagagctacgaggaagtcctcgtgatcacgtcgcttacagaggaccaggcggcaactgctgaagacatcgcagctgcggactcgcaggagacctcgtcggcagcttcttcgaagacgtcgacctcgaccgattcctcatctgactcatcgtctgatggctcgtccgactcttcatcggacagcacatccggctcttcggcatccgattcttcgtcgagcacgtcccagaccacatctcagtccacatcatcttccacgacgacgtcttcttcctcgacgtcgagctcccagtaggcaaggcaggagacctcatgcagatacaggacacgaacagatatcgtcacgatgcgctcgttctggggattgtctgcctcgtgctgcagcttgccgtggctccctatatcgcgatcgcaaacgggcatccgaactttgccttcatcttctctgcgaccttcgcgctcacggtcggcggccctaccggtgtggctatgggctttgcggcaggcatcgtctatgacctgggtgcgtcgagcccgatggggctcatggcattcctgctgacgctctcctcctatatcctcggcatcgaggcaaggaacaagctgaatgacgacccgggagcagcgctcgcgaatggcctcatcagctgcttcgcagtcagccttctctatgggctggcgatgctcctgaccggctcgagcgcctcattcatcgatgtgattctgaccaggagcctgccgtccttcttcctgacggcgctctttgccattccgttctatctcttctattcgcgtccgcagtcttcgggcgcgaccctgaaccgcagcctcgggacgaagatgccgacgcttggcaatacccgcaggcgcagccagggacatctcggcaccagagggcggcagatctagctgtgagcctttccaccatcatcatcctcgtgctcgtctcgatcatcgtcgtggcgggcctcgtgcttctcttctcgcgcggggagatgcgcttcaagttcgatatcggcggctcggctccgcgtgcagcgggcggaaacgatgactccggcgatacgacgatcaggaaccgcatcatgggcctcggcatcttctccggtggcgccatcgcggtactccttgcacgtctctggtccatgcagctcgtctcctctgacgagtatgctgcccaggcagaatcgaaccgcacgaggaccatctcgattgccgctccccgcggacgcatcctcgaccgcaatggcaaggagctcgtgacgaaccgtccgagcctcaccgttgtcgcagactctgaggtcgagaacgacgacgtggagatgcagcttctcggcaaccttcttggtatgccccgcatggccgtgaagaggaagatcgaggattcctcggaaggcgcccagtctgcccgtccggtgatggtcgatgtctctatccgcgttgtggcctacctcgaagagcaccccgatctcttcaccggcgtcacggtgcaggaaaggacgcagagaagctatccgtatggctcgcttgctggccaggttctgggatatgccggcacggtcacgagcgaccagctggcggcatcgggcacctcgaccgatgagggtgccatcgaatacgagtcaggagatacggtcggccaggcgggcgtcgaatacgaatacgagaatgtccttcagggcgtccgtggcgagcagacggtctacgtcgatgcctcgggcaatgtcacgtcgtactcgacgacggtcgatccccaggcaggctccgatgtgctgctgacgctcgaccttacgatccagcagggctgcgagagtggccttgcccatgccatcaaggttgcaaacgaccttggctacaaggactgcaaggcaggcgccatcctctgcatggatgtcacgaatggcgagatcctgggcatggcgtcggcgccctcattctctccgtcggtctttgtcggtggcatatcgaacgacgactggaatgcgctgaactcggaagagggcatgtatcctctgatcaaccgtgccatccagggacagtactgctctgcctcgacgatcaagccgctcacaagcttcgctgcgctctcgaatggtctcgcgaccatcacttcgacttactactgcgctggcctctggacgggcttcggcgaggcatatggccagtactgctggaagaagaccggacatggaacaatgacgatcgagacgggcatcacgtattcgtgcgacgtcgtcttctatgagatcggcaaggcattctatctctccgacaatccggaagcccagcaggatcatctgcgcatgtggggcctgggctcgacctacgatatcgaccttccgagcgaggcgtcaggacgcgtgcccgatgccgattggaagaacgagtactacagcgcctacgacgagaacacccgcacatggatgggcggcgaccagacgaacctctccatcggccagggcgacctgctcgtgacgcctctgcagatggcatgcgcctatgcaggcatcgcgaatgaaggcccgatctggcgcccgcatgtgctcaagggcgtgcaggcgcagggagcctcgggcacggtcgtcgaataccagcccgagattgcgctctcgccgacagaggatgccacctacttctcgaccatcaagaagggcctgcgcggcgtgctcgagaaggaatcgacgaacatcattgcccacttcagctcgctctccgtctctgtcgaaggaaagaccggcacgggcgaggtcaatggcaaggacccggtcggctggttcgtggcctatgctcctgcagagagcccgaagtatgtctgcgcctgcgttgtcgaggaaggcggctacggcgagaactctgccatgcgtggcgtgcgtgacgtcttcggtgccatctacaacgagccggatacatccgatgcaagcagcacgagcggtgcccgctaggggagagaggaggacaagatgcagtacagaacgcccaggtcgcaggaaggcttctacgacaggatggcgcatgctctgaacggcagccatggcaggcacggaggcggcaggcacgcgaccgtccggcgcggctctggcatcgcatcgaaggtctatcttccccagctcgtgccggcaatgctccttgtggcctatggacttgtcgttcagtggtcagcctcgctctcgataccggaagcctccctcccgcgccaggcggtgggtgtgctcatcggctgcatcgtcgccttcatgatctggcgctatgactaccgcacgcttgcaaacatgcgcacggccctcatggttgcagatgccgtgctgctgctcctgccgagcattcctttcatcggcgtctctgccaagggcatgacgggctggatccagattcccggcatcggccttcgcttccagccatcggaaatcgcaaagctcgtgacgatcttcctcatggcatcagtgacagcggaatataacggcaggatagagacgctcagggactacgtgaagctctgcgggaccctgctcttcccgttcgtgctgatcatgacgcagcctgacctgggcacgggcctcgtgcttctcttctcgggtgcctgcgtcatcatctgcggcggcgcgaagagaagctgggtgctcgtgacaatcgccttgatcgttatcggtgctgccctcatcatcgccacgtcaatgacggaaggactgcctcatatactgaaggaataccagctgaaacgactcatcgtcttcgtcgacccttcggtcgacccgacaggagacggctacaacctggcgcaggccaagatcgctgtcggctcgggcggcttcttcggcaagggcgtcgagaacgcgacacagacgattgcaggatttctgcctgaagcccataccgacttcgtctttgccctgctttcggaggaattcggtttcctgggcgcgctcgtgctcctgggcctcttcggctggctcatcttctcgacgcttgcgcttgccctcaaggtggagacgacgtttgcaaagctcgtgcttgtcggcattgttgccatgtggacgttccaggtgctcgagaatgtgggtatgtgtataggcatcatgcccatcacgggcatcccgctgcccttcatcagcttcggctcgtcgtcgatgctggcgcagatcacggcggtgggtgtcgtgcagtcgatatggcggaacaggacgaagtccgcgtaaggcctggacttcaggatcggaggcattgtggccaagagcaaaggaatacccttcagcaggatattcgaggttgccggcgccatgaagatggcgcaggaccgctcggagtccagcgtgaaggtcgaggtgcttgtcggcgctggtgctcctgccgacgagatctctgcaatgaagcgctgcttcgtgcctgagaccgcgcgcgcgcatgtcctggtctgggatctctcttcgagggctgagatggcacctgatgccgataccgatctggcagtcgtgcttgtcggcacgcagccgaaagaggcggcccagattgcgcttgcctgcgtacgcaggaagtgcggctgcatcttcgtcgtcccgtctgcgctcgaggctccccaggagctgccgcgcgagctcgaggacacggtcgatatcgtggctgctgcaggcgaggaagccatcctttcgaagcttgcgcttgcgcttgctgcccaggaggagcgcatcctccttgccgctgccttcccgttctgcaggaaggctgtcgcctctgcgcttgttcggcagagcgcattggcgaatatgggtgtcggtgccatctcgctcatcccaggctcggaccttccgatcatgctggccgagcaggagcgcctggcactcgatctcatgggcgtctatgggaagaagcccggccccgaggcagcggcagatcttgcgggcgtcttcggtgcaggctttgcctatcgtgccattgcccgcacgcttgcaggggcagttcctggcatcggctgggccctgaaggcttctgtcgcctacggaggaactgtgctttccgcctgggctgtcgaaacgcaccttgcaggtgacatgcctgagatctggagcaatatccaggagttcgtctctgctctggcaggtgcgcagggcggggaggcagcgcccgagcgccaggagcaagagcagcccaggatcgtgcctcttgcccaggcaacgcttcctgaagcaccgaaagatgaaggagatggctatatcacgctttcctagcagatgaggtgcgtggtgaagctgtggagtgccgaaatctttagacaggaatggcatgcaggagggctattctttgttacgcaaaaggcatctcatgaaggaacgttcacatttcgcactaaaaccgcagctagctgactttttctgattgacgattgttctgagcgctagtagaatagctagctgttgcactcaaatcagcaatgaagggttcacacatgtacgcaatcgtttcaactggcggcaagcagtacaaggttgccgagggcgatatcatcgacatcgagaagctcgatgcccagcccggcgacgaagtccagcttgacgtcctcatgctcaacgatggccaggaggtcactgttgacgcatccaccctctccgacaagaaggttaccgccgaggtgctggagcagtttaagggtgagaagcagctcgttttcaagttcaagaagcgcaagcgctatcaccgcacccgtggccatcgtcagaacctcacgaggatccgcatcaaggctctccccgtcgaggctgcagcaaagtctgcagagtcggccgagtaaattccgttcggtatagcaagcagataggcaggtactctcatggcacataagaagggcggcggctcctctcgcaacggccgcgattcccgcggtcagcgtctcggcaccaagcgttttggtggccaggcagtgaaggagggcgaggtcctcgttcgtcagtgcggcacgcacatcgcaccgggcgagaacgtcggctgcggcagggattacaccctgtttgcactcaaggctggcaccgtcgagttcaccaagggcaagaagcacatggtgcacgtccgtacggcgaccaccgcgtagcaattgttggacacgcattgctgaagggacccttccgagggtcccttttcttttctcgaagacgttttcggggcagatagaacgacaaccgatatactcgattgagtagagcacgatacaaggaggggcgatgttcactgactttgcccatatcaacgtacaaggcggcaacggcggcgctggatgcatgtcattcaggcgcgaggcctatgtgccgaaaggcgggcctgacggcggagatggcggacgaggaggagatgtcatcctcgaggcggacccccagctctcgtcgctcatagactaccgctacaagcatcacttcaaggcagagcgcggcacgcatggccagggagcgagaaagcacggcaaggacggcgaggacctgatcctcaaggtgcctctcggcaccgtcgtgcgcgagctcgaccatgagacgcagaagccgctctaccagattgcagacctcacgcatcccggcgagcgcgtcgtcgtagcccctggcggcatcggaggccgtggcaacatccacttcgtgacatccgtcaggcgctctccggcctttgccgagaagggcgagccttcgcaggatcactggatcgagctcgagatgaagctcatggcagacgctgcccttgtcggcatgccatctgtcggcaagagctcgctcatcgcccgcatgagcgcagcccgtccgaagattgccgactatccgttcacgacgcttgtcccgaacctcggcatggtccgtgcccgcaatggccactccttcgtcgttgccgatgtacctggcctcatcgagggtgcaagcgaaggcaagggcctggggcacgagttcctccgccatatcgagcgtaccgccctcatcatgcatgtcgtagatgtgactggctcctatgagggaagagaccctgtgcatgacttcgaggtcatcaacgatgagctcgcagcctatgctgaggacctcgctgtacgtccccagatcgtcgtcgcgaacaagtgcgatatgccggggaccgaagagaatgtcgagcgcgtccgtgctgcagccgagaaagcgggatatccgttctttgccgtctcctgcgtgacgggtgccggcatcgatgcactcatggatgccacggcagaagaggtcttcgagctcaggagcaaggcggcagaggaagccaggaaggcagctgaagagaagccgatccgcgactgggaggccgacaggcgccgccgcgaccgccgcatcgatatcaagaacctcggcggcaatgtctggcgcgtctcgggcgtcggtgtcgagcgcatggtcatccagaccgactgggacaacgaggagggcatctcctacctcatgcaccgcttcgagaggatcggcctggacgagcgtctccagaaggctggcgtgaaggacggcgacgaggtgcgcatcctgggctatgccttcacctacgaaagcccggaccacgacgatgagtacgctgagctcaaggactctgacgacgaggtcgtcgaggagttcatcgagggggacgaatagcgtgggaggacaaggccccatcgtcgtgaagattggctcttccacgcttgtggatgccgcaggcgcacctgaccgtgcgttcatcggcagcctctgcagccaggtggcgcgtctcatggacgaagggcatgaggtcgtcgtcgtgtcatctggcgctgctgccgccggcatggagcgcctggggctcaaggcacgcccgaaggacctgccgacgcttcaggcctgctgtgctgctggccaggcagctctcacggagatctacgcagaggttctctcccagagcggacatgctgcgggccaggtgctcatgacaagaagggacgtcgtcgacagggagtgctatctcaatacgagaaacaccttcgagcgcctcctggagctcggcgtcgtccccatcgtgaacgagaacgatacggtctctgtcgcagagctctcgttttccgacaatgatatgctcggcgccatcgtctcggccctcgtgggggcaagtctctatgtgatcctctctgatgtggagggcctctatacggcaaacccctccacccatcccgaagccaatctcattccgcgtgtcgaggagctcacgcccgagatcctcgcaggggctacgggcgcagggtctgccttcggcactggagggatggcatcgaagctgagggctgcgcgagccatgcttgctgccgggataccgatgacgatatgcgaaggcagaaaggcggacgtgctcgtcgatgtcgtgcacggcaagaaggtcggcacgcgcttcgaggcttttgccggacacgctgcgcatgaaggcgcccgcaagctctggatcggccttgcaggcgttccccagggaacgctcacggtggatgagggtgcagtccatgcgcttgtcgacagaggctcgtcccttcttcctgcaggtgtcatagccacagaaggggagtatgcggcaggagatgtcgtggacatccgtgcggaggatgggatgctcgtggcacgaggcatcacgcgctactcagctgacgaggtcatgcgcatccacggcctcaagctcgatgtgatcgagcgcttccttcctgaacgtgaaggtgcgccgcttgtgcaccgcgacgagatgcttgtcttctgagcgggaggggattgagccttatggaacaggagcgcttcgatctgccgcagctcggccaggacccctcgaggacctaccgccttggcatcatgggcggcaccttcgacccgatacacaatggacacctcgtcgctgcggaacaggcgtatgacgacctgaatctcgatcttgttgtcttcatgccggcaggaagccctgccttcaagcagggcaagaagattgcctcgggcgaggaccgctacgcgatgacgctattggcgacctcggacaacccgcatttcgtggcaagccgtttcgaggtggaccgccctggcatcacctatacctcagagacgctccgtcttctgaaggagcactatcctcagaatgtggagctctacttcatcacgggagccgacgcaattgccgacatcgtgcgctggaacaactcggcaagcattgccgagaatgcgacgcttgtgggggcaacacggcccggctacaacctcgacaaggctgccggcgctatcgattcttctggcatcgacttccatgtgatctatctcgaggtcccggctcttgccatctcctcgagttatctgcgcgagcgggtggccaagggacagagcctgcgctatctgacgccggactccgtcacagggtatctccacaagcatcagctctatggcgcaaaggcagggaaatatgccagataaggcatggaacataccgcgctgcagcatcccctatacggatgggcagcggaaagagatagcagagctcgagcacgatatcaaggcgcagcttgcagagaagccgaagcgccttgcccattcgctttcggtggcacggactgccgagtggatggcaggggtctacggtgtggactgcttcgaggcacgctgtgccggcatcctgcatgactgggtgaaggctgagacgcatgaagcgcagatagaagaggcgaagcatctcggcatagagctggacgcgccgctcgagaaatgcgagccgctcctgcatggcctcatcgcagcacgtaccttgccacagcgctatcccgagcttcctcagagcatctggcaggccatctctcgccacaccacaggggctgccgacatgtcggacctcgatatggtgctttttgtggccgatggcatagagccgttgcgcaagccctatccgggtatagacaatatacgcggacttgtcggcacagcgccgctcgatgaggtcttctgggcgtcgtttgcaggcggcatcgtctatgtgatcgagacccggcgctatctctatcccggcacggtcgatatatacaacgcacttgtagaaaaggaacatgcatgagtgtgacaccgctcgaacttgcgaaggtcgctgctgcggcagctgacgacaagaaggcatatgacattgcgcttctggacctcacgcagctttcggatatgtgcgactacttcctgatcgcttccgcgatgaacgcccatcaggctgatgccatcgtcgacgagatcgagaagaaggtccgcctgaactgcgccgaggatcccatctccatcgaggggcgtgacggcaagcactggattctcatggattacggtcctgtcgtcatccatatcttcgatgaggagacgcgcaggtactaccgtctcgagcgcctctggggcgatgcaccgaggatcgatctcggactcgagaaggatggggaagaggagccgaaggaggaggcctagtcccctcccagctcgtcgtcaggacgttctggcacgtcctttcccttgagcctcatatcgcggccatatgatacggcgctgcttccgaagcggcgccgtatttcgtctgccgcttctgacagtgcgtggaggtcgcgcggcgctgcaggctcgggagcgccgtcaagattgagcgcaagctgctggggctctgcctcgcgtccgaatccagaaaggccgacgccgacaagacggacacctgtgcctccatgccagatctgggaaaggagacgccgtgccatggggccgaagacatgctcgtcgtctgtggcgcgtcccacaggcgtctgcgccgtgtggtagctgaggtcatggtagcggagcttcagcgtcacgacggtgccttcgagcttctgggcacgcagacgggtgccgcaccgtgctgctgccagatcgatggccgccagaaggtcatgctctgtcgtgaggtcatgcggaaacgtatgctcggcagagaccgacttcggctcgcgcttctgcacgaagggacgtacgggagaaagctcgagtccctgtgcgcggcgcttgagctggggtccatactgccccaggagcgctgagagatcctcgtcgtcggcatgtgccagatcgcccagggttctcatgccgaaggatctgagcctgcgctcggtggcagcgcctatgcctgacatgcgcgacagcggaaggggagcaagaaagcgctgctctgtgcctggatagacgggcgtaaggccgcgaggctttcgtgcctctgaggcaatctttgctacggtcttcgaggttccaaggccgatcgagcaggtgatgccaagcgcagccacccgctcctgaagccgctcggcaatgagtacagggtgctcgttcgaatagcgtcccggagagatatcgaagaaggcctcatcgatcgacatctgctcgacaagcggcgtctcgtcgaggatgagcgccatgaccttgtgggagagctcgcggtagcggtcgaagtggccgcgcgtccatatcgcgttggggcagagcttctgggcagtggcagaaggcatggcggaatggacgccgtacttccttgcttcataggaggcggtcgagacgacaccgcggtctttgggacttcctccgacaatcacgggcttgccacgccaggcaggatggtcgagctgctcgactgatgcgaagaaggcatcgagatccaagagccctatggcaggaccctcccatgtggggagggtcctgtgatttcctgcattggttttgctgtgactgtccatatcaccgtgtctcgggcagacgtaccgtgaaggtcgtgccgtgctccttgtcgcttgcgacctcaatcgtaccaccatgcgtctgggcgatggattgggcaatggcaaggccaaggccaaagccgcctgtctcgcgggtgcgcgccttgtccgagcggtagaagcgctcaaagacatggggaaggtcctcggggtcgattggcgtgccgagattgttgacggaaaggactgcgtgtccggaatcgtccttgagattcaaggtgacggccgtgcccttggcagcatatttcgtcgcgttgtccacgaggatcttggcaaggcgcttcagggactgagcatctcctttgaccttgaggcctggctcgatcgtgctttcaagctcgcagccgcgctcgaatgccatcgcatcgaactcgagggcgacgttgtccacgatatcggagaagtcgagcgtctcctgcggcatcttgcccttcgcggcagcaccgttctcgtcggcacgggcaagcgtcagaaggtcgttcacgagcgatgccatctgctgcgcctcgtcggccgtggagtctacccagcgcctcgagtcctcgggcaggctcttgtcagcctgaaggatctggctgttcgccaggatgacggcaagcggtgtcttgagctcatgcgaggcatcggcgacgaagcgcttctgcgaggtccatgcctcctgcaccggcttcagcatccacttcgtgagataccaggtgataaggagaagggcggcaagagcgctcgagatgatgaccgcagcagatacaagctggcgcgagaatgcctcatcgaggatcgaggtctcgacaagcgcaatcgtcgtcgtgccatctgaattgcttgtggactgccattggatgtgctggtctgcgatgtgccccgaagactgtcccgatttcaggacctttgcaatcgtgtcctcgagctgatcttccgtgagctgggcgattgtcgtcgtatagcccgtgatcgtgccatcgctctcgaccctgactgctgccgtcagcatgttggggcgcgggctgtccttcccgaggctgatgctcgtcgaacctgtagcggagttgacctcatgcagcacgtgctcgaggctctcatgcaccatctgctgctggttgctataggtcgaataaaggctcatacccatgacacccacgagtatgagccctacgagaagaaccgtgacgatcacgaactgcttatgcagcttcttgagcatctgagctactcctgatcgaacatctccagacgatagccaagcatgcgcagcgtcgtgatctggaccttcgaattgatatggttgagcttcttgcggaggaacgagatgtaggcctcggcagagttctcggaagcctcgccgtcagtgccccagacacgggtcaggaggtcctgcttggagacgacgcgctgcgtggagctcatgagaagcttcaggacttcgaactccttgccggagaggtgcacggacttcgtgccgcaggagaggtcgtgcgtattgaggtcgagcgtgaggtcgccgaagttcgcctcgtcgagcatcacggcgccctggcggcggccaagggcacgcacacgtgccaggaactcagcagactcaaatggctttgtcagatagtcgtccgcacctgcgtcgaggccctcgaccttgtcttccgtcgaggtgcgtgccgtcagcatgaggacaggggtggagttcttctcatggcggagattgcggagcagctcgatgccatccatgcccggaagcatgcggtcaaggacgatgaggtcatagagtccgctttcggcataggtcaggccgctctgtccgtcataggttgcttcggcgttgtagccggcgtcggtcagtatgcgaacgattgcatcggcaagcttgcgctcgtcttctattaccagtacattcatgaggccattccttcctgccgtgagagcaaggccatacgctgtggaacttgtcgcgtatcgtacgtggcccagcttaagctacgcttaacatcttcccctcagaggcctgaaagcgtgaaatcggcgcaaagtcgctggctgctccacaaaaactgcaccttgcatgcatgcctgagagtcgtacaatttacagttgctgtatagagccaatgcggcccatcatccctacattctcagagggccgcgcgtctagaggagttttgccttggcagttaagattcgcctggcccgccatggtgccaagaagcgtccgtactatcgtgttgtcgtcgctgacggccgcagcccgcgtgatggccgcctgatcgaggaggtcggccgctacaacccgctgaccaacccgaagaccatcgagctcgacctcgagaaggtcgacgcttggatcgccaagggcgctcagccctccagcgcagtgtctcacctcatcgacatcgtgcgcaccggcgctcctgcacctgagaagaaggcaaagctttcgaagaaggctgctgctaaggctgcaaaggctgagtagtttcatggctgaggaaatcgatcagaccacggacgagaccgaggccgacgtcgagatgccctcagacaaggttgcggacctggtggagtatatcgtctgcggactcgtggacgatcaggatgcagtctctctcgatgtgacggactccgagtccggcacgctcatcgaggtcagctgcgctgctgccgatgcaggccgtgtcattggccgcaagggccgcaccatcaaggcaatccgcacgctttcccgtgcgctcggtcagcgtgtcggtacgtcggtagaggtagaggtgttgggctagggcatgcccgattatcgcgtgatagcccgtgtcgtcaaagcgcacgggaaaaagggggaggtcgtgacggttcccgtccacggccttccctctcttatgcatgaagggctttctgtctgtgtcgtgccgccccggctcaagggtccgcgctggcacaaggtcctttcatgcgcatcggatgggcgcggacagcgcatagctctggacggcgtaagcgatcttggggctgcagaggctctggtcggccgctcccttctcgtctccgtcgacgacctccctgacaattttgccttcatggacctcgacgccctcatcggaaggcgtgtcgaagatcctggatatggcgacctcggcgagatcgaggagatcctgacaggccctgccaatgatgtatgggtcgtgagagggacttcagccggagagatcctgcttcccgtcatacctgatgtcgtgtccgagataccgtcttcgggcagcatcgaggtgcatgtgccgaaaggcacgattcccgaggagggggactagtgctcttcgaagcaatatccgtcatccccgaagtgttcgagccctatgttggtgcctccatcctggggcgcgcccgcaagaagggcgtcttcgatttctctgcctatgacctgcgcacctggacgcatgaccgccaccgcacggtggacgatgctcctttcgggggcggccagggcatgctcatgaagccgcagcccatcttcgaggcggtgcatgccgtctccgagatgcatgaggagaagccatatacgatcttcttctctccctgcggagagaccttcacggaagagattgcccaggagctctcggaacaggaccggatccttttcgtctgcggacgctatgaaggcatggacgagcgctgctacacgctggcagacaaggtgctctcgataggcgactatgtgcttaccggaggagagcttgcctccctcgtcgtcatggatgccgtggtgaggctcttgccaggcgccttgggagacgagaagagcgcactcgacgagtcgttctctgatggtcttctcgaatacgcccaatacacgcgtcctgcatcattcgagggcatggatgtgcccgatgtgctcctgtccggagatcacggcaaggtagatgcctggagaaggagaagctcgctcgagcgtacggctgcctggcggccagaccttctcgaggatgctgaactaacgccggatgagcagcgcttcatcgatgaaatcaccgagagggggaagcgagatggcagcacgccatgctgatacgggcgaagatgccccgaaacacaacgaattcctggaatggatcctcgtcattgcgatagcgatcggctgcgcgctggcgttcaggacattcgttgcggaagtctatgaggtgccatcgggctcgatgctcgacacgatccagatcggcgacaggctcatcggagagaagatctcctaccacttcagctctcccaagcagggagacatcgtgaccttcatcgatcctgaggattcgaagtccacgctcatcaagcgcgtgatcgccacggcaggccagacggtagagttcaaggacggcgtcgtctatgtggacggcgaggcgctcgacgagccctatacggaaggcaagccgacagaacctcttacgatgcagtctgcgaacgcaggctccatagagtacccttataccgttcctgaaggctgcgtctgggtgatgggggacaacaggaccaattcgctcgactcccgctacttcggtcccatcgaggtcagctccatcacctcgcatgggctattcatcttctggccgctatcggatgccggctctctgtagcaggcacgcacacatacgaaggagatatgtcatgggcacctctgcgctcacattccaggacatgatcctgacactcgagcattactgggcagacaagggctgcaccgtcatgcagccgtatgactccgaggtaggtgcaggcacgttccatacggcaacgcttctgcgctcgctcggtccggacgcctggaggacctgctatccgcagccctgccgccgccctgccgacggccgctacggcgacaacccgaaccgcatgcagcactactaccagttccaggtcgtcctgaagccctgccctgaggattcgcaggacctctatctcggctctcttgccgccatcggcctcgatcctgccgagcacgacgtgcgcttcgtcgaggacgactgggagagcccgacgcttggcgcctggggccttggctgggaagtctggatggacggcatggaggtcacgcagtatacgtacttccagcaggttggcggcatcgaggtcgatcctgtgcctgtcgagatcacctatggcctcgagcgcattgccatgtatgcccagggcaagaactccgtctacgacatcgtctggagctatctgccggatggcacgccgatgacctacggcgacgtgttccacgagaacgaggtcgagttctcggcctacaacttcgaggtcgccaacgtcgacatgatgaggaacaagttcgatgactacgagcaggagtgccactcctgcctagagcgcgagctgccgcttcctgcctatgactgcgtcatgaagtgctcacatgccttcaatctcctcgattcgcgtggcgccatctcggcgacggagcgcgcgaactacatcctacgtgtccgcacgctcgcaaagctctgctgcgagtcctatctcgagcacgtagccaaccgcaacaaggcacaggaaggcgaggtggcctagatggctgaaacgaaggactttctgctggagatcggcaccgaagagatgccgagcgctccgctcatgaatgcacagaagcagcttggcacgcttgtcgccaagaggcttgacgccgaggggctctcccatggggaggtcacgacgttctcgacgccgagacgcctgacggtacaggtgaaggatgtcgctacggcgaccgaagaggtccacgagatcaagcgtggccccaatgctgccatcgccttcggcaaggacggcaagccttcgaaggctgcccagggctttgcccgcaagttcggcctcgcagccgaggacctcgccgtgcgcgaggacaaggacggaaagacctatgtgtgggcagagaagtccgtgccgtcccgcgcagccgaaggcatcctctcgtctcttggccatgacacgattgctggcctcgagtggccgaactaccgcagccagcgctggggatctgagcatgagacgttcgtgcgcccgatccgctggatcgtggcacttctgggcgacgaggtcgtgccggtgacctatgccggcgtcacgagcggcaacaagacacgcggacaccgcgtgctcggcccgggcgagcacgtcgtgaagacgcccgcagactacgagaaggttctcgaagatgccggtgtcctcggcgagaagaggcgtcgcgaggccatcctcgagggcgtccgcaaggtcgaggaagagcgcggaggcgcccacgtggacatgccgaagcgcacgttcgacgaggtcgtcaacctctgcgagtggccgaccgtgcttgtcggcaagttcgacgaggagttcctccaggtcccgcatgagatcatctgcgagtccatgctcacgaaccagcgctacttcccgatctacgacaaggacggagagctcacgcgcgagttcgtcgtcgtctcgaacgcagaccccaaggtctccgatacggtcgtcgacggcaacgagcgcgtcgtgcgtgcacgcctcgatgacgcgaagttcttctatgaggaggacctgaagcatccgctcgagtactacgtagacaagctcgacaaggtcgtcttccaggagaagctcggcaccgtgctccagaagacgaagcgcatggtcaaggttgctggagctgtcgcccgcgaggccggcgctaccgacgagcagacgaagaacgcagagcgtgcagcctacctggccaaggcagacctcgtgacgcaggctgtcgtcgagttcacgagccagcaaggtgtcatgggcggctactatgcgaaggcatccggcgagcccgatgaggtcgcagaggcaatccgcgagcagtaccgtccgcgctttgcaggagacgagattccgtcccatctggtcggccgctgcgtcgccattgcagacaagctcgataccgtgtgcggcatgttcgccatcgacgagccgccgacgggctcttcggacccgtttgcactgcgcaggagcgccatcggcatcatcgccatgctccgcacgatgcctcaggtctcgctctctgccatcatcgaggcttcgcttgctgcctatgccgagcaggggctcgagttcgatgctgcaaaggtccaggaggctgtcgagcagttcttcgcaggacgtcttgctgccatcgcaaaggacgaaggcatcgcacccgatacgatcgaggcagtctctgccgtcggcgtaatcgatccggacgagttcctgaagcgcgcacacgctctcgacgaggcccgctcgggcgagcctgagctcttcgaggaccttgccatcgcctatgcacgtgcatcgcatctggccgatgcaacgctcggcgagtacgtggatgagtcgatcctcacggatcccgagaaggacctgctttctgcctgcaagaatggcagggaagaggtcgcagcagcgcttgcggcaaaggactatgccggcgcccttgcagcgcttgcaaagctccgcgagcccatcgatgccttcttcgacgacgtccttgtcatggatccggacgaggccatcaagaacaaccatctgaagcttctgaacaagtttgcgcagacatttgccgatgtcgccgatatcggctgcctttcgcgaaagaagtagggcatttcggcggtgcggtacttgcaccgcctgacatatcctctaatctagcattgcacatattcgttcgaattcgaaggaggaatcgggcatggacactcttgagctcgattaccagccccccaaggccaaggtccttgttgtctctgactctctcggaaccaccgcttctgccgtcgtagacgcagccgaggcgcagttcgacaaggatctcgtcgacgtcgtccgcctgactagagtccgcacgatcgaagaggtcgagaagttcctggatgagcagatggagtccgaccgcccgatggcagtgttccatacgatcggcacctcagcgctccgccgcgaggtccgcgatgcctgcgagtcgaggggcatcccttcgatcgacctcatgggtccggccatcacggtgctgtccggacttaccggtgtcgagccgtccgaggaggtcggcgctctgcgcaaccgccagtaatcagagctagcatgtcagaatcacaacttgttaacgaaatcaagtgtaaatccgttaacggctaaaaaaccattctggcatagcgcactgcattccttggatatactaaaaaaacgtgatcagtggatacctgcctcaggtaactgcggcaggcgtcttcttgatagacggcaagtacaagttgtttaaggagtgctatggctgagaagcatgtgtatcgcttcggcaaggacgccaacggcaacaatgtgaccgaggtcgcaggcaagaccgttgacgaagcgaagtggattacgggtggcaagggtgcaaaccttgcagagatggcaaacatcggtcttcctgtccctccaggattcacgatttcctgccagacctgcgtcgcctactctggtgctggcaacgtgtggcctgatggcgttctcgacgagatcgatgtctaccgcaaggatctcgaggagcgcatgggcaagaagctcggcgacaaggaggatcctctgcttgtctccgtccgttccggtgcaccgttctcgatgccgggcatgatggacacggtcctgaacctcggtctcaacgatgactccgtccagggcctcatcaagcagacccagaacccgcgcttcgcatgggactcctatcgtcgtttcgtccagatgttctctgacgtcgtcatgggcgtgaatggccagctcttcgaggatgccatcaacgccaagaaggccgagaagggcgtcaagctcgacaccgagctcgacgcagacgacctcaaggacctcgtcgcaaccttcaagcagatcttcgccgacaacgtcgacgcagagaagtatcccgaggttgcagagggcggcaaggctgtcttcccgtccgatccgtacctgcagctccgccttgcagagcaggcagtcttcggctcctggaacacgccgcgcgcaatcctctaccgcaagcagaacaagatccccgacgatctcggcacggccgtgaacgtccaggtcatggtcttcggcaacaagggcaacacctccgcaaccggcgtcgccttcacgcgcaaccctgctgacggctccaacgagcgctacggcgacttcctcgtcaacgctcagggcgaggacgtcgtggctggcatccgcaacacccagccgatctccgaccttccgaagaccccgggcctcgaggaggcaggcaaggagctctaccacgtcttcgagatcctcgaggaccactacgcagacatgatggacctcgagttcaccatcgagcagggcaagctctggatgctccagacccgtgtcggcaagcgcactgcactttccgctctcaaggtcgccatccagatgtatgaagagggccgcatcaccaaggagcaggctgtcatgcgcgtcgctcctgagcagctcgaccagcttctgcacccgcagttcgacaagtccgcaaagtacgatgtcctcgccaagggcctcaacgcttctcctggtgcagcaaccggcggcgtcgtcttctcctctgccgatgcagaggccttcaaggaggcaggcaagccctgcatcctcgtccgctgggagaccacgcctgacgacctcaagggcatggttgcagctgagggcatcctgacgtctcacggcggcaagacttctcacgcagcagtcatcgctcgtggcatgggcgcaccgtgcgtctgcggcgtcgaggcactgaacatcgatgctcctaacaagatggtctccgtctccggcaccgatgtcgtgctccacgagggcgacgtcatctccatcgacggcacgactggcgatgtcatcctcggcgaggttcctctggtacgtccggagctcggcggcgacctcgagaccatcctcgactgggccgacgagatccgcaaggatccggagcgcggccgcgtcatcggtgtccgtgcaaacgccgacaacccggcagatgcacagctctccgctgacaacggcgcagagggtatcggcctcgaccgtaccgagcacatgttcctcggcgatcgcaagcagctcatccagaacttcatcctcgcagaggacgatgccgtcaaggctgactccctcgagaagctcggtgctgcccagaagggcgacttcctcggcatgttcaaggccatggacggcaagaccgtcatcgtccgtctcctcgacccgcctctgcacgagttcctcgacaacccgcgcgaccttgaagtcgagatcaccaaggaggaggatgctggcaaggactgcaccgagaagcgccagctcctggcaaagctcgactccttccaggaggccaacccgatgctcggccttcgtggatgccgtctcggcctcgtctatcctgagctcaacgtcatgcaggtcaaggcaatcgcctctgcagcagccgagctcatcaagcaaggcctgaacccgaagccggagatcatgattccgctcgtcggcttcgagcgcgagatcgagatcgtccgtggtgtcgtcgaggagaacgtcaagaaggtcgccgacgagtacggcgtcgagcttgacatccccgtgggcacgatgatcgagctgccgcgtgctgccatcatgagcgaggacatcgctcatcacgcagacttcttctccttcggcacgaacgacctcacgcagacctgcctcggcttctctcgtgacgacgtcgagtccgcattcatgccgctctacctcgagaagaagatcgtcaagacgaacccgttcgcaacgctcgatccgggcgtcgcaaagctcgtcgaaatgggcgtcaagggtggccacaagggcaacccgaacatcgtctgcggcgtctgcggcgagaccggtggcgatcctgagtccatccacatgtactacgacctcggcctcgactacgtgtcctgctcgccgtaccgcgtgcctatcgcacgtcttgctgcggcacaggcaaagatcgagtccaacggcggcgcaaagacgcttgccaagtaggcttatcgcctgactgattgaagggagggacgcgctgagcgcccctccctttgtgctatcttggattgtgcaggttatctgcagtcatgtttctgttgtggcggagccagacctgccgtataatcacatcttgtgtgtaaacctatgtgtcgttcgcaggagcgtcggcacctctagagacaaggaacgaatatggactacatccgcgctatcgagcgtcagcagatccgcgaagacattccgcagatcctcgtcggcgacaatgtgaaggttcactaccgcatcaaggaaggcgaccgcgagcgtattcaggtcttccagggcgacgtcatccgcatgagcggtgcaggcgcacgcgagaccttcacggtccgcaagattagcttcggtatcggtgtcgagcgtaccttcccggtgaactccccgaagatcgccaagctcgaggttgtccgtcacggcgaggtcaaccgcgcaaagctctactatctgcgcgaccgcgtcggcaaggctgctcgcatccgcgagaagcgtgcctaagcacacaagcacggaaggaagagggccgatgaggccctcttctgctatagagggagccgctggtggagaagagagagcctgcacgcgatatagcacggaagctgcatgaggcgagcttcgaggagcttggcgccctcgaagagctctatagggatgacagcagaaagcaggtccaggacgcgcttgcgcgcgcagatagacggcacgagaaggaggcagcagaacgtgagcgtgtcgagcagttgtatgcccttcaggaagagctcggtggccctgggcttgtcatcggcgtcgacgaggtcggacgtggagccatagcaggacctctgaccgtcggtgccgtcatcctgccggcagatcccaagatctggggcctcaacgattcgaagcagctgacgcctgagaagagggaagtgcttgcagcagagatcgcagatgtcgccatcgctatcggcatggcccatatcccgcccgagacgatagatgcgctcggcatgtcggcatgcctgaggcgtgccatggcagaggcgatcgcttcctgcggtgtcgagcctgactgcgtcctgatcgatggcaacccggtgcatgtccacccgaaggagaagacccttgtgaagggcgatgcacgcattgctgccatcgctgcagcctccatcgtcgccaaggtcacgcgagaccatctcatgtgcgagcttgcggaggaatatcctgcctacgggtgggatgcctgcaaggggtatggctcgaaggagcacatcgaggccatcaggaaatatggcctcacaccctatcaccgggcatcgttctgcagcaattttgtggagggcaccaggctcttctgatgttttctgtgcctgagccgcttgcagccatgcttctgaccagcacctctggtgcagctgccagcttcctgcgatgtccgtgaaagcgaaggcttccatctgtgcaagacgtctctgccatagttcttagagcgaaagaagggagcctctatggcagagcgtgggaatggcacagaagagctgggcgaaaaggaagccagggagtttggcggaaggccggcggtcttctggcatgctggagatgaaggcaccgaagaaggcgcctcgctccatcagcagggcatacgcatcgctgcatcctatttccgctaccgggaggcagacatcctctctctgggagatggaagcatggatacgccggatatctgctgcacgcttgacggtgagaccatccttgcggacatggtatctgtcgccgatatcgaacggcagatgtccataccagaactgacagtcacgccggacgacttctggcgctgccgcaggaaagcgcttctgtggcttgcagaccatcgtgtgccttcggtgcgctacgacctgatggcactgggcatcttcgctccgaagcatgcccgcatccgccatcttgccggcgtctatttctggtcggacgagccagaccagcttgccttctactgctcagatgaagacgaaggcagtctgcgatgagcggggaggaacggttcgagctcgatccagatgatgccggctatccggcactggtgcaggaaggctatgagacggcgccgcatatatatggcataggggacccggaggcgctccaggggccttgcatctccatcatcggggcccggagagcgacaccttatgggctcgaggtcgcacatatggcaggaagggtctcggctgaggcgggcatctgcatcgtctcgggaggggcgcttggctgcgatgcccaggcaagcaggggagcgctcgaggcaggcggacgtacggtcatcgtctcaggatgtggtgccgaccgtgtctacccaaggtcttcggatgatatctttgcagcggcaaggaaaggcgctggctgtgtcatttcgctcgaaaggtggggcgaagggccaaagcgctatacgtttcccaagcgcaatgtcctgattgctgcactctcgcccgtcctcattgtctgcgaggcaggcaggaaatccgggaccatgggaacagcggaagctgccatggatatgggacgaagcgtctacgccgtgccaggctcgatattctcgccgacttcccagggaacgaactatctgatccagaatggctgcggcctcatcgcagacgagctcggcctcgagcaggtgctctcgagcgattatggatgcgaacgcaggctcacccggtctggcatgccagcctggggacgtgttctttcggcgctcgtggcctctccgatgcgcccgcaggatctcgcgggtaagataggtctcgatgaattgacagtcgccgatacgctctcatcctatgaagagatggggctcgtgacgaagcttccggacggatgcttcgcaccgagcgagaaggcgtatcgcctcatggaagcggagccagacggatgacagatacggtcacagtcgtaggagcaggacttgcagggtcggaatgcgcattgcagctcgcccataggggcgtgcctgtgaagctctatgagcagcgcccgacgaacaatacggtggcacatcatactgaccgctgtgctgagcttgtctgctcgaactcgctcaaggcgacacggctcgagagtgcagccggactcctcaagcacgagctcgagacgatggggtcatatgtcctggctgctgccaaggagcatgcagtgccggcaggcggcgcgcttgccgtggaccgcgatgggttctcggaagcggtgaccgagatggtcgaagcggagcctctgatcgaacttgtccgcgaagaggtgtgcgagctgccggaagaccctgctgtcatcgccgcgggcccgctctgctcggatgcgctcttcaaggcactgtctgacaagctcggcggtgcagcgctttccttcttcgatgcagcagcccccatcgtcgacgccgagacgatcgaccgcacacgtgtctttgcgcagtcgcgctacgaggaagagagcgcaggggactacctgaactgccccatggacaaggaggagtatcagaggttctacgacgagctcatctcggccaagcgcgtgattgctcgcgatttcgagcagtcagatctcttctgcgcctgccagccggtcgaggaagtggcacgcacgggtgtcgattccctgcgcttcggtgccttgaagccggttggcctcaaggatccacgtactggcaggcgtccttgggcggccgtgcagctgagagccgagaacaaggctggcactgcctacaatctggtgggcttccagacgaaccttacctggcccgagcagaagcgggtcttccgcctgattccgggacttgaggaggcagagttcttccgctacggcgtcatgcacagaaatacgttcgtcgactcgccgaaggtcctcgaccgtaccttcggcatccccggcacgaagatccgccttgccgggcagatctgcggcacggaaggctatgtcgaggctatcgcttcgggcctgcttgcggcgctcaatacctacgcagacatcacggacaagcctctcgtcacgcttccgcccgagacggccttcggtgcgcttgtcgcctacgcgaccgatccggagacgaaggactatcagccgatgcatgtgaatttcggtctcgtgccacctcttgcagaccagtcgctcaagaagcgcgaacgctatgcggcctaccgtgaccgtgccattgcccagatggatgccttcatggaagagcgcagagatctcttcgagaaggaagcatgacagaggctgcggatgcccgcacggaggaccagacgcgctttgcggacgaagcggaagaattcctgcagtacctcggcgagatcaggaacctttcggcccagacggtgcgggcctatcgcacagaccttgctgcctacatcgcttggacgaagcgcgagggagtgcttccgcatgaggtgacgcaccgccagctcaggagctatctcttcgagctcaagcgggcgggatatgccacgacgacgatcgacaggcacctgagcgcgctgcgctcctgctacaagtggctcctgggcgaggggaagattgcgacagatgcggctgaggccgtctctggcccgaaacgagcaaagcgcctgccccatgcaatgacggacagcgaggctgaccgtctcatcgaggcctgtcccgagacgccagaaggcctgcgcgacagggccttcctcgagctcctctatgcgactggcgcccgcatctcagaggcctctgccctcgatcggaaggatatcgattctgaccagatgcttgtgcacctcttcggcaagggctcgaaggagcgcatcgtgcccatatatagaagcgcccttgacgccgtggagcgctacgagagggaagcgcggccgctctttgcagaagagagtcccgtgacgacggatgcgctctttctctcggcacgcggacgccgcatgagtgccgatgccttgcgcaggcgcttcagagaggcttcggctgaggcagggatcgatccgacctatacgccccactccctccgccatgccttcgcgacggagctgctttcgggcggtgccgatatgaggagcgtccaggagctcctgggacatgaatcgcttgcgacgacgcagatctatacgcatctttcgatcgaccgtctcaaggatgcgacgcacacggcgcatccgagaggatagaaactgtggaggctgcgtggaggttttcgtcctgcgcctgaaaaatcatgcaggacccgtggagagcatttgccagagacgggaagcagaagcgctgctatactaagtacttgctgtgcgtccgcacggcaaaagtcgcacacgtgactactcggaggccatggtgcccgcagccacaagccaggctgagggtggtgctccggggctgacatcacgtggaggaagaaccaatggaggtttgaacatggctgtcaagatcaatctcaagaccctgctcgaggctggctgccactatggccaccagacgcgtcgctggaacccgaagatgaagccctatatcttcggcgagcgcaacggcgtctacatcctcgacctcaagcagacggtcatcgatgccgaccaggcatacacgttcctcaaggagaccgctgccaagggtggcaccatcctgttcgtcggcacgaagaagcaggctcaggaggccatcaagacccaggccgagcgctgcggcatgccgtacatcgctgagcgctggctcggcggcatgctcacgaacttcacgacgatgcgttcccgtatcgaccgcatggaagagctcgaggccatggtcgaggacggccgcatggctacgctcccgaagaaggagcaggctgtgctcggcaaggagctcgagaagctccagcgcaacctcggtggcgtccgtgatatgaagtcccttccgcaggcactcttcgtcgtcgacacgaagcgcgaggagctcgctgtccgcgaggccaaccgccttcacatccctgttgtcggccttctcgacacgaactccgatcctgacgtgatcgactacggcatccctgcaaatgacgatgctatccgttctgtcgcccttctgaccgagcttgttgccgacgcaatccttgctggcacgggcaaggagcagatcaccgaggccgagatggcaggtgcagccgagccggctgcagaggcacctgctgcagagtaagtagctagaaaccgcaaagtaactacgctttaaggaggtcacatggcaaccaagatcaccgccgccatggtcaagcagctccgtgagatgactgactccccgatgatggagtgcaagaaggcactcgtcgaggctgacggcgacatcgacaaggccgtcgatgtccttcgcaagatgggcgtcgcaaaggctgtcaagcgcgctggccgtgacacgaacgagggcaccgtcgctgcctacatctctgaggatggcaagaaggcagctcttctcgagctctcctgcgagaccgacttcgtcggcacgaacccgaagttcgtcggcttcgccacgaagcttgctggcgtcgttgcagagaacaaccctgctgacgtcgacgctctgaaggctcttccgatggccgagacgaccgtcgctgacgagctcaccgagcagatccacctcttcggcgagaacatgaaggtcctgcgcttcgttgcccgctccacggagaatggcgccttcggctcctacatccacaacggcggcaagatcggcgtcatcgtcgagttctccttcacgaagcctgagaccggcgccagcgaggagttcaagacgttcgcccacgacgtcgcactccacgttgcagctgtgaacccgatcagcgctcgtcgcgaggatgtccctgccgagaccatcgagcacgagatgagcatctacaaggcacaggcagccgagtccggcaagcccgaggccatccaggagcgcatcgctcagggccgcatggagaagttctacaaggagtccgtcctgaccgagcaggagttcgtcaagaaccccgacgtcacggtcggccagcttgcaagccaggtctccaagtccctcggcgacacgatcgaggtcgtgaagttcgaccgcttcgagttcggcgagtagttcgaaatatgagagccggccttcgggccggctctttttttatggcgcgagaccgttggtcctactgggcccgttcatatatgcgccgctttggtacaatcacctattgacctgcgtgcccgaaggcacgcataggattgagctgagtggaggatatcttgtccggctacaagtataagcgggtgctcctcaagctttcaggcgaggccctcatgggctcccagagcttcggcatcgaccccaaggtaatgaacaggcttgctgaagagataaagccgatctgggaagacggcgaggagattgccatcgttatcggcggcggcaacatcttccgtggactctccggagcggcacagggcatggaccgtgcccaggcagacaacatgggcatgctggctaccgtcatcaattgcctgtccctgcaggatacgttcgagcatcatgggatggactgccgcgtcatgagcgccctcgagattcgccaggtcgcagagacctatatccgccgccgtgccatcaggcacctcgagaagggccgcatcacgatctttgcggctggcaccggaaatccctacttcacgacggatactgcagcagcgcttcgtgcctgcgagatcaatgccgaggtcctcatgaaggcaacgaaggtcgatggcatctacgacaaggatcctgtgaagtatccggatgcgacgaaatacgataccatcacctatctcgatgtcctgacgaaggacctgaaggtcatggatgcaactgccacggcgctctgccatgacaaccacatgccgatcctggtcttcaacatcgagacccctggcgtcatcaagaaagcgctgtgtggcgagccggttggcaccaccgtcgtagaggaggcatagagtgagcgagatcaccgattacgcaaagagccatatggagaagtgcctgaaggccctccaggacaacttctcccgtgtccgtacaggcagggcaaacccgcatgtgctggatgacatcatggttgactactacggccagaagacgcctgtgacccagcttgctggcgtcaaggtccccgaggccgccatgctcgtcgtcgagccgtgggacaagtcgtccctgcgctcgattgagaaggccatcgaggcatccgatctcggcatcaccccgtcgaacgacggcatgtgcatcaggcttccgttcccgcagccgacggaggagcgccgcaaggagcttgtccgggagtgccagaagtacgccgaggaggcaaaggtctccatccgcaacgtccgccgcgatgcgaacgagaaggctgagaaggatgacagctactccgaggacgacgtgaagcgcgagaagaaggccatccagaagctcacggatacctatgtggacaaggtctcctctatgctcaagacgaagactgccgaagtgatggagatctaggtgcagatcgattccgaaaagcttcaagcctactatgcggatgcgccagacgatatcgccctttccgatatcgatcttgcgcgcatcccgcgtcatgtctcgatcatcatggacggcaatggccgctgggcgaaggcgcgtggccttgaccgctccgaaggccatgtcgcaggcgtctcatcattgcgcgaagccgtgacgacgagcgtcaggcttggcctcgatgtgctttccgtctatgccttctcgaccgagaactggaagcgtccgcagcatgaggtggatctcctcatgcatctcttcgcgacgacgctggtgcatgagcttccgctcttccaccaggagaacgtgaagctccgcttcctgggcgacatcgagtcgcttcctcaggagacgcgtgacgtcttccaggagggcctcgatgagaccgccgatcatacaggcatggtgttcgcgcttgccgtgaactatggtgcacgcaaggagatagtgcgtgcggcacgccagcttgcagaggctgcctgtgccgggagcattgcaccggaagagatcgatgaagatatgttctcctcgcatctctatacggcagggcttcccgaccccgatcttctgatcaggacgtccggcgagctgaggctttcgaactatctgctctggcagcttgcctataccgaattctatgcaaccgatgtcttctggcccgacttcacgcgctgggacttcctgcgcgccatccgctcgttccaggggaggaacaggcggttcggaggggtccagaacgcatgagcgggcatgagggggagagcggacacagcggggagagccgtggactcgatcgcggcatcgattcgctcgagcggaagcgccaggcgaaagagcctgcccgcattgcgggaacgctgcgcggacagagggtgcgcctcggcacggagaagctcctgacgaggacgacctccggcatcatctacgcgatcgtcgtgcttgcaggcctcttcatcggccctcatgcgacgatgattctcgtggcgggcatggcatggctatgctgctccgagttcttccgcatgtgccgcatgtctggcaggatgccgaacgaggccatcggccttggcgcagcagtgctcttccctctggctgcgcagttcaatggctaccagtcgctcatggcccttctcatcatcctctgcttcgctgtcgcgggctggtatgtcgtgacgccacgtgcgaacatcgccgatgtcgcgacgacgatcttcgggccgatctacacgagcttcctcttctcgagcgtcgtcctcatcaggaatgtggaccccggcttcgaaggagcgctccttgccttcggcgtcatgggctccatctgggcaaatgatgcaatggcctatctggtcgggtcgaggatcggacgccataagatggcgccacgcatctccccgcacaagtcatgggaaggctttgccggcggcatgtgcgcctctctcatcgtctggctcctgactgcagcgctccatgtctgtggcgtcacgtggccgctggcccttgcgggcggccttctttcgggcatcggcggcgttgtcggcgatctcttcgagtccaggataaagcgcggtgtcggcgtcaaggattccggcaacatcatgcctggccacggtggccttctcgatcgctccgactctatgctcttcggtgcgactgcggcctatttcatacttttcctaggaggaatcctttgagcttgaagacgacttctgagacggctttggtgccggatggaaggaagctgcgtctggctgtgcttggggcctcgggctccatcggcacgcagacgctcgatgtcgtgaggcatcacaaggacaaggccgaaatcgtctgcctctcggtacatacgagaaccgatgtcgctgcagccgcagcgcgcgagttcggctgccgcctcattgccgtgaccgatccggcccatgcccatgatgctgcgctcgaaggcctgccagagggcacgaaggtgctcgtcggccctgaagcgctcgtagagcttgcgaccagggacgatgtggactgcgtcgtctcggcggtcgtcggcttcgccggcatcgaatcgagctatgccgcagccaaggcgggaaagcgccttgcctacgcgaacaaggaatccatcgtcgtcggcggcgacctcatcatgccgctccttcggccgggccagctcgtgccggtcgattcagagcactccgccatcttccagtgcctccagggggaggagaagggcaccatccagacgatctggctcacctgctcgggaggtccgttctatgggatggagcgcaaacgtctgcgtgaagtgaccgtcacagatgcgctggcacatccgacatggtccatgggatcgaagatcacgatcgattctgcgacgctcatgaacaagggcctcgaggtcatcgaagcctgccgcctcttcgatgtggacgaggcacaggtgcatgtcctcatccagcgccagagccgcatccactcgatggtggagtttgtcgatggctccgtgaaggcgcagatgggtgcttccgatatgaggagctgcatccgctatgccctgagctatcctggacgctgggcatcgcccgaggcagagcgcgtctcctggggcacagagcagccgctcacgttcggcgaagcagatatgcagactttcgggtgccttgcgcttgccagagaggcatatcgccgagggggtacgcttccctgtgtgatgaatgcagcgaacgaggtggcaaatgctgccttccgccatggttcctgcggcttcctcgatatcgaggacaccgtccgtgccgtgatggatggcgcgaagatcgagcctgtcgagagtgtcgagcagctcgaggaggtcgacgcctgcgcccgtgcagctgcacgcagctatctcgggaggaggcgctagcatgagcgtcgcatctgctgtcttctgggggttgatcaccctctcattccttgtcttcatccatgagggcgggcatttccttgctgcccgcatgtgcggcatgcgcgtgaccgagttctatctcggcatgccctgccgcttcaagctgttccgcaagagccgccgctatggcacggaggtcggcgtcacaccgatacttctgggcggctatacgcgcatctgcggcatggaaggcgagcctcgtgagcgtctggccgacatgctctggcttgtgcagcagaaagggcgcttgagcgccgaagaggctgcgtccgagcttggctgcaccgaggatgaagcctatgggatgctctcggtgcttgtcgactgggcttcaatcgagccctactacaaccctgagctcggcgagaagccaggacagcgcgactggcctcaagccttccagaccgtgaagagggacgcaaagtgccttacggagtatgaccgcgaaagcgacttcacgctttcgggcgcgaccgaggcaggggaggcaaggcttcctcaaggggatgctgcatcgttccttgcggccgagaagtcccatacctatgcagggcacggcttctgggcgcgtgtcttcacgctcttagcaggtcctcttatcaacctcatctttgctctcgtcgtccttatggctggcttctcgcttgtaggcgtcacggtcagcgtgaacgaaaacacgatcggacaggtcgtctcaggctcgcttgctgaagtctcgggcctcgaggcgggggataccgtgacggcaataaatggcgaggaagtcacggactggcagagcctcgtatcggcgctccaaccctgtcttgcagatggctctgacttcacgatcgagatcgagcgcgatggagccgcacagacgctccatgtcgatcaggatgagagcgcgccatcttcgacgcttggcatcgtcgcaccctcgaagaccgtgcgtctgagcatcgccgattccttccaggcttcgatctcctatgcgaagcaggtagcagatgctgcgatatcgctcatcaggccgtcgcagacgatgcaggtgctcaacgagtccacctccgtcatgggcatatcggtcatggcatcagaggcagcatccgaaggcgtctgggagctcatgctgttcatggcaatgatctccatgtcgcttggcttcatgaacctcctgccgatccctccgctcgatggcgggaagatcgtgatcgagatcggccagaagatcgtgaggaagaaccttccccagaaggcgcagatcggcatctcctatgcagggcttgccttcttcctcttcgtgttcgtctttgtactcagaaatgacatcctgagattcgtagtggggtagatgcaggcatgagcgagaaagcagcacgtacaagaacacgccaggtgcacgtaggtacggtcgccgtcggcggcggcgcgccggtatcggtgcagtcgatgtgcacgacgaagaccgatgatgcagaggcgacgctggcacagatcgagagcctggcttctgagggctgcgagatcatccgtgtcgctatcccgaatgccggagcgctcgacggcttcgaggagatctgcgcacggtctccgcttcctgtgattgcagatatccacttcgaccacaagcttgctatcgaggcggcaaggcgcggcgctgccgccttccgcatcaacccaggaaacatcggctcctgggagcgggtcgacgcctgcatcgaggcggcaggggaggctggcatcccgatccgcatcggcgtcaatgccggctctctcgacccgaaggtggacgctgacgagaagctgacgctgcccgaaaagcttgtggcctcatcagtctccttcgtcgagcacttcgaggatcgaggcttcaaggatatcgtcctttctgccaaggcacatgatgtgccgacgacgcttgcgacctaccgtgcgctctcgcgcgagctccccgacattccgctccatgtcggcgtgaccgaggcaggcacgctcaggcagggcaccgtgaagaactcggtcggcgtcggcatccttcttgaggagggcataggagatacgatccgcctgtcgctcacggctgagcccgaagaggaggtgcgcgttgcctgggagcttctccaggcccttggcatgcgccgtctccatcctgagctcgtgagctgcccgacctgcggacgctgccaggtgaacctcatcggccttgccgacgaggtggaaaagcgcctctcgaagatcgaggcaccgatttctgtcgctgtcatgggctgcgtcgtgaatggcccgggcgaggcaaagagctgcgacatcggcattgcatccggcaaggggcaggggcttctcttcctcgagggaaagccgctcaagaaggtgcctgaagaccagatggtcgatgcgctcttcgatgagatcaaggaacgcttccctgaggcgcaggcaaaggaataagcggaacttccagaaaggctcctgcgggagcctttcttctctccggcatgtgcttgtgtccaagagcggcatcgatgggccatccggcagctcaaaaggcttagaatgaaacccgtatgtgtgggatgccgaaaggacatgcattgaatacctataagctcatgagcaatctctatgcgccgaccctcaaggaagacccgacggaggccgtgcttgccagccacaagctgctgcttcgtgccggcatgatccgccgtggctcggtcggcctctattcctatctgccgcttgcctggagatcgatcttgaagatcgagaacatcatccgcgacgagatggacaagatcgactgccaggagatgatgacgccgatcctgaccgacgccgagctctggcgcaagagcggccgctggaatgcctatggccccgagctcatgcgtctcaaggacccgctatggccacagtatgcgctgggccccacgcatgaggagacctataccatctcgtgacgaacgagctcaagagctagctacagcagctgcctgtcatgctctaccacatccaggacaagttccgcgatgagcgcaggccgcgcttcggcctcagcgctcccgcgagttccatcatgaaggatgcctattccttctccgcgagcgtcgagtccatgcgcgagtgctacaggagcagaaggaagcctatgcaagcttctgccgccgtgtcgggctcagggcccttccggtcgtgccgactccggccagatcggcggcgacacctccgtcgagttcattgctcttgccggccggcgaggccgagatctgctactctactgcgatgcctgcggctttgcagcagacaccgaggcggcaacggccaaatcagcctcgtcgagggcgaggctggagagctcgagaaggtagaacgccctcctgcagcaccatcgcagatcttgctgccttcctcaagatccccgcaggcacgcgcaaggcgcttgccctcgtcgacggcgacaagtgtccggtcgtcgtcttcgtgccgggagaccatgacctgaacactgaaggcaggccatgtcttcggcgagtaccacctgatgtccgacatgactcaaggagtatggccttgtgaagggcttcatcgggccgatcggcctgcccgagaacgtgaaggtctacgcccgagacgctcaagagctccgagtggtgggctgtcggcgccaacgagcaggacttccacttcatccatgcgaagcaggggcgcgacttcgagatctcgaactgggcagacctcatcaccgcaaagggggcgacctctgcccgcactgcggcgctccgctcaaatcgctcgtggcatcgaggtcggccaggtcttccagctcggcacgaagtactccgagaccatgggcgccacgttcacggatgaggatggcacggagaagccgttccagatgggctgctacggtatcggcgtcggcaggacgctgcaggccatcgtcgagcagcaccacgacgagcacggcatcatctggccggtgagcgtcgctccctacgaggtggagatcgtgccgctcgatacgcatgacgactcgtgtggccgattgcaaagaagcttgcaggcgagcttgtcgagcatgcatcgaggtcatcgtcgatgaccgcaaggagcgtccaggcgtcagttcaacgaggcagatctcttcggcttcccgtatcagttcgtctgcggcaagcgtggcatcagaacggtgtcgtcgagatcaaggagcgcgcaacgggcgagcgccagagattgcaatcgacgatgcagtcgacgagctcgtggatgccacgtctcgaagcgtgcctaagcctgaagacgctgcgtcagacatacagcgcatgaaagaggcgcccagaagctctcaaggcttctggcgcctttctgtacttattcgcgaaagcgctacttcattcttcctgatagacgcggttgccggcaagagcgcctgtgagaccatcggcgaggacgaggatggcaaggaagggagacgacacctggattgggtgcgaagggccctgcggctagacggatgacagagacgacgccgagggcgcaggccactatatgatcgggatgatgcccttcgtacgaacggcgtattggcagcacgtgctccctgaagccggagatggcgctctacgagccgtcccacgccgagcacgccgtatgccatgcccttgccgaggctgcagcgacgaatacccgacgatagcaaggacaaggcctgcgaacatgctggcaaggctccagatcttcaggaacttctgcttctctgtcataggatgattcctttcggttgtaatcgagcttctagtccttttaccaacttggcctgtgcgtaagccgtgttcgggccaaatagcgcctgaagggcatccacgcgcagggagcggatgggcttggacgcggtttccgcatgtcgagaaagcgtgaaggcgcaaacttgcgaaaatcgtgcttgaccggaatcgagcttctgttagtaattcccgcaccgcatggggaattagctcagttgggagagcgcgtgactggcagtcacgaggtcagggttcgaatccctattctccaccatgatactccgcaggccacttagtggcctgcttgcttgggcagcgaggcgctgcatttcatcctcggctggatggactgaagagctgaatctgctaatatcactcccacgggcgattggctcagggtagagcacttccttcacacggaagggtcgctggttcgaatccagcatcgcccaccaggatatcgagggcggcgctcaggcgtcgcctttttctctatttcgggctcatggcgcaacggttagcgcaggggactcataaccctggttgcaggttcgatcctgctgggcccaccaaagatcgaggccggcagccagcgctgctgcctcttttttgtggaaaggatggtctgccgatgttcgagttcctgaagcggcatggcaagaatgcggaatccggcacgcaggacagcgatgccttcggcctcgaggattgcgacatcgatcttcaccctccgcgagcttgccggatatcctgctgaaggcggactcacgcacctcaccggtttcctccgttcgtggtgcttggacacagccacagctgccgactgcgacttcctgaagagctacggcgtccacgcagtgtcgtcgacctcagaggagggccgagtggcccgagggcgatggccgcttgcagaagatcctgacatctcctggatcaatgtgccgctcttcgctacaacatgagcgatccctacctcatgccccgcacgggtgctgcgggatatctcgcccgagagttacttgcacgatactcgcgaacaagcctgccgtgaagagatctttcagttcttgcagagcagagcgcagatgattgcgtgctcttccactgtgccgctggcatggacagtgaccggcgtgacctccatgctcctcttggcctctgcggcgtcggaccgcgaccacatcactcgacgtactcctacgccttcggtggcgtccgcgaggaccaacgaaggcaggtcaccgtccggaaagcctcctcgataagatgcacgttgcgccccgagctccaagaccccgctcaaggcgatatcggtagacctgggacctgctcattgcagatatggtggcccgatacctactcgcctcctgcggcatattcatgccggagacgagacgtgcctgtgcgagagtctctcgagggctgagagaacccgcaagctgcagctccaggccgctttccctgtacttttcacgtgcgtttcgcagacgtgcttccgtaccattatacctctttggttaatgcaaagctctagaaagggacgctatggcagaaagcgaagatccatagcagctcttcggcatgtatgtggcacatgtcggcatcaacgctcgtctgacagaggcctgaggtccattgtgaaggaattctccgactttatggggccttgcccgtcaggtcatctcgccggcctcccgtttcccccttcgcgatcgaccttatcgagtctgcgtcccggccgtgccgtggcacgaagggccatatcggcttccatgtggacgtatcgacgctgcggagagtggtttcaagtcccgcgcttcgagatcaacgaggattcctcgcgtgaagaatccggacggctcgacatccttgtgtatttccagcatgagatcgctggattcgccatccattctgtaccggagaagtaggagcttccactgatgttcttgcttgcgacaagatccaaagtcattcgtcggtcgcctgttctctacgcggccgctgtacctgcagtctcaatgcatggcgagcgctgggcgctatgtcggccctaaggagcaggcaagaccaccttcctcagatcctcatgggtcaggagacgccccccctgatgaggaacaagtcgtccttccgcgaagggatacgacgtcggctacctcgagaggagacgaagatctccggcacgaagacaagcctctccaggaggtcatcgattcggcaaccgagatcacggcactgggggagagagcgcgtgcacgactcgacaagggagactcgaacacgccggaagggccttgcctcgaacatatgcgtcgaggactatgcacatgcctcaggacgccttcgagcaccttcgtcggctatgagctgatgcccgagccgctccgattctcgctggcctcggattcctgtccgagggaccttcgacaaggctgccgtcgacttctcgggcgctggcagaatgcctcatcgcgtctccgaagctcctctccgccatcccgacctgcatgctgctcctgacgagccgaaaccacccctcgaccctcgaaagcgtccattggctcgagccaccttcatctcctcgtatgtgggaagtcctcatatcgtctcgcacgaccgctctcatggatggcctgtgtgaagccatgtggccttcgatcgagaaccgcaccgatgaccgaccattcggggcaactacgactcgtacctgaagcagtcgtgagagcaccctcgagcagatcgtgcgaagctgtcggcacaggagcgcgagattgccctatgcagtcttttcgtcgccaagttccgcttacaagccgagaacagcgcagcgcaggaagcgcatgagcgcatgagccctcgaggaaat

SEQ ID NO: 48 - DNA, 20761 bp, Unknown
  Metagenome-assembled genome
ctttgcagcctattctaggcgttctcttaggcgttcttctcgatccagctgttgggatctttgccctcggccgcaagacggtcggagaggcggcccttcgggcttgcagaccagatcggagcagacgtcttggcccagcgctcggctgccgccttcgtcttgctctcgagctcgtcgacatcctcaggatgcgtgtagtccgtggacttggcacccgtctcgtgcaccatctcggagagggcgccagggttgtcgagcaaggggcacggcctcagcatgttcgggttgaacggctggtgtgcctgatagctcttgaagagcgggctcttgtagcactcgaggagcgtcttctcgcggatattggagtcggagtagtggatgaaggcgcagggctctgcgtcgcctcctgcgttgatgtggaagtagcggcgggcgcctgcgatgcagccacccgtgtactcgccgtcattccagaagtctgcgaagaagatgggcacattcttgcgccagtcgtcgcgcaccttgtgatacatgccctcacgctgctctgccgtggcgagaagctcgacaggagagcccaggccgaccggcatgtacgtgaagatccaggcaaagagcacgcccttgtcgacgaggaactggacgtattcgtcagaagtgacggagtcatagttctgggacgtgtagcagatggaggcgccgaacggaagcctgcgctcgcggagcaggtccatcgcacggacgaccttgtcgtaggtgccagcgccgcggcgggagtcggttgcctcgcggttgccctcgatcgagaaggccggcatgaagttcttcacgcgcaggatctcgtctgcgaactcctcgtcgacgagcgtgccgttcgtgaaggcgctgaagtagcagtcagggtgcttctcgcagaggcggataaggtccttcttgcgcagtgtcggctcgccgcccgtgaagaggtagatataggtgccgagctccacgccctgcgtgatgatggagtcaagctcatcgaacgtgagggacttctgcttggagtccgtgtagttcgcagcccagcagccgttgcagtggaggttgcaggccgtcgtcgggtccatgaggatggcccaggggcagttgcagccttccttctggttgatctcgcgctggcggtagccaccgagcgtgacggagttcacgaagaagttctgcacgaacgtgcgggcaacttccttgtcgacgttatcgataacgttctggacaagacggcgccagttgttgtcaggatccttcatgaagcccatgaccatgttgaacagacgcagctgtgctgcattgatgttgtcgcctgagccggcgaacttgttaatcatggactcgacctttggcagattgccatcgaagtcgtcatagagcatatcgaatgcctggttgacggcgatgctgatggccttcgccttgatggtgtcgagcaatgccatacccaatctcctttatacggcgtccccatacagaatgcgcaccattgtacgcttatccgtagcaattcctccgtggatgacgcatcccgccatacaggcggcataaatggcacctcagcacactgaattctcgtaaaggctattgcataaaagtgcgaagtgggcctatgagccgggttctgtcgtggacaatcatttatctacgaatgccgttgccggcaccctctagcgcgcaacccgagcgcggtgcgggccacaccatagcgctcctatttgcgtttgctccggaaggggcttgccaagccgccgtgttgccacgacgctggtggtctcttgcaccaccgtttcagcttttctctcacctcgaagaggcagcgggagtcttcttttctgcggcgctttccgtcgggtcgccccgcctggccgttagccagcttcctgccctgtggagcccggactttcctcatgacccaaagggtcccgcgattgtctggcccacttcgcaggagagattgtagcatgcaggaagctggaagtacctgcgctccctcccctccccagaagtccacatcaaagaaacctagcaggacgagcagcatcgtctgctgagcagagggaccatcaggagccgccatgctgcatccatacagaaagagcctgcgggaggaagggtttccgcaggctctataagaatatattccaaatcctaggaaaaaagtggaactaatcgagatcgtccacgttgacgcccggcgtgaaggtcggagcagaggtcaggacggtcttgtcggcaggtgccggagcaggcgtctgtgcgggtgccggagccggtgcaggcgcagcggcctgagcgggcgtcggttcgggagccggtgcaggcgtcgagacaggtgctgccgtgacggagacggagaccttcttgccggtcgtcgggaagacggcgtctgcgtcgtccatgaagtgctggagcaggttcttgtactctgcacggaagtcctcgcgggactgcttcaggcggtcgatctcgtccatctcgttctgtttctcggcaagagcctgacggatgacctcgcgggccttctggtctgcctcggtgcggatctcgttcgcggaagcccttgcgtcggcgacgatcttgtctgcgctctgctgggcgacgatgaggaccttggagatctgctgctcggaagcgttcagtgcaggagcaggtgccggtgccggagcgatcggcgcgatggcggcagcgcccttctgggcctgcagcgtctcgatctgtgcctgggcggcagcgagctgctgctcggagctgttgaggcggctcttgaggtctgcgatcttctggagcattgcgtcgacttcgccggagagctgctcgaggaaggcgtcgacctcttccgtgtcatagccgtgcttggaaggagagaatgtcagctgttcgatatccgcaggagtgatagccatcttgatacctttctgttatccacgacaccgtttgaattattgcgctgtcagtgagcccgttagatcagtgcccgtacgatgaattcctcgacggctccgagaaccatgaccgcgatgaccggcgagaaatcgattcctccgatcggcgggatgaacctccggaagaggttcaggtacgggagcacgaggcgtccgagagcctcgctgatatcgtctacaaggctacccggctttctgggaaaccaggaaagcaggcaccagacaatgatcaggatctcgtagaagtagaagagcgaatagacgaggtttgcgagctgcacgagttgggtctcctgttatttcttgaggtcaccgtcggcgatgagcttgtccacatcagccttggtaagagttatacccgcagggagcacgctgaagacggattcgccgagctgctcgacttctccaccaatgccgcaggcaaggccgaagctgaagtcgaggacgcgctttgccgtatccatcggcgtatccgtgaggacgagcacgaccggctggttcgtctggacgcggcggatgaccatctgcacgtcgtcgtaggactccggcttcagaatgtagggcggaagctggccggaggtcacgcgctgcaccggtgccggcgtctgcggctcggaagcggccgtatccgtgtaggaatcctgataggaatcatggctctcaggataggtcgtgcgcggtgcgtaggcaggatcgggtgccggcgtctgggcatagccatggcccgcagagtaggcggattcggtcttctgctgctgggcgaatcctgcaccggcattggatgctaccggacggccggagcgggtgtagaccgagacgctctcagcctcggggcgcggcgtgttgccgagaaggccggagccttcggtcctctggggctgcgtggaggaaccacggcggcgcgaggagcggggttcgggatcggagacagcattgccgtcgtcgtagtagccgtcgtcgtagccctcatcgtagtcgtcgtaattgtcattgccgcgtaagcggtccttgagattgtccaggaaacccatgtccttgccttcctacctctatgctgcgttcttcgttacttcagttcgtagtcagggctgaacaccactctgcccagcctaataagggtcgagccttcctcgagagcaatcgggaaatcgtcactcattccacaggaaagctcacagagacttaaagaggtgcgctgcctcaggtcttcggccagctcgcgcaggccagagaacgtgcggcgggctgcatcaagatcgtgtgctggcgccatcgtcatgagtccctcgatctcaatccccgacagtgcaagcaggccatccagattctcgataagctctgccggcgcaaatcccgacttgctctcttccccggagacattgacctcgaggagcaccttcgagaccaggctgcgcgccagtgagtgcttcgagatgacttccgccagatgaagcgacgagaccgactgtatgaggccgaccttcccgaccaccatgttcaccttgttggtctggaagttgccgatcatatcgaagcggacgccttccatctcaggatgcccgtcgagcgcttcgagcttgcggcgaagctcctgggggcggttctctgcaaagacgcggtaccctgccttccaggcctgagcgacctcgtcaggcccgaccgtcttcgagacggcagcgagcgtgacctttgcatccgctcttccggaacgcttgagcgcttcatctgcaatctccaggatgcgggatctccgctcttcgagaaacttcagataggcttcttcgtcttccatacatccacccccccaaagcgtctgtatcaggatgcaagatatgcaagtgcgccgtggcggccgcagtgcccgccttcggcacgataggaatagaacctgtccgtcgcccgtgccgtggagatgccgcaatccactatggattcctcccccatccctgcgccttcaagcgcgaggacgatggcacgtgcaaggtcgagacggtgtccgggaagcgccacgctctcatcgaacgtgtcgacgaagcgcgtgaggagctcttccgagacctcgtagtcaggacctgcgatgtggggcccgatgtaggcgaccgcagaggaagcatcctcctctgtcgccgcaaggagcttcacgagtgccttggctgcgatggaggctatcgttccccgccagcccgaatggacgacagcaaagcccttctccgtagccaggatgaccggaacgcagtccgcatagcagagaagcaccggcaccccaggaaccgtgcagacaattgcatctgcgccttcacgggcctctttctggatgcgcgcgaggctctcctcatctgccgtatccacaaggagcaccttgccgccgtgcacctgcttcgggttcacgagacggtcaggactaccttcatagcccagagcggcaagagcgcgggccctgttctccgcgacatgctcaggcatatccccgcaagcatcgcccaggtcgagcgatgcgaagacaccctcggagacgccgcccgtgcgctcggtgaagccgaagcgcacctgtccctcagcgtgcccatccgtcaggaacgacacgccagagacgctctttcgtgtgagagacggcgtttccatcaggctctcctacatgcgggagtgcttcaggaagtcagggatatcgaagccctggttcgcgttcgaggaggagttcgtgcgggagccagcgttcgagcgggcaggtgcagacgtcctcgtagcgggcgtggaaggacgcgacgccggacgggagcccctgttcgagctcacggaatcaagcgtcggaaggctgtcggagtcgttctcgtcgaggcccgtcgcgatgaccgtaacgcggacctgatcgcccagggactcgtcgacgacggtgccaaagatgatgtttgcatcggggtcgacgttcttagcgacgatgtctgcagcgtcgttgatctcctggatgccgagatccttgttgccggcaatggagagcaggacgcgcgttgcgccatcgatcgaggtctcgagaagcgggctcgagatggcctcctcggccgcatcagcagcacgggagtcgccggaagcgacgccgatgcccatcattgcggaaccggagtccttcatgatcgtgcagacgtctgcgaagtcgacattgatgaggccagggaccgtgatgaggtcggtgatgccctgcgtgccctgtgcgaggacctcgtctgccatgcggaaggcctcgagcatcgtggtcttcttctcggagaggtcgagcagacggtcgttgggaatgacgacaagggtatcgacattggcagcgaggttgtcgatgccgccgagagcggactgggagcgcctgcggccctcgaacgtgaacggcttcgtgacgattgcgacggtcagggcgcctacgtcgttctttgcgatgtcagcaacgacaggtgctgcgccggtgccggtgccgccaccctcgccagccgtgatgaagaccatgtctgcaccggcaagagcggccttgatgtcgtccttgctctcctgggcagcctgctggccgacctcagggttggcgccagcgccgaggcccttcgtgatgtcggtgccgatgtggaccttgatgtcagcatcggagattgcgagtgcctgggcatcggtgttgattgcgacgaactcgacgccgcggatgccctcgtcgatcatgcggttgacggcgttcgtgccaccgccgccgacgcctacgaccttgatgactgcgaggtagttgctggggatgtcgttgtcggtcatggaagttcctccttgcttggcgacggggcgtttgtggtccgtcatgtccatagatccgttgctgctgcgttcgtgctgcgtttgagtttctgtgtccttctttggtgctgcgagctttcggcaagtcgttggagagaccctaaccctcaagttaagctcaacgcctcatctaaagcggcatatatttgcacaacgtcccaacttccgtcaacacttttgtcagaaatatggattgcgcaggtagatgcctcaatttacatgcgttataagcttaaagcagtacttgatggttagggttttgaatcctcattcctcgaccttcaaccctcgagtccgaccctcggccttacctctatccttgagacttttctgccagcactcaagctgcctgaggcttcgatgggatgagatcagcctctccgaaggcacaagagaggcccgcttcgatgaagcgggcctctcatagctcatttccttagatcttctaggctcccgcagagctcgtcgaggacgacgtcatccctgtgccggtcgaggatgccgtacccgaagaggtcattccggaggtcgtgcctgaagccgtacctgaggccgttccggaagaggacgtggtgccggaagatgccgtgcccgatgtggtgcccgacgaggtccctgcggtcgtgccagaggtcgcatccgtcgacgacgtaccggacgctgtggtgccggaggcgcctgtcgatgtcgttgacgacgtatcggtcgacgtcgttccgctcgtgctcgtggagccgctgtcagaagacgccgagttctccgtctcagccgtgacgcctgtcccctgcccgaccttgtcggaatcgacgctcctgtacgagggattcgtaggaacgcggacattgatataggtgaccttgcccgcatgctcggagaggatggccgtaatggcagtctccttcgcagagatgttcgtcgcggctcccagagatacctccacaccgttcgagaggaggcaggagaggctctccatcgtgcttgccgagaagctcacgatctgcgacttgaaggaggacgagaagctgttgagatacgtgttcacggcgacgatcacatcgtcggtcgcagcagagcctgcaacaggctggaccgtggcagggacattgctgatgaggatgcagctctgcgaggtggcaagcgccagcgctgcctcctcggaggtctgtccgctcgagcggtcgagcgtcaccggctctatccagcagccatcggaccccagataccaggcaacgcttcctgagttcatgaggacaatggcggagaccgagcgctcgttcacgctgatcgaaagcgtattggggaacttgcgctcgatattgatcgaggcgacccaggtttcttcttgatgttcgctcgacagccttctcatcgacattgagaagcgtcgtgcccccggaatctgggcaagctttgcaatggaatcctggctcacatgggccgagccctgcgtctcgatgtaccgtgatcgtgaaggcaggacttacggagagcaggaggaagacgacaagggcaccgatgccagagcaatccgcagtgccgcgaagagggcgacacgcgatacgagcttctggtggtcgactgcctttccgtccgggtgccgcctcggtatccttgaccttgtgccgaaggtcgggaccttctcgaccttgttcggattcttggctgcccttctggagcggccgtttcgtccttgagcgacctgccgacgaccgttgcaacgctctggcgtggccgcttccgcgcccgacagagcgcttcatctgaggcacgctcgagctctggcgcggcgtcgcctgcctctttgtggacgctggccttttggcatggaacgtgtcctccttccgctggctcttccctgctctggacctggcttgctagtccttctgctctgcctttcgtcacgctcggcaacgcccttcaggaatgcaggacccatgctcgtgacatcgcctgcaccctgggtgtgaccatatcgcccggacgtgcaatctcgacgaggcgctcgatgagctcctgcggttcggcagtactcgacatcgcccacatggccatgctcgcgggacctcgtttgcgaccgtcttgcggagatgccaaacggcattctcgcctgccgaaaacatccatcacaggatgcgtctgccttgtcgaaggcttgccgaagagcgcgcgccagggcctgcgtgcggctgtacggtgcgggctggaagacgacgacgatgccttgaaactcgagatctgcagcagcagagagcgtcgctcaatctcgggtggatggtgtcccatagtcgtcgatcacggtgatgccgtcacggtccccgacgtgcgtgaagcgcctgcgggcgccctggaagctcgagagagccttggccgtcatcgtcgaggtcagaagccaaggacatcggccacggcgagcgatgcggtggcgttcagcaggttgtgcttgcccgggttcgcatggatgacgatcttctctgtcgtgccttgggcgcttcacgtgaagtggctctcgagctgatggtgtgtacctctggctcgcacacatagtcgttctccggcttgaagccataggtcacgacagagcgtccggtcgacttggcaatctccacatagtgcgggttgtcgccccatgatcacgatggtgccggaatcgcccacgaggctcatgaacttgcagaacttcttctcgatgttctcgagggtgccgtagtggtcgagtgaccggctctatccagcagccatcggaccccagataccaggcaacgcttcctgagttcatgaggacaatggcggagaccgagcgctcgttcacgctgatcgaaagcgtattggggaacttgcgctcgatattgatcgaggcgacccaggggttcttcttgatgttcgtctcgacagccttctcatcgacattgagaagcgtcgtgcccgccggaatctgggcaagctttgcaatggaatcctggctcacatgggccgagccctgcgtctcgatgaccgtgatcgtgaaggcaggacttacggagagcaggaggaagacgacaagggcgaccgatgccagagcaatcgcgatgccgccgaagagggcgacacgcgatacgagctcctggtggtcgacatgcctttccggtccgggtgccgcctcggtatccttgaccttgtggccgaaggtcgggaccttctcgaccttgttcggattcttggctgcccttctggagcggcgcgtttcgtccttgagcgacctgccgacgacgctgttgccacgctctggcgtgccgcttccgcgcacgacagagcgcttcatctgaggcacgctcgagctctggcgcggcgtcgcctgcctctttgtgggacgctggccttttggcatgaacgtgcctccttcctggcctggctcttccctgctctggacctggctgctagtccttctgctctgccttctcgtcacgctcggcaagcgccttcaggaatgcaggacccatgctcgtgacatcgcctgcaccctgggtgatgaccatatcgcccggacgtgcaatctcgacgaggcgctcgatgagctccttgcggttcggcaggtactcgacatcgcccacatggccatgctcgcggacctcgtttgcgaccgtcttgccggagatgccaggaaacggcatctcgcctgccgagaagacatccatcacaaggaggacgtctgccttgtcgaaggctgtgccgaagagcggcgccagggcctgcgtgcggctgtagcggtgcggctggaagacgacgacgatgcgcttgaactcgagatctgcagcagcagagagcgtcgctgcaatctcggtgggatggtgtccatagtcgtcgatcacggtgatgccgtcacggtcgccgacgtgcgtgaagcgcctgcgggcgccctggaagctcgagagagccttggccgcatcgtcgaggtcgaagccaaggacatcggccacggcgagcgatgcggtggcgttcagcatgttgtgcttgcccgggttcgcatggatgacgatcttctctgtcgtgcccttgggcgtcttcaccgtgaagtggctctcgagctgatggtgtgtatcctctggctcgcacacatagtcgttctccggcttgaagccataggtcacgacagagcgtccggtcgacttggcaagctccacatagtgcgggttgtcgcccatgatcacgatggtgccggaatcgcccacgaggctcatgaacttgcagaacgtcttctcgatgttctcgagggtgccgtagtggtcgaggtgatcctcctcgatgttcgtgatgacggcgatgttcgggttgaggtagaggaaggagccatcggactcgtctgcctcgcagacgaagtagccgccgttgccgttcctgccgttcgtgtcatagccctcgacgatgccgccgatgaggaaggaaggatccttgcccatgcggtcgagcatcgtggcaatcatggacgaggtcgtcgtcttgccgtgggttccggcaacagcgaccgtgcaggcgccatcagagagtgccgacagcatgcgggcgcgcggccacacggggatgccaagctcgcgggcacgcacaagctccggattcgtctccgggatggctgtggagatcacgacgacgtcaggtgcgacctcgtcgatcgtgcttgcctcatgtcccacatagaccttcacgccggcgttctcgagctcgcgcacatagcgcgatgccttgaggtcggatccggtcaccttgcagccgcgctcatgcagcacgagcgcgatgccgctcatgcctgcaccgccgatgccaatgaaatgcgcgctcttgaatgcggaagttccttcagccatgtctggtctctccttcaagacgtccaaactcttctatgctctaggcttttgcctgagcagcacgttccacttcgtctgccagggccgcagcagcatgtgcctgcccgagcccttctgctgccttcctcatcgctccgcgctcctccgcgttgtcgacaagcgacaggacctcttcgcggaagcgctcggtctcgacctcggcatccggaagcaggtgtgcagcgcctgcatctacaagatagtgcgcattcgtcgtctgatggtcggcagtggccttcggatacggaatgagcaggcttgggaccgcaagggcggcaatctctgcaatcgaggaggcgccagcacgggagatcacgcagtctgctgccgcaagcgcctcgcccatgttcgagatgtagggcttcacctgatagcgcttcttctcctctggcgtgagggcaagcgtcttctcggcgaactctgcgtcatccttgcccgtcgagtgcacgacatagaggtctttcctcgagaggagctcatccttcatctcgcagagcgcctcgttcaggtgatgggcaccaagagagcctccaaagacgaggagcatccgtgcatcttccggcacgccgaaggcacgcctgccatcggcacgcgtcgcagagatgacggagcgccttaccgggttgccggtgacgacgaccttcgtatccttgccgagcttgccttcgaaggcaggcatggcctcaggaagcgagaggcagagggtgcgtgcgaatccagagcacaccttgttcgcaaggcccggcaccgagttctgctcatggatgacgaccggcacatcgtgcctcgagcaccagcgcagaagcggcatctcgacataggcgccgaatcccacggcgacatcgggcacgcccgtctcttgaaaatggctgccgattgcacgttctgcctttgtcatcctcacgaatgcggagatgagcgtccaggggcgctcgcggtcgaaacccgagatcctcgtcgggaagaagtcaaatcctgcctcaggcacaagcgttgcctcgagacggttcggctgcccatagaagctcacctcgtggccacggcgtttgagctcctctgcaagcgcaagggctggattgatgtgtcctgcagtgccacctgcagcaagtgcgaccttgagtgccatgctaccttcctctcctcggacgtctgcgtccggtgctttcctgattgagatggggcgactgcgtgcgcgttctgacctgcggcccggtatcgggacgcctgagccgagaggccggatccataagatcgcgggagctccggctctcagaggcacgccgcgctgcccttgcctctgcgtgggcacggacttcggcatgtaccgaagcaccgccctcgacgaccctgaacgtcggagcagacgcctgtgccctgctctccgaccttgtcatgacctcgccgacacccgtgccgccacgtgctgccgtgccatctgcgacacggagctgggagcgcgcacggtcatgctcggtctcaggcaggatcgaggacctggataccgagaggatgaggccgacaaggatgcagcagctcatgatcgacgagccgccatacgacaggaacggaaccggcttgcctgaaaggggcatgaggccgagcacgccgccgatgttcacgaagagctgcacgacgaggatcgtcgagcatccgcaggcaacgaggcgccccagaaggtccggcgcatagtttgcaatcttgtagctcgcgaagagcagaaggaggaagatgcagacgatgccgatggtaccgacaaggccacactcctcgcccacgatcgcgaagatgaagtcgttgtatgccatgggcagataggcgtacttctggtgcgagaagccgatgccgacaccgaagaggccacccgatccgaaggcataccagccctggatgagctgcagccaggcgacgcctcgaccagctccgggcgaaacagacctccgatgagcagcgctggcgcttgccacctcgcagactgtcatcctcctcatccgcaatgtccctgcccggtccagccgttcaggctctctgctgcgcacagacgatggttatcgtcgccgtgaacacgtatctcaacagctttctcgtcctccttcaagtcgcataatcgtgagcttctcggcaagctctatagagagcctctcctgcctctctgaactgcgtggaggtatctctgggaccgcgacgaacatctctgcgaaggagctgccatccggccatcctctccgagcacatgcgggcaaggtcacctataatcaatgaatgtccggccgttccctacgaatccctcgtacaggaagcgtcgattccgacacaggtcgggcagaagaacgccgtagttctccgtctcagccgtgacgcccgtccctgcccgacttgtcggaatcgacgctccgtacgagggattcgtaggaacgcggacattgatataggtgaccttgcccgcaatgctcggagaggatggccgtgatggcagtctcctcgcagagatgttcgtcgcggctcccagagcatacctccacgccgttcgagaggaggccaggagaggctctctatgcagcttgccgagaagctcacgatctgcgaacttgaaggaggacgagaagctgttgagatacgtgttcacggcgacgatcacatcgtctgtcgcagcagaggcctgcaacaggctggaccgtggcagggacatgtgctgaggatgcagctctgcaggtggcaagcgccagcgctgcctcctcggagtctgtccgcccgacggtcgagcgtcgccggctctatccagcagccatcggaccccagataccaggcaacgcttcctggttcatgaggactagggcggagaccgacgctcgttcacgctgacgaaagcgtattggggaacttgcgcgcgatattgatcgaggcgacccaggggttcttcttgatgttcgtctcgacagccttctcatcgacattgaaagcgtctgtcccgccggaatctgggcaagcttgacaatggaatcctggctcacatgggccagccctcgtctcgatgaccgtgatcgtgaaggcaggactacggagagcaggaggaagacgacaagggcgaccatgccagagcatcgcgatgccgccgaagagggcgacacgcgatacgagctcctggtggtcgactgcctttccggtcgggtgccgcctcggtatccttgacctttggccgaaggtcgggaccttctcgaccttgttcggattcttggctgcccttctagcggcgcgtttcgtccttgagcgacctgccgacgacgctgttgccacgctctggcgtgccgcttccgcgcacgacacaagcgcttcatctgaggcacgctcgagctctggcgcggcgtcgctgcctctttgtggacctggccttttggcatgaacggtgcctctcctggcctggctcttccctgctctggacctggcgctagtccttctctctgccttctcgtcacgctcggcaagcgccttcaggaatgcaggacccatgctcgtgacatcgcctgcaccctggtgatgaccatatcgcccggaacgtcaatctcgacgaggcgctcgtagctccttgcggttcggcaggtactcgacatcgcccacatggccatgctcgcggacctcgtttgcgaccgtcttgccggagatgccaggaaacggcatctcgcctgccgagaagacatccatcacaaagagacgtctgccttgtcgaggctgtgccgaagagcggcgccagggcctgcgtgcggctgtagcggtgcggctggaagacgacgacgatgcgcttgaactcgagatctgcagcagcagagagcgtcgctgcaatctcggtgggatggtgtccatagtcgtcgatcacggtgatgccgtcacggtccccgacgtgcgtgaagcgcctgcgggcggccctggaagctcgagagagccttggccgatcgtcgaggtcgaagccaaggcatcggcacggcagcgatgcggtggcgttcagcatgttgtgcttgcccgggttcgcatggatgacgatcttctctgtcgtgcccttgggcgtcttcaccgtgaagtggctctcgagctgatggtgtgtatcctctggctcgcacacatagtcgttctccggcttgaagccataggtcacgacagagcgtccggtcgccttggcagctccacatagtgcgggttgtcgcccaatcacgatggtgccggatcgcccacgaggccatgaacttgcagaaacgcttctcgatgttctcgagggtgccgtagtggtcgagtgatcctctcgatgttcggtgatgacggcgatgttcgggttgaggtaaggagccatcggactcgtctgcctcgcagacgaagtagccgccgtgccgttcctgccgttcgtgtcatagccctcgcgatgccgccgatgaggaaggaaggatccttgcccatgcggtcggcatcgtggcaatcatggacgaggtcgtcgtcttgccgtgggttccggcaacacgaccgtgcagcgccatcagagagtgccgacagcatgcggcggcggcacacggggatgccaagtccggggcacgcacaagctccggatcgtctccgggatggcttggaatcacgacgacgtcaggtgcgacctcgtcgatcgtgcttgcctcatgtcccacatagaccttcacgccggcgttctcgagctcgcgcacatagcgcgatgccttgagtcggatccggtccccttgcgccgcgctcatgcagcacgagcgcgatgccgctcatgcctgcaccgccgatgccagaaatgcgcgctcttgaatgcggaagttccttcagccatgtctggtctctccttcaaacgtccaaactcttctatgctctaggcttttgctgagcagcacgttcacttcgtctgccagggccgcagcacatgtgcctgcccgagcccttcggctgccttcctcatcgctccgctgctctcgcgttgtcgacaagcgacggacctcttcgcggaagcgctcggtctcgacctcggctccggaagcggtgtgcagcgcctgcatctacaagatagggcgcattgtcgtctgatgtcggcagtccttcggatacggaatgagcaggcttgggaccgcaaggggcaatctctgcaatcgagagcgccagcacgggagatcacgcagtctgctgccgcaagcgcctcgcccatgttcgagtgtagggcttcacctgtatgcgcttcttctcctctggcgtgagggcaagcgtcttctcgcgaactctgcgtcatccttgcccgtcgagtgcacgacatagaggttctttcctcgagaggagctcatccttcatctcgcagagcgcctcgttcagtgatgggcaccaagagagcctccaaaacgaggagcatccgtcatcttccggcacgccgaaggcacgcctgccatcggcacgcgtcgcagagaaagacgagcgccttaccggggttgccggtgacgacgaccttcgtatccttgccgagcttgccttcgaaggcaggcatggcctcaggaagcgaaggcaagggtgcgtgcgaatccaagcccaccttgttcgcaaggcccggcaccgagttctgctcatggatgacgaccggcacatcgtgcccgagcaccagcgcagaagcgcatctcgacataggcgccgaatcccacggcgactcgggcacgcccgtctcttgaaatgtgctgccgattgcacgttctgcctttgtcacctcacgaactgcggagatgagcgtccaggggcgctcgcggtcaaacccagatcctcgtcgggaagaagtcaaatcctgcctcaggcaccaagcgttgcctcgagacggttcggctgcccataaagctcacctcgtgccacggcgtttgagctcctctgcaagcgcaagggctggattgatgtgtcctgcagtgccacctgcagcaagtgcaccttgagtgcctgctaccttcctctcctcggacgtctgcgtccgtgctttcctgattgagattggggcgactgcgtgcgcgttctgactgcggcccggtatcgggacgctgagccgagaggccggatccataagatcgcgggagctccggctctcagaggcacgccgcgctgccctgcctctgcgcgggcacatacttcggcatgtgccgaagcaccgccctcgacgaccctgaaagaagacgcctgtgccctgctctccgaccttgtctgaccgccgccacccttccgccacgtgctgccgccatctgcgacacggagcagggagcgcgcacggtctgctcggtctcaggcagatcgaggacctgatccgagaggatgaggccgacaaggatgcagcagctcatgtcgacgagccgccatatacagaacggaccggccttgcctgaaaggggcatgaggccagcacgccgccgatgttcacagagctgcacgaacagatcgtagagcatcgcgcaggcaacgaggcgccccagaaggtccggcgcaaagtttgcaatctgtagctcgcgagagcagaaggaggagatacagacgatgccgatgtaccgacaaggccacactcctcgcccacgatcgcgaaatgaagtcgtgtattatgcccatgggcagataggcgtttctggtgcgagaaccgatgccgccaccgaagaggccacccgatccgaaggcataccagccctggatgagctggtagccggagccgtaggggcttcccacgggttcatcatcgtatgattcgctgcctcgataccatccagataggaataggtgtccgaagattgatggcacccccacgaacgcgccgcggacgaccttcccgagaagccggcaagagggccagacgatgagggtggcgccgatgatgatttcgtgcccttgtcaggctgcatgaggatagcaagaagcggcactatgatcccgcgcaatctgcaggacaagctcctggcggtcgaatcgagtgctcctcgttagtacggcaagagcgccctgcaccggcgatgatcacgacaggctttgcgaactcggagggctggagcgtgccgaagccaggacagcaatccagcgcgttgcaccataggctcctgaccgcaaacggcgtctcgacgaggaggaggcaaatgacgacgagtaatgacgagcgcaaggaaacggcccgcgtgcccaaatgtagtcgcgcgttggccctatgaaaaaacgccagcatcgcaatgccgatagcgaggttgatggcctgatgcgtgaggaagtaatgtctgagcgttgccgaaggacgcataattgactccgtgatcgacgacgacgaatagtcatgaaggagccgaagagggcaaggaagacagatcggcatgacgatcagccttggtggccatgaacctgtgccggcacgcccccttatggcgccgcataagtgcttgccggcaaacgtattcccggcgctgtttccttggtcggcttgggcacttggcatccgcttcggactcctgcacaatactcgtcctgcgagtttcttgaataagctcgccagtttcctccatgttttggacactcatcgaacgaggagcagcgggtgacaccataccacgtcttcggggatggccaagcaaccggcactgcgaagttcgcgcatagcggctcttcgaggaacctcgctgtgctccttccgccacggatgagcttcggcatcctcggaccagcagcaccgtagcagatggcaacacggcagcgcgctggcaaccttctttcgcaagcaggtaggcggtcccttgtcgtggccgcagcaggattcacggatatggcccgaacggaaggcttccgagcgccttctcgaccgcatcggtgttcgttcccttgagtcgttcacgaaagcggatgcctcccgccctcgccgatggctcgatactgtgctcgagggcatgggaagtatgtctgatgccccgcctgagcgttcgaccggcacgccgacatggacgccagcgccgatgcagcaagcgcattctcggcgttgtgaattccttcagaccatgtccttgcggctcagagatccgtgctcagataccgtccagacgcacgatgatctcgtctccctgaggataggccggtcatcggggccttaccggctccgcctttacgctgaatcgagcagacatggacaccacgggaacggacacgccctgcgatggtgcggcaccattcgtcgtctcagagattgaccgcaatgtccccctccccgatgtttctggaagatctgctccttcgcggcagcatagtttctcgattcgtcttgtggggggggggggggggggggggggcccccccactcgatgtggtcaggcgtgacattcaggagcactgccaccttcgggtgaagctttttcgttgtcgcatctgaagctcgaagctcagcccgaaccagagccctcctgtctctcgtcgtccgcctcgtttgatcgtgccgatgttgccgacgggtagaagtctgcctgcatggcagcctcctcaaggaggcctgcaggagagcgtccgtcgtggtcgtcttgccgttgtccggtgatggcgaccccagtttctcgggctctcgtcgataggcgaactcgggcctcccctatgagctcggaggatgctcttcgcccggtctggaagaaggaggagacctcggagattccaggcgaggcgacagcaaggtcgtatgcaaccctcgatatcttcggtcccaatctggggaccgtgcaccgagcgagcggagctcttctgcgagcggcccctcgtggctttccttgcgcctaccgatggtgacagactccaccctgccgccgagaccttcgcgtcgtagcgcccactgccgcaccggtttcccgcaagaccgaggattggaggacacgtcctagcttttccgtatttttcgcccatcgcaagcctcctaagccgagctggaaatagacgcgtcggaccagttaccgcaatccgccgacactttcagaagcggaatgacgaaccttcgtccgctccagcccttcttctcgaaaatgatggtgggcagaggagcatgcggaagacactccttgccacggggcgtcttgaagctcacga

SEQ ID NO: 49 - DNA, 14087 bp, Unknown
  Metagenome-assembled genome
atgaagggcgatgagcgctacgtatgacctctcgctgggtggagaaaatcccagctggtgtactcccagcaggcggtagacctcatgctgcggagattaaccgcgacccagagcatattattgattccatgcgagcggaggtcgcaagaagaaacgaggccaaatagcttctatagatagcaggaagccgaccccaggagcaagggaatctaagcccgaaggcctacccccattcggggacccagctttaatccactcaagtcggctttacagtagtgtaccctgttccgagttctttgctagtcccggctcgacggatgtggaaaaagcgtcatcggccgacggcgatggctcagatcaagactgaatgtagtagacttgtcaagtggcaaaggtgggccagcctccgatttcgtctccggcacctgggcatgaccggggagaaggggcaagaaggagcatcacggctgtcttcataggacgagatcttcacggttcggagcgcttcttcaggagcagaggatcgtacgcactctgaggtgtctgggcgcagcacattgccgaatgtccatccgccttctgcttgcacctcatgccagggcttcgcatgaactctggcgcaaacgcccctccggccttgccgcgtgtatgcagtaggctggatacaacagcaggaggcggcaggtgatagagctttacggacagacgatgcgggcacgcatgcagtcgatgaaatcgatgattgggtatggatcaagctcacctcgccgtcgctcgacgagatcgagtccgtcgcgtcgcagctccagggtgtcgatcctgccgatatcgctgctgccaatgacccggaagagaaatcccgtgtcgagtacgaggaagcgttctccttgtccttatcgatatcccggtcgacgagtgtgcgccacggcgtctcgacgtatgagaccatccctttgggcatcctcatcctcgagcacaatgtgatcacggttctgtgcgcaggatacgccgatcctctctcggggcggcaggctctggcctggagctttcgacgaggctgcgccgccagttcctctaccgcatcctgctgagatctgctcttctctaccagagagatctgcgctgcatcgaccggcagaggcgcagagttcgaggagaagataaagaaagtccacgacggaagccgacctcatgagcctccatgaggtggagacgacctttgtctactttcagacatcgctcaggggcaatgggtctgtgctcacgcgcctgcagcgctcgggcaggctccatcctggccccagcacagaagatctcctcgaggatgctgcgacagagacgcagcaggccatcgagatggcccagatctaccgtgacattatggatggcacgagaaacctcgtgagctcgctcatggactcgcgcctgaacaatgtgatgcagcgcctcacgtcgatcacgctcatcctctcgatcccgacggtcatttcgggactgtatggcatgaatgtcgacctgagctggatgccgctcgcgaatgtcccgcatggctttggcatcatctgcggcggcacggcgatcgtcagtgtcatcctttcgatcatccttgtccgcagaggctggatgtagggaagcagaagcaaggtctcgcgcatgaaggaagggcagatggatatgctccatctgcccttctgtcctatcctggtgggtgtgcgggaaccgtcaggcgtgtcagcatatgcgtgcggccagccggaagctgccctgtctggatagtcctgtccaagaaggcagtggggagagggtacggcgggagaacggtgcatgcaccctggcactttcaggaaggcagatccagagccaggcaatctggttcgtgtagccctgaatcgtctggatggcctcgatagtctcggaaggcccgcacgcggcatgcagtgccttgccatgctcaaatccatatcgaccgtgacggtgcccatgaagttcacgtgtgccatgctgtcagcgtcaaggagggggatgccggtcttcggtccgtcattgttgccggtgcaggatagggtcccgccggtctcggagacgcccctataggctttcgtgaccttcgaggcagagatggatggccagggcggctaccctccgcagggaggatagggctatagccagggtggctatcagcaacgtcagaacggatttgctcaggcaggctatccccgggcccaccggcacagtcctggcaggaagtaccggatgcagcagcgcagggaggcgcctccttcgaggatgctagcagcctggcggaggtttcccagggcagggcagctcccgaagcagctgctgcgggagcacaagctggcatgtcacgccagcccccatgctgccgaggatggctcctggacctgcccgacctgtggtgactgcttcgacgattccgataacgaccagcgaagagcctcaagcaaaaagacatgcccaaagggacctgccttctgtgcacgtttcttctggcatgccacttcacgtgcatatgctgcaacgcgtatgatggagaggcacgtacaggacaagatctggattggctttctgcatggcagatacacgcataacgatgagagatatcgcggcccatttcggcatctccgtcaatacagttcacaaggcgatagcgggaaagcccggcgtcggtgccaagacccgttccgagattctgcagtatgccgaagaggtcggctatgagcgcaacgaaagcgcctcgatgctcaggcgcaaggcgccggttgtctatgtcgtgctgccaagcgcagaagacgatgggcgcttcttctatgcccagctctggagcggcttcgaggcattcgctgcctcccacagttcgggcgacatcgagttcaggcgctgctcgtttcgtcccggctgctatgcggacgtgctttccgagatctatgggaagatcgaggcgggggaacatgtgagcggccttcttgccttcacgcccgagacggaacgggatttcctggagctcaagcgtctctcggagcatgctatccccatcgagcttgtcatgggcgcagaccgaaggattgaccatatcggggcagcggttcccgactaccatgctgcaggccttctcatggcagagcaggcagcgaaccttatggcaggcagggctcacggagatgcaggcctttcggcggtcctgctctcgggcgatgcgacggtcgaggcgcatcgtctcgtggccgattccttcagagaagagctccggagaatgctgccggaagcacgcatcattgaggtcccgggcggccacagcgagcgggacgagctccccgacagggtgcgcagggctctggaagggtgtgtgccctcgtttgccagcagcgtctttgcgacgggcagcatggtgcttgcgcaggagctctgcgctgccggccttgccggcaaggtgcctgccatcggctctgatgtcttcccggagaatgtggaagcgctcagaaaccataccttcacgaatctgctcttcaaggatccggaaggccttgccttccgtgcggctgccacgctctctgcctacctcttgtatggaaaggtggacaaacgactcatcgtcggcgatgcggagcttgtcttccgctccaatctggagcactacctcaagaggcgctagggcgcttcctcctgcgtctgctcatccggatggcatgtcgttcttgagagggcctgctgcaccttcttctcaggggctggcagaggctggcgccctgccgtgtaggcgatgctgcccgatgctgtctggaagctgctggacagggtgtgctcgctatgcttgccgtgaaggcatctgatatgggagagcacggccaggcctgctgccggctcatctgggcgaaggcaggtcttgctctgtcgcaggaccggcctggaggaaagggagcgtctcttcagcaggagcagctgtctgctcccgcgccagctggatcttgcctgctccgtcatgcccggtgtgtggcagacgagatggcctgtccgctgcaggcgaagagccgtgccgagacaacgatagagcggagcttgcgctcatgcagggtatccatcgcagcctccttcaggcgcgcggttcgaaggcatgaaggcagcgtatgtttgggtcggcagattgtcaagctgagtgcaacatctcctgtagacctcgtggctgtcctgtatttcaggaccttcctcggcctgccgttgatcaggtccaccgcatgctgcacctcctcgtccgtcaccttgccgaagtcggtgcccttcgggaagaactcgcgcagagcccgttggtgttctccaccgtcggcttctgccagggatggtgggggtcgcagaagtagaactgcacgcctccgagggcctttgtgacatctgcatgccccgcgaactccttgcccctgtccggagtcaccgtctcgagcgggcgcccctccagaagcgcgacctcgccgcctggagacgctggcgctgtcatgccggcatctccctgcaaggaggagcctcgatgccctgtcggcgagcacggcaggcatgcggacccggaccgactaccgtgtcgtcctccagtcgccgagggcgcgacctcgcatcggcctctgccggcctctcctccacggtgtgcgagatcctgatcttgcccccgtctcgggcctcttcctgcggatcctcttcccttcctgcgcaggtggcgccgcacctggccttcggggccggctcccggcaggtcgagcgtgcctgcatggacctcgcggtagatcgtcgagaggctcacgacgcaccttccgccgttctccagcctgagcctgcgtctatctcgtccgggaccagtgcctgtccatgatgagcgagcgcaccttctgcgcgagcgcagggtcggagagcctcctcttcggcctgcatccctgtggcgcgcctccgccctcctctgggcggcgctgccccatagcgcccgtgccgccgttcctcttcagctcgcggcagatggtcgacctgtccctcccggtctctccgcgatgtagccgatggaccttccctctgcatgcagcgtggctatgcagtccctctcctgagggctaagatgactgtagtggcacattccttccagcttccgacgttgacctagacaaccacatcgtagccttccgggatgtgccacgcctgcattcggcgggccatcctgttgcactcagaatgctaatccgccgtcttatttcctgaactctctgttagaccttattgacgtggcggcccggtccttccagtagctccagaagggctgctccatgtctatcagctcgcgccttgtatggacgtaccctccctcccgcaagctggccggagagggtgtccttcctctccctctcgaatgcttcgcctgctccgtccagaggaagcatgcaaggtagtggcccagccgcttggtcgagacccatggaaggggagcaggaactcgcgcagcctctggtgcatggcattgacgaggccgagctctccgttccttgcctccctggcgacggtcgccgcatgctcctccacccgagcgcgggcagcacgcgcgcatatcctgcatgtcgtcagtggcgacccatgagctgtcgacgatgccggagagggcatccttcagccgtcgtcggtcggacgccccctgccgcagacggcggcatattcgtctcccaggtcgttcacgcagcactcgaccgcaaccttgaggctggatatcccgcgggaatgcacggcatggccatgcgcgtgcgccttcctggcatctggatgtccgaccttcccctgttgcccgccagcgactcgtcgagatagaggccgccgcctggcatgagacggagggtcccttcctgaagggcgcaagggcggaccccatcacctcgaagagcctcatcctcatgaaccacgacgtcctgaggcagacgctgcagctgtccgcgagctccctaagggacatgcccgcaagcgtgccttccgcatatgcgccaggtggccgcatcgagcttggacatcgcgagcccgatcccgtcttggagagaaggtcctgccgcatgacctgcacctccatctctggaagccatgggcgtcatggcccttgcgcagaagtccccgatccgcatctcggacacctgtccggcgtgcccctgagggcagagcctgccatctcctcggctatgagcgccttcagcctctcgaggagccccgcttctccgagatgcccatcttctcacctgctgcagtacatggatccatccggaccctccgctctattatggtctgtttggcgacaatcatcataggcgagggtccgatacttttggaccccctcaggtcaatcaaggtctaacagagagttcctgaacgagaggctgcacgagcaggctgcagcgggttgctatgctatccgtgcattccctgcccgatgcgtcgaaaggaaatgatatgcgaaagagaacgaacgggatgctcctcgagaaatcgtctgccagcatgcatctgcgcagcctggtgcagggcagcagcgcgcaggcaggcgctttgcgcatctgcgcgggagctcttgctctggcgctcagcgcaaacctcgagattccgcttcagccggtgcccttcacgctccagatcctggcgcttggcttcattgctgcgacgctgaagccgaaggaggcggcatctgccgccggcgcctatgtcgcggcaggcgcgctcggtgctccggtcttcgcgggcggccttggcggcgtctggcgtctggcaggtcccaccggaggcttcatcctcggcttcattgccggcgcctgggcaggatcgtatcttctctcccagctttcgaagacgcgccttccctgggccgcgtcctgcttcctctctcttgtgggtatgacagcggcggtctatcttgccggctgggcacagctggtgcttgtcgcgcagctctctcctgctgcagcattcgcggcaggtgtcgagcccttcgtcgtcttcgacctgatgaaggcaggccttgtggcatcggctcttgcggcaggacgtatcgcggcacgcgaggtgtgccgctaggtccatccgccatatccaatgcagcttgaggcagtccgggcagacgttccgggctgcctttgctatgtatggtggaatgcctgggcatctgcagcctttctgctcttttgcgggctggtgtctcatgggcatagaatcgctgtgcatacatctggacaggaaggtgctggattcatgggcgacatcacggtaggctgccatctctcgacttcgaaaggctatgaggcgatggggaagtgcgcgctcgagatcggcgcaaataccttcgccttctttacgaggaatccccgaggcggcaagggcaaggtgcccgatccggcagatgtgcaggcacttctcgatcttatggagcgccaccagttcggaaagctcgttgcgcatgctccctatacgatgaatctgtgctcggcgaagccggatgtcgtggaatacacacgcgaggccttcgcctccgatatcgaacgcatggaagagctgcccggcaactacctcaacttccatcctggcaaccatctgaagcagggagcagatgaaggcatccgcctcatcgtcgaagggctcaaccaggtgctcgcgcccggacagaagacctgcgtgctgctcgagaccatggcagggaaagggaccgaggtggggcgtacgttcgaggagatcgagcgcatcctcgaaggcgtcgagcacgacgagctcatgggcgtctgcctcgatacctgtcatgtgaacgacgcgggatatccgatagcggaagacctcgacggcgtcctcgacgagttcgatcgggtaatcggcttggaccgcctgaaggcactgcatctgaacgattcgaaaaatcctcttggctcccacaaggaccgccatgaaaagctcggccagggcacgcttggccttgctgccttccaggccatcgtgacgaatccgcgcatctcgaatctgccgatgatactggagacgcccaacgagctctctggctaccggcgcgagatagctgcactgcgtgctcttgctcggggagcctcgctcgacgaggcccaagcgctgctcgaaacggaagacgaggagaaggaagcgccgaagaaggcataggggccgcttttgggcccctcatgaaggcctgccaggatgctcgagaaacgtgggaacgcatggtgtgaaggcgaggcaggctggtgtggcgctggcaggggcattgcgcagaccgatggtcgctgtccatcttctcgggaaggcgtgaggttctatggatcgctccgatacattccgcatcctgatgctcggaaacagcttcacgcgggccaatggcctgccagagcttcttgccgaggagctttcctgcgaggtcgaggtgcacgcgcggggaggggcacgtctcgccgaacagctgaacccgaagacgaagcttggaagccagacgcttgcctcgctcgaggcaggaggctatgccttcgtggtgctccaggagatgagcacggcagctgtggcatcgccggcatccttcgaacgaagcgtgcagaggcttgcctctctggtgcgggcacagaaaggggtgcctgtcctcttcgagacctgggcattctgcgaaggatgcccgcgccttgctgcgcttggcctcgctccatcttccatgcaggatgcaatcacttctgtctgccgcagcatcgcagacaaggatcgtctcgtgctggccgaggccggggaggccttcaggaaacagggctttgccccaaggctctacgggcgcgatggcaggcaccccagcctggacggcacgaagctcgccgcccaggcccttgcctctgccatccgcggtgcgtgagcctcaggagttctggcagaccgtctttccaatcatgatgttcaggatctcgacgtcggtgggatgcatgccgacacgtccgacgtatcccatggagcggatcgtctcttccgtcgtctcgccgatgaggccttcaccgggattgaagtcgacattcgtcaatgccatgtcgctgccgaggatggcggcatcgaccgcagcggcgatcttggcagcacagctcggctttgctccgtcgcagacgatgccgcccacattggcaagggtattggcaatcgttgcctggtactggccgaaggagccgcccctcaggtagcagatggcagcgccagcaccggttgccgcggtcacagcgccgcagaaggcagagagctcgccgatgaagcgcttcgcatggatggcggtaaggtcggagagtgcgacggcacgcagcatctcgtcgtgggagaccttgaggaagcgtgcgtatgctgcgacaggcaaggagcacgtgatgccctggttgcccgagccgcagttgattacgacaggcatgggacagccgctcatgcgggcgtccgaccctgccgctgccgcagcgcgtgcacggcaggagatatcgtcgggacgggtgaggagcagggtcttgccgatgcgggcgccccagtcgcccgagaggccttcgttcgagatctcctcattgagcgtcacctggcgctcgatcatgtccttgatgtcggcaatgtcgaccgtatggacaaactcccagatgccttcaagcgagaggcaggcaagatcgggctctgcttctgcgtcctcttgcgcagcaccttcctgcaccgtgacgccgtcgaccgagactgccttcccatcacgtgcgagctcgacgacattcgtatgcctgcccgagacgcaggccacaccctcatggccttctcctgtcgcgacgacgcggacatagaggttcggcacatcctctgccagggatacatcgcagaagccggaggagacaagctcgcgtgtgcgctcctgctcatccgatgccttggcgccgaagcgcttgcagatcatgtccatgcagaggaagctcacaccagctcacgcagaagccgcagtcgagcgcgaggtacggcagcgagatgagctccttgttcgcaagcaggttcattacaacgacagcgaccgtgaagagcgcaaccgtcgggctcggaatggaacggagcaggacgcggcaatcttgagcgttttctgagcatgagatatctcccggtttggattggcaagcaggtttctacctgggactgcttggagggccgctctcggccgcagaacatggtagcaaagagggctctatcacacggaactccagaaaaggcctgaaagagcattgcctgtaccagagccagagccttccggcatcagcagacagaatgcaggctcgtatagaatggatgcgtccacaacgcaagagaaaggttgagcatggatacagaagagaagaccgaaaaagcggagaacgttcaggccgaagcggctcctgaggacgctgtcctgagaagacggcagaggccccttcgatcgagccctttgccgaggaaatctcgttcgatacatttgccgcatccgatatgcgtgtctgcaaggtgcttgcctgcgaggccatgaagaagagcaagaagctcctgaggttcacgctcgatgaggatccggcaccgagaggcaaatcctttccggatccacgcctacacggccagaagagctcggcggcaagaccgttggcgcaacgtgaacatcccgccaaggagaagatgatgggtctcgactcctgcggcatgctgctttctgccgtctatgaggaggatggcgagcgcccttcctcctcatgctcgatgacaagatcctgaggcgcaaagctctgctagctcccaagctggagaagcgcaatgagactgttccgccatcttttgggagccatgctctcctgcatccttgcctccttctgactctgggcacctgggcctgcagcacgccatctgctgcaccccaggatgtcaggccactcttagcagtcacggtccaggtcgagcatggctcttctatacaagcaaggaggaggtttgtgcctacctccatgagtacggagagctgccgccgaatttcatctcgagacgaaggcgaagaaggcaggctgggttcctcggaaggaaatctcgacgaggtctgcccgggcatgagcataggcggctctgtcttctgcaacgacgacggaaagctgccagacgccgagggcaggactggcatgaatgcgatatcgactacgatggaggcatgcgggggcctgagcgcatgtctggtcgaccgacggcctcatctactacacatccgaccactacgagaccttcgagcagctctactgaggaagaccgatgaagatccggatttcagaggcagacacgcttgccccagacgacgtctgggaccttctgtctgagagcttcggcttcccctcctggttcggccgcaactttgcagcgctttctgacctcctcgaagatgtggcagttccagccgagctcgagatcgtcctggacagccaggatgaagactcgcccggcaccgtttctttgcaacgcttgccaaggttgcctcgcgtgctgccgaggagaatccgaccctccaggtagcgatatatacggtctgagaggagtttctgccatgatcgaaaagcacggcatgtggtatgcgccgcacgaaggcacaaggacactccacatctggcttcctgagactactacgcagacggaaacgaggagcgctatcccgtcacgtattcttcgacgggcagaacctcctctgacaatgaggcaacctacggcacgagctggggctggcagatttcctccgcagctgggagaagccgatgattgtggtcggtctcgagtgcagccatgtcgtaaacgagcgcctcgacgaatactgtccctggagcctgaagatcatggacttcgatgtccacgggaggcgagaagacgttccagtggatcgtgaaagacataaagccctgggtcgatgcgacctatcgtacctggccgcaccgcgaagcgactgccatcgcaggatcaagcatgggcggcatcatgagcgtctacgggtcctgcccacacgatgtcttcagcaaggcaggctgcatctcttcgggctgccatttcatgaaccgcttcttcgtgcctcttgccaacatctcagacatctcctgatacacgggcctacttcgcctgggcagagggagagtccggcaagatctggggagaggatctcctcgaagattcggatgaagccgcagccacgcagaggttgccacaatccttcgcaatgagggagcggcaactcgctctggtgcattccgggaggggagcacaacgaggcaagctgggcgacgcagaacaggcgctgctccgatttcctgtggtgtgcccgcgaggatggaccagacgaagcctgagcaagaacctcagacagttatgcagggggagccaggatgttcagcccgtttcgtgacgagcaggggatgagaaggcctggcgatgtggcatggggagaccttgcccagctccaggagctcgaggaaggctttgccctcgagttcaagcagacattcggcccctcagtgcgccgcaagatcccgaagatcgtggcctcgttctcgaactcccatggcggatggctcatcatcggcattgccgacgattcccgcgaagtctgtcctttgcccaaaggctctgccgactactcccagatcataggcgagctctgccgccaccatgtatcgccggcaccgcgctcgaggtgcgttcctgccaatccccagatccagagaccggcgtcgtacgtgccgcatcgacgagggcgacttcccgccctatgtcgccgacggcattgtcgagatcagggagggctcgacctcaggcctgccgatcggcagcgctggtcgatctctacgacagagcgatgaggagaaggcaggaagtcgagcgcttctgcaggcgcacggtcttctatccgatggcagatgatgcagctgagatgcagcgctcttcgacctctattttccatatgggaccagcggcagaagatgtccatgcccgcaccgccgtgaacgagggcgctgccttcatgcaggaagcctttgcccacaacggcggcgagtgccacgtccagcatgcccatgacagcctcatcttcaggagctcccaggcagacgaatggtgtcccccactctgccatcgagctcttccctgacgcatccatgaagctttcggtccctgctgtcatggtccgcggcaagaagcgaaagagtgcgctcaagacctgcgggaaaagagggcgcctgttcctgatgatgtccgcctatggacgcatcggcggcactccagcgcgtgacgaggatggcatcgctccttgacgcttcgtgcgcctttcgggcctttcctggcaggaatatgctgtagcatacgagctcgagcacatggcaggcgtgacgctctggtcgaaggatccgacctatctctcctacgcaaagacagcacggcatcctctggtgcgcaacggcagacgcctctcgcgcgtccgctatctcgatgaaggggcacacgacaccttccgcgcccgccagtttgccggcagccacttttcgaagcctgcggacttccgcttggctcgcctgactcggaagacactgctctcgtccaggcgctgctctcgacaagccaggacgaggaggcgcaagagcccaatgaagagtgagcgcctcgaagcgcgatttcatggagaaggaacgaaaggcagttcgtttaacaagcctgtagttatcgtgcgctaccgtatcccccaaacttcacaagagcaaggagcatggcatggagcgcacggcccgagaaggtacctcaatatcctgaagcgcgagctcgtctgcgcgcttggctgacggagcccatgccgttgcctatgtggcggcgctggcgcgtgagcgcctgggcacagctcctgagcatctctccgttgcctgctctggcaacatcatcaagatgtgaagagcgtgaccgtgccgaacccggcaaccagcgtggcatcgaggcagcagcgacgctcggctgcgtcggcggcaaggcagaggcagcactcgaaagtctcgaagcgtccgaaa

SEQ ID NO: 50 - DNA, 85764 bp, Unknown
  Metagenome-assembled genome
ccctttcttaaatagccgagctcgctttccgagccttaagtcctatgaacgacccgaccatctttcgatgtgccgtgcgttgcgatgccgatttctttttccggcagaggatttctatctctgaccaggccatgtaggatatggcgcgcggttttcttgcccgattgtctgaggatgattcctcagaggacctaccgccgagacgcccccattccttagaggaggggctctgtcgccgaagacgatgctcctggcctgacccatcaagcacgtattacgtcgagcctctgagttgcaccaatcccttgcagacggaaggtgcactttggcgggtcgtgcgacggacgtgacttagtcaaatcaaaaacacagggggggagggaacaagggggagagggagggtacgaaatcgaacagcatgtgtacacagtgagggtgtgggggggtaccggcgcctagtagtagtaggcgcatgaatagcccgaaagtgacggttcgacgaggacagcccaagcgtatgcgaagggacatcggaagccagcagacctgtagcagacacggcttccacgaagcagaaggctggtgcccgtctctcgagcacctgactctccacaagactgttccggccacagaatgctttctctctgctttttcctcatcgtcgcaatccttctctttgcaatcggccttctgggcaacgcttcttgttgcgctctgcgtgaccataggcgtcgcataggccagatgcttgacggcgaccgaagatcatctcattcttcctgtgcctcatgggtccgaaggatgacggaagatagctggaaaatcgaacgagcaaggagtggatgtatggatacgagacgaaggacacagcaaaggccacgtatgctgctcctgatggacaggagagcatgaccgatacggaagacatcgtggcagcagaggaggatgacaactccgaggattcgctgacgttcagcaacggcgtgatcgagaagatcgtcgccctcgccgtacgcgacgttcctggcgttgtcggcatgaagggcggctgggtgaaccgcgtgcaggatgcccttggtgcgaccgaccccaggaagggcgtgacggtcgaggtgacgcctgatgctgccgtgcgcgtgaacatctccgtcctgatcgagtacggtgcctatgcaccgcagatcttcgaggacgtgaagaaggccgtcgtgaagcaggtcatggggatgacgggtctcgaggttgcaggcgtgaacctgcgcatcgaggatgtcctcacgcctgaagaggtctcccgcaacgcgaagcgcgcagccgaggaagaggcagatgccgatgccgaaagcgaggccgaggcacaggagtccgaggaggatgtggcaccggtcgcttcgacggagcctgccaaggcctaggaagctgaaaagtcagcatctgaacagccgagcaagaaaagataagcctgcatgccttgcatgcaggctttttatatatgatttgtaaccaggcaggtccagtcggttgccaaatgtccccgctgcggtatatttgtcagaaatctggaagcgttgaggaggagctatgagcacatgcggcacccctgcaatcatcgatgtggatccaggtgtcgatgatgcggctgcgctcttcatagcgctgacctgctcacgtctcgatacgtcgcttgtgacgaccgtcgggggatcgatcggcgtcaaccaggcaacagccaatgcgctgaagctcgaggccttcctcggcacccgtgcacttgttgccaggggacgcgacctcccgaattccgagaagcgccactacatgcagccgacgctcggaccgtccggtctgggctcctgggtctttgccgatgaagcatgggacctcttctacaacgtgcctgcgaaggatgccatctgccagacggcgaagagcgcagcagcaaaaggccagcgtgcctgtatgatctgccttgcaccgctcacgaacctcgccgatgcactcgaggcgcaccccgatctgcccgatatcctgggtcccgtcttctgcatgggttcgaccatgggaacaggagatacgctgcagcgtgccggcaggaatgtcgcagcagaccctgcaagcgcgaaggcggtccttgcctccggtctcgatgtcttcctcgtgccggtcgaggtagcggcagcggttcgcatgtccgatctcgatatggccgatatcgccctttcgggccgtgtcggcaatgccgtctatacgatgctctccggtgcccagagcctcgacggcaagggcaaggagattgcagaccccatagcggtcggccttgcgacccatcccgagttcttcacggtcgtgcccggcgagcttgaagtcgaagacgacggctcctgcggcatgaagataggggaggaagcggcacatccgaactgccgtgtcgctacggctatcgatgtgcatgcattccgtgcctggttcaagtgggctctggagcgcgcctcccgctagcggatatcttcagcgcacgctcagctgtgcgcccatttgtgctcctttgccgcttgccctccaatatgcgtcccatctcgcctagagtagataggtcgaagggggatgtggagcttgggtcagacaaggatgcgcgatatctggatcaagtcagctgtgggcgtggctgctgcggcattcctcgttgctgcagcctatgccggaggcggctgggagccgcaggcaccggtctatcccgagccagacgatgcgtgggatgcgcagtgcatcgaggagggcatagaaggccctgcggtcggcaccgatgcgccgaatgccgtgcaggactatttccccgacgagccgaccttcggcatcctttcggacaaccccacgaccgatgagacgcaggacgcaacagaagacggtacggcgactgccccgacatccggaaagaagagctactccacgtatcgtgcgctcgacgagtatctcgatgagaacttcgatgcggctggcacgcctggcataggcgttgtagtcgtcgatgcagcaggagccgagtacgagagaacgatgggcgacatcgagagcgaccacgacacgatgctcataggctcgctcacgaagtcgttcacggccctctcgatcatgcagctcgtcgaggatggcaagatcgacctcgatgaaccggtggcaacctactgcgacgcctatgggacgccggacaatgtgaccatcaggatgctcctcaaccagacaagcggattcggctactacgactcgcttgccgaggcgacgccgggcctcacgcagggcacgttctcctattcgaatgcgaactacgaccttctcggcaaggtcatcgaggctgtctcgggcgaggcgtacgacgagtatgtcgaagagcatatcctggagccgctcgagatggacgactcctcggcgagccttgaggcgcgtgcctctgcccatgcctggaggaactacttcggctggaatgtccaggatggctttgtgcacgaggacggcgatgattcctggggcagctggagctcaggctatatggccacaagcacggccgatatgggcaagtacctcatgatgtacctgaaccagggcacccagaccgctacaggcggcgcccaggtgctttctgccgcaggcatacgccagatgttcctgtcacgtgctgccgacccctacagcgatgccttctatggtatgggctggatctcgttctactgggacgatggggaactcgtgctctcgcatgacggagacgtcgagaacggcgtagcacgcatgatgatcttccctgagcgcggcatcgcgattgctgtgctcggagacgcggcggatgccttcggcggcaatacggccttctacgagcttgcggacggcgtcgtcgcaaatgtcgtcggcggcaaggcagagcctgtgagcgccacggagcgcatcgcgacgcacgcacaggaagatgccttccttgccctcttcgtgctgcttgccgtagctcccatcgtgcgcctcagacgctggcggaaatggatggacaggcttccgcacgatgtctcgctctggcgcctcgtgtgcctccacgtgctggcgcctctgggcatgctctgcatgccagtattgcagggctacaaatggcgggatgtccttacgttcatgccagatgtaagcatcgtctatatcggatctgcagcggtgctcttcctgaccggtgccgcaaagctcctcttcatgctccatgtctggaagaaggagagaggaagagagctggctgcgtaggcgtggcttcttcgagagacgagaaaggcctgccggatcgctccggcaggcctcttccatgccacggggtcttgtggcagcttgcgctagaaccctgcatagatgaaggttgcaggtgccgtgtagcccgagaagttcacgaaccagaagagcagaaggcccattgcgatgatggcagcggcagccccgatataggtcagcgtctcatgggtctgcccgaagtcgagcatgcgctccttcgcggtggcaagcggcgtgaactccgccttctcgtccttcttgctcatagctggatccccctcatatcgtccgtgccggcaccctctgcgtcgccgtagccccagccgccgaggaactcgtcgtcctggccgttcacgaagtggtagacggcgcgctcgatatggacccagccacgccagcccgggtgcacggtatcgcagaagaagtagcgctcgtactcgcagggggagaagtcggcgtaggtggcaccggcagaatctgctacatccctgacgcgggcataccaggcagcacgctggctctcgtcgatgccgacatggtcataccagggtccgtgcatcggcagcatgatcatgagcacgctcatgccgcactcgcgcgtgacatcgaggaagagcgagaggtcggaccactcgctctcggcctcgtcgaagttctggccacgctctgactggtagttcttgttcttctcccagtaggagtcgtagacaccgatctcattgttcgtgcagcgcgcctggccatcggctgtggcctgctcgagccaggcttcccagtcaggctcgcctgtcgggatgccctgaagcctcgtcctgctcttgctcggcgagccctggatcatcttctcgagctcgcttctgatgcggagcgtcttctcctcgtggatctggaggtcgttcagcgtatcgaacggcgtgtcctggttggcagcggcgagtgtatcggaggagatgccgagctcgcgggcacgctcgcgcaccttgtccttcgtcgtctgcgagagcatcgtgttctggcagaagttccgatagagctcgtagttgaacttgccggagaacttgttctgggcgccgccgctcttgaagaaccactgcgggctcacgaagagcatgcactccttgttctttgcatgggcacaataggcgcctgccgcgatggcctgccagaggctctggtcgaacggctcgccgatgagcgtcatgtccacgccggggttactgtctccaaagaccttgagcgcaatctcggggatgaggtcggcattgaaatagaactcggacgtgccgaagcagaagcggccatcgtcgctcatgtttgcgagcacgaagtcgacggcctccgatttcggcatgccgtacacatagtcatagatgcgcgagccatccgccttgttctcgagcttcgggtacaggaactcgtctgcaccgacgagcccggcgcccagggcggcgaggcttcctgcagttgtcttgagtagggtcctacgggtgatcatatgcgtgagtacctcagtcgagccgcttctccacctgcttgatgatgagattcggcgtgttcatctccgagcggtcgacctcggtcggcgcaatcgacacatcgagctcgtcctcgagggcgacaagcagctcgatggcgcccatggaatcgaggtagccctcctcgaagagatcggtgtccatgttgtcggcgacgtcgtcctcgccggagatatcgcagagaaggtcgatgaccttctgcttcacctcgtcgtggctatacttttctgccatctcatgctcctttcacgagcagcgtaatctggccgcagaacagggcgaagccgaagaacacgagagccatcgtgacggcccacgagcagatccggtaccacgtcttgtggcggtgcgtcttgtagaacttggtgcgctcccagctctgctccagagcaagaagcacgccgtggtagaggccgtagaggatatagtcgatcgagagcccatgccagaatcccatgataagcatattggcgatcatggcggtctgggccgtgcgcaggcgtgcgctctttcccttgaaggccttgcggcgcatgagggagcgggctatgcgcatgaagcagaagtcgcgcagccatgtcgagagcgtgatgtgccagcggttccagaagtccgtgatcgaggtcgagaggaagggggctcggaagttcctgggcacgtggatgccgaaggcaaggccggcaccttctgccatccaggaatagccggcaaagtcgaagaagaggtagaggccataggcgatgcagttcctgaactggcgccagatagcgacggcagtgccttcgttgtactggttgaagtactcgggcacccaatacttctcgaagattgtggccagcacgatcttgtagaccatgccgagcatgatgaggagaatcgcgttggcaagcatgccggagtactcgtccttcgagggcacgttgtcgaggtcttcctcaaagcgcctcgagcggtcgatcgggcctgacgtgaaggtcgggaagaagattaggaaatagagatagtcgctcatcttcatgcgctcgatgagcccatcatgcgtctcgacgaggacctgcaccgagcgaaaggtcacatatgagatgccggtgaagccgaggatgtttgccgagaaggcgcccgacaccttgcaggcgacgagcggcacgagcgtgagtgcaagcgctatatggaagcgccgggcgctcttggggtcgccccagaggaagtgcgcacagagaagggaatccgccaggaagatccagcagaaaaggccttccagaggcgtcttcacgaagagagcgaagagcatgaagatcgaggcatacagcccgtatctcctcatgctcctctcgtgcaggccgagataggcggctcccatcatgaggagcgcaaggatgaagaagaagctgaaatcgctgaagaaagacatgcgggatggactcctacgcttgtgcgagcatcttgcggtctatcttagtattcgtcgtgagcggcatctcgtcgagcaccttcacggtcttggggaccatgtaggaagggagattctcagcaaggcgcatgcggatcgcacggggcgtctcgtcttcggtcggctcggggtggtcgaggacgacgaaagccttgagcgcagagatgcggtcgtggcgcttgacgggcacgacggctgccatcttcacgcccttcaaggctctgagcgagtgctcgacatcgccgagctcgatgcggaagccgttgagcttgatgagcgaccccatgcgcccctcgtagtggagcatgccatcctcgtcgaggtgtccgatatcgcccgtgcggaaggagcggaccttgcggccgtcctcaagcgtggcttcggagaaggcatgcgcggtcttctcgggctcgccgaggtagcccttcgccacggtgtcgcccacgatcacgacctcgccggactcgccggctgcgcactcggcgccgagcgggccatcaggctcgtcgatgtgatagacatggagctccgtgccgggacggggatatccgacaggcagcgcatcatcgcttgcgatcatctcgtcggtcatctcggcgtaggtgatggcgaccgtcgactcggtcgggccgtaggtgtttgcgaccacggcatgcgggaagcgcttcttgaggcccctagcggtacggtgcgagagcgtatcgccgcagaagaggaagagcttgaggtcggggaggagctcctcggagaagctcgggtcggcgaggcacatgtccgcgaagggaggggtcgacacccagacgttcatatgggagtccttgagctcggcgaagaggcgcttgaagttcgcggccgactcgggagcaagcgcatagagggagccgccggtagaaagcgcgcccacgagctcgaactcggagaggtcgaaggaatagggtgcctggtccatgaagacctggctgcgctcgcggatggccgggaacgtatcgagccactccatgaagtgggagacgtcgttctcggtgacctcgatgcccttgggctttccggtcgagccggacgtgaagatgatgtattgggtctcatcgcctgtgacccagccctggctctcgttcggcctgagctcggccgtctcgggaagcgtggctgcctcgagcacctcaggtgcgcagatcatgccctcctcatggtgtccggcagctgctgcctcgtccctcgatgtcgcaacaaggatcgaaggggcacatccgagcgattcctcgatctcttcgcacatcgtctcgacgcggctctgcggcatgcttgtgtgcacgggcacgaaggcgtgtccagcacgcaggcaggcaagaagagagcagagcatgtcggggcacttgcggccgaggacgatcaccgggatgcggtcctgacggatgctggcgagcctgtctgcaaggacgcctgagcgcttccagagtccggcataggtgagccgctcctcgccgagcatgcggaacaccggcgcctcagggtggcagcagacctcgatccagatgcgcgccagaaggtcgtttgtcgtcaggtcttccttctcctgtgccgtacggacactctccatgagatgctcctttgtgtcagcagccatagcgcttcggatgatactgctgcatcttaggcgtcctccctaaactgggccttaagcaagataaaacctaaagactcccaaaagacgggccttgaggagcggatgcagaatgcggccgggatacgatagattccggataagagaaagggcatccgtgaagattcttctggcagacgacgagcgcgagctcaggcaggcgctcatagcgatactttcgcatgcaggatatgaggtggaaggcgccgccgacggcgaagaggcgctctacgatgccaagacctcttccttcgacctcatcatcctcgatatcatgatgccgaagatggatggactcacggtgctcaggaagctccgccaggtggggatggatgtccctatcctcatgctcacggccagggctgatatcgatgactgcgtggctggcctcgatgccggcgcgaacgactatctcgtgaagccctttgccgccaaggagctcctggcaaggatccgtgcaatcacgcacacaagccccggggccgtgaaggcgcatccgacgtttggggatatcgagctcgacgaggggaactccgagatcgtctcccacggcaggaaggcgcagctcacggcaaacgagctcaagatcatgaagctcctgcttgcgcacgcagggggccttacctcgatggaggcgatccgccgcgaggtctgggggctcctctccgataccgagccttccgtcatctgggtgaacatctcgaacctgaggaagaagctcaagagcaccggtgccgaagtgcagatcgcagctgtgcgcggccttggctaccggctcgagatgccggagacgaaatgagcacgcacaggctccagcgcctccttttcggcggagcagatccgacggtccgtggcatgcgccgcaaggtcacggcagcagcgcttcttgcctgcacgctcgtcctggcctcggtccttgtcggcatcaatctcctgaactggaacgcgacggtacgcgggctcgataccgagctcgactatctcgaggatacggatggcgagctctcggcgctcctctcggattccgacggctcctcgcctgactaccttatggaagtgccctatgacacgcgctacttcgtcgtcacgctcgactccgaggatgcgccgatcgccctcaacatggactcgatcgcctcggtgcacgatgaaggcgcggtcgagatggcgcaggatgctgtggctgccgggcagccccgcggctttgcagacagctaccgctatcgggtcgtctcgaccgtggggcagacgacggtcttcttcctctatgcctacaacgaccttgcctacttccattcgtttctcatggcatcgatcgcaatggggctcatcggactcgccgtcttcatcctcatcgtcattcccttcagctctgctgccatacgccctgtcgaggaggcgcagaagcagcagcgccgcttcgtgaccgatgcgtcgcatgagctgaggacgcctctttccatcatccagtcggcggtcgatgtgatcgagatcgagaacggcgagagcgagtggacggaaagcatccacaaccagacgaaacggctcgaaggcctcacggacaagctcgttgcgcttgcgaaggcagatgaaggggcagattccctgaagcttcaagatgtcgatttctcctcgcttgcgatggaggttgccgaggacttcgaagcggtatcggcggcgcagggaaagccgttcacgaccgatatccaggaggggatcgtcgtgcgcgccgatgccggcatggcgggacagatcgtctcgatcttgcttgacaatgcgttcaagcactcgcctgatggtgcttcagtcacattctccgtgaaggggacccgcccaggccatgctcagatcttggtcgcaaacgaggcggaagggctcgctcccggtgcacaccccgagctcttcgaccgcttcttcaaggcagatccttcgcgcacctacgaagggggccacggcataggccttgcggtcgtgaaggcggcggcaaaggcccatggtggcaccgccgaggccgtatcggatggacaggcgctcacgatctcggtcgagctctaggcaagccccaggatcttgccgagctcttcgggcgtctcggcgatggcctcggctcctgcgccttcgagttcctcgcgcggcgcggtcctgccccagaggacgccgatgccggggatgccgaccgcatgcgctgcgtcgatatcgtagtggcggtcacctatcatcacggcgctctccgtgcctgcctcgtcgagcacaagcgcaagcgtagctgccttcgtctggggcgcatcgctcctcttgccttcgatgaaggaaaagaagggggcgatgccggcatcctttgccgacttctcgacgaggtgcatccgcttcgagctggcaatcgcaagcatgcgtccggatgccttgagagcttctagcagctccttcacgccggcaaaggctggccacgcctcaggaccgagcgacgaatagatctcgcggtagcggttcgtgatcttctgggcatccttggcgctgtagccgaagacctgggagaatgcctgcgggaagggaggccctatgagctggggcacatccttcatgcgctcttcaggaagccctgcctcccgcagcaccgtctcggctgtacggatgatgcagggcgcggtattggcgagggttccgtcgaaatcgaagacgacgagctggcatgctgctagatctggcaccgtgatggatcctttcttctcggaatgccaaggatacagcaaaggaggcagccgggatatcctggctgcctccttgtgcattgcgcttgcacgcactgcttctctacttctctgcgggctcccacttgcagcggactggagagacgatggagccatcggccttgagcttcttcatggccttgtcgatctccttgcggtcgatgccggtcgcggttgcgatctggcctgcgctcatcggggcgccgttctccttcatcgtggcaagcactgcttcggtgacttccatgtgaggtcctttcgacgaatgcatggcacctctggccatgctggcacctagtatacgatggtgtgaatgcgaagagaagcagaaacgatactagttattgataattttctggctggcagccagcagggaggagcgcacaatgaacacggtcgtcgtctttggcagcctcaatatggacctctcgattgcggcagagcgcatgccgaagcagggagagacgcttgcgggcgaaggcttctgcacgaatccgggcggcaagggcgcaaaccaggcagtcgctgccgcgaaggcaggagcgcctaccctcatgttcggtgctgtcggagaggatgtcttcggatccgcgctcgtggatgcgctggacaaggcaggcgtcgacaccactggtgtgaagaggctctccgacacgagcacgggcgtcgccgtgatcctgcgcacgcagggagacaacaggatcgtcctcgaccatggggcaaatggcctcgaagcgcccgaggagatggcggaagccgtggcagccgcgggagatgctggcgacatgctcctctgccagatggagtgcgacctcgagacgacggccgccgtcctccatgcggcccatgcaaagggcatccgcacgctcctgaatgtcgcgccacccgaaaagctcccctcaggcatctgggaagatgtcgatatcgtctgcgtgaacgagacagaggcagaagcccttgtcggcatcctgccccaggatgaggagagcgagaggcaggcgctctcagcgctctcggccctcggacctgctacggctatcatcacgctcggcggcaaggggtctgtcgcgctcgaggacggcaggttcctcgaggtgcctgctgacaggatctgtcctgtcgatacgactgcctcgggcgacacgtatataggatatctggcccaggggtatgtatctggtttggggctggacgaaagcatgcagcgcgcaacgcatgccgcaggactcacggcgacccgtgtcggggcgcagcaggccatcccgtgtgcggaagaagtggacgcgctcttcgggccagcatccggaaacaggcgataggatggatggttctgagattctggagagggcccaggatgcggggctcgaggatacgctggcagagcttctggcccgttcacgcgacgaggccgtgtcagagatcgagcgtacggtcataggccaggatgcggtcgtcgaggaagtcgtggacctcatgtatgcctgcctcgagcggatgctcaggcgtgccgaagggaccgatgagctcgacctgccgcgtgcctgtgccttcatgcttgccggcacaacggcttccggcaagtccttcctgatgaaggttgccgcgcgtgtgctgaagctgccgatcgtgacgatagactgcacgggcatcacgggcgctggctgggccggagactccgtctcctcggagctgagaagggtcgcccatgcgctcacgcttgcaccgggcacgccggtcatcgcgttctgggatgaggcagacaagctcgtccgctccacctccggccagaaccgtggcttcgatgcgcagggcaatttcctgaagctcctggacggcgagacgatggtgctcgagccggagcagccagggcagaaggagctgacgctcgatacttcgcgcatcctcaatgtcttcgccggtgccttcatgggcatcgaggacatcgtgaagaagcgcctgctcgagaacaagctcacggttgccggcacgaagagcgcccataccttgatggacaaggatgccctctatgcagaggcgaatctcgaggacctcatcacctggggcttcatgcccgagcttgtcggccgctttggcgcggtcgtgagcgtgcctgcgctctctagggctgcgctcagaaagatcgtgaagggctccgagcgctcgctcgaacgcaggatccagaacctcctgggtcctggcaagacgttcgagatcgaggacgatgcggccgatgcgatggcgcaggaagcgaagaggagcggcctcggtgccagaaggatcgaccagctggcgaatcgctatgcagcccatgctatagcaggcctgcaggacccgaagggcccgaacagggcaacgctcgtctgtgccgaggatggcctcgagcttgccttcgaccgtgtggaggagcttgccgaggcgggaaaggcagtcaaagctgaagctgatgcggccacgcccgagacggtcgagctgccgaagaagaacgtctttgcgcctgatgaagacctcgagaagcgcgtgaacaaggctctcgccggcgcccgcttcggcgatgcggcgaagacccgtgaaggacgggagctcctcagccggagatcgctgcctataagggctggcatctcaaggaccagcgcacgcttccagcagcggagctccttcttgtccgtatgggctatctggtcagaggcagagggagtgcgctcacgctcggagacctgtgcctacaaccgctttggatgtggcggtcgcaggctctgtgagctacctcgtatactcttttcggccgtgtggatacctgcggcatacgtgggctcgaggagcgtgccacggaagatgctgcgctcgcgacgcccgttaccttggcggcgctttcagcctataggcgctttttgcctatccggaagccgtgcgcaaggaggtgtgaagcttgcacaggcgcgcgcgcttgcggccatgacctcagagcaggaggcagcgtggctccgctctgatatcaacgatgtcgcggtagcgctcgacaaggagaatccgttcggagacggcccctcgatcatgttctgaagatcaggcagacggggcatcctttgcctgcgtgagcttgtggagaaagcgctgcgagcgccgtcttgccgtgcctgacacattcggtagaggaggagccggcatcggcgatgcgctcctgcgcttcgcggccgaacggctcctgaaatgagcgcttcggcattgtcgtccagaaggacgcggatgagctctgagacggaggtcttgccgacatggcggacaatccggcgctcaggctggtccttgcctgtctggcagagcatgatgtcggtcgtatcggcaaagcgggcgggaatcgttccgtccgcaagagagatggcacaaagcatgggacacttccaagggttctggcagatttctgcgctgttatggtcaggtacgtggataagtacccctaaatcggtctcatgaaaccatgagtcggcaagtgtctgtccggcttgctaatatggaaggccggacgtcggaaggagagcgcaatggagtaccggagcatcttgggaccagatgcaggtgcaggcgagcctcaagagatgacagaggcccttcatgacgggaggatcgattctctgatcggtgctgccgctcaagatccgcgctgggccgaggcacgtccgctcttcctcgctgcgccggcaggggagcgcaccgctgagtggcggctcggcgtcttttcagacctgatggcagaccctgctctgaggcgctcggtcgagtcgttctctcatgacctctcggcgctcctggacgatcttgcagccgtgctcgagcatttcggtccggccacggcagcaagcctcgacgatgtaagccgcttggcgctcctctcctgtgccgagcgctggtgcaccctcgtcgagcgcttcgaagaggcgctccactctgcgcatctcggcgaaggcctgggctcctttgcccgctaccttgcgcgctactgtgcagctgacagctacctgcgcctcaaggacgatatcgcgcatacgaagaagctcctcggctatgtgcagtgctcgcttctcgtcgacgatatgggcatgcgtgtccgcaagtaccagggagagcctgcgctttcccgcggccttgaggacctcatccgcccctttgagccttacgagacaaagcctgagcctgagtggcctgcgcctgctgcggcagatcctgcgatggacgcagcggtcctcgaagccgcctcgcgcgacttcggcgaccagttccgcgcccttcagaccttctgcgaaaggcatacggcctttgccgatgagaagattgcacgctttgcttgggatgtccgcttctatctggcctggctcacgcttacggacaaggtccaggaaaagggcagccctgtctccctgcccacatttgcgggagcagatgatatcgtggagctgaaagacgtctgcgacggagcgcttgcgcttggagacggatgcgtgcctatgacggtgacgcttgcgccaggcgagcgccttgccgtcatctcgggcaggccgcactccggcaggaccacggccgcccgcgccatcatccaggctgtctggtgtgcctcgatggggcttcccgtgctggcacgcaaggcgcatctgccgtatcgcgggacactctcgacgtggatgcaggacactcacgatgcaaagcacgggatggcaggaatccgtggcgcgcttgcaggcgccggcgaagatgccctcctggtccttgactgccctgcgccttctggctctccttcagaccagcttgccttcacagagctcatcctggaagaggcacttgcctcagcagcgtctgtcgtcgtcacggcaggacctgatggtgtgaccattcccgatggacttgcccatgcctgcgcgagctttgccttcgcagacgatacggagcatccaggggcgcgttccttgaaactcgcccgccacgccccctggggcatggagtccgctcatactatggctgagcgctatggcttggggacagagcagctgaaggcacgcatcgccgcaaacaggcagggagctgatgcagagtgaagatccgtcttctgtacgccgaccgcgaagagcggagcatgggcgaaggaccgtttggctggaacgaagcgctcgaggcgaccggcacagatgctctcgtgaagctcatggcacagggggatgtaggcctgaccgctgccgcgaagcatgcgcttgcccacccgcttgccacggcgaccgaggtggcctatcgccaggatgccgtgcgcgacgcgctcgagcatgcacaggccgtgaagcatctctttgccgtctgccagggagaggcagtgcatgcggcagatgctgccggcacctccgatttcctcgcgcttgccgatgtggcggcccagcacgtgcaggcgctctccgagcttgcccaggtcgcacgcgatatgcaccacgacgtgaagtcggtggcgcttcggcgctttgctgacgagatggcagagcttgtggaggaaggctatctcaagagtgcagacgagatgctgcgcgagatctgccgtccctcctctgccctcatgagcgccacgctcgacccggagacgctcaggccccgctacgagctcaggagctatcccaggcgcaccgactggctgcgctggaaggtgacaggtgccgtcacggctgatatcgaagacgatgcagccgccgcagaccgagcaagccgtctcgcttcggccaggcgtgccttggcccccgtgctctgggagtggacaagccgcatggggagcttctttgcggcactcagagacgagcttggcttctacgccgcggcaatcaaccttgccagcgcctacaaggatgcaggatgtgcctggtgcctgcctcaggtcgaggatgtcctgcctgaagagaagccgggataccatgcccatgcgctctcgtatgcggagagcggcagcttccacctcattgcggacgagatctctgccaagggcatctcgtgctggcttgcagggggagcagacgagacaatgagaaggcagttcctctctgcctggggccaggcagagattctggcgctcacgggatttccggttcctgccgaggagctcacgcttccggtagcgacgcaggtcgtctggctctcgtctgagggcaaggatgtcgaagagggccttgccgaggcaggggagaagctctcgaagctccttccgggaagcatcgtgctctgggatgagcccttctcctggttcagccagacggaggcggcagagcttgtctctggccttatgggcaccattgcagaagctggcgccgagcttgtcatagccaccgcgaatccgcatatcggcgccaggaacctcgcgcggcgcggcgtcttccatctgcgcctcgagcagacgcaggaaggcctgcgtgcggtgccgggcaggccccgcgccgatacgaggctccaggacacattcgaagaggtcttcggcgagcgcctggatgtggcgctcaaagccgcacgatagggggatccatgcccgagaagatgttcaacacccatatccagtggacaatcaggaagaaggatggccgcaagatcaagatatacggcgagacgtcgatgcccagaggcttcgagagcgctcccttcccgcgtcccaccatcgtaatggcgcacgggttcggctcttcccataagtccctcgtgccgtatgccgaggtcctcgcccagcgcggctatgtcgtctacaacatcgacttctgtggcggcggacaggaatccaagagcgatggctcctgggaggatatgagcatagagacggagaaggaagacctgctggcggctgtcggcctcatgcgcgaagagccgttctgcgacccgaagtgcctcttcctcttcggcgcctctcagggaggagtcgtctgctctcttgcggcagacgagcatccagagctcttccgtggcatggtgctcctctatcctgccttcgtgctgcatgaggatgcatgcagggcctatccggaaggagagccgctgccggagcatctggaagctctcagccgtcccgtcggtgcgtcctatatcgaggcggcacgccgctatgtgcccgaggagcacatgtcctatccagggcgtaccttgatacttcatggggacaaggatgagatcgtgcctctggcctcatccgagaaggctgccgccaacttcccggcggcgacgcttcagaccgtcgaaggcgcaggccacggcttttcgggcgaagcacagaagaaggcagccgaagctgccttcgatttcatcttccatgtgctgcatgacaaggagaagagcgcctagcaggctgcgggcaccggctccgcgagtgcatgctggatgcgcaggctgtactcgcgtgcatgatggagtgcgaattcgagcgggtgcgcgtcggggaacttcacgatcttggcggtagggattgcctgctcgaccgtgcggatgtcctgacggcggcgcttcctgcttccttcggcgtaccagtactcgacggccgagctgcctccgatgggccccctcggcagctcatagctgtggcaggaggcagagaggttccagacgcttcttgtcgagatgcgctggagcgtgccgcagatgatgccgcgctcctcttcagaggagatgtgctcggccagcctgccgagccccttcggtaccgagagcttggccgcctcgtaggagagatagtctctcgctgcctcgagcttcgatacgatcgaggagccctgatggggaaggacgccctcgtcgatgattgcatgcatgatgcggatgcgacagtcggccagaaggcgcacgacgacagatcctccgatatcgatgccaagagcaccgaggatatcgagatagccacgggcaatgagcccgtcttcaagctcctttgccgtgcgctcgacgctccagaaatcgccgccgtcctggaaatcatggccaggaagcaccggcacgacgacgtggtagcgctcggagagcaggcggatgtcaggaaggagcacgtcccaggtcacaagcctgggctgaaccactagaaggatatcgggagagtctgtcccgaattcatgaaatctcactgcttgtcacctctacatccttgaaagactagacataagaagcgccgagtgcaagcacacggcgctctgcggaagtcttctgtcaggagcggaagtggcggggcgctgccgaaagcggcgactggatcggcagctctgcttcggcttcctcctgggcctcggcggcacgggcatccctgccgaccgtcgaaagcaggcggtcgagggcaaagacgacgtagccgagtgccgcgaagaaggcatagccgcagccgacaagcagaaggacatgctcggggccaatctgcgtgacatcgagcaggggatagggatagcgtgagacgcccgagatctggaagtctccggcaagatcgatgcttgtgccggcaacgaggagctccgtgatcaggagatagatcagaagcaggcaggtccagacaagcggtccccacccatgcatgaggcccttccggtcgaagaggagccagtcggcgacggcaagcgccggaatcaggtaatggagggcgaaaaacgggaagtcccagccgtaaccccagaagggaccgaccttcagaaggaagtgcgtgacggtgcaggtgacgacaaggcacatcgtgagcgcatacttgaggctcggctcgatgacagagccgccacggtcctccttgcgatgcacgaggacaaagatcgcctcgcagagccagtagatggcagaagcggcggcaatgaggacagcgaagtagtggagcccctcgaaatgccaggagccgcttctccagccgaaggtcagggcaagcgccaggacgcacagggcagagatgcagagatgacaagcttcatcaagaaggagagggaagcgtgatggatccgcatgcagaagctcctttctgggcgcggctacgtaagcgagaagggcaggagtgccgcaagacggtttgcaaggtcggaagcgattgccggcaggctcctcatggcatgggcagcaggacggtacgaagaaatagagggccacaagcacgtagcacacgatgcgccagaagagggcagcacgcgcaaagccccgcctgttcatgttcttgctcgcgaaggcaaagatgagggaaggagacaaggcctacgagcggaatggcaaaaagaggatcgtgaatccgatatagccgccagccgtgatgggttcgtcatccgctgagaggaggtgcgtccttgctgtgaaatgtctgggcatagcgtgctcgattctgctgcgatgatgagtgatgagtgatatctaccatataagtcctacttcttccgtgtgggcagtcatcggcagacggcagacgggagcgataccgttacaatggggaaacgagcttgtaagcgatctggcctgcgtggtggagcaggcgccgatgcaaggagagaagcgatgaaatatttcggtacggacggcttccgcggcagggccaatgaaggcctcaatgtcgagcagcgttcaagatcggccgctatgtcggctggttgactacggagcgcgaaccagggcaggaagcccgtgtcgtcctcgggaaggataccgccgttcgtcctacatgttgcgagagcgccctcatctcgggcctcgtggcatcgggcgccgatgtctacatgctcatgtgatcccgacgccgggactctgctatgagacgctcgatggcgggttcgactgcggcatcatgatcggcctcccacaacccctacacggacaacggcatcaagctcgtgaacctgagggctacaagatggacgaggatgtgtcctcaagacgaggactacctcgatggaaaggtcgaggtgccgcttgcgaccggcaatgcgatacggccgcacgatcgactacatgcagggcaggaaccgctacatcgcctatctgatcgcctcctgcggcttcagctccagggcatgagggtcggcctcgactgcgccaacggcgctgcttcgagcgtcgcccgcccggtttcgacgccctcggtggccgatacctacgtgatcaacaattggccctgatggctcaacacaatgtcgactgcggcccacgcacattgaagctccagaacttcgtgatgtacaatcgcctcgaacgtgggctttgcctacgacggcgacgctgaccgtttgcatcgcggtcgacgaagggcggtgtcgtcgacggcgacctcatcctctatgtctgcggcacctaactcaagaagcatggcaagcttgcccatgatacggtcgtcccgactgtcatgtcgaacttcggcctcttccgtgccttcgacgatgctggcatcaagtacgaggcgagcgggctgtgggcgacaagaacgtctatgcctgcatgcgcgagaacgggctactcgctcggcgcgagcagtccgccacatcatcttcggcgatatcgagacgacaggtgtgacggactgtgatgacaagcttgaggctcatggaggtgctgcgtgccgagaaggagaagctctccgagctcacgcgtccggtcaagcgctatccgcagctttcatcaacgtcgaggtcaaggacaagaatgcgtgaggaggctcccgagattcaggaagcagtggccgagggcagagcacttcctcgagggcaatggccgcgtgctcgtccgtgcatccggcaccgagccttgatccgcgtgcttgccgaggacaccggagcaggatctctgccagaaggcgggacgatatcgtgatcgaggcgctcgcaccgtaccgcgtctagcacgaactgaaagcggcaaagaggcggggcctgcatctgcaggcgtcccgcttcatcttgatgctgtcgttgtgatcaggcgccgaccttctgcttcgtccagacaggagtgtcgcggcatcacatcgccgcatcggtctcgttcaggatctcgtggcgcatgtgctcatagatgtgcacggagacatcctttacgccggcatcgcgcgccatcgaggccgcatgctcgacgccccttgccgcagggagccgacggggtcctcggcgcctgccgaagaagacgggcaggtccttgtcccacttcgcgcgaagcagtcaggagagcagacgaagcgggtgtgattgcagaggaccgtcgcatagccgccacaagagaatggaaagccgcaggcagggtctcgcgatataggcgtcgacgttctccgtgttgtaggcagccagtcgaagtcggtccttgcattcttgatctgctttgcataggcacccgtccgagcgaatggagcattcgaggtaggcatatcgccgtggcgccttgccgcctgcacagcgaggccatgcatgaaggcagaggctgcaggcgggacgtgtccgtgccggaaaggatgcaggccttgaggtcagggtcgcggatggtaggtcgcgaggtaggcacgggcaagataggatccggcgagtggccgaagagcacatgcggcacgcccggcaccctctctccatctcctttgccatgcgcctgatatcgtcgaccatgatcttgtcgccgccctgggcaggaagcttgccccagcgctctggagctgcgctctcgccgtggcctatctggtcatggccgcagacgacgtatcccgatgggcaagatactcggcaaagcgctcgtagcggctgatgtgctccgccatgccatggacgatctggaagatggccttcggctcgccttctggccacacgtctttgcgtggatctgggtggtgcgtctgcactcggaaacgtgaggctcttttctgaggcccgcgctcgtggatgtatccattgcgtgcctccctgcaatcgctcacggacccatcctaggccgaagcctctgatgcatacacggaaggctggccagacggcacaaaagacggcgcatgcggaaggaaggacaggtaggaaaaaggcctggaaagagcttccaggccagaaggaaactatgtgggcgtggctaagtagagcgcgaggtcttccgacgcgccgcgtcgtctggtgtacgctcctgcacgtagcggatgaactcgcggcgctccctgtctgtcctgagctttgctgtgtatgccatgtcttcccatatcgtcggcaagggcaggggagatgcggtctgcctcgacgaggcgcctccataggtccgcctgattcggcatccgagtgggacatagcggtggcagtcgcgctgcgaggcatagacacagagaagaacgctcgctgggtcacgtcagtcgcatccttctggaccatgtcggcccagatctggtagacatcgcaggagtgcgcatagttcattatgttcggcgtggttggatccgggcggacgcaggttcacactcgaggccgaacatagtcgccggcatctcccaggccttccttggccttgtcgagccggaagaattccatgtgggtgaagcggctactgatgccaaaggacttgccggcagcgcgggccccgcgtttctggagcatcggatcgatcgcaggaaggcaggtataggccatatcgagctctcttcggcacgcgtgccatgctcctcgggaacccttctttgtctcgaagaggggattggcgtggctggcgaagatggcatcgtaggaggagatgcgtcccgagacgaactcccgacacatagctgcccttcggcctgtctgcaaagaaggtggccaagagctgcatcgtcgcaatcttgcgggcacgagcgagccatgccgacctcggcttcgcagaagagggatagccgacctgtgaggcgaactgctttgcatcgtcgagggtcgaaggctgatctggcgtgctgtcggaatggaccccatcgcatagagcggcttcatgccggccttgctctgcccagacgccatctgcgcggtcgatgctcccgtcacgatatggaagtcatcgcgcagggtgcatcctgcgcgaagccagaattcgtgttgttcgattcgagccagtcgatctttccgatttgtacgagaagaggcgacggcacggagaagcctggctgtagtccgcgagattcggcgtgtagtagtactcggtgagcgagctcttgagctctggtgccagcccgtcattaacggggcatctccgataccgaggacggtgacgccgttttctctggaggctgttgcagaaactgcagaagacaggagggaactgcggggatatgaagacgaaattcatggactacctctgacgaaggcattcaggacccatcagctagcgcgtgcagggctacaggctgtttacagaagaagacattacgcatctttgcaggaagcctgcagatgaaaaaagggcctgtcccgaaggaaaggcccagatgcatgcaaccagatgaagctacttttggcggcgcgtggaagacctgcgggtcgtggtctcttcgtgcgggcttgctgcggtcttggagcgggcggcagccgtcttcttcgctgtgggtttgcagcacttggtgcaggctttgcagcgggctcagctctcttggctgcaggcttgcagcgggagcgggcttttcagccttcggagcctctgccttcttggagcaggctttgcctcagccttcggtgctgctgcaggcttctcttccttcttcggcgcaggagcagcttcttttggcaggaggctgcctcttcggcaagctccttcttcacgtcctcgaggacgatcggcaggaagtagcgcatctgcttcttccaccatggccagtcgtggttcacatcgtagccccagaaatcgcaccaggcactgatgcccaggcgcttgaaggaggcgtccatgtcgcgcaggtcggaaaggccatcttcccaggcaccctgtccgacgcagaagcagagcgagcggtggttgtagaggtcgatgtagggatggtctgccggaaggtcatggagcatctggaccatatcgttcatgtagaggttctcgtccatccagtcgccgaagaagaagctcgtgcgatagacgccggagagcgcgatgcagccctggaagaggtccggacggcgcagcgccgcaatagcggagtgggtagcacccatggagcagccggttgcgagcgggcggaggtcggagccgttcctgtcatggacatacgggacgagctcgtccgtcacgaagcggaaatagtcctcctggcgctgggcacgccagctcttgtcgccgttcgtgttcgaccaggattcctggtcgatggagtcgacgcagaacagctgcacctttccaccatcgatgtagtcggcaagctcggagatcatgccgaagtcctcgtagttcgtgcacttcgagtcctgggtctggaagacgatgatggggtatcccgtcatgccgtacacgatcacgccgagatcttcgccgagcacattgctgtggtaggaaattgcatcgcggtacatgaagcctcctcagatagcacatcaaacgctgcccatggtagcagcacaaatgcctggaagccctgcctgtgcgcatctcataacaacaaatttataaactaacgcacagatatcggcgaatgagccgatttttacgtctacgaaaggaagagctcgaggacaagcacggacaggcagcagacagcggcgacagcgaagaggctctttccccgccaggatgcgtagatgccaagggcaagcgcggctgcgcctgccaaaggcgactccgtgctctggaatatcgccggtactgtcatgactgccaaggtcacataggggacgtagaagaggaaggacttgaggtaggggctctcgatgggcttcctgatgaagattacaggaaggacgcgcagagagaccgtcgccgctcccatagccagcacatagatccacatgttcatgagagggcctcctgcgtcttccagggctggcgctcctgcgcggcatagcggaatgccggcactccgccatgcaccgggaagagccaggctgcagcacctgcaatcgcgagcgtcaggatgatcgtgcgcgtgccgcttgaaagctccgagacgatgggagctgcatcgcagagcatgcttgcggcaaagctcgcggccacgacggcgcagacggccttttcctggtgcgctgccgggatgatcacggcgaggaacatcccgaagagggcgacggagagggcagagaggatgcgtgccggcaagacattgccgagaagggcgccaagggcactgccgagcgcccagccgggaagcgccggcaggaaggagccgaaggaataggccgggcagaccttgcccggacgggcgatcgtgagcgcgaagagctcgtcggtattgtcgtaggcgatgagcatgcgctgccagagcggcgtcttcgcatcgaagcgctgggcaagcgcggcacccatgaggatgtagcgggcatttgtgatgagggtcaccgctacgagctcgagcacggctgctccctgggcgatcgagaaataggcggcatattctcccgccgaggcattgcagaggaagcttgcgacgagcgactgcagagggtcgagcccagcccctgctgcagagatgccaagcgagaacgagacggcaaggtagccaagcgcaatcggcacgccgtcatgtgcgccctgccagaagcaagatgctgtccttgccttcgatgcgcttctctgagctgctgctgtcttttccatggtgcctccctgcgctgttttgcatacttgtacgcctcggcaaaccataagtaaaacgattgtatgtaatggcataataagcagagctaatgaaaggagcgccatgagagcatcgcgtgcaggggtgtgcgtaagggttgccgagaaaggcagcttcacggcagtggccgaggagctcggctatacgcagtctgccatatcgcagcaggtacggtcgctcgaagaggagctgggatgcacccttctcgaaaggcgccgcgacggcgtgcggctcacgaaggatggctcggtcctcatgccctatctcgaggccataagccatgcagaggatgcgctctcgcgccggcagcgggagctctcaggccttgtcggcagcgagatctcgatcggcacgttcacgagcgtgagccgaaacatcctgcctcccctcatgaaggagttcaaggaagtctggcccgaggtccatttcgtgctgcgccagggggagtacacctcgattgcagactgggtgcgcgaaggggagctcgaccttggcttcaccgatatggaggatgcagcaggcctccagcgtgtgccgctcctcgcagacgagatgatggccgtcgtgccgcatgggcaccggcttgcaaggaagcgcacggtatcgctcgaagaccttgtggcagagccgctcatcgtgctcgacgaaggcgaatcgtcggtggctcttcgtgccttcgagcatgctggcatcacgccgaatgtcgaatatacggtcacggacgactattcgatactgcagatggtgagggaagggctgggcgtcacgctcctctatgagctcatgctctcgaactacgatacgggcctcctcacgaagcatgtgcgggagcgtccgaagaggaacatctgccttgtctggcgttcggacgagaccctgcctctggcctcgaagcgctttgcggagaaggtcatatcctcctctgcaagctcgccttacccgttcgtccgtctggtccagagctgaaagcgcagtgccaattggtgcctgatatggcatgcaagcggcttttcctgcaaggtttgtgatacggtctagctagctttccgcaagcttgaaccatccggaagggggaatccgtgtccaagagattcacgatcaagaaccaccggaccggttccgcagcacatgtgctcgatatcttcgatgcagaggggcacattgcctacaatgcgaagatacagcttgcaggcggtgtcgaccatatgatgctgcaagatctgaatggcaacgagattgcacgctaccgggtccgtgccttcgaggagcgcggcatgctcatggtgacgatggcggacggcgtgcgctttgcggcaagcttttcaggcgtccaccatacgccgcatctttccgtgccggactacggctggaatctcgaccgctcgcctgtgcgcgggatgtatcacatcacgaacttcaggggtgacaagatcgcgacggtcgtgcgtggcgaggaatctctcggcagctatgtggcaacgatctccgactgccgccacacggacgagcttcttgtgctcgtgcttgtcgtgcgcttccttctcgagcatcgctgaagtgaagaatgcgcatgatggcaagtctttatgcgcatggatgagagcaagcgtcggaattctcaggaatgtgtggccgtcggccgctccattcccaccgctgccgattggggtggaaaggatgaagcgtttccattaggctcgaaggtggcgcggctccaaggcagacattccggatgcagggaagtggtcacggatggcaatattctcgacagatcaggtgaaggacaagatcgaagcgaagcagcatgagctcggcacggtgaagcagagcatcgagctggatcatgaagagcttgccatgcgcgacgatatccggaagaactccgaccagatgcttgccgaatatgcatcacgcgagaaggagctcgaagcgacgcttgcccacgagcagaagcttctggggagcctcgatatggtgagaaggccgttcaaggagatgaaggccgagcttgcccagggcaagagcgacttcacgaaggacgagcgggcgacgcaggagaagaatgcgcgagcgctcgaggaagccgaagagaggcttcgctccttcgacctcacgcacacggagaggctctcggacgaggagaaggagcgccgctgtggcctcgccgaggatgtgaagctcaggaaccaggcgctttcggctgccgacgaggcgctcaggcaagctgagaagcgcttcgacgagagccagaagcccgtctacgacaacatcgctgccgtcaagaacaacctcgaccgccaccagaaggccgtccaggaggcccagatcgagctcgaggacatcgcgctcaagcgcgcctatgtgacagactgcatcacggacaacacgggagacgacgagctccacagcgtgatccgccgcaaggagaacaaggcagaggccatccagaaggagatcgagaagctcgagaagcagcagcacgcccatgagagcctgatccggttcctctgggcgtgcctgatcgtgtttgcggccttcctgatcttcggccttatgcatgtgctgggagactagcgcctcttgaaatagatgatgagctggtagacgccgaagacaaggcagccgacgccgaggatgacggcggaccagaagtcagggccagagaaggtctggttcatgccgtaataggcaaggatggctgctgtcgcaaagcagacgacggcatagccgatgcggcggctcgtgcgcttctggcgcctgccgcgctcgagcacctgctcgctttcggagagcttcggctcctctgccttcttgagggccgggatgaagctcaggtagaaatagcccgacgtcaggatatagagccctgcgaagagggcaatgccgatccagagcgaggtcgtagcaccgaagatcgctgcaagcgagaccgcgaagatcgtgcgctggcggtcgaagaaggcgagctggcgcatcttcgactcgggcacatagtagtactggtggagatagtcgttgtagtagacattcctgccggacttgtccaccctcacgacgtcgtcgagctgaggcgaggctttcttcgtcgccgagccggtcgtggtctttcctttcgccattccaaacctttctgtcctgtccaggctgtcgggcctgtctgctaatatgggtacatccgttcgaagaaaggagctccgtggcaggcacgcagaagcgctatctgtgcatagacctgaaaagcttctatgcctctgccgagtgcatcgcgcgcgggctcgatcccttcactaccaatttagtggtagcagaccccacgcgcaccgagaaaacgatatgtctggctgcttctccggcgatgaagaagctcggggtcccggggcgctgtcgcgtgttcgagattcccaaaggcatcgattacatcatggctccgccccgcatgcgctactacatggagaagtcggccgagatctacggcatctacctcaggaagatcgctccggaagacatcttcgtctactcgatcgacgaggccttcttcgatatcacgccctatctgtcgctctatgggatgaccgcacgcgagctcggcgaggcgctcaggagcgaagttgcaaaggagacagggatcaccgcgacctgcggccttggcacgaatccctacctcgcaaagattgccctcgatatcacggcaaagcattcggatgacttcttcggcgagctcgacgaggagagcttcagggcgacgctctggaaccataggccgctcacggacttctggcgcatcggccctggcatcgcgaggcgtctcgccgagatggggatacacacgatgggacagcttgcgcatgccccgacagagccgctcttccgagagttcgggaaggacgccgagatcttgatcgaccatgcctggggcgtcgagcccgtgacgatggcagatatcaaggcctacaagccgcaggcgcattccctgagctcgaaccaggtcttcggctgcgcctatgacgcagaggatgcgctcctcgtgctcaaggagatggcagatgcgcttgcccagcggctcacggaaggcggctttgttgcaggcggcatctcggtctttgtaggctatgcgatcacggaggaggagcgcgaatatgcgcgggagagaaggcgcctccaccgctatggccccggcgcttcgggctcgatgtccttcctcgtgccgacaagctcctcaaggaagatccggcaggcggcagaggcgatcttccacgaccgggtggatcccgagcggcagatcaagcgcctcggcatcggtgccttcgaggtcgttcctgaggatgcgaagggcgcgcagatgagcctctttgctgaagaggagacagatgaaggcgagctttcgcgccagcggactgtgaacgatatcaggcagcgcttcggcaagaatgcgatcctgaagggcatggacctcatgccgaaggcgacagcgcgcgagcgcaacagccagatcggcggacacagatcgggagatgagaacgatggggtcgaagacgtctggcgcagataggccagggcgcatccgctatgggcatccgtccatgagcgcagcagagcgggcaaagatcttcatgccgttcgatgcgctgccggaataccggggcctcctcaagaagaaggaagaggagatccgcgacaggcagaagcgcggcctcatatgagaagagcctgcttgtgcaggctcttcgtcaggcgttcatgagatggtggcgggcaaaccactgggcaagagagcccgacacaagggcatcggcaaactcgtctttcggcacccagcgggcacggtcgacctcgcggttgagatggaagtcttccgtcctggcccggcagacgaagttcgagatcagcgtgttcgtgcgggcatagaactggcttgcattgaagcggaggtccgagacgtcgagcgctgtctcctctttgacttcgcgcctgacggtttcctcgaggctctctccctgggagacgtatccagccacgagcacgccgtgcttgccatactggtcgattgccaggatcctggtcccgtcaggggagtagacaatcgtgctgatggcagaagaaaatgctggatagcgccatgcattgcaggtcgggcaccacggctccgggccgtcttctggctgctccttcagcacgagctcagatccgcagatgctgcagtagcgctcatgcggaagcgcgatgccgtcgttgccgtgccattgaggcagcatctcttcttctgccattacagggtctctccggccttcttcggcctgccgtcgaagtccttgccatgggtgatggattgggctttctgagcatcgaagccatcatcgaggaagcacttgagatcgcactgcagctcgccctgcgtgccgtagtagagatcccagaagcttgccgtgtgctcatggcccgtatagggatcggtccacgtctgatgctccctgttctcgaagacagaggaggcttccttccttgccctgtgtgccatggcccggtagagcgaatggcggcggtgcaggacattgacctcgatcgcagaggcgatctgggacttcgcatcggtcaggtgcggtgccctcatgaggcgcatgagggtcctgtgggcattgatggcgccagagaagagcgtgtgcggcacgacgagcccatagaccttcaagagcatgtagcgatacatcctgtcgcagatgccgaggatgcgctcggtggcatcgaggcactcatgggccgggtggaaggtctcgacggtcttgccggacttcgtgtagagcaccatctcgtcgaggtcgcgctcgacctctgccgtgacgactttcgcatcgcgctcgtcgaggccttcgacgcctgcctcgcagatgccgcgggtccagcttgccacaaacggtccgaccctcgaatcgagctcgaagtggctgatatagcctgccacataggcacgtcccgtcggcctctcatggtctgatagataggcaagcgagcccttgaaggcggcgatgcactcctcgatcttctccgtgtggaggagcttcgcgatattgcggtattccttgaggcgcggatcgagatcgagcgactcgaagggatcggggccctggcagcccagaagataggccttgcgctcctcatcggattcgctcttgagcgagttcgctgccgtgaaatacatgtcctgcccgtagaagtagtgcgtgatgatggctggcatgcagaagccctcctgtcaatggtcgtctggccttgtcgcactctacagtatcggacatacacgggctccgtggcgccggatgcgtcgaaaaagcactaacctccgtgtgcggcagcaagaaagggcataaggtcctgccgcctcctttctgcgctggacactcagaagaggagatgtccggcaccagacacatgaaagtgcatctgtatgaaaggttcgagcagctcagatgtgccgtgcagatgctggacagaagcggctgaaagattcatggggatagctgggatttgggcagagggcagcatcggcgcgagcagcgccgtgggcataatgaagcgagaagacagaagctgccagatattcagatatctgcattgcagcatttgcatgaaggatctccggctgaaaggcggccatgctcgaactctcccatatctccaagtcgtatacgaccggcacgttcacgcagaaggcgctcgacgatgtgtcgctcgcattccgtgactgcgaattcgtctccattctcggaccctccggctcgggcaagacgacgatgctcaacatgatcggcggcctagaccacttcgacgacggcgaccttctgatcgacggcatctcgacgaagcgctaccgcgaccgcgactgggacacctaccgcaacaacaggatcggcttcgtgttccagagctacaacctgattccgcaccagacggtccttgccaatgtcgagctggcgctcgcgctctcaggcgtcggagcgtccgagcgcgagaagagggcgagagaagcgctttccaaggtcggccttgccgaacatgccgacaagaagccctcgcagctctcgggtggccagatgcagcgcgtggcgctagcccgtgcccttgtgaacaaccctgagatcgtgctggcagacgagccgacaggagctttggactccgagacctccgtccaggtcatggatcttctgaaggaggttgcccaggaccgcctcgtgatcatggtgacgcacaaccccgagctcgcacgccgctactcgacgcgcatcgtagagctcaaggacggcacgatcagatccgataccgacccttatgacccgtctcttgatgccacgcacagggctgcaaagcctccccgcaagactgcgatgtccttcctcacggcactcggcctctcgtttgcgaacctcatgaccaagaagggaaggaccttcctcacggccttcgccggctccatcggcatcatcggcatcgctgcgatcctggcgcttgcgaacggcgcgaacggctatatcgaggataccgaagagaagatgctcacggtctatccgctccagatccagggcacgagcttcgatatcacgtccgtcctctcgtcggtgaatggcacggcaggctcgtctggctcatctggcagctcctctgatgatggctcttccgattccggcatcaaggaagcgccgaccatcacgaacatgttcaagagcgtcggaaagaacgacctcaaatcgctcaaggaatactttgacgccgatggcggaggaatccgtcagcatgcccgcgccatccagtactcctacgacgtgaagcccgagctctacctcgagaatgccaatggcacggtcacggaggtgaatcccgagtcttcgttcacgcagctcggactcggtgtctcctcctcgatctcctcgagcatgacctcgcagacgagcgcgttccatgagctcatggacgataccgacctcatcaagagccaatacaacctcgtggcaggtgagtggccgcaagctgaagacgagctcttggtcgttctcaggcctgatggcacgcttcccgatctcgatgccttcgagctgggccttcgcgaccacagccagctcgactacatggtctcgacgctcacgaacgccgagagctcctccaccgaagagtccgcgatcgatgcagaaagcggagcgagctactcgacagacgatatcctggcggctcacctcaagcttgtctatccgaccgacatctatgcctatgacgagcagtacaggatctggacagaccgctcggatgatgcggacttcatgaagacgcttgtctcgtctggcaaggacatccatgttgtcggcatcgtccaggcaacagattcctcctcttcgctcgatccgggcatctactacacgagcgccctcacgaaggatgtgatggcacacgcagcagatgccgacatcgtgaagcagcagctggcagatcctcaaaccgacgtcttcaccggcaagaccttcgccgaggaggcggcaggcacggcaggggaggatatcgatctctcgaacctcttcaatgtggatacggatgccctcaaggcctcgttctcgttcgatacctcgaagctcgacctcgatctttccgacctcgacatgtcgtccatgcggacgcccacgatcgatgtgccggcactcgacctttcgtctgtcgatatgtcttcgctcgacctttccggcatcgatgtctcctcgctcagcacggacgagatcaaggagctccttcctgacttctccgatatcgatgtgcgggagctcgtctccggcctcgatatcaagttcgaccagacagcggcccaggcactcacagccgagcttgtgcgaggctggcaaacctacatgcaggagcatccagacgcccaggtccaggactacttcctcctcgacagcacgaagaaggagatcgaggacggcgtacgcaagatcgtgaacttcgatgagatcgagagccagatagagcagcggctctccggcatcgtcgacgagaagatccagagctcggtcgcaaaggccctggagtcccaaatcgtgtcccagctggcaagccaggtggaaagccagctcgaggcaaagatcacaaccgccctcacgtcctacatccagtctgccttctcctctgtcatgcagcagacctctgctgctatcgagacccagctcacgagtgccctccagacaagcatgggcaggcttcaggcctcgttcccgaatgcgatctcggtcgatggggacaagatcaagagcgccttcagcctcaatatcgacgagacgcagctcaaggagctcatggccggcatgctctcgaactcgagcgccagctacgacgacaacctcgcaaagctcggctatgccgatcctgcaacgccttcagagatcgacatctatccgggggacttccaggacaagaacaaggtcatagagatcctcgacgactacaacgaccagcagaccgatgaggcgaagaagatcagctataccgatatcgtgggcacgctcatgcagtccgtgacccatattgtcgatatgatcagccgcatcctcatcgcctttgtctcgatctcgctcgtcgtgtcttcgatcatgatcgccgtgatcacctacatctccgtcctcgagcgcaagaaggagatcggcattctccgcgcgcttggcgcgagcaagcacaacgtgagctctgtcttcaatgccgagaccgtgatcgagggcttcatctctggcctcatgggcatcctgattacgctaggcgtctcggtcccggtcaatgcctatgtgctttcggtctacgatgtgccgaacatcatgaggctctcctggcagtcggcattagcattgatcggcatctcggtcctgctcacgttcctggcgggcctcatcccgtcgaggaaggcagcccatgaagatccggtcgaggcgctgagaagcgaatagactccgcagacaccccttgtctgtccgtccggagatggcatattgcagccatgccgcccggtgcttcacccttgagatggggagagcgccgggcggctctctgtgtggagtgtgcagaaagctttgcatctgtcttgtcagatgacatgacagctgccatactgccaactcggcgctggatacgagaggggattcatggacacgaagaccacaggcacgatggctgcgcgcatcgccgagctcaagaaggagcaggatgccgtcatccttgcccactactacgtgaaggactctgcacaggaagtggcagactatatcggcgactccttctatctgagcaagcttgctgccggactcgactgcaagacgctcgtctttgctggcgtgcgcttcatggcagagagcgcaaagctgctgtcgcccgagaagcgtgtcctcatgcccgagccgaaggctgactgcccgatggcgcacatggtcgtgaaggagatggtcgataacgctcgtaccgagtacggagacgacctcgctgttgcctgctatgtgaactcgacgaccgagatgaaggcatggtccgatgtctgtgtcacctcctcgaatgccgtgaagatcgtgcgcaggctgccccagcaccacgtcctgttcattccggacatgaacctcggccgctatgtggctgaccaggtgccggaaaagcatgtgatcctgaacgacggattctgcccgacgcatgaggcgatcgagcttgccgagatcgagaagctcaaggccgcgcatcctgatgccgtggtctgcgcccatcctgaatgcacgccctgggtcgtcgaggcagcagactatgtcggttcgacctcaggcatcatcaagcgcgtcgccgaaggcgaggagaagtcctacatcatcgctaccgtgattggcgtccgccgcacgatcgagcagaagatcgccggccagggcaaggagatcttcttccctgagacgacgcccatctgcccgaacatggcaatggtgacaggcgagaagatcctctcgtgcctcgagaccgggtcgggcgaggtcgaggtcgatgacgctgcgaccgagggcgcacgccgtgcgctcaggcgcatgctggagcttgcgaaagactaggagccatggaaacagaagagactatcgaggcggcccgcacagcagagccgcaggacgaatcatgcgatgtggcgattgcggggtgcggcgtcgcaggactcttctgtgccctgacgcttcctgcctccgcccgcattgtcatgctctcgaagggcacgctcgaggaatgcgattcgatgcttgcgcagggcggcatctgcgtccagcacgacgataacgactacaaggcattcttcgaggatacccttcgggcaggacactatgagaaccgccgcgaatccgtgaagatcatgattcaggagtcgcgcccgacgatcaagcgcctcatcgactacggcgtggagttcgcacgcacttccgatggcagcctcgcgttcacgcgcgaaggcgcgcactcacgcccgaggatcctcttccacgaggacatcacgggcaaggagatcacgacaaagcttctggcacaggtgaagaagctcaaaaacgtcgagattctcgagaacactgagatggtcgacctcatcgagcgcaaggaccagaatggtacgccgtactgcgcaggccttgtggctgtaaggcgcgacggcacggtgcttcgcctgcatgcgcaccatacgcttcttgccacgggtggcatcggcggcctcttcacgcacagcacgaactatccgctgctcacgggagacggcgtgcgcatcgcaaaggagcacggcgtcgcgctcgagcataccgactacatccagatccatccgacgagcctctggacgacgaagcctggcaggagcttcctgatctccgagtcctgcaggggcgaaggcgcggtgctcctgaacggcaagatggagcgcttcaccgatgagctccagccgcgcgatgtggtgtctgctgccatccacgaagagatgaagaaggaaggcacgaaccacgtctggctcagcttcaagaacatcgatgagcagacgatccgccaccacttcaagcacatctacgagcactgcctcgaggagggctacgatatcacgaaggagcccatccctgtcgtccccgcccagcactacttcatgggcggcatacatgtcggcgaggattccgagacgaccatgaaccatctctttgcagcaggcgagacaagctgcaacggcgtgcacggaaagaaccgccttgcctcgaacagcctgctcgagagccttgtcttctctgcccgtgctgcaaagaggatgatctctgaccagaaggaattcggctcctggatgctcgagccgaagaagacggcacctgccgcacccaaaaggaggatcgagatggacgagaccatgaagcaccctgccgtgggcgagccgaggccgctcacgccgagctatcagaagggccacagcatggatacctcttcgctgggcctcatgattgacaaccacatcagggaggcgcttgccgaggatatgccctacggcgatgtctcgaccgaggctgtcatgccccgtgcccgccgtgcccgcgtgcagctcatctgcaagcagcagggcatacttgccggcatcgatatctacttccgcgtctacaagctgctcgatgcctctgccgtgatggtggcccgtgccggagacggcgacgaagtcatgcctggccaggtcatcgccgaggtcgaggcagatgtaagggcactgctctcgggcgaaaggaccgccctcaactacctgcagcgcatgagcggcattgcaacctatacgcatgagatggtgcaggcgctccagcaggcaggcgccaaggcgacgctcgtcgatacgaggaagacgacgcctggcatgcgctacttcgagaagatggcagtgagaatcggcggcggcacgaaccaccgcttcggcctctctgatgctgtcatgctcaaggacaaccatatcgccgctgctggaggcatccgccaggctgtggcagcagcgaagaggaggagccccttcatctaccgcattgaggtcgagtgcgagacgattgcccaggtgaaagaagcagtcgccgcacacgctgatgtcatcatgctcgacaacatgacgcacgagcagatgaaggaggccatcaagatcatcgatggccgtgccctcacagagtgctccggcaacatcacgctcgagaatgctccccagatggcagatctcgggatagactacatctcgagcggggcgctgacgcattctgccggcatcctcgatctcagcaacaagaatctgacgatgctggagtagaagcgatgggaatggacggcgcagcaaggcgcaggcagatcgtggcggcactcgaggggagcgcgcgtccactctctggcaaggagctttctgacatgctccgggtgagccgccaggtcatcgtccaggatatcgcgctccttcggcatgaaggccacgagatcgtggggctccatactgggtatgtgctccgcgaggagaggaaggggcttcgccgcctcatcaaatgccaccacaccgacgatcagctcgaggacgagatggaaatcgttgtcgatgccggggccacgatggaggacgtgatcgtgaaccacaggacctacggcgtcatctcggccccgctcggtgccaggagcaggcgggatgtccagggcttcctggagggcatccattcaggggtatcttcgcccctcatgctcctcacagatggctaccacttccaccatatcagcgcgccttccgaggatatcctcgatgcggtcgaggagaagctgaaagaccgcggctatcttgtgccgatcgagacatgggagagagacgatatcgagagccacgcgaagcgctagaagctgcataggacagatgaaaaggaaggccagggcgtctgccctggccttcctgctatcgatcgggatttgtccgccggctcgcttacgcctttgcgtgcgcgtctgccgggaccttcagcatgaagatgaagccgacgacgaaaagtattgcaatcgagaagacgccgaggtttgccatgcccgtgagctgcgtcatgacagcgacaatgagcgtgcccatgatgtcggaatacttgccgaagatatcgaagaagccgaagtactcgttcgagttctccttcgggacgagctttgcgaactcggagcgggagagcgcctggatgccgccctggaagaggccgacagccatggccaggatccagaagtcgatcgcggtctggagatggaaggcagcgtagaacgtgatgcagccgtaggcgacgatgccgacaaggatcatcttcttcgtgccgaccttcgtgccgagcctgccgtagatgatggcagaggggaaggcgacgaactgcgttgcgaggagcgccagcagaagctgcgtcgagtcgatgccgagctgggagccgtagctcgtggcgaggtttatgatcgtgtggacgccgtcgatgtagaagaagtaggcaatgatgtagtagagcatcggcttgtttgcggcgatgctcttcatcgtcttgccgaggccccgtattgccttcgagacagcatggcgctcgagcggcttgtaatgcgtctggtcgacgtttctgagcatcgggatcgtgaacgcgagccaccaggctgcagtgacgatgaaggagagctgcatgcttgcgcggacggagatgccgaaggggagcaggagcacgatggcaaggcagcagatgaagggcacgcacgagccgatgtagccccaggcatagccctgggaggagacctcatccatgcgctcgtctgtcgtggcatcgacgagcagcgagtcatagaagacgagcgagctgttcagcatgatcgaggagatgatatagatcacgaggaacggcagccacgtcgtggggatgccaagggcacaggtcgcgatgacgcctgtgccgaccgtgccgatgatgaacttcttcttcatgccctgcatatcggcaagagagcccaggaacggcatgaggagggcaatgacgagggaagcgatcgtctgggcgtagctccaggcgacaagcgcgtttccttctgccaggctgttgaaatagatcgggatgagcgctgtcgagagcaggacaagtgccgagttgccgacgtcgtagacaatccagctcttctcgcgtttcgtgaatttctgtgccataggtcttccgccttccaccgtgtcgtgcacggtccctctcaagcaatgggatagactcatgtgccgtggactttctagcgaaatgcgcgcctccgcatccggagatgtgcgttggggtagaaaacccatgaacacagtacggtaacgtcttaccggactgaaggcctgaactggtaagcggcaggtcttgtttcggtaaggaccatgtgaggagcttccatgcctgcaataatgacgcacgatttcttcggcaaggacgtctacgacgagtgcttttcgacgatcggcatgacggcagacgagcgcgatgcgttccttctcggcagccagggaccggacccgctcttctacaccctcatcgatcctgcgctcaaggacttccgcaatgtcggcgatgtgatgcaccatgagaggccgacgtcgctcatctgcgcgatgcgcctggcttatgaggcgctcgacagcagcgaccttgcaagcgggcgtgcctatgcgctcgggttcctctgccactatctcctcgactccgcgatgcatccgctcgtctatgccgagcagtatgcgttctgcgatgctggcgtcgaggggcttgaccgttctgccggctcctatgtgcacgcagagatcgagcgagacttcgacgagatggtgctctatacgaagcttcaccgcacggtccagatctacaagccctaccgcgaggtgctgcgcctcgacgagccggcgctcgaagccgtgggccgcatgtatgcgctcgtgctccagagcgtctatggcctctatgcgccgcagaacctctatgtgaaggctgtgcatgacttccgcgtcgtgcagcacctgttctattcgaagaatggccagaaggcaggagtgctcggcactgtcgagaagcttgcgacaagaaagccgtattcgctcgagcgcgcgatggcgcaccgggcccgcgcggaggagacgagcgacttcgacaacaggggccacgcttcgtggacgaatccgttcacgaagaaggagtcgaccgattccttctgggacatctatgacgcagccaggaagcgcgcttcgtctgcgcttgcgctcttcgccgatgacagcttcacgctcgcggaggcagcagagctcacggatagcctcaacttctcgggccagccagcggaaggttaagggaataaattatgtgtgtctctgttagaccacagttgacatgcagctctcctgctcccaccagccccagaagggctgctccttgtcggtgagcatcctgcgggtgttgtcgtatctgccctgcgccgcctggcccgcgccgactgcagggcgtccgacttgcgcgcctgctccgtccattcgaaccaggcaaggtagtggacgaggcgcctggtggatatgccgctgaacttggcgaggaaccgcttgagcctctggtggagggcattcacgagcccggccgccatgggaccctgcgcccgcctcggaggatacggaggatgcgccgagcccaggcagcacgcgggcatagcctgtggccatcggtctcgaccggggagccgtcgaatgaagggagggaggattccagctccctgtccgtcggcctgccgcggcccaccgccctgcagaaggagtcgccgaggctgttcgcgccgcacacgatgacaccttctgttcgagatgccgcgctcatgcacggagcctccgtgcctgtgcgggccctcggcatcttcacgcggccctcttccggtttcctgagagggattgtcgaggcaggtgccgtccacctgccaggatatggaggggcccgtcctgaagggctgcaggcccttctccatcacctcgcatatccgcatcctcatgaaccaggatgtcttgagggagacatggcaggcagccgcgcatgccctgaggctccctcctgcctgcagcacctctcacgtacagcccccaggtctccggagggagcttggagagggcaaggagccccatcgtcttcctggagaaggtcctgccgcagcccctgcagagccacctctgcgagccatccctgccatgcccttgcgcacgaaatcggcggacccgccacctctgggcacgccgccggggcatcgcctgcaccgaatccaagctccctcgccacggccgccttggtcgcctctatcagcctgcgcttgtcgccaagcgtgagctcctgcatctcatggagcatggtgtcaatcatcctgttccccgcttgctggtgttctgtctggcgactgcatcatacgcggggagcaggacagtattgacgccatgtcatgtcatttctggtctaacagagacttatgtgtctgggctcggacggatacgccgagcggccatataaatccgtgagtggcggcaccgtcttacttgacaaggcatctacctgcactttttctgacctgtcacaagaaagagatgccagaacgagattgtcgtgtttcgcgaagggtgcttagggtatcatagacaacgcgttcttaagggcgcaggtatcgcgcgcaagcgcactgtgttttgccctgtcagggcaaatgaaagaaaggcacgtcatggctcaaggtactgttaagtggttcaaccccgacaagggctacggcttcatctctcgtgaggacggcgacgatctgttcgtccactactccgagattcaggtggatggcttcaagaccctggacgagggccaggctgtggagttcgacatcacgaccggccagaacggcaagctccaggcttccaacgttcgcaagatctagtctcagacaagacatatctttgtgatgccaagaggctcctcttcgaggagcctctcgtttcatataaagagggattgtgctgccagacgtttccgacctagtctgttccgagcgggatgtcgcgccagtcttcgagatagatgtcggcaatgcggcgtacctcgttcgtgtcctggagggcatcgcctgagcagacggcacaggtcgtgcagccggcacggtgggctgaaagaagggcttcggcgaggtcctcgaagacgatgcagtcagatggtgccacaccgagcctcttcgctgcctcctcgtagatgtcggggaaggccttcgagcgtgcgacctcctgcccatagaccttcacggggaaccacttctggatatcgatcctgtgcatggactcgaggagatcgggcgtgttggtcgttgcgagcgcataggggatgtgcgctcgctggagcgcttcgaggtactctgccacgccgggcctgagcacggccttcgttatgtagagcgcccggctcatgcgcatccattcctccacgatatcgtccggatcctcgtcgaggtggtagcgctcgaccgtgtagcgtgccccctcggcaaagcccagggcagagagctgccggggaaagtcgaccgcatagggtatggcgcgctttgcaaggaaggcgcggtccacctcctcccagagagacgccgtatcggagacggtgccgtcgaagtcgaagatggcggccttctcggggagcggccagagcatctcgggcgctgccggcgccagagctttcttgtcaggcgaagatgaactcacggtaatgaccttccgcatatttctgctttgctgcgttcagtatcgtacactgggatggttcagagacgatcgagatgtgccttgaaaggagacatcacatgtcagcagaacctacgcgcgcagaagtcgacgcctatgtggatgaggtatgggacgacgtgatccgtgacatcgactatctcgtgcaggtcgaatccgtagaggatctggcgcatgccgatgaagagaagccgttcggtccgggcccctatgaggcgctcaaacgtgcgctcgaagttgccgggcgcctaggactcgagccgcacaattgcggcggccatatcggctatgcggaccttccaggggcatctgaaaagcagatagcgacaatcgcacataccgatatcgtgccgctcggcacgggctggcataccgacccgctccatgtgacgaggaaggaaggctaccttctcggccgcggcgtcctcgacgacaagggccccttcacgctctcgctctatgcggcacacttcttcgcacgcaaggaacagctttcgggcgagcaggtcccgtacacccttcgctgccttgtcggcgtgaacgaagagacgaacatggaggatgtcgagtggtatctggcccactacccggagcctgatttcctgttcacgcccgatgcagacttcccgctgatctgcggcgagaagggcctctacggctgcgcgttcacgacagcaccggttgcccagcgcatcgtctccttcgatgccggcacggcctccaacgctatccccggtgtggccgagctggtgctcaaggccgatgccgacaagcttccggcagcagagggcatcgcgatcgagcctgcaggcgaggggcttgccaagctcacggctcacggcaagggcggacatgcctcgatgcctgaaggcacgaagaacgctatcggcatgctcgtctcctatctcttggcaaacaatctcgtcgagggtgacgagcgcgagttcttcgagttcgagcagaagatctttgcggcaagcgacggatcgggcatgggcatcgccacatccgacgagaagttcggtgccctcacgagctgcggtggcgtcatccatctcaaggacggccgctactcccagacgctcgactgccgctatccgacctctgtcacgggcgaagagctcgactccaagctcgagacgctggcaaagagcttcggcgtcacattccatcccgagcgcaaggtcgagccgttctacacggacccgaactcggccgagatccagacgctcgtcaagacctacaacgagttcacgggacacgacgacaagccgttcacgattggcggcggtacctatgcccgccacttcaagaacgcctgcgccttcggcccgcacgactcccgcatggagacgcctgagtgggtcggcatcgagcatggtccggacgagggcatcctcgaggaccagctgaagctcgctctcaagatctacatcgtgagcatcgcccgcctcatgaatctcgacctctaaggtctcaaggcacagacgcgatacgaagaaggccaggacgtgcgtcctggccttctttcatgcatgccggatctgatgctagcggtcgggctctccttcgagcgagcggctgatatcgagcacgacgtcgtcgcctgaaagcatcgcaagcacatcgacgaagttcttcgcgacggggaagacctcggcatcgaaggcagcgcgcatcgcaaggacgaaggcttccgagacttcctcggtcggcgctgccggcacattgtgggaggcgagcacgtagtccacgtcctcgtcggtctccatctttgtcatctctgtcggcttcttctgggagagcgagttcaggttcatgacggccatgaggtaggaggaggagacgaagcgcgtgcacctgcgccacgaggcggcagaggccatctcatctccgatctgctcgaagatctgggcaagcgctgcataggcattgccaagcgtctcggggtcgtaggcgtgctcgagaagaaggatgagcgtctctttcgctccttcgaggtcgcccaaggcggtctgtgcctgcgcatggaggagataggcagaggtgtccataggcgcgagcaccatcatcgatgcgctctggcgccttgcctcctctgcctcgcctccggcaagcgctgcctgcgcaagcatgaggcgcgcctggtagtaggcatcgggcacaaggatggtcttctgcccctcgtttgccatgaggcggttgaagagcgcacggtcgcagtagcttctgaagaagcggtgcaccgaggtctcggtatccgcgaggctgtgtgcgccctcatagtccctgagagcgtctctgaggattgctgcggcatctgagtactgctgcttgcgtgccaagccttcagcacgctccacggcgcgtgtgagggcgtctcccgagatgaagtcatcctcgatggagagcgcatctgaagaatccaggcttccatcgatgatgtggcccatcgtgcgctttgcagcatcctggacgccttcgtcctccatgtctttcgtgacggaaaggatggcatggactgcttcctcagcggtcgtgccgaggttccttccaatcttttctgctgcctggatcctggccgtgtcctcgttgatggcaaggcctgagacatggtcgcagccgagcgcctttgcagaggcgccgaagatccttctcttcgaggtggcgactggctcgtagcggaatgcggggcagaagcggacgtccgaaagagacagctcctgaggtatcggattcagggcttcggacggtgcatccatgtgcgcatcgaacgatgcgaagacagcccagggatccgagatctcttccatatcgaggagagcaaagcggttcctgtcgaagtgcaccgtatagaggcagctgcgcttcgtgcctgtcgtctccatggcagagacgaatacatcctttacggcaggggagcagcggaaggcgcctgcggcaagaagaagacctactctcagcgcatactggcttgcttcgcgggcacgcatgaactgcgtcgtcggcacgaccctgccgaggccatccacccaggcgctcctcgggaagcaggcggcaggcgtcgcttcgagctcgaagagcacccgtccctcatgcatgttcacgcggtatcctgcctcgagcctgtaggggaggcggaagctctcgagctctgtcgctatgcccttgcgcactgcccactcgccgtcagagaacggctcatcgagggtggggagcttgtccgagatggtcgggacctgcgaggtgatcgagcgggcgacgctctggttcgtgcggaagcactccctctccgtcaggggtgcatcgtccttgtggaatcctgttgtgaagagcagtgcgttgagcgctgcctcgatgcgaacgagggcaagcttcgtcccgaaggggacgcgcggctgcatgacgcggagatagaagagatggctcctatggagcagcacggctgtcgtctggggaagctcaatgtccttgtcgaaaaggcctgcctcctcgagcatgcgggcataccagagctcgagctctgtcggcgcctgcggacgggtctgcaccttctgctgctcgtctggctggctctcgccgagggcggcggccttccgggtcgcgatgtcgccgacctgggccttgagctctgctatcgcatcttctgctccaagaagcctcttggtgatcgtttctgccgtgagcgtggagagcggagtcgccggcgcgctcggggcaggggcgggcacctctgccttgcgttcggtatctgtatgctgctcgtccatgaaatgctcctttgatgtgcacgtacctcctgcatcgccctgtgccatgcctgctgcggcggccccacagaggacagctgctgcagctgccgctcctgcggcaagcgcaggaagcgcggaggcaagccctgcctgggcaagtacggtggcgcagagtgcaagcacgacgaagagctgggctcttgccgcgagcttttgcgtgcgcctctccatccaggcctcccgtctccttctggagcgcagagaatgcagatgctttttacctaccccaccgtttggaatggcatacgcgggatggcatatcggacctgaaaacgtcgcagagcgtatactgattggaaatatggagaaagagggattgctgatgggcgaaacagagaagcgctatctcgagacggcgatagctgacgacgatatcgtatatggggcaacgcagatcttcgatgcgctgtcagatttcacgcgcttccagatcctctgcgccctgagcatccaggaccgttcggtcggcgagctccaggagttctgccatgtctcccagtcagccatctcgcaccagctgaggcttctcaaggaccgtggcatcgtcgcttccaagcgcgatgggcagcggatggtctactcgctcgacgacgaccatgtggcaacgctcatcgaggtcggtctcgagcatgcaggccattaccgctgcgaaggtgatgacggagaagacgcctagcaggaagcggcgtccaaggcaggaagcctgagcggcatgccatccacgtagagcggatgcggctctcccgcgatgaggggacgggcatatctcaggtatgcatcggtcacgtgcatgccatctgctgcaatcatggaggcaggaacggtacgctcctcgtttgcgacatcggcgattgcgaccgtgccgatcttcgtctggtagggaagagagctcacgcgctcgatcgtgcacatgatgcccgtggagccggcaaaggcagcacgtacggcggcggcaccgagacccctggcctctgcgaggtcggttgcagaagcgcaatgcgttgccgcgcgctggagggtcgagagctctgtgccgcgggtcttcacatggagctcgcgcttcaagactcctgcgaggtagcggcaggtgccggaaagcgctgcctcatggccgaaggcatcctttgccgccttggcgccgcccgcttcgcagagaagcttgcccgaggcatcgcgcacgccttcggaggcggcaatcacgacagtgttcttgtgctcgaggagcgaagcgacacgttccacgatgtgctcttctgtctgcggcacctccggcaggaggacgaggtcggggcaggggagctcaggagatgaggcaagggcagctgctgcggcgagccagccggcattcctgcccatgatctcgatgacctcgacgctcttgaggtcgtagacggaggcgtcacgtgcaatctcgccgacagcggttgcaatgaacttcgcggcgctgccgtagccaggcgtatggtcggtggccatgaggtcgttgtcgatcgtcttcgggacgccgacgaagcggatcgggctctccttctcggcaccgtaggctgaaagcttcgagattgtgtccatagagtcgttgccgccaatatagagcacggcgtcgacggaaagctcgtcgaagagggcgaagagtttctggtagggtgcctcgtcctcctgatagtccgggagcttgtagcggcaggagccaagatagctggcgggcgtgagtgcaagaagctcgagtgccttggcatcaggggctgccgcatcgaggtcgacagtcctgccttccaagagtccttcaatgccataccgcatgcccagggtatgggcgccggcttcgcgggcacaggcgatgacgcctgcaaggcttgcattgattgcggcagtggggccgcctgactgaccgacgagaaccgtgcgcttcttccccatggtttggatccttcctgagagtctgctcgtgccttcattgtagctgacacagagaacggctcccccggcatgccggaggagccgccagcgtatctctgttggggcttttaggcctctcctgcttcctgcttcatcgcaagctcagggtcgatgccggaaagcggtcggatgaagaggccgcttctgagcttcggctcgaaccaggtcgacttcggaggcatgaggagtcctgcatcggccacgcgcatgagctcgtccatgctcgtggggaagagcgagaatgcgcagcctgcatcgcctgctgccttcgaaagagcctctgtcccctcgatgccgccgacgaagctgatacgggggtcacggcgcgggtcttcgatgtggagcacaggagagaggaacctgtcctggagaagcgagcagtcaagcgaggcgacagggtcctgctcctcctctggggtgagggtgagcgagagcctataccaggagccgccggcaaagagggcaaacgtgtggcgctcttcaggttcgggcgcttccgtgaagggtccctctgcggcaaagccagcatcctttgcagcggcgaggagctcgtctgccgtgagccctgccgtgtcctcgacgacacggttgtaggccaggatcttgagctcggaggccgggaagaggacggaaagtaccaagttccagggagccttggagcttgcgttcggatgctcttcgcggcgggcaagggccaccttcacggcgcttgccgcacggtggtggccgtctgcgatgtaggcgcagggaatctgctcgagcatggcctcgatcgcatcgacagcgtcctggcgggcaaccctccagacggtctggcgcacgccatattcgtccgtgaagtcatagagcggacgtcccgacatcgcagcattcaagatgattgcgaggaccggattgtcgcggtaggcaagaaataccggacccgtctgtgcatcgagggccgcgatatggtcgatgcggtccttctccttgtcggcacgggtattctcgtggcggcggatcgtgccatcgacgaagtcatcgaccgcagcggcacagacgatgcccgtctgcgatcgtcctgcctgctcgagcctatagaggtagtagcacttcctgccatcggctacgagcgtcccgtcctcgatgcgctcgtccaggagcctcttggcctttgcatagacctcaggggcatacatgtcctggtcgggcccgaaggcggtctcgggacggtcgatagcaaggaagcttttcggatgcgcctcgacataggccttggcggaggcgcggtcgaagacatcgtagggaagggctgcaaatgtcgccgccttgtcaggcgcaggacgaaggcagctcatcggataggcatgcataggacggaatctccttcgctaggcagtgcgtgccggcttgatgacacggacacggtagatgccatcgatcttggaaagctcatcgacagtgccctcatcgaggggcacatcggtatcaagcagcgtgtaggcatgcgctccctgtgcttcgtttgccatcctctggatgtttgccgtggcattgccgaggatcgaggagatcttgccgatcatgcccggaacgttcttgtgcagaagggcgacacggccgcctgccttgcaggggccaaggtcgcaggcagggtagttcacggagttcctgatcgtgcccatctcgaggtaggccttcatctcgccgacagccatgtgcgcgcagttctcttcggcctcgttcgtgcaggcgcccatgtgcggggtaatcgtcgtgcgtggcatcttcgtcgtcttcggcgtcgcgaagtcgcagatgaacttgccgagctggccggactcgagggctgctgccacggcgtcctcgtcgataatgtcggcacgggcatagttcagaagcatcgcagaaggtgcgaggagcgccagctgctcggtcgagatcatgtggatcgtgtcttccttcgcgggcacatggagcgtcagatattcggcgccacggcagaggtcatcgaggctctcgacgcgcttgacggagcggtcgagctgccaggcatgctcgacggaaagatacgggtcgtagccatagacatcggcaccgagggcgacaagggcattggcgaccttcgagccgacagcgccgagtcccacgacgccgaccttcctgcccatgagctcatggcctacgaaggccttcttgttgcgctctgcatccttcacgatgttggggtcgtccgtgtggtcctcgacccagtcgatggagccctgggtgtcacgggagttcacgaggatcatgccgacaacgagctccttcacggcgttcgagttgccgccgggggagttgaagacgacgatgccgcgctcagcgcactcctcgagcgggatgttgttgacgccggcgccggagcgggcgacgcagcggaccgaaggcccgaagtcgaggccgtggatgtcggaggcacggaccaggatagcatctgccttgttgatgtcgtcggtcttctcgtagccttcgccgagctcggccacgccgtctcgggtgatgttctttgcgatgttgtcgagcacctttacatagcgcatggatgcgttcctttcgaatctatgagaaatcaggctcttatgcgtttgcctgctcgaagtccttcatgtaggcgatgagggcatccactgcctcaggagagacggcattgtagcagcttgcgcgcatcccgcccaggatcctgtggcccttgagaccgaccatgccgcgctccttggcgcctgccacgaaggccgcgtcaagctccttggagccggtcgtgaagacggcgttcgagatggagcggtcctcgggctttgccaggcccctgtatagcttggaggagtcgatctcgtcgtagagcttgttcatcttggtccagttgcgctcgcccatggcctcaaggccgccggtcttctcgacccagtggaacaccttgccgcagagatagatgccgaaggtgttcggcgtattgaggagcgagtccttctctgcctcgacgtgccagtcaaggtactgcgggcagatgtcggcgcgtgccggtgccttctcgaggaggtcgttccggacaatcaggaccgtgacgccggcagggccgccattcttctgggcgcccgcatacagcatgccatagcgggagatatcgagcgggcaggagaggaacatcgacgagatgtcggcaacgatatcgaccgagcccgtctccggcagctcctttgtcatcgttccatagacggtctcgttctggcagagatagacatagtcgaggctctggtcgacggggccggaaatcgttgcggtatggtcgaagtgcgtctcctcagaggaggccagaaggtctgccgtgccatacttggcagcttccttgtaggccttcttcgaccagttgccagacacgatgtagccggcatggcccgtgaacatgaggttcatcggcacgcctgcgaactcgagcgtggcgccgccctgcaggaacaggatcgagtagttgtcaggaatgcgatagagcttcttgagggctgccttggcatcctggaggatctcttcgaactccggagatcgatggctcatctcaagcacgctcatgctactgccctggtagtcgagaagctcggactgggcttcctggagcacactctcgggcattgctgccggacctgggttgaagttgaacacgcgagccatctacatgctcccatcgttcggcacctgcgccaaggcacagatgcgccctcctgccgaagcagcgaaggcgagatgtatagatgcgaacactgtagctattcagtctgatacagctctgcaaaaagccggaaattatctcaactgttaccaagtgcatcctgctggatagcattcggctgacatttctgtagcaggttttccctccattccggcacgcataggggccgcctccggaaacggcgagaaattggacgcgctcttcgggtagaaagaatgcatattggttgttcgagataaggagctgccatgtccggattcgatgcattcgatactgcgcacaagatcttcctggcaggcgtcggtgccgttgccaccgcaagcgacaagagcacggagatgctcgacgatctcatccgcaagggcgaggagaccgtgaagcagggccaggccttgaacgaggaactcaggcaccgcacgcgcgacgtcgtggacggcgtttcggatggtgccctgaagtcgaagatcgactccatgtccgatgaggagcgcgacgcgttcgtccgcaaggtccaggagatggcagatgcggcgaaagcctcccatgtgaaggtcgacgtcgatgtcgaagacgccgagaccggggacgcagacagcaagacggagtagagcgtggcagattccggaaaagccggagcaagctccaagaagacagatgaagaggcagccgcagagggcaaggacgtctacgagggcataaaggatgccgccttcgaagagacgatagggcttctcggcggccgccagggcggatatgagagcgggacgcgcgcctcgcgcaggaagcgcatgggcgagattcttgctgtcgtgcgcaagtacgacatcctgcacggcctcacgccggtgacgctcaggaagatgctcgaagagctcggccctacctttgtgaaggcagggcagatcctctcgatgcgctccgagatcctgcctgagccgttctgccaggagctcacgaagctgagggccaatgtcgagccgatggacagggatgccgtcctttcggccctgaggtccgaatatacgataccgattgaggacatcttcgatgcaatcgacgatgtccccttgggctctgcctcgattgcccaggtccacaaggcccgcctcattaccggcgagcttgtcgccgtgaaggtccagcgcccgcatgtgcaggagacgatggcgcaggatatcgatatcatgcgccgccttgcccgctatgcctcgcgcttcctccccgatacgcaggtgctcgatctcggctccgtcatcgaggagctctggcattcattccgcgaggagacggacttcctcgtcgaggcgaagaacctcgaggagttccgccacaacaatgcgaacgtgaagttcatcggctgccccaagccctacatgaaatggtgcacgcaccatgtcgtggtgatggactatgtgaacggcataccaatctcgaacacgaagcgtctggccgaggatggctatgacctgaacgagatcggcatgaagctcatcgacaactatgcccagcagatgctcgacgatggcttcttccatgcagatccccatcccggaaacatcatcatctcaggcggcaagatcgtctatatcgatctcggcatcatgggcaggctctcatcgcatgaccgcgatgcgacgcgcgagatggtattcgctgtcgcagagaggaactcggcacgtctcaagaacgggcttctgcgcttcgccgtctcagatacgagcaaggtcgaccatgcacagctcctggaggacctcgatgcgatcatcgaggactatggtgcggcagatctggacgacctcgatatcgctgccttcatgaactcactcatagctatggcaaggaagagcggaatcgagcttccgggcacggtcacgatgcttgcacgcagccttgtcacgctcgaaggcgtcgtgaacgacttccttcctggtgtctccatcatcgagatcgtgaagaaccatatccgtgcgcatgagacgccgctcgactttgtgcagaaggaagcgaagacctacgcgcgtgaggccgaggcagcctcccatggccttctcgaggcagcatcggaggcaggccttgccgccaagatgcttacgcgcggccagctcaggatgaagctcgacttctcggacacgacaagcccgatatccgatctcgctgctgcagcagaccgcttgacgatgggcatcgtcgtggcgggactcttcatcggctcttcggtcatctactatgcccgcatccagcctgtcatcttcggcatcccgatcatcggcttcgtcggcttcttcttggcgctcttcctgggactctggattgtccgcaacatcatgaaggagcgcaagcagaaccggcgctgagctgagcagacagagcgtttcatgaagaaggcggccctccgaggagagccgccttcgctgtgtctttcagcctctgtgctagcttacgacgcggtagccgaccgtgccgacaccggagaagccgaggacagatgcgactgcaggctgcatgtcgatctggcggttgccggagtaggggccacggtcgttcacgacagcggtgacggtcctgccgttgtaggtgatctcgatgatcgtgccgagcggcatcgtcttcattgcgacgcccatggatgtcggcgtcagcgtatcgcccgaagccgtcgtgccatacatgaggccatcgccctcgccgtacatcgatgcctcgacgtaggtgtagctcgcggctggcgctgcgctcgaagaggaagaagacgaagaggcgggagcggaggcttgggggacagagctctgggaggaggtgtcctgctgctggctctgggaggacgtctcctgtgcctgcgtgctcgtctgagcagaggagtcggaggagctgtcctgtgttgcctcttggatctcggtcaccgttgcatcctgctggcccttggcctgctcggcctcataggctgcttcctgggcagcggcgttctccatggccttctccttggcagcctcgatggcagcatttgcgctgtcataggcatccttggcggcctggaccttggcttcctcgtcggccttctgctgcgagagctcggcctgcttctgcgtgagctcctgctgagctgcgacaagatcgttcatatcgttcgtcgcattgcccacgatgtggttcaggtacgcgagctgcgtgatgaagtcattgaacgtgtcggcagaaagcaggagggccagaagggagttctggtcctggtggatcttgtaggacgtggcgatagcgttcgaggcgtttgccttgagctcggggagctggtcttcgatctcctcgatgcgggcctcgttgtcgtctatctgctgctgcaggctgtccagctcctgctgggcctggtcgtactgctcgccggccgcgatagcggcattctggagcgattcgaggtcggtgtcttcagcaaatgctgccacaggcaccgaacttgccacgagggcagccgtgatggctgctgcagcggcatggcgaaagaatcttgcaggtgttcgcatctcttctaacccataatctcgtcggggaccttatcaggtccgtttgcagatctggaattggctgattgcgcagtgctacttctcgtcaattcatgttctctatactactcccgaagccgacatgattggcgattatccagctaaaggccacaagttgcaaaaatggtgtctgccacatgcacaaaatcatgcatattggtggacaccttatgcaaagcgctacctgaatgctatcagaacaggtttctggaagcctattcgaaggcctctgctgcgcgctcgagccagctcatgcacttgatctgctgagggcaggcgcgctcgcactggccgcagtgaaggcaggccgaggcaagggtgccttccttcgttgcatcctcatagcccttcttcgcaagctccgtctggccccagacaagctcgcggttgagtgccgagaagatttccgggatatggatgtgcacagggcagcccggcgtgcaatagtggcaggccgtgcagggcacctgcttgatctcggcgagcgccttctgtgcacgcccgatcgttgcctgctcgtcatctgtgagcggcttgaagtgctccatataggagacgttgtcctccatctgctgcatgtccgacatgccggaaagcaccgtgatgatgccgtcaagcgaggcgacatagcggatggcccaggaggcgagcgacgcttcgggctcggctgccttgaggatatcggcgacctgctgaggcggcgctgcgagcgttccgcccttgataggctccatgacgacaatggacttcccatgggcacgtgctacctcgtagttggcacggctcgtgatggatggattgtcccagtcggcgtagttcagctggagctgcacgaagtcgacctcggggtgctttgtcaggagctcgtccagaagctcaggcgttgcatggaaggagaagcccatgtgcttcacgaggcccttttccttctgttcgtgcacgaagtcccagatgtggtagtcgtcgtacttcctgaagttcgaggtctgcagggcatggagcaggtagtagtcgaaataccctgcctgtgtgcggtcaagcgatgtctggaactgcttcttgcaggattcctcatccgtgcatgccgccaatgcgttgatcttcgtcgcaagcgtgtaggaatcgcgtggatggcgctcgacgagcgcctgcctcgctgcatcctcagagcccgtgtagacataggctgtatcgaagtaggtgaagcctgccgccaggaagcggtcaaccatctgcttcgtctgctcgatatcgatcgtgccgtcctcaagcttcggcaggcgcatgaggccgaaaccgagcttcgggacatcctttccaaagtactcgctcatgattttcctctccttgtagttcccctgcgaccaagatacccgcgataagagactatatgaaaggagccgggccatctgcccggctccggacgctctctggaaccctcggctattcgagctcgaaggcgccggtgtagagctggtagtaggtgcccttctgggcgatgagctcgtcgtgcgtgccatgctcgatgatgcggccatggtcgaggacgatgatcacatcggagttcctgaccgtcgagaggcggtgggcaatgacgaaggtggtgcgtccctgcatgagggcatccatgccgcgctggacgatctgttccgtacgggtatcgatcgaagatgttgcctcgtcgaggattatgacagggggatctgcgacagcggcgcgggcaatcgagaggagctggcgctggccctgggaaagggaagcggcgttgtccctgagcatcgtctggtagccctcaggaaggcgcgtgatgaaggagtcggcgcctgcgagcttggcagctgcgatgcattcgtcatctgtcgcgtcgagcctgccgtagcggatgttgtccatgacggtatcggtgaagaggttcgtgtcctggaggaccatgccgagggagcgcctcaggtctgccttcttgatcttgttgatgttgatgtcgtcgtagcggatcttgccgtcgtcgatatcgtagaagcggttgatgaggttcgtgatcgtcgtcttgccggcaccggtcgcaccgacgaaggcgaccttctggcccggcttcgcatggattgtcacgtcgtggagcacgatgtgctcgggcgtatagccgaagtccacgtcgtagaggtcgaccttgccctcgagctgggtgtaggtgacagagccatcctcgtgcgggtgcttccaggcccagaggtcggtgcgctcgtccgtctcctcgagcgagccatccttggcgcgcttggcattgacaagcgtgacatagccgttgtcctcttcaggctcctcgtcgagaagcgagaggatgcgctcggcaccggcaaggcccatgacgacgaagttgatctgatgggagacctggccgatcgatcctgcgaagcgcttcgtgaggttcaggaacgggacgatgatgtcgatacccagaaccatgccggagatcgaggggttcgggatgccggcgacaaggaagatgcagcctgcgagggcgacgatcacgtaggcaaggttgcccgtgttcatgaggatggggccaagggtgttgccgtagatgttcgcgttcttcgaggcctggaagagctgctcgttcaccttgtcgaagtcagtttcggtcagcttctcatgcgtgaagaccttgataaccttctggccgttcatggattcctcggcaaagccttcctcggccgcaagagcacgctgctgcgccaggaagaagtgggcagagcggccgccgagcacacgtgtcagggccatcatgattgcaaccatgaccaggacgacaagcgtcagcggcacggaataccagaacatgatgtagacgacagagaccatggcaatgatggtcgtcaagaggttcgggagcgactgaccgatgaactggcgcagggtatccacgtcgttcgtgtagtgagacatgatgtcgccgtgcttgttggtgtcgaagtagcggatcgggaggtcctccatgtgagagaacatctcgttcctgatcttcatcatcgtgccctggcagatgacggcgccaagctgcgtccagccgatgttgcaggcaagggcggcgacgtagcatccgatgagcgtaaggacgatgcgcagaatctggggctgcgccgttgcccagtcgccggtctggaacgtgtcctcgacgacggcgatggcctgctgcatgaagatcgaaggcaccgaggcgatgatggcggctgccacgatgcagaggatctggatggtcacgaggccagggtagtagtggaagacaagcgacatgatgcgcttgaacgttgtgccgggattctgtgcaccatggccgcggcccggtgcctgctgcttcttggttgcttcctcgctcacttcgtggcctcctttcctgcttcggcatccttttcgaggacgcccatcttctcgtcgtgggactgcttgttctgggtcatgtagacctcgcggtagatgtcgttcgtgcgcagcagctcgtcgtgcgtgccgatggcatcgatttggccgtcacgcatgacgacgatgcggtcggcatcctcgatagaggaggtgcgctgcgcgatgatgatcttggtcgtgcttgggatgaagctcctgaagccctggcggatgaggcggtcggtcttcgtgtcgacagcgctcgtggagtcgtcgaggatgaggaccttcgggttcttcaggagggcacgggcgatgcagaggcgctgcttctggccgccagagacattcgtgccgccctgctcgatataggtgtcgtacttgtcagggaagcgctggatgaactcgtctgcctgggcaagcttgcaggcctcgagcatctgctcgtcggtcgcattctggttgccccagcggaggttgtccttgatggtgccggagaagaggacgttcctctgaagcacgacggcgacctcattcctgagcgtgtcgagatcgtagtcgcgcacatcgtggccaccaaccttgacggtgccttccgtcgcatcgtagaggcggctgatgagctggatcaaggtcgacttcgaggagccagttccgccgaggatgccgatgacctctccgctcttgatatggaggtcgatgtccttgagcgcggggcgctctgccttctcggagtacttgaagctcacgtggtcgaaatcgacggagccgtctggcacctccatgatcgggtgctcggggttggcaagcgtcggcttctcctgcaggacctcgcagatacgcctcgaggactcttcagccatcgtgatcatgacgaagaccatggagaacatcatgaggctcatgaggagagagaagccgtaggtgatgagcgcggagagctggcccacgcccatggcctgcgactgggtcgtgacgatggccatcgagccgaagtagatgacgaaggtgtagatgatatcgactgccagcgtcatgagcggcgtgttccaggcaaggatgcgctccacgtgcacgaagtcatgatagagggtgccggaagcctcattgaacttctgcttctcgtaatcctcgcgcacataggacttgacgacgcggatgccggagacgttctcctcgacggaatcgttcaggcggtcgtacttgcggaagatgcggcggaagatcggcatggctgtaagcgcgatcttgaagatggcatagccaaggaaaaaggcgacgatcacgtagacgactgccatggggccgccggagatgaatgccatgatgatggagaagatggcaagcatcgggcagcggatggccatgcggatgatcatcatgtaggcctgctggacgtttgtgacatcggtcgtgagcctcgtcacgagcgagcttgtagagaagcggtcgatattggcgaacgagaagccctggatcttgtggaacaggtcatgcctcaggttcttggcaaggccggtcgcaccgatggaacaggtgacgcctgcagcggtgccgaacgcaagcgagaccagggcgaggcagatcaagatgacagcagaagggatgatgccttcaagcggctctcctgctgcaatctgattgatgagctgcgccgtgaagaacggaatggtgcactcgatgatggcttcgaaggctacgagcaaaggggtctcccacgcatacttgcggtactcgcgcagcgactgcgccagcgtatgcactatctccctcagtccgtattctggaagcgtgctgtccgtgcccgcctccatcgcattcttgatgcttcgggtcaatttcactccggcatcgccttctttctctcgtcttccagttcattccaatgaccgaccagccggtcaagcgtctcgagcagctgcgtgcgctcgttgtccgtgaggatatcgaacgcatgggattcgaatgcctgccggcgcttggcaagcgcttctgcctctttccagccagcatcggtcagcgtgatatcgagctgccttctgtccttctcggagcgcgtgcgcacgataagaccttcacgctcgagcttcgtcagcacttcggacagagatgcggagctgatcggctccgagttctggaggtcgcgctgctggagcgtgccgcctgcaaggctgagcttgatgagcatatgctgcttgccgctcctgccgccgctgtgcacatgcatgaagtgaccgaagtagccgaagtcctgcatgatgctgtgctcgattgtcgattctgaacgatgctcagggggcctgcagcagcgtgcccccgttccgtttgccatgtttcacctcttctgattctcgggcccgcctgtggaatcgcaaggtgggcaaatgttttttcctataaaatgttaggtacctagcaaatagatgtcaaggtacctagacaactatgtacagagtgtgcagaggaggtgcgccgggggagagaaccgtgcaggaaaactgcctttgtggaagccacgcaatggcttccctatataaacagagtcgctgaactgggattgtaaaggacatgtaagccggtatcaaagctgcgtaatagacgggtgggcgcagatttcggagctctttcaggccctagcattcaagtcagcagagggcagccttgcaccatgcaggaacttccgaatatacacgaagggctgcccagtctcaggagggacagatatgtcaaagagccttacccgtcgcggcttccttgctatgagcggaagcgctgcagcactcgcaggtctcggccttgccgcctgcggcggtggcagcacgtccaccacagactccagctcgagcgagacgaagaatctgtccggcagcatcaccgctgtcggctccacggcactccagccgctcgtcgaggctgcatccgagcagttcatggagacctacccggatgtccagatcacggtccagggtggcggttccggccagggcatcacgcagatctcccagggtgctgtccagatcggcaactccgatgtcttcgccgaggagaagctctcgaacaaggatgacgcaaagaagctcaaggacaaccaggtctgcgttgtcggcatgggcccggtcgtgaactctgaggtcacggtcgacgacatctccatggccgacctcaagaagattttcatgggcgaggtcacgaactggaaggacgtgggcggctccgatcaggacatcgtcgtcatcaaccgcgcttccggctccggcacccgtgcaaccttcgagtccgctgttctcggctccgacaaggtccccgagtccttcaagccgcaggagcaggattcctccggcaccgtcgcatccatggtcgcccagaccccgggtgccatctcctaccttgccttctcctacttcgctgacaccttcaaggcactcaaggtcgacggcgtcgaggcaaaggaagccaacgtcgagaccaacgactggaagatctgggcctacgagcatatgtacaccgcagcagatcctgacgagaccacgcaggccttcatcgactacatgttctccgacgatgtccagggctccctcgtcgagcagacgggctacatccctgtcactggcatgaaggtcgcccgtgacgcagacggcaacgtcacgaacaagtaagggctttggcccagccgccatttagcggcatgcgaggcggcatctgcgcacatgcgccaggtgccgtcttgccatgcagctgcagttttcaggaggaacagtgtccactaacagtacaggtgctgcggggagcatagccgaaggctcctcctcgaagtaccggatagagcggaagggaaagatcctgaccggagcctgcgtgctcttcgtcgttcttcttgtcgtgacgctcatcttcatggtctgctcgagaggccttgcgaccttcacggcagacggcatcagcttcggctcgttcattacgggcacgacctggaacccgcaccagacaggcgatgatggccagccgctcatgggagctctccccatgattgcaggctcgtttgctgtcacgctcctttcctgcgtgctggcgcttccgttcgcgctcggtgcagcaatcttcgtcgtcgagatccagccgggcttcggcagcaaggtcttccgcccgatgatcgagctcctcacgggtatcccatctgtcgtcttcggccttgtcggcctttccatcatcgtcccctgggtccgctcctgggcaggcggcaccggctacggcatcatggcaggctcgattgtccttgccttcatgatcctgccgacggtcacgtcgctttccactgatgccctcgccgctgttcctgaggcctatcgcgatggctcctacggccttggctgcacgaggtggcagacgatcctgcacgtcgtgatcccgtctgcgcttccgggcatcctgactgctgtcatcatgggcatggcccgagcctttggcgaggcacttgccgtccagatggtcgtcggcaacgcagcccagatgccgcagggcctcttcacgccggcagcgaccctcacgtccgtccttaccatgggcatgggcaatgaggctatgggcaccgtctacaacgatgtcctctggtcgctcgctctcgtgctgctcgtgatgtcgctcttcttcatcctgatagtccacttgatcggcaggaagggggcggccaagaatggctagcgaagaaacgaaggccacgaccttcacggcaacgaagtccacgaagacggccaagacccaggacaagatcgcaacgggcatcctgaccgctatcgtcgcgctcatcctcatcgcgcttgtcgcgatcatcgcctacatcgtcgtctcgggtgcctgcaagctcttcgatatccacttccttacggcgaagcctgagcagttcaaggcaggcggcggcatcggacctgagctcttcaactcgttctatctcttgatcctgacgctacttatctcgctcccgatctctcttggcggtgccatcttcctgacgcagtacgcaccggtcggtcctgtcacgagcatcgcgaagaccgcgatcgagacgctctcgagcctcccttcgatcgtcgtcggcctcttcggcatgctgatcttcgtcctgcagttcggctggggcttctcgatcctctctggcgccctcgcgctcacgatgttcaatgtgcctatcctggtccgcgtcatcgagcaggcgctcgaggcagtgccgcgcgaccagagggacgctgcccttgctctcggcctcacccgctgggaggcaacgacccaggtgctcatccctgccgccatgcccgccatcgtcaccggcgtcatcctctccgcaggccgcgtcttcggcgaggcagcagcgctgatctacacggcaggccagtcggcacctgctctcaactggacagcaccgatcacgagccaggcgaacccgctcaacgtgttcaggcctgccgagacgcttgccgtccacatctggaagatcaactccgagggcgtcgtgcctgacctctctgccgtgtctgcgggcaccgcagcagtcctcatggtctgcatacttgccttcaacatcatcgcccgcatcgtgggcaagcatatggggaagaagatgacggccgaatgagcatgaatcagacgatggcagcatcgctcgtgacgccggcaggcaagagcagctacgctggaggcgaggcagccatcaagacagtcgatctcaccgtcgactacggcgagaagcgcgccctcaagggcacgagcctcgagttcggcctcggctccgtcacagccctcatcggcccttcaggctgcggcaagtccaccttcctgcgctgcctcaatctcatgaaccgcgagatcccgaactgcaggatcggcggcgagatctactaccacggcacggagatcaaccagcacaagatcgatacgttctccctgcgcacccatgtcggcatggtgttccagcagccgaacccgttccacaagtccatctacgagaacatcgccttcgcacccaggaagcacggcatcacgaagaaggcagacctcgatgcgcttgtggagaagagtctcaggcaggctgccatctgggatgaggtcaaggacaagatctacggctctgcctatgcgctctccggtggccagcagcagcgtctctgcatagcacgcacccttgccatgaaccctgatgtcatccttatggacgagccttgctcggccctcgacccgatcgccaccttcgcgatcgaggagacaatccgcgacctcgcgcagcagggcatgtgcatcatcatcgtcacccacaacatggagcaggccatgcgcgtctccgaccgcaccgccttcttccttctgggcgacatgatcgagaccggcgagacggcagagctcttctcccatccgaaggaccagcgtctcgacgactatctgacgggaaggtttggataatggcgacaccaatgtcggtcgagcatctcgacctgttctatggggacttccaggccctccacgacatttccgtgaacatgcctgccggcaagatcacggctttcatcgggccttccggctgcggcaagtcgacgctcctgcgctgcctcgaccgcatgaacgaccgtgtccagggctgcaaggtcaccggcaccgtcaagctcggcgagaccgatgtctacaaggacatcgatgtctatgagctgaggcgctgtgtcggcatggtcttccagaagccgaatccgttccccatctccatctacgacaatgtggcctatggcctccgccgtcatggccgtccttcgaagtccgagcttgacggaatcgtcgagtccacgctcaaaggcgtcggcctctgggatgaggtcaaggacaagctcgaccattccggactctcgctctccggcggccaggcacagcgtctctgcatcgcacgtgcgcttgccgtgaacccggatgtcctcctcatggacgagccgacaagcgctctcgacccgatctctaccggccttgtcgaggagctcgcgcagcagattgccaaggagcatactgtcatcatcgtcacccataacatgcagcaggcttcccgcatctccgatgtgaccgccttcttctatctgggcaagctcatcgagtgcggaccgacgccgcagatcttcaccgcaccgaaggaaaagcagacggaggactacctcacaggaaggtttggctaatatgtcgagaaccgcatatctcaagcagctcaataccctgtccgagcacatgaccgagcttggcaaccaggttgtccagtccattcgcgatacggcacgcgccgtgggcgacgcggactccggcgcctccaaggatgtccaggaccgccacaatgactccgagaggctccgccgcagcatcgaggattcctgcatgaacctcatgctcctgcagcagccgcttgcatccgacctgcgtctcgtcacgggctgcttccgctccatcacagaccttgcccgcatcgacgagatggcctacgagaccgcccttctcatcgaagagtacgatatcgcacattccgagcttgctcccgagctggcgcagctcgccgagaaggttgcccgcatggtcgagaaggcactcaaggccttcgagggctcagacgtcaagatggccgaggaggtcttcccgcttgacaacggcgtcgacgaactctttgaaaagatccgcagcgatgtagtagagttgctgaagactggtgccgagccggcagctgtcgctccggaagtccttaccatcgccaaatactacgagcgcatgggcgaccactcccagagcattgctgactgggcaatcttcagggctacgggaagctaccgcggccgcacgatgggggacaaggactagctgtggtctactacgtcgaagacgacaagaatatccgcgatctcacgatctatgcgctgacgcaggcgggcatcgatgccagaggcttcgactccgatgtcgagttcaggcgcggatgcgccgagcgcgtgcctgatgccatcctcctcgatattatgcttcccgataccgacggcatccagatcctgaagaggattcgccagacgcctgagctcaaggatgttcccgtgatgatgctcacggtgaaggataccgagctcgatacggtccgtgccctcgatatgggtgcagacgactatctcacgaagcccttcggcatgatggagatggtgagccgtgtccgcgtcatgctccgccatgtcggcaagcactcgcagtcgcagcacgccgaggtcctgaagtgcgggccgctcacgctctggcccagcaggcgtgaagtgaccttgaacggcgaggagctccagctcacgatgagggaattcgacctgcttgagttcctgatgcgctcgccgggcgaggtcttcacgcgcgagaccctgctccagcgtgtctggggctgggacttcgatggcgggtcgcgcacggtcgatgtccatgtccagacgctgcgctccaagctaggagatgcagccgacctgatcgagacggtcagaggcgtggggtaccgtctgaggggatagcatggctgagaagcatgaggcccggtctctttccagcatcatcttcatagcgctcacaatgttcgccgtgggcgtggctgtcgtggccacgcttgcggcggcttttgtcttccatgcgacgctcgtcgacgatgcaaagcatgagctgacagaccagtgcgcaacaatagcggcatcgctcaattccgacgatacgaccgatacggatcaggatatcgtgcgcatgctgacaccgcagaagatgagggcgacgctcgtcgctcctgacggcacggtcatctacgacacaaagttcgaggcttcgagcctgccgaaccacgcagaccgacaggagatccaggaggctctgtcttctggcaccggggagaccgagcgcccctccgataccgcaggcaatgtctcgctctactacgcgcagcggcttggctcgggcgacgtcctgaggctctctgaggaccgggagtccgtgacagcgatcttcacgcacgatatcggccttcttgtctcgattgtcgcgctcgtcgtgctcggtgcctgggcggcaagccgcatgctctcgaagcgcctcgtgaagcccatacttgatatcgatacgacggctgccaaggcagaggctccctaccgtgagcttgagcctctggtagaccgcttgaacgaccagcaggcagagctcatagcccagatggacaagctgagagatgctgacgcctataggctcgagttcacggcgaacgtgacgcacgagctcaagacaccgattgcctcgatccagggcgctgctgagctgatacgtgacggcattgcccgtcccgaggacatccctgagttcgcaggacgcatctacagctcggccaggcgcctctcgtcgcttgtgagcgacatcctgacgctctccaagatggatgagtcggagcgtgcgggcgactcgcagctcctgggccccaagacagaatgtgacctctgccagattgcaggagacgtcacggaccgcctccaggacaaggcagagcgtgccggtgtgcgccttacgctcgaagggcagaagtgcatggtcgtcggcaatgcggggctgctcgatgagatggcatcgaatctctgcgacaacgctatccgctacaaccgcgtgaatggcaaggtatacgtctgggtgtatcagatagcgggtcgtccgaccgtatcggtatccgataccggcatcggcatccccgaagaggcgcagccgaaggtgttcgagcgcttctaccgtgtcgacaagagccgctctcgttccaacggaggaacaggtctcggccttgctatcgtgaagcatgctgccgctttccataacgcgaagatcgatctcaagagcaagctcggcgaggggacgaccattacggtcacgttcccgagtgccgatgaatctatgcagaataatggatagattgtcctaacttttacttgacacctgcatccgctctgttgcaggaatgtgtccagaaggaaaacaacgcaagcttgcggggctcatccacctcttgcgtgctaggatgcttgcaacaaatcgaagccgcctgatacgtgacggtgcatacatgagattcaaggaaagatgaggtgttggggatgtcccagagcatacgtgcctgcgtcgtaggtgctactggttatgcaggcatcgaagctgtgaggcttcttctccgccatccttccttcgaactggcgatggcaacagacagaaagcttgtcggcacgaagctcgccgaggtctatcccggcctcgccggcatcacggacctggccttctcggcacctgtcgcagaggatatcgccgcagcagcagatgtcgcctttctcgcggtgccgcatacggcgtctctggcactcacgcctgcgcttatttcagctggcgtctccgtcatcgatctttctgccgactaccgcctgaaggatgcctcagtctatgaggagtggtacggcgtcaagcacacctctcctgagcttctggacgaggcggtctatggcctgcccgagcttgcgcgcaaagaccttgcaaagctcgccgagaagcgtgaaagcggcaaggccgtgctggtggctgctcctggctgctatccgacggcgacggcgcttgcttcggtgccggcgctcgaagcaggcttcgtttcgggcgaccttgtgatctccgatgccatctccggcgtcaccggtgccggcaggacgcccaatgcgcgcactcatttctgccacgccgacgagtccgtagaggcctacggcgttgcccatcacaggcatacccctgagatggagcagacgctctcagctgctgccagacgtcccatctctgtcgtcttcacgccgcacctggccccgctcaagcgcggccttctggctaccgtctatctgcctatggcagaagatgtcacggcagacgagttctttggtgcctatgcagcacgctatgagaaggagccccttgtcgaggtgctgccccagggccagatgccgcagactgcctctgtggctggctccgcacgtgcccaggtgggccttggattcgatacgcgacgacgacgcatggccatcgtctcctgcgcgatcgacaatctgggcaagggcgctgcggcacaggcaatccagtgcgcaaacgccgtcttcggactcccggaaacagaagggctcgatctcatacagcccctggcatgatcggtcgcgggcagaggaggcatagcttgcacgtctccgtccatccggcagcagaagctgcctctgctcgaaaggcctgaaaaacaaatgaatgcatatgaacctattgcggtccctgtctctgctaccggggccatgccggaaggcttctcaacctgcgaaggcggtgtctgtgccgctcaaggcgtgaaggcctctggcatccacgctggcttccggaagaatcccgaaaggctcgatctggctgttgttgtcgccgacaagacggctacctgcgccgccacgttcacgcagaaccagttctgcgcagctccggtccagctcgaccgcaagcgtgctgccacaggcaagatccgtgcggtgatgctcaactccggcatcgcgaatgccgcgacaggagagctgggactcgcgcatgcagaagaatccgcccatatgctcgccgaggcgctcggctgcgaagacagcgaggtcgaggtcgcatcgaccggcgtcatcggaccgcagctcgagatggggcccttcgagtcgggcatcccggaagccgtgtcaaagctcgcagcaaccgctgaaggcgcgcatgatgcggcgtgtgccgtgatgacaacagacacgcacccgaaggaggcagcgcttaagggaaccttgccttcgggcacgaagatccacctcggcggcttcgtgaagggctccggcatgattcagccgaacatggctacgatgctctccgtcgtggcgaccgatgcaaatgtctcgcagaaggcagcgcatgcagcgcttcttgctgcggtccaggactcctacaacaaggtcacagtcgactccgatacctcgacgaacgactcctgcttccttatggcaacaggggcggctggtggccctgagatccaggaaggctcggcggactttgccgtctttgcggcagcattgaaggagctctgccaggagctggcgcgccagatcgcggcagatggcgaaggctcgacgaagctcatcacggtcgattgcgtcggtgccaggacagatgcagaggcagagacggtggcgcgtgccatcgcgaactcgccgctcgtgaagtgcgccgtcttcggcaacgacgcgaactggggaagggtcgctgctgccgccggcaagtgcggcgttcccttcgaccagacgagggtcgatatcgactttctgggtgttgcggtctgccgcaagggccagccggttctggtcgatgaggatgacatgctcgtgcgcttcaaggcggacgaggtgacgatagccatagatcttgggcaggggagcgcgcactgccgcatctggacctgcgaccttacgcatgactacgtttcgatcaatggcgactaccggagctagcgctcaggaaaggatacttcaatgaaggcagaagagcgcaagcgcagaagcgaagccgcacagaaagcagaggtcctgaccgaggccctgccctggatcaacaagatgaacggccgcacggtcgtcgtgaagtacggcggcgctgcgatggagaatgcagacctcatgcgccaggtcgtgggcgacctcatgctcatgaagctcatgggattgagaatcgtgctcgtgcatggtggcggcaaggccatcaatgccctcttgaagcagctcgatatccctgtgaagttcgagcgtgggctccgcgtcaccgacgatcagacgatggaagccgtgcagatggtcctcaccggcaaggtcaaccagacgcttgtccgtggcctcaacgcctacggcaatgtcggtgtcggcatctcgggtgcggatggcatgacgttcgaggtggagcagaccgatcccgctctgggacgagtcggcacgattacccacgtgaataccgagctcatcgagtcggtgctcgatgatggctatatccccgtcattgcaagcgtcggctgcggcgaggatggcttctacaacatcaacgccgatgtcgcagcctcagaggttgcaagcgccctcggtgccgacaagctcgtctatctcacggatgtggatggcctcttccgcgatgtggaggatgaggaatcgctgatctcgcagctcacgaagagcgaggcagaagagctgctgggaagcggtacgctctcagcaggcatgattccgaagatttcctcggtcgtagaagcgctcaaaggcggcgtcaaggaagtccatctgctcaatggcaccttcccgcatgcattgcttctggaagtgttcacggatgccggcatcggcacgatgattgtacaggatgaggagtagcaatatggctgatttcattgcagaagacgccgagtacgttatgcatacctatggccggctcccgatcgagccggtgcttggccatggatccactctcgtggactcgacgggcaaggaatatttcgacttcttggcaggcgtcggcgcggtctctctgggacactgcaacccggtcgtgcgtgatgccctcgccgagcaggtcggcaaggtctggcagacaagcaactacttctatgcggagaacagggcggagcttgcgcatgacctctcggacctgctctcgaagacgacggacacagagggccacatcacgggctctaccggcacgaagtggcaggccttcttcggcaactccggtgccgaggcaaacgaaggcgccatcaaggtcgcacgccgctggggcgaagaggagctcggcggcgctacgggcatcctgacagcgcagcggagcttccacggacgtacgctcgcaacgcttgcagcgaccggccaggcagccttccacaagtcgttcctgccgatgccggcaggatttgcggacttcccgctgaacgatgcggatgccctcgaggctgccatcgcgaatcctccggcaggcaccggtcccctctgtgctgtcatgctcgagtgcatccagggcgagggcggcgtctggccggctgaggcagcgttcctgaagcgtgctcgcgagctctgctctgagcaccacctcatgctcatcatcgacgaggtgcagaccggcttcttccgtaccggcgctcccttcgcctaccagcttgccggcatcgagcctgacatcgtctcccttgcgaagggcatcgcggacggcttcccgatgggtgctgtatgcgctcgcgaagaggtcgcttcgctcatgcatccgggcgaccatggttcgaccttcggcggcaactgccttgcggcgacggcaggacgtgcctgcgtcgaggagatggtcaaggaggacatcggcgagcatgtgatcgaggcaggaaaccatctggcagaaggcctcgcgaagcttccacatgtgaccgaggtcagagggcatggcctcatgcgtggagcccagctcgatgtaccgtttgcgactgaggcggtagacaagggccttgaggcaggcctcatcctgaaccacatcggcgactcgatcctgcgcttcctgcctcctcttgtcatcaccaacgctgagatcgacacgatgctcgagcgcctggggaagatcctcgaagaggcctaggattcctcgcaggcacttaccatcgtccggaagagcgcgtccgtcacatccgggggcgcctctttcggaagcgtatggccatggcctgggacaatcacaagctctgcgcctgggatggcggaggcgatagcctcggtctcctcgggctttataacatcattctctcccgccatgatcgtggtcggacaggagattgacatgaggctctttgcctcgatatggggctcctcgtccatgaggcgaaggaggtctgcggtcgtgcgtgcctctgctgctgtgggcgtgagaagagacgcatctattgcacctgccgggtcgagcgactcctcccagctggcccagtcatcgagctcacgtgctgcaccctcaacatcccatccgtcgctcaggattccctcaggcgagaggttcgcgccggatgccgtgcaggagaggacccgctcaggacagtcgcgtgccagaagaagggccaggatgccgccatccgagaagccgaggatgtggaacttctctatgccccatgcgtccatcacggcaagggcatctgcttccatgagctcataggtgagatgctcatgtccccgtgtgctcttgccctggccacgcgaatcgacgccgatggcaggatttccgcctgccacgaccgcatcgatcgtcggtccgaatatgccatgctcctcgccgtttccatggaggaagaggacgggtgcatcctctggattcactttccagggcgcatctgccccataggcaaaggcagcgatcttcgcgccatcaggacgctcgataagctcagctctgagaggtgccacatgggggcgctcatagggcgagggaaaatggagctgtggcgggacaggcatatgcatgaggaaaggtcctttccaaaggaaagcgcccgcccgaaggcggacgcttgaagtggtctatttctgcccaggcttcttctcgaagaagtcgtagcgcggaggcagcgctacgagctcgtgcgtctcaggcgtctcaccctgcgcttcagcgagctcggtgacgccgtcgaaggcgtggtcccagctgaagaagagctcgggcttgaagttcagatgctcgcagatcttcgcgcagccgaaaggcgttgctggatgcatgagaagcgtcacggtacgaagcgctcggaacgcattggcaagtgcctggacgtaggcctcgtggtcgtccttggcagccttcgactcgtcgccccagcgcttgttggcagcgcggcagtactcttctgcgacagagagtgcggtatgggcatcgaagacggcgcaggcacgctcgaaggcaagcgtcgcctcgtttgcagcatcgacaacttcctgctcaggtgcgacttctggcaggtgcccgtcgcagttgtttgcggcaccgtagaagcagctcctcgcaaggcggttgaagatgttcgtcaggaaggcgctctccttgagggcagggtcgacgacgcgcggatcgtccttcacgaggatctcttcgccggtcttcttgtccttatggctcacggaggtgtcatagggcttcggagagaagctcacagccttctggtcgagagcaaggctcagccagtgggtgcggagctgctcgggcgtgtagtggtccagaagctcctctgccatgggcggcttgatcttgccggagctcgaggccttcttgttcatgaagaggatgtggtagttcgcgactggcgtgtcctggaagaggccccagtcgagcgcttcccacatcgcaggctgcgcgacgcagtagaagtagatgttgtcctggccgatgaactggaagacctttgcatcgtctgcacaccaccagtcatgccagtccgtggaggagtagcggccttcaggggcattcgcaagcacggtctgcacgaaggagataggtgcccagaggctttcaggccagacccagactgtgaggtccttcgtgtcttcgagatcgggtgccgggacgccccaggagatgttgccggtgaggcggaaggggagaagcgtcttgccggtgcggaagcgcacacctgcctcttcgaggatctcgcgggcatggtcgcggtcttcccagttcccgaagctgacagagaaggactgctggttgccctctgccggcgtcacggtatgggccggaagcttcggctctgcagctttgaaggcgtcctcgaagcgctgctggatgtagatgaccgggtcgacgaggctctcgcggaccgtcttcgtgacaatcgggcgcacctgcggatccttgccccactcgtccgtgagcttctcgaggtctttgcggaaggcagggagatcgaagtaccagttgtcgacaggacggagctccggcttcgtgccggtaagctggctcaccgggtcgatgagctcttcggggtcgaactggtggccaagatcgcactcgtcggcgtaggccttctcggacttgcagcccttgacggggcagcggccgatgacctggcggccattcaggaactggcctgccttcacgtcgtagaactgcctcgtggacatcttcctcagatagccacgctcatagaggcgctccaagatctccttcgagagctttgcatggatcggacgtgccggttcgaggccagagcctgcgaagatatcgagcgagatgccataggcatccagagcttccttctggaggttgtggttcgcctggacatagtcgacgatcgtgccctcgtagccttcctcttccaccttcttgcggtagccctccatgatgggggagccatagcagtcggtacccgagacgaagatcacgttcttgcggccgatgcggtcgcgcaggaagcgggcgaagaagtcggcaggcacgaacacgccgccaatatgcccgaagtggagattcttgttgccatacggcatgccgccggtgatgaccgcacgcttggggaactgcgggcgctctgtggatgctttagctgcttctgaagccatgacctatccttcattcttggctatacggcacgctctattgtatgccacggcaggcggtatgggcagaatggaatatgtgtttgctgaaggagggggagcgtctgtggaagtcagaggagaggtcgatgtgctcggcgatgccgtgctgcagagaaggatgcttgtgcagtctgagctcgtgctggccctgggcctggctctctcgctcattgcggcagccttcggcggatggaccatcttccgcgacggctgggccgtgctctgggctgtccttgtcatgatggcatgctttgctgtccacgagctcgtgcatgccctcttcttcctcatcatgtcccatggcaagtgccatatcagcttcggcgctgcggcaggcttcctctacacgaggactgatgactgcatgctgccgaagggactcttcatctgcgtgctcttggcgccgaccgtccttgtgacggcaggcatcgtggctgcgggcttcgctctgtcctttcccgcagagtcgctgattgtggcagcggtgcatctctccggctgcgtaggggactgggatatggcaaaggccattgcaacgacgccccatgtcacccatgtgaaggactccgaaaccggctgcatccttctggggtagcacccagagttcaaggacgaaggatgcgccatgtgccgtctgcccgaggagcatatcggctgccctcttccggtttctggcatcgagcggggccgtaggcttgcctgcgaagatcaggggagcttcatgggggcacatggcgtccgaaacagattccggatctgctttgccgccatcctcgggcagggtgctgactgcgccgattctcgcatggctgccgattccgaagacaatgcatatgcagacagcgctgatgcagctgataatgcccttgctcatagggagcatgctgaccagaacgttgctgcgcgcctccccctgagatgaaagacattctgcgttttaggaggtcttgcctcagcggtggggtctctcagctccaagagctcgactcctactgtatgacggcgccgtttgtgttatggatttcgccgcatgggcggatatctgccttccgttcagcggttcatgataaagcgccctgaaacgcaggagcgttgatagaaagcaaacgagcagggcggaaccccaaaggattccgctctgcatgttctatgccttatgcaggcattcctgctggttcactagctccggtatcgtgccatcatctcggagaagagctcctgcaccgaaggcggcgtgtacgtgatcgcgttggctcctgcctctattgtggccaggatggtatccggcttgttgccgccggttgcaatgataggaactgtcggatgcttggcacggatggcccgcacgatattggccgtctccttgcctcctgcgacattcaggatggcagcgcctgcagcgaggcgggcatcgatgtcggtctggggtgtcgcgaccgtcacgacggtcgggatatcgacagcgcgggagacgccgagcaggttcacattcgagatcggtgcattgaggacgacgcccatggcaccctgggactccacgtccttcgcaagcgatattgttctcatgccacgtgtcgtgccgccgccgacgccgcagaataccggcacgctcgcagcgctgatgatggcagcggagatggactgctggggcgtgaagggatagaccgcaaacacggcatccgcatcgcagttcttgatgatggcaaggtcggtcgtgaagacgaggctcttgatccttctgccgtagatgacgatgccggaggcacgtcttatctcctgtggcatcttcaggatgttgtggcggaggcgcgactcgatcgaggggacggtacgctcttccttgggaatctgagggttgcccgaaagcgggggagcgctttccacgacggggggattgccgggattgatgggctttgcttcgggcataggcacctcgctctgtctttgggatttttgctgccttcatgctacccacctgcgcgggttttacgcttttcgcagaacaaatttctgtggctgcaacagatggctttgaatgctacggttgtagcagcaatagaccataagagaggaatctatgggcacaccgctccttcttcatgcctgctgcgggccctgctcgctcgagccggtgaaatatctgcgcgaggaaggcttcgagctgaccatctgctggacaaatccgaacatccagcccattgaagagcatgacaagcgccttaagaccctgcttgcctgggcagatgaagtggcccacgtgccggtgatcgttgcagaggaccgccgcgatctctgggaggcgaaggtggcgccagccgggcttgcgcgcgaggcacgctgccgtgcctgctaccgcgtgcgtctcgaggagtcctgcagggtagcgaaggaagagggcttccactacatctcgacgacgcttgtcgtctcgccctaccagctcttcgatgcctgccatgaggtgctttcgaagcttgcgccgaagtatggcctggaagaggtctggcgcgacttcaggccccattatccggagtcggtcaccgattcccgtgcgctcgggatgtatcggcagaactactgcggctgccgcttctctgcggcagaagctgccatcgaacggcatgaagcacgcgacatgcgcaaggccgagcacaaggcgaatcgagcagcagctcgatgtgtgccttgtgcacagtgagcctgaaagctcaaagcgcgctatcatcaacaaggcataacgtaaagaacaaaaaggattatctctatgcgcactgacgatttcgactatccgctgcctgatgagctcatcgcgcaggagccggcagacccgagggattcctgccgtctcttcgtgctgcaccgcgagaacggtggccacgagtaccgcacgttcaccgatatcggcgagtacctcgagccgggagacctgctcgtcgcaaacaagacccgtgtcatgccggcacgtctcgtcggcaggaagcgccagacaggcggcgtctccgagacattgctcctgaagcgccgcgaggacaaggatcctctgggacatgtctgggagtgcctcgtgaacccgggaaagcgcctgaagccgggcaatgtcgtcgagtatcgtcctggtggcgcccatgcaccggagacggctccggtcgtccttacgggcgagatcgtcgactacgtggacgattcgcgtggcggcaggctcgtgcgctttacgccggcagaggggcttacgctcgacgaagccatgcacaaggcaggacatgtgcccctgcctccctacatcacgcagtatgagggcgaccccgagaaataccagaccgtctatgccatgcatgaggagcactccgcagcagccccgacagcaggacttcacttcacgccggagctcatcgagcgcctcgagaagcagggcatcggctggaagactgtggagctcgaggtcggcatcgacaccttccgcctcgtcgaggaggacgatcctacgaagcatgtcatgcataccgagcgctatcacgtcccgcaggatgtcgtggatgccgtgcatgcaacgaaggcagcggggcaccgcgtgattgccgtcggcacgacgagcgtccggtcgctcgagagcgcctgggaggcagatgcaccggtctccaatcctccggtaacggcacgccgcttcgaggatgcacaggattctgccaaggtcacgggcaagggcgatatcgtggagcgcaagaacgccacgacgaacctctatctcatgccgggctcgacctaccacgtggtcgatgccctgatcacgaacttccatgtgccgcgctcgactctcatgatgcttgtctccgccttcgcgacgagggaccagatcatggatgcctaccaggatgcaatcgaccaccgcttcaggatgctctccttcggtgatgccatgttcatcgactaggctatctgcaacatatcaagctacgaagaaggccggatctgctcagtgcaggtccggcctttgtgctgccttgtggctgctttgtcctagacgatatggagaaaggcagctggaacctcattcaagaaacaagggccctctgtggggcatcgtgggttaggcttcggttgtccgaccggcttgccacatttcgcaggaggtcccagccatgctctatcgtaccagcatcgggctcgacgtacacgcgcgttccatcgccgccacggccttcatcccggagaccggggagatagtccagaaggccttcccgtatgacgcgggcaaggtcgccgaatgggccaagggcatgccccagcccgcaagatgcgtctacgagtccggccccacgggctccggcctggagaggaagcccggcaaggcaggcgtcccatgcgtggtcggcgccgtctccaagatgctcaggccctctggcgacagggtgaagaccgacaggcgcgacgccaccttcctggcgcgcatgctcgccgtgggcaacatcgtcgaggtggccatgcccaccgaggcgatggaggccgcacgcgacctggcgcgggcacgcgaggactgccgccacgacctgatgcgcgcgaggcatctgctctcgaagttcctgctcaggaaggggatcgtgtatcccggaaagaccgcatggacgaaggcccacagggaatggctcggcaggcccggattcgcggacccctgcgagcggctcgtcttcggggaatatctcgagagcgtgaggtcgcccgggctcaggcgcgcaaggcccggcagggccatagaggagcgcgctgccggggaggacatggcccctgcggtctcggccctgaggtgcgtcagggggataccggccgtgaccgccttctccatcgcagccgagatcggggacttctcccgcttcccggatgcacggtcgttcatgtccttcgtggggctcgtgccatcggagtcatcgagcggggagagcgtctcgcgcggcagcatcacccggacgggcaatatccatgcgaggaccctcctcgtggaggcggcatggcagcacatacggcccctgaggccgacgtctgcggcagccatggacgatgcggcgggcgtgcctgcagatgtcgccgaggctgccgcgcgggcgaaccgcaggctccacagccgtgctgcccatctgagagggcgcggcaagcctgccagcgtcgtgaacaccgccatcgcgcgcgagctcgcagggttcgtctgggcgctcgccaggatggccgggtgatgccgctgcggccctgggccgcagcctgacagatgggtccttcccggaagcccgcgcctggctcgatggcgcgtggggcaatccgcgaacgcac

SEQ ID NO: 51 - DNA, 33991 bp, Unknown
  Metagenome-assembled genome
cggtgaagagcccacatgcggcgtcagaacgacattcttgcaggatgagcttgtagctctcaggcagcggcggctccatatcgaagacatcgatgccggcgccggcaagatgtccggagttcagggcatctgccagagcatcgttgtcgtcgatggcgcacgggcacaattgatgaagacagagccttcaggcatctcggcgaacttctctgccgtgaacatcttcctcgtcgaagcgttgttcggaagatgcaggctcacgatatcgcttgccgcaaggagctcgtcgagatctgccacatactcgatgcctgctgctgtggcctcgggatttctgtgacgggcatacccagcacatggcgccgaacgctgacaagagacgtcctgcctgggtgccgatgtgtcccgtggcgacgatgccaacagtcctgcggcaatctcgcggcccacaagaccatgcgaggtcttgccggtacgtgtgcagcatctcctgccgaaccttgcgcagcacatcgatcgtgaggccgatcgtgagctcggcgacgctcacatcggagtaccctgcacagttgcagacagagacgccctttgccttgcaggcgtcaagcgccacatggtcgatgcctgtgaaggcgacagctatcatcctgagcgcagcatctgccgaatgcagaggcagggtacggatgttcgcgatcatcacgatatcagcgccttcgctcctcttcgcaagctcggaggcgtccgtcgtctcgtatcgtaatagacgaactcatggccacgctctttgataggacgtgcgagctgctcgatggtctcggcaggcactccaagggttccagcaatgcaatgcgcatatgaagcctccaaaaggtccggaatcatggctcatatagctacggccgcatgtccccattgcacgacagcaagcagacagcattccctgtttctggcgtcatggacttctatggctgctgcgaccttgcagggagcatggcatcagcgctctggcagccctccctgcactaccagcacctcatgcccgccataccgccacggacggccagaagcctgagaggaaacccaggtcctcaactcggcaccggtcgacaggcgcttcgcgctctatgcctatgcacgccagacaggaccgtggggagagcttctgggcatcagccgctcagatgcatcccgcttctcgctcgataccgccgcacagaaggcgctgcctcccctcttcattgccgcaagcaaggcagacagcgatgtgccattcatctgctctcagacgctggccgagacggctcctgcaggcgagtccttcttcgttgacaggctggaacatgactttgaccgggaccttgcgcacagagaaggcatggatgctggcaggcatgccttgactgggcagaccgcatctagggcagcctctggctagctcccggcaagcggagagcatccatttgggaggcatcaacgtctgcggctcttctgcgctttgagatacggcaggagctcgtcgagcgattcggacgtctccccatcggggcttgtgctgcccacatccatgaggacaagctgctggcttctgggcggccctcctcttcgcgcctatgctgtggtgggcgccagaaggaatcagatttgtgaagacaagtgcgagccagacgaaagtcgcgacagcaattgcgcacacggccgtcacaagcagcagttgcccatgcctggtgccgattgtctctatgcttcacgccgctctcccgtccatcacactggaaagcagacaacatccgacctgccgacagcactgaatcccttccatcagatttctgacagaaatctgcaaaacactcactgcaagagtgtatcagaagcatatcgaattgctaggattgagctgaatcccgggcagaacaacgaaaaaaatgaatgtagcgatacgagtccggagggcagcctatctcttcctgcgcttcttcgaagcctgcgactccgctctgcacgaacctcttcactagagatagagcagcgccgtgatagcgagaaggacgaagctgatgaagatcgtgtcagcctggatgctggcaacggcaccgacgcctgccagaacgagcgtgaagagacagagcttgctgtaggtcagagcaagcgagctttcctgcgagatcctgatgccgaagatgccggtgatgatgcagccggcgccacagatgagctgacgacagtcgctgttgttatcatcgcgatcatatcgtcgaaggagagcgtcgagcccgatttcgccagggcatctgacagggcagcctgcacctcggcgttctgaaggcccatgagcgccatgattgccatgatcagcgtgaaggaagcggctgcaatctctgctatcgagatgaagagcaccgcattcggctcctgctcggctctgctgccttggcacgcttcttcttgctcatctgcttctcccgaatggctggatggtatcgacggacggcatcaaggatagcgcatggcagatggcggaagcatccgcggcaccgtctgatgcatgtgaacggatttccctctgccttcgccggaccttcggcatctatgcgctcgatgtccggcgatggtgcagacctttctagtgccctgcggtaatgccgagagctcaaggctcgaacgaattaagccccataccgcgtttccgcaggtacggggcttcaaattcatggtggcggggaagggaatcgaacccctgacacggggattttcagtcccctgcttaaactgagctacccagccgaagtgcgctctcttgcgcgcttgtttatagtaacagactgcctccccaagtcaaagaacttttttattttctttgctctgaggagaaatcgcctgcttacttgtcatcatccgatatgtgacgaggagccacggtacgggagcggcgaagcggcatgcccttgaagatggcactgagccccgtcgtctcctccttggcaggagcctcctgcttctcttcggccttggccggtgctgctggcttgggttctgcctttgccgggaaggctcagggccgcttgctttgggctctggtgcagcaggtgcggcttcggtgcttcaggtgctgcaggtgggtgtctctgtcttcttttcgggagcaggaacgatgcaggcttagccttcggcgcgatgcgggaacctctgctgccttccggggcttggagcctcagatgtcttggcagcagaagccgcctctccttcgaggagaacggcatgacctgggaaggctttgcgccctttgccgccttcgtccctgcgttgtagccatgaggtcgatggcatgctctgctgcagagaagacgcctgcaagccgaagcgaagcctcggcaagagaaccggacttggagattgcgatatggcggtcagagagctccttctccgctgctgcaagcttcttgagagctcctgtgcatgcgcttcggcacgtgccttctcatgccgggctggacaagctcagccctcatgcgggcaagctctccctcgcggtcgccgtcttcaggagcgtctcctgaatctggcgctggagcgactcgaggtgggcaaggcgtcctggatctcttcctgcgtgagctccggctcggtcttcctcgtctgtgcctgcgcaagtgcagctgtcagatgctggcagcgctcctcggctcctgcgagctcctccttgagggcagctggcgcttctgcctgctgcaagctgctgccgcagcgcttcgtattcctgggacttctgcgcttcggtgcgctcgcggacattctgcgcttcagcgcaggcacgctttgccttctcgagctctgctttcgcctctctgagcgattcctcgagaagcgccttctgggccttcgtctcagcgagccgggcctctgctgccgtcttgtcgctccgggagcgctcagcctcctcagatgcgctctggcctcctcgcggagactctccatctcgtcctggagccgcgaattctcgttaaggcatcacggagaagatcgacgactctcgtcgcttcaagtccgcgtccaccctcagacggagcagcgatacgcgcctccgtccttgcgatgcttcttcttgccttcttgcggcttcagaatcgagcgcgctctcttcctgcttcatgaacaacctttcacgtgagctgctgtacagcagcagaaggtgtcatccatcgacagatccaatccatcctgttttagggtaccccacacagataaggccgtttcccatatttcggccggctcctgtatgtaacgcctgactgtgctacaagacggtagaacccgtcttgtagcagcgcagcagaaaggattgagatgcggatcctgtcttcgatatcggcggcaccgccatcaaatggtctctcagggatgaagctggcaaggcctcaagcaggacgtcttccctacccccaaggactcgacagacgcccttctctcccctcatggaaatcgtgaagctccctggatcgcaggctccggcatcgctataagcgctccaggcgtcatagagcatcacgcttcaagcgcacgggaggcgctctcacctatgcctatgggcttccgcttgcgcaacgcctcgagaagctctcgggactgcctgtcacgatcggcaacgacggcaagtgtgcagcgctcgcagagagctttctcaggcgctctcaagggcacgcagaactcctgcgcgctgatcctgggcaccggccttggaggcggcctcgtcgtcgacggaaaggtcctggctggcctcatggctctgcaggcgagctcagcctgcttcgttcggcttggcctgatggcacgatggctcctgcgccggcatggacgcaagcacctcgctcatcgcgcccatgaaatcgacatgcggaaagacagccgaggagctgcctgatggcaaggcatgcttcaggctctcgagagcggagatccggcagccaggcaggccttcgagtcctggtgcatggcagtcgctacagtcatcttcgaccttgctgccatgctcgatatcgagcgctgcgcgataggcggcggcatctctgcaaatccgcacgtgctcggaggcatcaagacagcgtgcggaggtctggagaagctcccgcacatcttcggccagaccattacattgcccgaagtcgtatcctgccgctacggagcagaggcaaaccagctgggggccctggctctcttcctcgagagcaggaaggacaggtaaggcaaaggggagctggcatgccagctcccttttctcatcttgctctgcgctgctactcgtgagcgcaggcgtgatggcagagatgacctcttgaggcgtctttgccgagacgatggcagacatcgtcttctcatcgtccagaagttccatcacatcgaccagggtcggcaccgcttggccggatcgacgaccgcaagcatcacgaggacctgcaccggcagcggcttttccggcgatcccatgagtgcaaactcgaccgggtgcgcaagcacggcgacagcaattgcatcggagagcgtgtagtcgttcgagcagtgcggcaccgcggcattgaccggcttggcctcgaggcccgtcggatagatcttctcgcgcgcgacgactgcatcgggatagctgctcttgaccttgcgcagctctacgagctttcccgcaagcgcacgcagcgcctcttcggcagtatctgcttcaagaccgagaagcacgagacgctcatccagaaccatgtacgacctccgacaggaccttcctccacataagctttcctattctacaccatttccccacttttccgccatcaatatttcaaatggatgggatgaggagcagatgcgggctttggatggccctggaagctcctagaccagaaggtctgcaacctcgagcttcggcacatgatgcgagccatccgcctcatgccagtaggctattccgtgctctgtcgtcgctggctcgagcacgacctcctctgcaggcgtgccaagcgccagcacaagggagatggcaaggcctgtgtcctcgagaccgaagtcggagatgaggcccgcatcaaagttcttgaggatgcagccgccaaggccttctgctgccgcagcgagcatgatcgtctgtgccgcgatgcctgcgtcgtagcacctgatcggattgttcacggctgcagcaggaaccatgatgaagatgtagccaccgggtcgctccccctctgcaggtcctgcccagtccttgaggagcgctgcccacttgagatgtgcaaaggccttcgcgcaggcatcagcgccgctcacaagatggaagcgcagcatctgcgtgttgttgccggtcggagcaaagcgcgcgacgtcgatgagggctcggagcgtctcctccgacaccggcttcgactcgtcgaagcgtctcttcgtcctcgaggagcgcacgagagcagcaagatccttctcttccatgcctgttccctcttaaagatctgccttgccgatctgggcaacggcttccttgatcttctccggcggcagcacgagcgcgaagcgcacgtagccctcacccgcaggtccgaagcttgcacccggcgtcacgatgacgcctgtcttctccatgagctcgagcgtgaaggcaagagagtctgtcctgccgtgcggcaggcgtgcccagacgaagagcgtgccatggcagttcggacgctcccagccgatggcctcgaggccgtcgcagagggcatctcttctctccttgtaggcaaggcgctggcgctcgacgccgtcaagcgggcccttgaggcaggcaatcgcaacattctgctcggcgaagaacatgccgaagtcgacctggctcctgagcttgtaggtggcctggacgatgtccttcctgccgacgaggaaggagagcctgacaccggtgacatcgaaggacttcgagagcgacaggaactcgacacccacatccatagcgccgggatagttgaagaaggagctcgagacgccttcgaacacgacgtcggcgtaggcattgtcgtgcacgatcacgatatcgtgcttctttgcgaaggcgatgatctcctcgtagacctcaggcgtgccgaccgaccccaccgggttagccggaagcgagacgatcatgtacttggccttgtccgccacatcgtcgggaatgtctgccacatgcgggaggaacccatgctctgctgtcagctggtagtagtaaggggttgctcctgcaagctgcgtgccggcacggaagaccggatagcagggatcggggatgagggcgatgtcgcccggatctgccagggctgcacagacatactgcatgccttcctgcgtgccgcggcagctcatgacctggtcgggctcgaggccatccacatcgaagcggcgcttgtagtagtcgcagaccgcctgcttgagctcatccttgtcatgcagggcatacttccagttcgcatcatctgcgcaggagtcgacaagtgccttcttgatgtagtcaggcgtcgggaaatcgggcgtgccgaccgacaggtcccagacaggacgtcccgcagcttcaagctcgcggcgcttctggttcagactggcaaagacctcgtctccgaaaagatcgagacgcttcgaaaactgcatcggctctcacgctccccagcggccaggcgccgcttcctgcatatctataggcaagattccattctattattcgacgagctgcctgcctcctgaaatgccgcctacgcaacacgatgtttgcctgatggggcacatgccagagcgcatgtcatgcgaacccctggcacgcggattttcagtccctatgagtggagaagggcctgccttgcggcaggcccctggctgcttgtctgtctacttctcctgtggcatcttccagccgtgctggtcggtatggagaagccgctcggcacgctcggagagcggctcgccgagatacttctcgtagacccgcacgatatccggattctcgtaggagttcctatactccgagatgcggtcgagcccatagagcatctggccgcgtgcccctgccagctcctgtccgtcgtggatcggctgcccgccgccaccgacgcagcctcccgggcaggccatgacctcgacgaagtcataggacacggtgcctgcaaggatcgcgtcgcagagacgcttcgcattgccaaggccgcttgcgacagcgacacggagctttctgcctgcaaggtcgaactccgcttccttccagccggtgaggccgcggacgttcctgaatgcgtcattggcaggcgtctcccctgtcgccaggtgataggccgtacgcagcgctgcttccatgacgccaccggtcgcaccgaagatgatgccggcgcccgtgccttcgccgaggggctcgtcgaagggctcctcttcaagcgcatgcacatcgatatggtcggcgcggatcatgcgatctatctcgcggaccgtaagcacgcagtcgacatccggatctccgcaggcatccttcatggtcggcagcgcgcactccgccttcttcgcgacgcagggcatgacagagaccgagaagatatcgtgcggatcgatgcccagatattctgcgtagtagctcttcacgattgcgccgaacatctgctgcggcgacttcgaggtcgagacatcgtccacaagctcaggatagtgggccttcacgaagcggacccagcccgggcagcacgacgtgaacatcggatactcatgctctgtgccatcagagaggcggtgcagaagctctgtgccctcttccatgatcgtgaggtcggccgagaagtcggtattcacgatgtagtcgaagcccatcttcctgagcgccgagacaaggtgcccgattgtcgactcctcgggcgagagcttccagtggtcgccccaggccgtgcgtaccgagggcgcgatctggacgatcgtgaccttcttcgggtcggcaagcgcatcgtagacgcgtcccgtatcgtcgcgctcgcgcagggctcctgtcgggcagtgcgtgatgcactggccgcagagcgtgcagggagcctccgcgatcggacggcctgcttggacattcacggcggtgtgagcgcctctgttcgtgaggtcccacacatccgatgcctgcaccttgctgcatatctgaatgcacctgaggcagttgatgcacttgtcgttgttgcggatcagagggaacgtcttgtcccacggcatatgcggcaggtgcttttcatagggcagctcgaagatatcgaggtcgtttgcaaggctctggagcgagcagttgccgctcctcacgcagctcgtgcactccgagtcatgctgcgagagcaaaaactcgacgttcgtctttctggccttcctgaccttcgggctgttcgtgaagaccttcatgccgtccaggacatagttgttgcaggaagcgacgagctggtcggtcccttcgatctcgacgacgcagacacggcaggcaccgatctcgttcagatccttgagatagcagagtgtcggaatgtggacgcctgcagcttctgctgcctcgagtatggtggcgtggtcgtccacctggacacgcaccccatcgacggtcacgtctaccattgcatgatcctccctccgcggaatgcgccatagccgaagtggtcgcacctcagacacctcgatgcctcctgatgcgcctcttcaggcgtgaggccgtgctcgacgatatcgaagtcgccgacgcgctccgacgcctcacgtgatgtcatctcgcagcgggcgcacatgttcttgcccttgaactggaccgtcggtatctcgacatctgccacgatctggtggtcgaagccgaggtagtggtcgatgtttgctgctgcgaccttgccggcattgatggcacggatcaccgtggcagggccgctctggcagtcgccgcccgagaacacgccgtcaaagcctggcacggcaccatctgtatcggtcacgatgcggccgcgattgcatttcatgcccagttcttcgaagggcctggactctatggcctggccgattgccacaagcacgcgctcgcagggaatgacctcctcgggagcctctgcagcacgcggtgccggacgcccgttcttggggccgccgatgatctgcttctggacacggagtcccgtgacatggccgccttcagcctcaatcgcaagcggggcatggagctccaggagctcgcagccttcggccctcgctcctgcaatctcttcatcctgtgccgtcatgtccgcgacgcggcgcctgtagacgatcgtgaccttcttcgcatggcaccttacggctgagcgggcgacatccattgccacgttgccgccgccgatgacacagatgcgctcgcctgtgaagtcggggatctcctcgtcgccgatggcacgcagcatcttgacggcagactcgacaccttctgcatcctcgcccggaaggccgagcttccggtccgcatgggcgccgattgccagatagaccgcgtcatactctttcctgatttcaggcaggttctcggtgacaggcgtatcgagctctacgtttatgccgcagtcaaggagccactggatctcctcgtcgaggcgcttcctcggaagacgatagttggggatgccgtaacggagcatgccacccaggtgatgccttgcctcgaagatcgtgggctcatgccccatgcaggcaagatagtaggcacaggaaagtcctgccggaccgccaccgatgatagcaatgcgcttgcccgtggacggagccttcttcggcttgtagtctgcctccatgtgctctgtcgcgaagcgcttgaggccgcggatgttcatcggatcgtccaccatgccgcggcggcagtgcatctcgcagggatgctcgcagacaaggccgcagacgacaggaagcggattgtccttcctgatgagcttcacggcatccgtgtagcgtcctgcctcgacgagcgcgatgtagcccgggatatcgactcctgccgggcagcccgagacgcaggggacaagctccgactgcttgaagccgcaggcgtggtacttgatatggtgctcgaaatcgtcgcggaagccccggatcgctgtcagcgccatgcttcccgcttcatatccgatcgcgcagtcgctcgagagatagatcgtacgcgccgtcttctcgatgagctcgagcgtatgctcatctgccctgccttcgaggacctggtccatgagctccttcaggacgcccaggcctacacggcagggcgtacattttccgcagctctgcgttgcgcacatgccgacgaaggcagccgtgaattcgaccggacatggagcaagcgagctcaccgagagccgcttctctaccgcttcatgcagtccatccatgactgcctgggcctcgctgcgctcgaccacatgcaatctagccattcagtttcctctcctcgtgctttccgcacggcagaggcacgctcggcagctccttccccggaagacggctttccgcaccgccccctgtgccatgagcctgcacgccggcgcttcccctcgtcggcctgccatgcctgaagcttgagcatagcagccggaagcataggagccttacgatttgcggtgaatgaagcatattgcagggcagatggctgttctgcagcagaacgcataggtcctgcatggaaaaggcacctgcccggctttccggacaggtgccttgatggtcatgcttctatgctggtgcgctaggcaatctcgtgcttgaaggcctcgatgaccttcgtacccatgtcgcgcgtgccgagcttcctgtcttcaggcgtcatctcgtctgcaaggtcaggcgtcctccagccttcatcgagcacgtcctcgacggctgccttcacggcatccgctgcgtggtccatctggaagctgtagcgaagcatcagctcgaccgagagcatctgtgcaatcgggtttgcgatgcccttgcccgcgatgtcaggagcagacccatggctcggctcgtagagtgccgtgccggagcccagagaggcggaggcaagcatgccaagagagcccgtgagcatcgacgcctcgtcggagaggatgtcgccgaacgtattctcggtcacgaggacatcgaactgggcaggattcgcgacgagctgcatggcgcagttgtcgacgagcatgtctccgccctcgacatctttgaactcgtccatcatcctgtggttcacttcgcgccagagacgggatgtctcgagcacgttggccttgtcgaccgacgtgaccttgccacggcggcgcttggcagcctcataggcccagcgcacgacacgctcgatctcgtactcggagtattccatcgtatcgaccgcacgctcgcctgaagcgccgtcgacgccggcacctgcgacatccttctcgcgcctgtgctcgccgaagtagaggccgcctgtaagctcgcggacgatcaggatatcgacaccttcgaggaactcaggacgaagggtggatgctcctgcgagcgccttgtagatgtgcaccggacgcaggttcaggaagagccccagattcttgcggatggcaagaaggccctgttcagggcggacagcgccaggcgtcgtgtcattccacttcgggccgccgaccgctgccagaaggaccgcgtcagacgccttggcggcgtcgagcgtctcgggcggaagggcgctcacgggctcgcctgccgcacgcgtcgcatcgatggcagcgccgccgatcagatggtcttcgcagacgaactcgacatcttctgcctggccgatagctgcaaggaggcgctttgcctctgccatgatctcagggccgatgccgtcacccggcagggtgcagatacggtaggtcttcttccccatcgtctatgcctccttcttctgggcgagcagattcttcgtccttgcgacgaggccgccctcgttgatgatctcctggatgaagggcgggaacggctgtgcctggaaggtcttgcccgtcgtctcgtccgtgatgaggccagtgtcggcattgatcttcacgacatcgccgtcagagatcgcatcgcaggcctcggggcactccatgatcggaaggccgatgttgatggcattgcggtagaagatgcgggcaaaggacttggcaatgacgacagagacgccagcagccttgatagcgacaggagcatgctcgcgcgaggagccgcagccgaagttctcgtctgcgacgatgatgtcgcccggcttcacgcgcttcacgaacgtcgtgtcgaggtcctcgaggcagtgcttcgcaagctctgccgggtcggatgtattgaggtagcgggcagggatgatgacatcagtgtcgatgtcgcgcccgtagcggaagaccgtgccttcgaattccataggtgagcctccttcaggctagtcgagatcggacggcagcgcgatgtggccggcgacggcagaagctgcagcgacggcggggcttgcaaggtagacctcggaggtcgggtcgcccatgcgcccgacgaagtttcggttcgtcgaggagacgcagcgctcccctgctgccaggatgcccatgtagccgccgaggcagggtccgcaggtcggggtcgagacgacgcagtgggcattgatgaagatatccatgaggccttcatgcacgcactggagccagacggcctgcgtggcaggaatcacgatgcagcgcacgttcggattgaccgtgcggcccttgaggactgctgcagctgcgcgcatgtcttcgatgcggccgttcgtgcaggagccgatgaccgcctggtcgattgcgatatggcgggactctgccacaggatgcgtgttggagggcagatgcggccaggagaccgtcggcacgatatccttcgcatcgatcctgatgacctgcttgtatgcggcatcggggtctgcatggtattccttccaggagcgctccgtcctgccttcgagccaggtacgtgccatatcgtcgacctcgaagaggccagccttgccgcctgcctcgatggccatgttcgcaatcgtgagcctgccctcgaccgagaggttccggatcgtggagccagcaaactccatcgcgcagtagagcgcgccgtcgacgccgatctggccgatgatgtagaggatgatgtccttggcagaagcaccttcaggaagctcgccctcgatctcgaagcggatggtctcaggcaccttgaaccaggccctgcctgttgccatgccgacaccggcatccgtagagccgacgcctgtcgagaaggcaccgatgccgccgtaggtgcaggtatgggagtcagcgccgatgatgagatctcccgggccgacgatgcccttctcgggcagcagggcatgctcgatgcccatgcagccctgctcgaagtagtgggtgatccccatctcatgcgcaaagtcgcgcgtgatcttcgtctgctcggcgctcttgatgtccttgttcgggctgtagtggtcgggcacgaggaagatcttggtcctatcgaagatgccggcgccaagctcgcggaccgtcttgatcgcgatcggcgccgtgatgtcatttgcgagcacgccgtcgaggtcgcactcgatgagctgtcctggcacgacacggtcgaggccggcatgcgcggccaggatcttctctgccatcgtcattccctgtggcatggtctgccttcctttctggcttatgcctgctcctcagagccggcctctttcgagagaagcgaatcgacaaactggcgggcacctcgtgccgacctgccgccgcgcctcgtcgcgaagcgctctgcttcaaggtcgagctcctgctcgtcgagcgcaatgccgcgctcctgggcaagcttgtgcacgatatcgaggtaggtctgcttgttcggcttcgtgaacgagaggtggatgccgaagcggtcggagagcgacacgatctcctggagcgtgtcgttcagatgcacctcatcgccctcgcgctcgctgaacgtctcccgcacgagatggcggcggttcgatgttgcatagatcgcgacattggccgacttcgccgagaccgagccctcgaggattgccttcaaggctgcgaagttgtcatcgtctgctgcgaacgagaggtcatcgatgaagatgatgaacgtgcaggggttgtgcgtgagcgtatcgaggatgcccggaatgtcgcggagctgctccttccggacctcgaggatgcgcacgcccgcgcccgcaagcgcattggcgacggccttgacggtcgagctcttgcctgtgccggcatctccggtgaggaggatattggcagcaggaagcctcttcacgagcgcgcgggtgttgtcgaggatgaccttcttctcgcgctcgtagtcgacaagatcttcgagcctctgcggatcaggatgcttgaccggcacgatctgaccctgagcatccacgcggaacacatggtagcgggcatacatgccgtagccatacttgccgatgttcgcgatgcgctcatggtaggtgcctgcgatatcgaccttctgcgtatcgaaggcaggaagacggtctgcagctcccggcagaagctcgaggaagtcctggggctcgaggtcggcaagctcctggaggaccgagagctctgcctcggcagcagcagcaagcgaggcgccaggcaccctcccggcaccgatggtccgaagatacacattctcgtcgtcgaccgcagcgtccaagatgtaggacccgaggccttccgcctcggagtcgaagagcgctgccacgaaggtggcataggcacgggcaagcgccattgcatcgcctgaagtgctgttgccttcctccgcatccgatgcgagcgtcgctgccttatggagcgcatctcccagagccgcgatgacaggatcttcttcgaggctccggaagaccgtgagcgtatcgagcgagaacgagaggctcatgagcctttctgcattcattgcgtctaccacagctccctagttgaggacagcacccttggcgccgctcgagacaagctgggcgtagcgcctgaggtagccagagagcggcttcgtcttgggcgtgaacgctgtcatgcgccgctcgaactcctcatcggagatcttgaggtcgagcgtgcagttcgggatatcgatcgagatgatgtcgccttcctggatgatgccgataggtccgccagaggctgcctcaggcgagacatggccgatgcaggcaccgcgggtggcgccggagaagcggccatccgtgatgagggcgacagaggagccgaggcccatgccctggatggcagaggtcggcgtcagcatctcgcgcatgccagggccgcccttcggaccctcgtagcggatcacgacgacatcgcccggattgatcttgccgccgtcgatggcagcctgcgcctcttcctcgctctcgaagacacgtgccggtccttcgtgcacgagcatctcaggagcaacagcagagcgcttgacgacagagccttcaggggcaaggttgccatgaaggacggcgatgccgccggtcttggagaacgggttgtcgagcggtcgaatcacgtcgtggtcgaggacacgggcgccctcgaggttctctgcgacggtcttgcccgtgacggtaaggcaggacgtatcgatgagacctgcctctgcaagctcggacatgacagcgtagatgccgcccgcctcgtcgagatcctcgatgtaggtcgggcctgccggtgccaggtggcaaaggttcggcgtacgtgcagagatctcgtttgcgatatcgagcgagaggtcgacgccgcactcatgggcgatggcaggaaggtggagcatcgtgttcgtcgagcagccgagcgccatatccacggtaagcgcgttcatgagcgcttcctttgtcatgatctgcctcgcggtgatgcccttcttgaggagctccatgacggccacgccggcgtgcttggcaagctggaggcggcgggaatagacagcagggatcgtgccgttgccacgaaggcccatgccgatgacctcagtgaggcagttcatcgagtttgccgtgtacatgccagagcaggagccgcaggtcgggcatgccttgcactcgaactcgtggagcttgtcctcgtcgatctttcctgccgtgtaggcgcccatggcctcgaacatggaggagaggctcgtcttgtggccatcaatatggcctgcgagcatggggccgccggagacgaaggtcgtaggcagatcgagacgcgctgctgccatgaggaggcccgggacattcttgtcgcagttcgggaccatcacaagggcatcgaagccatgtgcgagcgccatgcactccgtggagtcggcgatgaggtcgcgggtcacgagcgagtacttcatgcccgcatgtcccattgcgatgccgtcacagaccgcgatggccgggaagaccaccggcatgccgcctgcttcggcgacacccatcttgacagcctcgacaatcttgtcgatgttcatgtgtcccggcacgatctcgttgtaggaagagacgatgccgacaaggggcttcctgatctcttcttcggtccagccgagggcattgtagagggagcggtgggccgcagcttcaggcccgaacttcaatgcgtcgctcttcatagggatatcctctctcaggcgcaggtgcgcccttccttaacgtgttttgcgctagccgacaatctggaagccttcgtcgacgaggcgctccttgattgcatcgatctgggcctggtcgcgggtctccatgccgacacgcagggtgcaggcagagatcggcaggtccggatcggacaggtcgtagtcgaccgagaccacatttgcgccgagcgaggcgatgatgcgggagacctgctcgagctggcccggcttgtccgtgagcttgatcgcaagcgtcgccttcctgccgctcatggcaaggccgcggttgatgacgcgggacaggatgttcacgtcgatgttgccgccagagatgacgcagacggtgcgcttgccctgaagcggcagcttgccgaacatggcagcagccacaggggcagctcctgcgccttcgctcacgagcttctggcgctccatgaggttcaggatggctgctgcaatctcgtcgtctgagaccgtgaccatatcgtccacgtacttctgcgccatcttgaacgtcaggtcgcccgggttcttgacagcgatgccgtcagcgaacgtgaccgccgtatcggatgctccccacttgcctgcatggaaggcatcgaccatggcagaggcgcccttggcctggacgccgtagaccttgcacgacggcttcaggctcttgacggcacaggcgacgccggagatgaggccgccgccaccgaccggcacgatcacggcatccacatcgtcgagcgtatccatgatctcgaggccgatcgtgccctggccagcgatgacatcctcgtcgtcgtagggatggatgaacgtggcgcccgtctcctcctggagacgcactgcctcgtcgtgggcatcgtcgtaggtgccaggaacgagcctcacctcggcaccgagacggcgggtattctcgaccttcatgatcggcgcgccatcaggcatgcagacgatgctcttgacgcccatgtgggtggcagccaaagccacgccctgggcatggtttccggcagagcaggcgatgatgcccttgtcgagcgcctccttcgggagctgcgagatcttgtagtaggcacccctcagcttgaaggagccggtgacctggaggttctccgtcttgagatagagctcgtcgagtcccggcacaagctgcggagcagcgatgaggtcggtctttctggcgacgcccttgaggacataggctgcgtggtagatcttgtcgagcgatagcatgggcatctccttagatggcaaggaagttcgtgatgtgctggcctgccggaaccatcgggcggaccatctcgtcgggatcgaggacgcagtcgatgaccgcaccggtgccgccgtcgagggctttctggagcgcttcttcgagctccgtgaccgtgctcacgcgccagccgggaaggtggtaggcctcggcgagcttcacccagtcaggtcctctgtcgagcgtcgtctcggagtagtgctggtcatagatcagcgtctgccactgatggaccatgccgaggacggtgttgtcgaagacgaccgagatgatcggcaggtggtagtgctcgacagttgcaagctcgatgcagttcatgcggaacgagccatcgcccgtgatatgcacgacgcgcttgtcggggttgccgacctgggcaccgatggcagcgccgaggccgaaccccatggcaccgaagccgcccgatgtgatgagctgtcctggataggagtagtgcatatgctggatggcccacatctggtgctggcccacgtccgtggcgaccatcgtgtcttcggggcacaggcgcgcaatcgtgtcgtcgatctgcttcggcgtcaggtggtctccgccctcttcgtactgggtctccgtcgggaacgagaatacgaactccttccagaccttgtggctctgctgcgggaccatctcgttcaggagctcgagcacgcgcttcgcatcgccaagcacatagtggtcgcagcgcacgttcttgccgatctccgtcgagtcgatgtcgacctggacgatcttggcctggcttgcaaaggaggaaggctggagtgccacacggtcggagaagcggcagcccacggcaatcaggaggtcgcagttgtcgacggccatgttcgaggcctgagatccatgcatgccgatcatgccggtcgagagcggatcgtttccgacaaagccgccgccacccatcacggtgatggcgacaggagaatcgatcctgttcgcgaactcgttgaactccttgttcgcgcgtccgcgcacgacgccgccaccacagataagaagcggacgctccgcttcctcgaccatctgcgccaggcgctcgaccgcagccgtctcaggctcacgggtctcgatgccgcccatgagacgcttcgagagctggttcgggaactcgaagatgcgatgctcctcgaccggcacatactcgtagtcgcacttcgcctgtgtgacatccttcgtgatatcgatgaggaccggacccggacgtcccgtgcgggcaatcaggaaggcctggcgcacgacatctgcgagctcatggacatccttcacgacacggttccactccgtgatcggcttcgttatgcccgtgatatcgacttcctggaaggagtccttgccgagaagcttggacgagacgttgcaggtgatagcaacgataggagaagagtccatataggccgtggcgatgccggtcgtgaagttcgtgcagccggggcccgacgtcgcgaagcacacgccgaccttgccggtcgcacgggcatagccgtcagcggcatgcacggcaccctgctcgtggctcacgagatagtggtgaatctcgggcgtctggtacaagacgtcgtagacgtcgagaatcgttcctccgggatatccgaagacggtatcgcatccctgctccttgagacactcgatgagtatctgggcacctgtgagctccatgcatcctccccctatggcggcaatccttgattgaaggatatgcctcgagctgccttatggcagcggcctgtcctgcagacggtgggtccctcgtgcgaggggcactccgtgtgcaggacgcccggatacgggatgcatccgggcgtccagccgaaatcaggtgccggaactagttgttgaggagcttgtcctcgtcgttccaggcgtagagagcacggatctccttgcccgtcttctccatcagggtctcggcctgctggcggcgcatggccttgaagtggacctggtgggactcatcggacatgtcgagcaggaactccttggcgaactcgccgttctggatgcgcttcaggttgtagcgcatgccctccttggcagcctcggtgatcacgtgcgggccggcggtgtagtcgccgtactcagcggtgttggagatcgaggaacgcatgccagagaagccgctctcgtagatcaggtcgacgatgagcttcatctcgtggatgcactcgaagtaggcattgcgcggatcgtagccagcctcgacgagcgtgttgaagcctgcctccatgaggtcggtcacgccgccgcagaggacgttctgctcgccgaagaggtcggtctcggtctcggtcctgaagtcggtctcgagcagtgctgcacgggctccgccgatggctgcgccgtaggcaagggcgatatcgaaggcgtcgccggtggcatcctggtgtgcgcagacgaggcagggcgtgcccttgccctcgaggtaggtggaacgcacggtgtggcccggagccttcggggcgaccatgatgacgttgcagtcaggacgcacctcgatgcagccgtagtggatgttgaagccatgggcgaaggcgatcgtcttgcccggcgccaggttcggctcgatgtccttcttgtacatggatgcctgatactcatcgttgatgaggatcatgatgatgtcagcccacttggctgcctcggcagtggtcaggacctccaggccctgcttctctgccctggccttggacttggagccctcatagaggcccaccttcacgtccacgccggaatccttgaggttcagtgcgtgtgcgtggccctgggagccgtagccgatgatggcgaccttcttgccatccagcttgctcatgtcgcagtcctgctcgtggtacatcttgaacgccatgtccaatcccctttcaatcctggtttgggtccgttcaatatagctgcctgccttcatccgggaggctggctgggctatccgttaactacctgttagcacgcggcaaccgatgcatgttcgttcgttttccaccggctttcaggtctcgagagttcctatagattcgcgttctcccgcatcacggaggagccccgctcgagcgatatgacgcctgtgcggcacacctccaggatctcgaaatcacgcatgaggtcgatgaagttgtctatgcgccgggtgcccccggcaatgcggaacacgatggaatcgcgggtgtagtcgacgatcttggcacggaatgcctcgccggcatcgagcacctgctggcgggtcgcattgtcgtttgcgaccttcagaagcagaagctcgcagctgatggaatcctccgggtcgaactccttgaaggagacgacatcggggagcttcgcgagctgggcgacaagctggcgcttggccctgtcctcgccctcgaactgcacggtgatgcgggaaagatcttctgtctcggtctcggagaccgtgaggcaggtgatgttgaactggcggcggcggaacatgctcgtgacacggttgagcacgccgtactcgttgcgcaccatgatggcaatgctgtaggtcttcatgatgctatcgccccatcctctgcttcacgtcgtccatgttcacgatgagctcgtccatcgaggcaccgatctggagcaccggcgtcacgaactcgtcgatccctatcgggcactcgatgaggacgggtcctgcctcggagaaggaagcctcgaaggcacgggagaagtcctcaagggtctccgtgcgcgttgccttggcacccatgcgcgggcaatggcgcagaagtctgctcccttgtgggaaagcgtcgtctcggagtagcgctggtgcctgaagagcgactgcatctgtcgcaccatgcctaaggtcccgttgttcaggagcacgaccgtgaccggaatgtcgtggtctgtggccgtgatggtctccgccatgtccatggcaaaggagccatcgcccgtgatgaggaccgagcggcacccggtgccgagagcggcgccgattgcggctccgaagccgaagcccatggtccccaggcctcctgaggtgatgagctcccggggatgcacgaacgtgaggtactgcgcggcccacatctggtgctgccccacatcggtcacgacggcagactcgtgcggacggatcctgtcgatagcaatcatgaggttcttcggggtcatgccgtcacggtagtcgtcgtagcccttctcctctgccctgagctcgcgcatcttgcgcccccacgcctcgtgcgtgttgggctcgatgagcggcaggagcgcacgcaaggtctcctccacatcccccagaagctcgaccttgtcgtccagggtctttgagagctccgaagagtcgatatcgatgcgcacgaccttgccggagggctcgaatttcgtgcggtcgcccgttgcgcggtcgttgaagcgcacgccgagggcaatcaggcagtcagacgcattgagggccttcgtgcttgcaaagtggccatgcatgccctgcatgccgaggaaattgggagtcctcgtcgggatgccggagacgcccatgagggagcacccgataggggcagagatcctctcggcgagctctatgacctcatcccccgctccgtctgcgacgacgccgccgccgaagtagatgaagggacgctcggcgctgttgatggcacgagctgctgcctcgaggtcagccgcatcgggcaccatctgctgcggcctgagcttcacctcgtcgtgctccagaggctctacgagctggcgctggacatcggaagggatgtccacaaggacaggacccttcctcccggagcttgcgagcgcgaaggcctcgtgcacgatatgcccgagcctgtctgccgagcgcacgaagtagttgtgcttcgttatgggcagcgtgacgccggtgatatcgagctcctggaaggcgtccgtgccgatcatctggttgctcacgttgccggtgattgcgacaagcgggatggagtcgaggtaggccgtggcgatgccggtcacgagattcgtggcgcccggacctgacgtggcgataacgacaccgcagcgtcctgtcgccctggcatagccatcggcagcatgcgtggcatgctgctcgtgcgtcgtctcgatgtggcggatgcggtcgcgcctgtcgtagagtgcatcatatatatcaagcacagtgccgccgggatagccgaatacggtattcacgccctcctcgatgagcgtctcgatgaggagctccgctcctgtcatcttctccacgttctcgccctccttcccgcttgtcttgctgatatgaactacttgccttcgttggcgcgtgccgtctggatcatgcggttgatcgcattgacataggcctttgccgaggacacgacgatatcgttgtcggcgccacggcctgtgtagatcttgccggactcggactggatgcggaccgtgacctcgccgatagcgtcgatgccgcgcgtgacggccttgacgacgaactcctggaggtcgccgtgcatcgagacgaccatgtcgattgccttgtaggcggcatcgaccgggcctgtgcccgtggcgcagacgacgtgcttctcccctgcttcgtccatgatcgtggccgtggcggtaggcaccagcgggtcgccgcagctcacctgcagtgcatcgagcgtgtagacagccttgatgtcgcggtcgcgctcctggaccatggactcgaggtcctcgtcgtagacttccttcttctggtctgcgatctcgaggaagcgctggtagatgtcatcgaactcctcaggcgcaaatgtgtagccgagctcggcgagacgatgcttcagcgctgcgtgcccgctcctcgcagagaggatgatttccgatcctgcggcacccacatcctcggggttgatgatctcgtaggtatcgcgggccttgagcacgccgtcctggtggatgccggaggagtgcgcaaaggcattggcgccgacgatggccttgtttgcctggacattcatgcctgtgatgcgggacaccaggtgacttgcacgcgtgagctcctgcgtcacgatgtccgtgtggccatcgagctcgtcgccgtgcatcttgagcgccatgacgacctcttcgagggcggtgttgccggcacgctcgccgaggccattgatcgtgcactcgacctgcgtggcgccgttcttgacgccagcgagcgccagcgctgttgccatgcccaggtcgttgtgcgtgtgcacggagatcgtgacgttctcgatgccgcggacattgtcggagaggctcttgatgcgggcaccgaagtcatccggcatgttgtagcccgtcgtatccggaatgttcacgaccgtggcgccggcatcgactgctgcctggatgacacggatcaggaagtcctggtcggcacggccagcatcctctgcatagaactcgacgtcgtccacatactgctttgcatacttgacgcagtggatggcacgctcgatgcactcgtcctccgtgatgcggagcttctctgcgaggtgctgcggcgagacgccgaggccggtgtggatgcgggggcgcttggcggtcttcagggcctctgcggcacggtcgatatccttgtcgacagcgcgcgtgaggccgcatacgacgcagtcatcgcctgcgaggcggccgatctcctgtacggacttgaagtcgcccggactcgaaatcgggaagccggcctcgatgacatcgacatgcatgcggatgagctcctgggcaatcacaagcttctcttccgtgttcatggatgcgccgggggactgctcgccgtcgcggagggtggtgtcgaagattgcaatcttgcgggtcataggatggctcctctcgtgtgcggatgcacattgatacacaaaacgcctggcccaggaaacctggcaggcgtcgcagagagttctatgtaagggtggtgtgtgcgagcgccgatgcctagctttctaggaagacaggatctaacgcgctggctgtatatgtctatacgcctagcgcgcgctcgctagtaggagtaccgcaatggagctgatggctacgctctgcgcagcttcagaaccaatgtatgtcttaatctgagacactctggatactcccttggacttggcacctcccggtgcgttggtagcaggatgacacactcgaaacagcttggacaggctctgaatctgttacgtagcgaaacggaaacaaagcacccaagcaagctttcagctacctcgctgaccgcttcttctaaatatagatgcagccgccatcatgcctgaaagctagccctgccctgtgcgcttcctgaatccgggagcggtcgtggaagatgcggggcgccacagcgccttcacattcgtcgaatgccttcgttgtggccttccccgcctgcttgcatacggaccatatctgtctgtgtggcatagcgcagggacatcactgcatgcaggcacgcctgattttccagagcctatcgatggatacgccagccgctctggaggctgtcgctcaggctgctagttcatgcgcttacggcgggcttgcttcagccagttgcgcttgaaggcacccacgccgccaaagaacttgctgtacgtctcaccatcctcgtggacagcatatttaacggcagcaagctcaatggtgcacaggtagtcagctacctgctccagccgatagacgctcatggcagtctttcgacgcacgacgacattgcgggacaaaatgcctcccgctgctccgtacagggcacgctccacgatgctctgtccaccgtcgtagcagaccttcatatcgtcgaaggtctgaaagaaatccaggctgtccgacatgaaagtttcgatgtcgcgctccatgcgcctcgagaggccctctggattcgggtactcactgcgacgatagaaaaaggtagcgtagctaatcggcaggcgctggaccagcacgttgaaagaccacaggagttgtttcctttgcgatggctccaggccctcataggtgccatgaccattcagcagcggctctgagcggaagggaatgttgggaaggcctgccctagaaagcgcctgctcgtagcgcatgacctgctcgcgaatatcattcgcctggtcatggaagacaggcgtcagcaggcagtgcgagatactcctcccatatccccgctttcgtccgcaaagatgctctgccctcttgccatgaaacagcccctggagacagaagaagccgggggataggccccggcacttggaggtagcggaaacccaccgccaagatcctcataccaccggagagcgctcctgcatacctccgtcggtctcgattctcatggcttggatctcaccatgaattggaaccataccgaattcaccatgctgaactctcctgccggtttcttcgatgtccgagcataacgcataatcagggatgcccatgatacagatgcagcttggctgcgatataaagactacccttgttcaacgatggaacccccacccatgcatccctgcaaaggccattgctcatagcgtgctgaaactggcttcccgaccaatcgtatgcagccctctcattgcaaagaaatggtccatggggagccatcggagccttcgtgtacctgctccaagagaacgacaaagcattgtccctgcatacccgcacagcttgccgttccagaccgtgctggcctcattcccagcgcggtgcggaacggccgagtcctgaagctgtctcgcactctttctggcatcacagccccttcatccatgcactcgaggtctgttctgcctccgttccatgcaccagaggcatacgcacacgtcagcggcctgtgcggtgctgccagatttctggcagaactacgacgctatcgaacgctttgtgtgcttttgcgtctgccgaaaaaatcctttggccctccgtgcgaaaatgcttccccgggcgcagttttgctacctgcgccggagtcgcttttctacatgttgtcgacaggcattcgacactctttcaacaatatcttgtatatttcatcgctgcagaccaccatgagttgtggcatagtactccttgcagcgcaagaggctgtggtagccacagctgatatgcaccaacgcagacgcctctcgcattgcacagaatgacatgcacgccaggggccagcgggaaagcgcgctggtgatgaccatcaaggagagcggaaatgaagattatcaagcgcaacggatctgaagtttccttcgatatctcgaagatcgagaacgcgatcaagggcgcgaaccgcgaggcagcagaggacgagcgcctgaccgaccgccagatcgtctacgccgccgagaatgtgcgcgaccgctgcgaggcagcaggacacacggtctcggtcgaggagatccaggacatggtcgaggatgagatcatggcactggaccgctacgaggtagcccgcaagtacatcatctaccgctatgtccagtctctgaagcgccagaagaacacgacagacgacaagatcctgtccctcatcgagtgcaacaacgagggcctcggagaaggaagcctcgaaggcacgggagaagtcctcaagggtctccgtgcgcgttgccttggcacccatgccggggcaatggcgcagaagtctgctcccttgtgggaaagcgtcgtctcggagtagcgctggtgcctgaagagcgactgatctgtcgcaccatgcccaaggtcccgttgttcaggagcacgacctgaccggaatgtcatggtccggcggctgtgatggtctccgccatgccatcgcaaaggagccatcgcccgtaatgagaacgagacggcacccggtgccgagagcggcgccgatgcggcgccgaagccgaagcccatggtccccaggcctcctgaggtgatgaaactcccggggatgcacgaacgtgaggtactgcgcggcccacatctgatgtgccccacgtcggtcacgacggcagactcgtgggacggatcctgtcgatagcaatcatgaggtcttccggggtcatgccgtcacggtagtcgtcgtagccttctcctctgccctgactcgcgcacatgggcccccacgcctcgtgcgtgttgggctcgatgagcggaggagcgcacgcaaggtctctccacatcccccagaagtcgaccttgtcgtccagggttcgagagctcgaggagtcgattcgatgcgcacgaccttgccggaggaacgaacttcgtgcggtccccgtcgcgcggtcgttgaagcgcagccgagggcgatcaggcagtcggagtcattgagcgctttcgtgctggcaaagtgtccatgcatgccctgcatgccgcggaaattgggagtcctcgtgggatgccggagacacccatgagcgagcagccgatgggagcagagtcctcttggcaagctctcgacctcatcccccgctccatctgcgacgacgcctccaccaaagtagatgaagggggcgtccggcgctgttgatggcacgagctgctgctcgaggtcagccgcatcgggcaccatctgctgcggcctgagcttcacctcgtcgtgctccagaggctctacgagctggcgctggacatcggaagggatgtccacaaggacaggacccttcctcccggagcttgcgaggcgaaggcctcgtgcacgattgcccgagctgtctgccgagcgcacgaagtagttgtgcttcgttatgggcagcgtgacgccggtgatatcgagctcctggaaggcgtccgtgccgatcattggttgctcacgttgccggtgattgcgacaagcgggatggagtcgaggtaggccgtggcgatgccggtcaacgagattcgtggcgcccggacctgacgtggcgataacgacaccgcaggtctgtcgccctggcatagccatcggcagcatgcgtggcatgctgctcgtggtcgtctcgatgtggcggatgcggtcgcgcctgtcgtagagtgcatcatatatatcagcacagtgccgccgggaagccgaatacggtattcacgccctcctcgatgagcggtctcgatgaggagctccgctcctgtatcttctccacgttcgcgcctccttcccgcttgtttgctgatatgaactattgttcgttgcgcgtgccgtcggatcatgcggttgacgcattgacataggcctttgccgaggacacgacgatatcgttgtcggcgccaggcctgtgtagatcttgccggactcggactggatgcggaccgtgacctcgccgatagcgtcgatgccgcgcgtgacggccttgacgacgaactcctggaggtcgccgtgcctcgagaagaccatgtcgattgccttgtaggcggcatcgaacgggcctgtgccgtggcgcagacgacgtgttctcccctgcttcgtccatgatcgtggccgtggcggtaggcaccagcgggtcgccgcagctcacctgcagtgcatcgagcgtgtagacagccttgatgtcgcggtcgcgctcctggaccatggactcgaggtcctcgtcgtagacttctcttctggtctgcgatctcgaggaagcgctggtagatgtcatcgaaatcctcaggcgcaaatgtgtagccgagccggcgagacgatgcttcagcgctgcgtgcccgtcctcgcagaaggatgatttccgatctgcggcacccacatcctcggggttgatgatctcgtaggtatcgcgggccttgagcacgccgtcctggtggatgccggaggagtgcgcaaaggcattggcgcgacgatggccttgtttgcctggacattcatgcctgtgatgcgggacaccaggtgacttgcacgcgtgagctcctgcgtcacgatgtccgtgtggcatcgagctcgtgccgtgcatcttgagcgccatgacgacctctcgagggcggtgttgcggcacgtcgccgaggccattgatcgtgcactcgacctggtggcggttcttgacgccagcgagcgccagcgctgttgccatgcccagtcgttgtgcgtgtgcacggagatcgtgacgttctcgatgccgcgggcatgtcggagaggctcttgatgcgggcaccgaagtcatcggcatgttgtagcccgtcgatccggaatgttcacgaccgtggcgccggcatcgactgtgcctggatgacaagatcaggaagtcctggtcggcacggccagcatctctgcatagaactgacgtcgtccacatactgctttgcatacttgacgagtggatggcacgctcgatgcactcgtcctccgtgatgcggagcttctctgcgagggtgctgcggcgagacgccgaggccggtgtggatgcgggggcgcttggcggtcttcagggcctctgcggcacgtgtcgatatccttgtcgacagcgcgcggtgaggccgcatacgacgcagtcatgcctgcgaggcggccgatctcctgtacggacttgaagtcgcccggactcgaaatcgggaagccggcctcgatgacatcgacatgcatgcggatgagctcctggcatcacaagcttctcttccgtgttcatggatgcgccgggggactgctcgccgtcgcggagggtggtgtcgaagattgcaatctgcgggtcataggatggctcctctcgtgtgcggatgcacattgatacacaaaacgcctggcccaggaaactggaggcgtcgcagagaggtctatgagggtggtgtggcgagcgccgatgcctagctttctaggaagacaggatctaacgcgctggctgtagtctatacgcctagcgcgcgctcgctagtaggtaccgcaatggagctgatggctacgcttgcgcagcttcagaaccaatgtatgtcttaatctgagacactctggatactcccttggaattggcacctccgtgcgtggtagcaggatgacacactcgaaacagcttggacaggctctgaatctgttacgtagcgaaacggaaacaaagcacccaagcaagctttcagctacctcgctgaccgcttcttctaaatatagatgcagccgccatcatgcctgaaagctcctgccctgtgcgcttcctgaatcgggagcggtcgtggaagatgcggggcgccacagcgccttcacattcgtcgaatgccttcgttgtggccttccccgcctgcttgcataaggaccatatctgtctgtgtggcatagcgcagggacatcactgcatgcaggcacgcctgattttccagagccatcgatggatacgccagcgctctggaggctgtcgctaggctgctagttcatgcgcttacggggcttgcttcagccagttgcgcttgaaggcacccacgccgccaaagaacttgctgtacgtctcaccatcctgtggacagcatatttaacggcagcaagctcaatggtgcacaggtagtcagctacctgctccagccgatagacgctatggcagtctttcgacgcacgacgacattgcgggacaaaatgcctcccgctgctccgtacagggcacgctccacgatgctctgtccaccgtcgtagcagaccttcatatgtcgaaggtctgaaagaaatccaggctgtccgacatgaaagtttcgatgtcgcgctccatgcgcctcgagaggccctctggattcgggtactcactgcgacgatagaaaaaggtagcgtagctaatcggcaggcgctggaccagcacgttgaaagaccacaggagttgtttcctttgcgatggctccaggcctcataggtgccatgccattcagccgcggctctgagcggaagggaatgttgggaaggcctgccatgaaagcgcctgctcgtagcgcatgacctgctcgcgaatatcattcgcctggtcatggaagacaggcgtcagcaggcagtgcgagatactcctcccatatccccgctttcgtccgcaaagatgctctgccctcttgccatgaaacagccctggagacagaagaagccgggggataggccccggcactggaggtagcggaaaccaccgccaagatcctcatacacggagagcgctcctgcatacctccgtcggtctcgttctcatggctggatctcaccatgaattggaaccataccgaattcaccatgctgaactctcctgccggtttcttcgatgtccgagcataagccataatcagggatgcccatgatacagatgcagcttgtgcgatataaagactacccttgttaacgatggaacccccacccagcatcctgcaaaggccattgctcatagcgtgctgaaactggcttcccgaacaacgtatgcagcccctctattgcaaagaaatggtccatggggaacatcggagcctcgtgtacctgctccaagagaacgacaaagcattgtcctgcacacccgcacagcttgccgttccagaccgtgctggcttcattcccagcgcggtcgggaacggccgcgtcctgaagctgtctcgcactctttctggcatcacagcccctccatccatgcgctcgaggtctgttctgcctccgttccatgcaccggaggcatacgcacacgtcagcggcctgtgcggtgccgccagatttctggcagaaatgcgacgctatcgaacttgtgtgcttttgcgtctgccgaaaaaatccttggccctccgtgcgaaaatgctttcccgggcgcagttttgctacctgcgccggagtcgcttttctacatgttgtcgacaggtcttcgacacctttcaacaatattgtatatttcagcgctgcagaccacatgagttgtggcatagtcatcatgcagcgcaagaggtgtggtagccacagctgatatgcaccaacgcagacgcctctcgcattgcacccagaagacagctacgcgaaaggccggcgggcaaggcgcggcgacaaccctcaaggagagcgaaatgaagattacaagcgcaacggatctgaagtttccttcgatatctcgaagatcgagaacgcgatcaggggcgcgaaccgcgaggcagcgaagacgagcgtctgaccgaccgcagatcgtctacgccgccgagaatgtgcgcgaccgctgcgaggcagcaggacacacggtctcggtcgaggagatccaggacatggtcgaggatgac

SEQ ID NO: 52 - DNA, 16245 bp, Unknown
  Metagenome-assembled genome
ggggagacaacattacgcagaagttcatctcctgggaatgtgaacggcctggcgagccgtcctcaagaagggccaagcttccaggagagattccgaatcttggagccgatatcttcgcaatccaggcggacgaagcctccaggagggccaggtcgagctatccaggtactcgttgtagcgctcgttccttgtctggagcgctgctccaaggttcgtctcctttgcgatcctgtggtagacgcggcgcatcagaggtgtcggctcttttgcggtagcccttgggacgggtcgcaatgacatgaggcgcttgaagccgcgctcgcggaccaggtggagcgggatgccggcaacgttcctatgccgccgtcaaagagcttgtggccgcccaatacctgcggctccatcatgccgggaagcgtcgagcttgaccagactttcctatgagctcatggacatgggcatatcgtccttcgtccagacaagcgtgcgtcccggtcgccttcgcctcgcctcgagcactggatcgcgatgggcgtcgggtttttcgcaaaggcctcgtagtcgaagggcagatagccatcgtcgacgcagccgatgagtcgtaccacgcattgaagtagccgtgccccgtcaggaacgagcgcacgcctcctgcctcgggccgcctgtcggcgagcacgatgaaggcgttcttcacgcgctcctggtctccagagacgaaatcgaccgtatggcttgctcctgcgctcacgccgcagacgaaatcgaacgatacgccgtgctccagaagcacattggcaaagcctgcggttataactggctcggtagcctcctccttcgaagaggagaggcgcaatcgctcacgtgggtctctatatgcagctgtctccatgactgcgaccttctggaacaggtccatgagcactgtggcatgcgagaagggatgaggtgctatgggagaatatcttaccaatccggccgatgcgcaggctgcgatgaagaaggtgatggagaaggcacaccatgcggtcttctcggagggtgctggcgtctccacggcaagcggcattcctgacttcaggagcccgaatggcctctacaaccagcgtggctacaagtatcgcccgaggagatgctctcgcacagcttctatatgacgcacagggaggagttcttcgacttctatcgccatgtcatgtgcgtgccttcggccaagccagaccagtgccacaggaagcttgccgagctcgagcaagaaggaaagctcgactgcgtgatcacgcagaacatcgatgggctccaccaggcagcaggctccaggcatgtgatagagctccatggctcgacgcaccggaatatctgccagaagtgcggagcagtctactccgaggagtggatctggatacggaaggcgggccgaagtgccgaagtgcggaggcgatgtgaagcccgatgtcgtgctctacgaggagagcctcaaagaggagaacctgatcggcgccgtgaaggcgatccagaaggcagacgtcctgatcatcggcggcacgtcgctcgtcgtctatccggcggcggggctggtggactacttccagggtgacacgcttgtcgtctgcaacctcgaggcggggccgcgtgacagtgctgcaggccttatctgcgcctgcgatatcgcaaagaccttcgacttctaaggtttcgaagaacgcacaggtacggccttcagcggcacaaggtgcgcgcgacggctacaatcgaaaccatccatctacagattctgctgcccttgcggcatggaaggaccgatcatgctcagagagaactatgccacgtggcactgtgcgggacatgagatctcgctggcgcggccgcacatcatgggcatcctcaatgtgacccctgactcgttcagcgacggcggcaagcacgctgacgccgactctgcgattgcctatggcctcaagatgctcgatgacggcgctgacatcatcgacgtcggcggcgagtccacgcgcccgggagcgacaccggtcgatcccgagaccgagctcgcacgcatccttccggtcgtgcgtgccttggccgatgctggcgccatcgtctcggtcgatacctaccatccgcaggtcgcagaggccgtgctcgaggcaggagcatcgatcctgaacgatgtcactggcttcacggacccggagatggtgcgcgtcgcttccgagagcgactgcggcctcattgtcatgtactggaacaaggaaggcctcggcacccatgcgacgaggcgctctgtcgagctcgacgtgaacaggccgaaccgccccgtggcacgtcgcgttccttcggccaggcgcttcacgcttcccgaagaggcgcagatcatgcgccaggtcatgggctttctgggcgaccaggcaaggaagctcatgcgtgccggcatcgcgcatgacaggatctgcatcgatccgggtcctggctttgacaagtttgccgacgaggatgtcgtgatccagcgtgcgacgccgaagatggtgagcatgggctatgcctatctctgcgcaccgtcacgcaagcgcttcgtcggtgccgtctcgggcgtcacggaagcagacaagcgcgatgctgcgacaatcggcatctgcctgggtgcggtcgaaggcggctgccggcttctgcgtgtccacaacgtgcccgaggtcgcgcaggccgtcgatgccttctgggctgtgcgccacccggatgcacgccaggccttcatctcgctcggcacagatatgggagatgtggacgagcggctcgataccctgggccatgcctgccgcctgatcgacgagattccgctcacctgtgtcgtgaacgtgagccatgcctacgagaccgatcctgcctatgggctcaaggatgaggtcgcgaatgccgtggcagagatcaggacggagcttgcgccgctcgtgctcctcgatgccctcatgaaggtcgagcaggagctcgggcgcacacgtccggaagacggatcgatgggccccaggactatcgactgcgaccttgcgtggtatgaaggggagacccatgccggcaacaagctgacgcttccgcataaggggctcggcgagcgcgactacgtgctcgtgccgatggaagatctgctccacgaccccgtacgcttcctggcgcactccggcgtcgaggtgctgccgcctgaagagcgcgtggggcatgtccgccgcgagctcggccgcatcctctgggaggcataaaagatggaagagatgccgctttccgggaccggttccttcgaggaggcacaggcgaaggcagaggaggcagggcgtgcaggcgctcctgcaggaaccgccttcttcgcggtcgcggaggagaagggtacgtcgcttctctgcgtctcggtcgtgcttgcgccgaagattccgatgccgtactacgagagcctgcctgcggtctctgccctgggcgtcgtcgaagggctcgagagcgcaggagcgcagggcctttctgtcggctggccagatacggtggtcttcgaaggcgcgacggtagggcgtgtgcgcgcgaaggcaggatatggagatgccggcatgttctgtgccgcaacggtcgcgctgacggctgcctcagctgacgaatccgtgcctgcgctcgaaggagcattcggcggcgcgcttccccaggcgtctgccttggcagagatcgtgcgcgaggcgctgcttgctgagtgccgcgcctgggaggagggcctgcagtcgaacggagcaggacccatggcgccagtgctcgaccgctacttcgaccgcgtccacctcatgggcgagaccgtcgatgtcgtgtatccgaacggacgcgtgcgtgcccagggccgctttgccggcatcgatatctggggcagggccacggtcgtgctcgaggacgggtctgagctcgagttcgctgccgcagagtcccagattcggggctaggagcgccgctcctgcgcggcgtgccagatcaggtagacgccccgaagcgtcaggtcggggtcgattgcgcagaagaggtcggtcgcctcgctcacggtgcgcgccaagccacccgtggcgatgacgggagctgaaggggctgcaatctcgcgcttgatgcgtgcgacgagtccttctgccatagcagcagtgccgacgacgaggcctgactggagcgcgcctgccgtatccttgccgagggcatgctcgggcgcctcgatcgggatgcttgccagcttcgcggcacgttcgaagagcgccgcggccgagagcatgaggccgggagcgatggcgccacccacgaaggcaccatccttgtccacgacgtcgatgttcgtcgcggtgccgaagtccacgacgatggcaggagagccgtagcgctccttggctgcgacggcgttgcagaggcggtctgcaccgatcgtctcggggtagggcatggagatttcgagatcggacacgtctttggcagagacgatcaggggctcttgcccggtcaggatcaggaagacctttctccaggcgcgggcaagcgtcggcacgacgcaggaaatgcctgccgcatcgattgcggtggcgccgaggcctgctgcagcgaagaaggcatggagctttgccagaagctcgtctgccgtgtcggtgcggtcagtcttcagccgccagccatgcacatgctcgccgcccgtgccatagagcgcaagcgtcgtctgggtattgcctacatcgaccgcgagaaacatgcgcgacctttctctcctgccacatttcagctcatcagtatcgcagatgcgcacctcagtgtctccatattctgtgcgaatgcttgcacatcaggcgcgaaaaagcgtactatgcttaacttgcgagccctggatacaatcagggccatagcccctcgtctggtcggaaaccagacctaccaaaggagtcctgccatgaagcaaggtattcatcctcagtacgtggagtgcaccgttcgctgcacctgcggcaacacgttcaagacccgctccacgaagagcgagatcgtcgtcgatctgtgcgacaaatgccacccgttctacacgggtcagcagaagctcgtcgacaccggcggacgtgtccagcgcttctccgacaagttcggcggagcagcagctgcacgcctcgaggctgcaaaggccgccaaggctgcaaaggctgcaagggctgccgagcaggaggctgcccgcaaggctgcaaaggaggccaaggctgccgagaaggcaaagcgtgctgcagagtacgcaaagaaggccgaggctcaggctgcagcagaggctgccaaggaggctgcagagaccgcagctgccgaggcaacgaacgccgcagaggcacccgctgcagagtagatctgactgagagcagatggaggagggagtccggaatgtccgggccccctcctttcatgctgagggctcgtgcgcgattgacgggccgacaagtactggatgatgcgtgaggtcttggggcttggaggccttcgaggagctgctatgatgtgacggagcggcgagagccgccaagcttgggagtatgtcccctgactaaaagcgcggcgcaagccccttccttcaggcatggggtcaagccgcgcatcgccgtcaggtgatagctatctgcaagcggtataatgcccgcatgaaatgcatgagcaacgtcgtctccaccgtgggaggggcgcccttggcaatcgccaggcaatgcatcgagaaccagaagagcgtgtagccatggaaagggcctacgagatccgcatctaccccaacgccgcccagcgcgaactcatcgagctcaccttcggctgtgccaggtgggtctacaacaggtgcctcgagaccaggaaggccgaatacgagaggaccgggagatcgccgtcggtctaccagctccagaagctcgtcacggcctggaaaaggacggatgcaccctggcttgccgaggtggactcccacgcgctccagcaggcggccgtgaacctggggagggccttcgatgggttcttccgccgctgcagggcgggcggaaagcccggatatccgcgcttcaagtcgaagcgggacgcgaggcagtcctaccgcaccaactggggaatctcggtgccggacgcgaggcatgtgaggcttccgaagctcggcctggtgagggcacgagtgagccgccccgtcgaggggcgcgtcctcaacgcgaccgtgaagcgcgtgccgagcggcaagtacttctgcgtgctcacgtgcacggactgtccgaagcccgatattcccgaagggcgcatcgaggtcctgggcgtggacgtgggcatccgctgcctcatggcccgctcggacgggaatgcgatcgcaaatcccaagagccttgccagatcggagaagaagctggcgcgggcgcagaggaggctctcaaggaagaagaggggctccagaagacgcgccaggcagcgcgcaagggtcgcccgcatacacgaaaagatagccagccagagaaaggacgccctgcacaaggccacgaccgaggcggtgcgcgagagccaagccatcgccgtcgaggacctggacgtcagagggatggagaagaaccgccgtctggccaagtccgtcgcggatgcctccatgtccgagatggcccgccagctggagtacaagtgctcctggtacgggcgaaggttcgtgaaggtcggcaggttctacccgtcgagcaagacctgctctgcctgcggacaggtcaatcaggcggtcgtgctgggcgtggaggcatggacctgccccgtctgcggggcgagccacgaccgcgacctcaacgcggcggtcaacatcgcgcgggaaggagcgcggcttctaaacaaagcagacggtaccgcagggcttgcgggaaccgggggcgcgaaagcgtcccgaacgctcgtggagcaggcgtaagaccagcttccgccgcaaggcggaggaaggctatctgcgtcgaagcgagaatcccccggcttcagccgtggggagtgtcaatggaactaggttcgcgtgctgtcacgcggactgcaggtgaaggccaggggacttccattttctaggcgcctatgatttttccgagcgacgcaggaagccgtagaccctcacgcacttgcggcagagcctgccaaggaggctgcagagactgcatctgccgaagcaacgaacgccgcagaggcatccgctgcagagcagctctgactgaggcagatggaggaaggagtccgggaaaccggactctcttctttggtatcgctcactatcgcccactgccggctgtggtgtcgcagagggtttcaggtgaccggcagcacagtaccggactttggctttcggtgcccgatatggcgctgcgggactcttcagacgtgcttctctgcggtcatgaggcctttccactcgccgtggagcatggggaggatggatgaggagatggccttcacgtcgcaatctgccaggttgaggtgccgtagcggaagatccgtcttctgcgttcactcgcgcctcgctacagacagcgggagccgttcgttcgtccccgaccccccatggatctctcgaagagcctcttttcatgtctcggggaagagacgctgacgttcgtgttcaaggtcgatatgggcaaaggcaggatgtgtctcgtagctttgccagcgcgccttggctgaagcctctgactcagggacaagatggcattggcagcgctctgcaagcagaagcgcgcacttgttgcgctgggcatctctgagaaggacaggatagctcccgtcgtgccttgcctgctggatgcgtgtcttggcctgcatgggtgccatgcgcagatagcgcggaagctctgcctcggtgacctctatgttttcgtgtgcgccccaggcatcgagcgcagaagcctgtgcggccacctgcggggcgagctgcgctgcaagctcttcggctgaggcaaccttctggagcctcaatctctcctcgaagcctttggggtcatgcgtgcgctcggcagcaaggctctggagaagcccgagccttacgtgctcgaccgtcatgtcatcaggaggctcgatgagcctttctgccagcgcctgggcgcagcgggcgggcttctctgcaagcgcctgatcgtgctgtgcctgtacgagctgctctttgagctttgcaagccagcctctggctcctgtgccctctgacacatggagcgtacctgcgtggctcctgacccactcgtcggtgagatccgggagatgtgctcccgaagaggagagataggcctctgccgccgcaagcacatccatctctcctgcctggggcacgacaatctctatctcagggggctcataggagcgcagacgcggtccgcttgccccttcatcttcagccatggtccatccttctttcagcggtacgggtagaatcttccctgtccggtgtgcagacatacccaagacttggccttccgcatgcgccaagcgcatgcacaaggtatcatcggttcatacagaacacgcggtgaaaggtgacgcatgaagtgcagcaattgcggctatgagcttcaggaaggcatgaaattctgccctgaatgcggcatgagggtcaagggcacgaagcatatcaatgcgccgggaaagacggccgcgctcggctctcccgacgagacgcatgtgattcctggcggtgcctctgcgatagtggcgcctgatgcagacaggacgaccgtgctgtcccatgaagtggcagcagatatcgcatcggaagcgacacaggtcctgccgcacgacgtggcagcagacattgcagccgatgctgccgaagagggctcggccccctcattcctggctggcgcaaaggaggagcctgaggcagagcccgagcctgcagaagaggaagctcctgcctctgaggagagcgggaagacgcaggctggcagcaggaaggtgacggtccagcgcggaccccaggtggcccgcatccatatccatgtgcctgaaggcaaggaagcccctgcggcagaagagcttgccgaagaggctcctgctcaggagacggctgtcgaggaagcgcctgcagaagagcctgtggcatcagaagaggctgcccctgctgatccgtccgctgaagccgaagtgccggcagctgcttccgaagagctcggcgagatggcagagcccgcaagcgagcctgcacctgagcctctagccgaagaggatgaagacgactgggacgacgagccgacgggagcccttccgcgtctcgatgcaaaggatgcacctgcgaaagagcctgagctttcggaagctgacgaggaggcgctcgagcagaggatcggcgcgctttccgatgaggcagacaggaccgaggtcctgaccgatggaatggacgaggagcttgcctcgcacgatgtggcagacatccccgaagcagcaccggtgagcgaagaggatgccacagacgtcgaagcgggacgcgaggcagtcctaccgcaccaactggggaatctcggtgccggacgcgaggcatgtgaggcttccgaagctggcctggtgagggcacgagtgagccgcccccgtcgggggcgcgtcctcaacgcgaccgtgaagcgcgtgccgagcggcaagtacttcgcgtgctcacgtgcacgactgtccgaagcccgatattcccgaagggcgcatcgaggtcctgggcgtggacgtgggcatccgctgcctcatggcccgctcggacgggaatgcgatcgcaaatcccaggggccttgccgatcggagaagaagctggcgcgggcgcagaggaggcttcacggaagaagaagggctccagaagacgcgccggcagcgcgcaaggtcgccccgcgtacacgaaaagatagccagccagagaaaggacgccctgcacaaggccacgaccgaggcggtgcgcgagagccaagccatcgccgtcgaggacctggacgtcaggggatggagaagaaaccgccgtctggccaagtccgtcgcggatgcctccatgtccgagatggcccgccagctggagtacaagtgctcctggtacgggcgaaggttcgtgaaggtcggcagtttctacccgtcgagcaagacctgctctgcctgcggacaggtcaatcaggcggtcgtgctgggcgtggaggcatggacctgccccgtctgcggggcgagccacgaccgcgacctcaacgcggcggtcaacatcgcgcgggaaggagcgcggcttctaaacaagcagacggtaccgagggcttgcgggaaccgggggcgcgaaagcgtcccgaacgctcgtggagcaggcgtaagaccagcttccgccgcaaggcggaggaaggctatctgcgtcgaagcgagaatcccccggcttcagccgtgggagtggtcaatggaactaggttcgcgtgctgtcacgggactgcaggtgaggccaggggacttccattttctaggcgcctatgatttttccgagcgacgcaggaagccgtgaccctcacgcacttgcggcgagcctgccaaggaggctgcagagactgcatctgccgagcaacgaacgccgcagaggcatccgctgcagagcagctctgactgaggcagatggaggaaggagtccgggaaaccggactctcttcttttggtatcgctcactatcgcccactgccggctgtggtgtcgagagggtttcaggtgaccggcagcacagtaccggactttggttttcggtgcccgatatggcgctgcgggactcttcagacgtgcttctctgggtcatgaggcctttccactcgccgtggagcatggggaggatggatgaggagatggccttcacgtcgcaatctgccaggttgaggtgccgtagcggaagatccgtcttctgcgttcactcggctcgctacagacagcgggagccgttcgttcgtccccgacacccccatggatctctcgaagagcctcttttcatgtctcggggaagagacgctgacgttcgtgttcaggtcgatatgggcaaaggcaggatgtgtctcgtagctttgccagcgcgccttggctgaagccctgactcagggacaagatggcattggcagcgctctgcaagcagaagcgcgcacttgttgtgcggggcatctctgagaaggacaggatagctcccgtcgtgccttgcctgctgatgcgtgtcttggcctgcatgggtgccatgcgcagatagcgcggaagctctgcctcggtgacctctatgtttttcgtgtgcgccccaggatcgagcgcagaagcctgtgcggccacctgcggggcgagctgcgctgcaagctcttcggctgaggcaaccttctggagcctcaatctctctcgaagcctttggggtcatgcgtgcgctcggcagcaaggctctggagaagcccgagccttacgtgccgaccgtcatgtcatcaggaggctcgatgagcctttctgccagcgcctgggcgcagcgggcgggcttctctgcaagcgcctgatcgtgctgtgcctgtacgagctgctctttgagctttgcaagccagcctcgggtcctgtgccctctgacacatggagcgtacctgcgtggctcctgacccactcgtggtgagatccgggagatgtgctcccgaagaggagagataggcctctgccgccgcaagcacatccatctctcctgcctggggcacgacaatctctatctcagggggctcataggagcgcagacgcggtccgcttgccccttcatcttcagccatggtccatccttctttcagcggtacgggtagaatcttcctgtccggtgtgcagacataccaaacttggccttccgcatgcgccaagcgcatgcacaaggtatcatcggttcatacagaacacgcggtgaaaggtgacgcatgaagtgcagcaattgcggctatgagcttcaggaaggcatgaaattctgccctgaatgcggcatgagggtcaagggcacgaagcattcaatgcgccgggaaagacggccgcgctcggctctcccgcacgagacgcatgtgattcctggcgggtgcctctgcgatagtggcgcctgatgcagacaggacgaccgtgctgtcccatgaagtggcagcagatatcgcatcggaagcgacacaggtcctgccgcacgacgtggcagcagacatatgcagccgatgctgccgaagagggctcggccccctcattcctggctggcgcaaaggaggagcctgaggcagagcccgagcctgcagaagaggaagctcctgccctctgaggagagcgggaagacgcaggctggcagcaggaggtgacggtccagcgcggaccccaggtggccgcatccatatcatgtgcctgaaggcaaggaagcccctgcggcagaagagcttgccgaagaggctcctgctcaggagacggctgtcgaggaagcgcctgcagaagagcctgtggcatcagaagaggctgcccctgctgatccgtccgctgaagccgaagtgccggcagctgcttccgaagagctcggcgagatggcagagcccgcaagcgagcctgcacctgagcctctagccgaagaggatgaagacgactgggacgacgagccgacgggagcccttccgcgtctcgatgcaaaggatgacactgcgaaagagcctgagctttcggaagctgacgaggaggcgctcgagcagaggatcggcgcgctttccgatgaggcagacaggaccgaggtcctgaccgatggaatggacgaggagcttgcctcgcacgatgtggcagacatccccgaagcagcaccggtgagcgaagaggatgccacagcgagaacgagactgtctcctcgcctgtaccgctctctcctgtcgcggccccgcataggcatctccatgccggagtccaccgcatggaggcatccgaagaccgctgcatccgatcgacggctacgtctcccgggacagcctcaatggaatggacgaggcactcgaggacgagaggacggctgctgccgtgcaggagccggatacagagaagacgggcgtcctgccgcagcacggtggtgcgcagccgcagcgcgaagcaggaggagaagcatgcaccgcatgcgatgcctgtagccattgcagtgctctgcgtctgcgcgggtcgtggcgattgtcgccttcgtgcactcgggcgccctttcgggcacgagcgagacgaccgaggaaaccacctcggagcaggctgccacgacagaggagacgtcgcctgagcccaggccgcactgccctcttctgccaagagcttcagcgagtacagcgcctccgagcttgcgggcatcgcaggcaatcgagaagacgtcctcgcgcgatgaggcgctctctgttgccgagcagtatggcatctgcaacgaggatggcacggtcacgaccgaggcaaacgaaatcacgctcacggatgcacgacagccgagctcccgtgtcgctgacatctatacggacgatatgcagacggcggaaaggctggcataacgttcgcttttccggaagctcgctcacgcaatgcgatgaatacgacggtcgccgaccaggcggctggggagctccgcgctccgctcctggctctcctccgatgctatggatcttctgccggatgagcttgcccacctacatcgtgccggtcgagaagatgacgaacaacacgggctacaccgtgaacacggctgcggtcacggcaacagaagactcgctgtggattcgtccttccgtcgaggtctatggcacggtgaactggaactgggagtcgagctacacgtcgaactacaacacgatcctcgggtctgaaggcacgcagtatgcccgtcttctccgagtcggggcgtcacgggcggcttcggacggcttccgaggtcgaggcaaagtccggcatcggcaccgatgcgaacacctggtggacgaggacctcgtctccgtcctcctctgaccacttccgtgccgtgagcacggtctccggcccctacgcggtcgacaatgcgacccaggagctcggcgtcgtcgtcggcttctgctactagcaattgaatatgcacctgccgcatccttgtgcggcaggtggagccatctgcaaggcgcatggaagtgccccttcggtggtacccttatggatggaaaagccacggccgcgccatgcggcatcatagcaaggagcacagccatgccagagaagctgaagagctggtgctgcctacgaggagctcgagcagaagctcggagacccgcagtcatcgcagacccgaaagataattgcccgcctcgcaaaggagcatgccgaccaggcagagctcgtcgcaaaggcgcgcgagtaatctccaggcgctcgaggacatcgagacgtgccaaggagatgctcaaggagacgtccgacccggacgacaggcaatgcttagtgaggatatctcctcgaacgaggagcgcctgccgaagctcgaggacgagatcaagatcatgctgattcgggcgatccgaacgacgagaagaatacgatcgtcgagatccgcgccgcgcgtcggcggcgacgaggctgccatcttcgcaggcgctcatcgttttgttcgaggagatattcctcctgaagattgccttgtcgtccgggttcggacgttccttgagcatatcttggccgtctcgatgtcctcgagagctatggagatacttcgcgcgcctttgcgacgagctctgcctggtcggcatgctcctcttgcgagggcagggcatattcttgcgggtatgcgagggactgccgggttcgagcttctgctcgagctctcggaggcagccccagcttcttcagcttctctcggctggctgtgctcctgcatatgatgccgcagtggagcggccgtgcttttcccatccataagggtaccaccgaaagggggcacttccatgcgccttgcagatggctccacctgccgacacaaggatgcggaggtgcatattcaattgctatagtagcagaagccgactacgacgccgagctcctgggtcgcatgtcgatcgcgtagggccggcgacgtgctcacggcacggaagtggtcagaggaagggacggagacgaggtcctcgtccccaggtgttccgcatcggtgccgatgacggacctttgcctcgacctcggaagccgtgccgaagccgcccgtgacgcccgactcggagaaagacggcatatgcgcccatgcattcagacgaggatcgtgtgtagtcgacgtgtagctcactccaagttccagttaacgtgcccatagaacctcgacgaaggaagggacggatgtatccacagcgagtcttctgttgccgtgacgcagcagtgttcatcggtgtagcccgtgttgttcgttcatcttctagaccggcacgatgtaggtggcaagctaattccggcagaagatccatagcatcggaggaagagccaggagcggatgagcgagctatcccagccgcactggcggtccgccgtcgattcatcgcatgaggtgagcgagcttccggaaagcaggaacgtttatgccagccttttccgccgtctgccatatcgtccgtataacatgtcagcggaccgggaagctcggctgtcgtgccatccgtgagcgtgatttcgtttgcctcggtcgtgaccgttgccatctcgttgcaagatgccatactgctcggcaaacagcgagcgccttcatgcgcgaggagtcttctcattgccggggcgatgcccgcaagctcggaggcgctggtgtactcgctgaagctttggcagaagagggcagtgcggcctggggctcaggcgagtctactcgtcgtggcagccgctccgaggtggttctcggtcgtagtccgctgtgcccgaaagggcgcccgagtgcacgaaaaggcgacaatcgccacgaccgcgcagacgcagagcaatgcaatgctacaggcatcggaaggccgttgcatgcttctcctcctgctgcgctgcggttgcgacaccaccggttgctggcgcaggtagccagtcttctctgtatcggctcaatcacggcagcagccgtcctctcgtcctcgagtgcctcgtccattccattgaggctgtcccaggagacgtaagaccgtcgatcggatgaagtgggtcttcggacatgctccatgcgtggactccggcatggaggatgcctatgcggggccgcgaccaggagaggagggtacaggcgaggagacagtctcgttt

SEQ ID NO: 53 - DNA, 14415 bp, Unknown
  Metagenome-assembled genome
gatgtgaatgaatgcccccttcctcgatgcggtaatagcgtctgcgtgggatcgccgaccttcaactcccagatgcttccgaccatcgcagggttctgtgctacatgaagggcctctccccgaagaaccaggccgcatcggcattgccttcggctcctatggctgggctccgcttgcacagaagcagatcgcttccgagatgtcttctgtcggcttcgatgtgcgcgagaccatctccgagaactggattccttccgagagcaccttgccgctatccgcacaaggtcatcgccctcgtgaggcagaggcatagggcttcccttcaaggggggcaaaagcagttactgcatgccagtatgcgcctgctgccaagggagccgggacttttgtcccggctccatctctgtcgggccgaagagatggcatggatgtgggtgcaggctcccggccgtgctgccagaaggaaatcctgcgggatgccaggggcttgccggcccatctgcctctcatccagctggcgtgacatcatgcaggatagcggcagggggcgaagagaccggagcctgtcgatagcagggcatggcaagaggtggaagcagagctcgcgtacgagaggtctgactatcatttttgagtctcatgatactcaaaaatgatagtcaaacgtgagacccaaatacagagctgaagacgcaggggctgagcaggatgagactgtgcggacaacaggcaaatatcgtcgcgggtcctgaaggctgcatggacctgcagtctgttgagactggctatgttattggcaaaggaatggatcgattctgtgctgatctttcggtcctacgcctgaagggcggctgggcaggcagcatgagtatcatctctgcacttagtgaatggcagattgtcaagctgagtgcaacatctccctgtagacctcgttggctgtccgtatttcaggaccttcctcgcctgccgttgatcaggtccaccgcatgctgcacctcctcgtccgtcaccttgccgaagtcggtgccctcgggagaactcgcgcaggagcccgttggtgttctccaccgtcggctttgccagggatggtgggggtcgcagaagtgaactgcacgcctccgagggctttgtgacatctgcatgccccgcgaactccttgcccctgtccggagtcaccgtctcgagcgggcgcccctccagaagcgcgacctcggccctggagacgctggcgctgtcatgccggcatctccctgcaaggaggagcctcgatgccctgtcggcgagcacgagcaggcatgggcggaccccggaccgactaccgtgtcgtcctcccagtcgccgaggcgcgacctcgcatcggcctctgccggcctctcctccacggtgtgcgagatcctgatcttgcccctcgtctcgggcctcttcctgcggatcctcttccccttcctgcgcaggtggcgccgcacctggccttcggggccggctccggcaggtcgagcgtgcctgcatggacctcgcggtagatcgtcgagaggctcacgacgcacttccgccgttctccagcctgagcctgcctctatctcgtcggggaccagtgcctgtccatgatgagcgagcgcaccttctgcgcgagcgcagggtcggagagcctcctcttcggcctgcatctcctgtggcgcgcgcctccgccctcctctgggcggcgctgcccatagcgccggccggccgttcctctcagctcgcggcagatggtcgacctgtccctcccggtctctcccgcgagtgtagccgatggacctccctctgcatgcagcgtggctatgcagtccctctcctgagggctaagatgactgtagtggcacattccttccagcttccgacgttacctagacaaccaacatcgtagccttccgggatgtgccacgcctgcattcggcgggccatcctgttgcactcagaatgctaatccgccgatccaagatgatactcaaacgtgagactcaatcagtttcaggagagcaagccgcggcgggcaggtgtcttcctctccgttgtctgccacagggcggatgcggatagagggcttctgtgtgaggctggctgcatcttctcgtctgccgggtctctggcgaggcggaaatacggcagaacagctgtctcttgggtagaaacgaagtaagcatgcaggatttctcggcagcccgccaggatggtcttacgctgctggtgggccccaccagaacaggacagtacgttttggtagaattgggctttaagattcgcacgtatccgggaggcaagcgcctacgcgcatggacatagcaattagcatcgtcgtcacgatacttctgactatcgttaacggctatttctcgatgtcggagatggcactctccactgccaagaaggtcatgctcgaccatgaggcggaggagggcgacaggcgtgcggcacttgctgcccagatgacggaagaccccacagccttccttgcagccattcaggtcgcgatcacacttgtcggattcgcaagctcggcattcgcagccacgagcctctctgagccgcttgcgggatggatggcatcgctcggcatgagcgcagcgaccgcctctgtcctcgctcccatcatcatcacgctcatcgtctcctacttctcgattgtcgtgggtgagctcgtacccaagcgcatcgctatggcagacgccgagaagatggcaaagaaggtcgcaggacccctcaggaccttctccacgatcatgaagccgctcgtgtggctcacgtcggcaagcgcaaatggcctggcgcatgtcctcggcatcaagtctgcggaggaccgcaacaacgtctccgaagacgagatcaagtacatggtctccgatgcagatgacctctccgattcagagaagtcgatgatccatgagatcttcgacctcggcgacgccattgcccgtgaggtcatggtccctcgtgtcgatatgaccgcgatggaggacacctcgaccatggggcaggtccttcaggtcatgcgccgcacgggatactcccgcatccccatctaccatgaggacgtggaccgcatcgtcggcatcgcccacatcaaggacatcatcagtcccctcatggacggcgagaacaaggacgagagcatctcgaagttcatgcgcgatgccgacttcgtgcctgacacgaaggacatcatcccgctgctccaggagatgcagtcctcccatgaccagatggtcatcgtcgtcgacgagtacggcggaacggctggcgtcataacgatcgaagatatcgtcgaggagattgtcggagagatcgaggatgagttcgaccccgataacaagtacctgacgaagctctccgatcgcgaatggcttgtcgatggccgcttctcggtggacgatgcagcagacctcggctggcctatccctgacaacgaggaatacgagaccgtggctggattcatcctggagcttgccgaccagctgccctcgccgggtgacgtctacacgaaggatgggtatacgttccgcgtgcagtccatgcgcggaaggagaatcgccctgctgcgtgtcacggcgcccgagcctgccaaggaggaagagcctgaagaggcaccctccgaagaggagaagaagcagccgaaggaccacgaagaggactaaggtgcaggaggtttcgctgtgtccaacatcatagagttccagaagatctcgatcggaccggagttcctgacggcccgtgtgcgcataggcgatggctatccggaaatgacgaacgaggacctggatgccacgacgagggtctggcgcctcatgccgcagattgcaagccatgcctgcgtgggcgacggcggcaagaccttccgcgatgttatgggcggaaccgaagtcgcgcaccttctcgagcatgtagctgtcgagctcatggccaggacgaacctcggcgacgatatcagctatgggcgcacgaaggctgtggaaggcgttgcccgtacctaccatgtgcagctcgtctgtccggatgacgtgctctgcgtgggagctctttcttctgctgcctggatcctccagtgggccttctcaagcggcggcttccctgagcccgatatcgatgcaattgtccagggccttgtcggcatggtgaaacgcgtggacaaagaagagaaggagcgcgccgccttcgaccgtacggtcgcggagcagcaggagcgtgcggaggcaaagcgccttgcgaaggagcgcgccgagcgcgagccctggaccgtcgttccggacgatatggtcgaccagtgggccgagggcagggaagacctggattaggcgtcttgcctgggcgggcctcaggcatcccgcaagaagacatccatccccggcagaggtggcttcagcccctctgtcggggattcttctggatatgccttcccacagggcagtccatctgatgcgccagcagagatgtcctgtctgcatcctcacagcatgcctgcccagggcagggagccttggcaggggaataggcagctctaagagcgctcctgcaccgcttggcttcttctgcatccttctggcagggttcgcctcgcttagctatgataaggatgggtataatctgccagacagggcggcagtatgccgcgcggctttggaatgtctgcgcatggagtgcgcacctgcatggaaaggatttgacatgagcgagaagagcgcaggtcttggttttgttgtcggcagcatgctgggtgctgcggtaggtgcggtcgtgggccttctgctcgctccccgttccggtgccgagagccgtgccatggcggcagacgcaatgaatgatgcctgggatggtgcagtcgattcctatgagcgtggattgcgtgtcgtctccgacaagatcaatgacttccgtccgcaggtcgatgcccacaccgatgagctccgtgcaaagatcgaccttgcccgcgagcgcatggaccagctccgcgacacgctgaacgacgctgtctccacggcttccgacacggtcacctctgctgcaagctctgttgcagataccgtgagctccgctgctgctcctgcagctgcctccgatccggtgcacgtggatgtcgagtccgaggcgaagcctgccgaagagtaggtcttggcaagctcatagtaggggtacgtatcaaggggcgcgccagtggctgcgcccctttttgtgaaagaggggaatccacgcatgcttcgtgtcggcaagctctacaggctccatgtctatgacaagaaggaagggcgctccggcaaggagaagctcaagagcctgggccgtgtgcacatgacggtgttcgcgccggacggcaggcacgtcgtggggttcacgatcacgcagcccgatatcgcaggcatggtgaagaggccagacctcttcattgcctatgatgccttcgaggtgggcgagcgtggcctcgttgccacgaagggcaaggagagcttcgacgatgcggcgcgcaagcgccttggcatcgattgggactcctgcatcatctggtgcggcatggatgccaagaccacggatggcaaggagctcggctacatcgacgacgtggcctatgacccagcgacaggcgaagcgcagaccttctatgtaggtgatggcggactctcccagaagcttgtcggcacagtcgagattccagtctctatgcttcgcggctacaaaaagggcttcatgctggtagatccagccgcaggtgacctcatcgacacgccaagatcactttcaagggagctcatctcccgcatctctaccgtgatcgctcgtcgaagatcgatgtcctcatctgcaaccacgtggagatggaccactctggctccacccctgtcatcaagcagctctccccgaacgtcgagatctatgcctccgcacccaggcggtccgtggcctcacggcacactatggaaccttggctatcacggcgtgaagacgggagataccctctctcgatcggcaagcgcacgctgacctttgtgcagagcccatggtccactggccggacaacatggtcacctacgatgcctatgacaagatcctgttctcgaacgatgccttcggccagcactatgcgtcctcgggcgcttcgacgacgagaacgcctctctgtcgtcctaaccaggcacgcaatactatgcgaacatcgtccagccctaccgcacgcaggcagctgccgccgtcaggccgtgcgctccctcgtgcggacgcaatcgatatgatcgcacccgctcacggcgtcatctggcgctcgcatgtggaggatatcctcaaggcgtacgaggaggagtacacctccggtgccctcaaggattctgctgtcgtggtctatgactcgatgtggggctccacggacaagatggcccagctatcgctgacggcttcctgcagctggcgtcaaggtcgcctcatggacatcaaggcgaacgacactctgatgtgatgaatgccttcctcgatgcgaagtacgtctgcgtgggtcgccgaccttcaactcccagattcttccgaccatcgcagggttcctgtgctacatgaagggcctctccccgaagaaccagggccgcatcggcattgccttcggctccctatggctgggctccgcttgcacagaagcagatcgcttccgagatgtcttctgtcggcttcgatgtgcgcgagaccatctccgagaactggattccttccgaagagcaccttgccgctatccgcgacaaggtcatcgccctcgtgaaggcagaggcatagggcttcccttcaaggggggcaaagcagtactgcatgccagatgcgcctgctgccaatggagccggacttttgtcccggctccatctctgtcggggccgaaaagagtggcatggatgtgtggtgcaggctcccggccgtgctgccagaaggaaatccgtcgggatgccaggggcttgccggcccatctgcctctcatccagctggcttgacatcatgcaggatacgcagggggcgaagagaccggggcctgtcgatagggcagggcatggcaagaggtggaagcagagctcgcgtacgagaggtctgactatcatttttgagtctcagatactcaaaaatgatagtcaaacgtgagacccaatacagagctgagacgcagggctgagcaggatgagactgtgcggcaacaggcaaatatcgtcgcgggtcctgaagctgcatggacctgcagtctgttgagactggctatgttattggcaaagaatggatcgattctgtgctgatctttcggtcctacgcctaagggcggctgggcaggcagcatgagtatcactctgcatcttatgagatggcagattgtcaagctgagtgcaacatctccctgtagacctcgttggctgtcctgtatttcaggaccttcctcggcctgccgttgatcagtccaccgcatgctgcacctcctcgtccgtcaccttgccgaagtcggtgcccttcgggaagaactcgcgcaggagcccgttggtgttctccaccgtcggcttctgccagggatggtgggggtccagaagtagaactgcacgcctccgagggcctttgtgacatctgcatgccccgcgaactccttgcccctgtccggagtcaccgtctcgagcgggcgcccctccagaagcgcgacctcgcccctggagacgctggcgctgtcatgccggcatctcctgtgcaaggaggagcctcgatgccctgtcggcgagcacgagcaggcatgcggaccccggaccgactaccgtgtcgtcctcccagtcgccgaggcgcgacctcgcatcggccctctccggcctctcctcctccacggtgtgcgagatcctgatcttgcccctcgtctcgggcctcttcctgcggatcctcttccccttcctgcgcaggtggcgccgcacctggccttcggggccggctcccggcatcgagcgtgcctgcatgacctcgcggtagatcgtcgagaggctcacagacgcacctccgccgttctccagccgagcctgccgtctatctcgtccggggaccagtcctgtccatgatgagcgagcgcaccttctgcgcgagcgcaggtcgggagcctcccttcggcctgcatctcctgtggcgcgcctccgccctcctctgggcggcgcatgccccatagcgcccgtgccggccgttcctcttcactcgcggcagatggtcgacctgtccctcccggtctctcccgcgatgtagccgatggaccttccctctgcatgcagcgtggctatgcattccctctcctgagggctaatagctgtagtggcacattccttccagcttccgacgttgacctagacaaccaacatcgtagccttccgggatgtgccacgcctgcattcggcgggccatcctgttgcactcagaatgcaatccgccgatccaaagatgatactcaaacgtgaactcaatcagtttcaggagagcaagccgcggcgggcaggtgtcttcctcccgttgtctgccacagggcggatgagggcttctgtgggaggctggctgcatcttctcttctgccgggtctctggcgaggcggaaatacggcagaacactgtctcttgggtagaaacaagtaacatgcagatttctcgcagcccgccaggatggtcttacgctgctggtggccccccagaacaggacagtacgttttggtagaattgggctttaagattcgcacgtatccgggaggcaagcgcctacgcgcatgacatagcaattagcatcgtcgtcacgatacttctgactatcgttaacggctatttctcgatgtcggagatggcactctccacgccaagaaggtcatgctcgaccatgaggcggaggagggacaggcgtgcggcacttctgcccagatgacggaaccccacagccttccttgcagccattcaggtcgcgatcacacttgtcggattcgcaagctcggcattcgcagccacgagcctctctgaccgcttgcgggatggatggcatcgctcggcatgagcgcagcgaccgccctctgtcctcgctcccacatcatcacgctcatcgtctcctacttctcgattgtcgtgggtgagctcgtacccaagcccatcgctatggcagacgccgagaagatggcaaagaaggtcgcaggacccctcaggaccttctccacgatcatgaagccgctcgtgggggctcacgtcggcaagcgcaaatggcctggcgcagtcctcggcatcaagtctgcggaggaccgcaacaacgtctccgaagacgagatcaagtacatggtctccgatgcagatgacctctccgattcaagaagtcatgatccatagatcttcgactcggcacgccattgcccgtgaggtcaggtccctcgtgtcgatatgaccgcgatggaggacacctcgaccatggggcaggtccttcaggtcatgcgccgccacgatactcccgcatccccatctaccatgaggacgtggaccgcatcgtcggcatcgcccacatcaaggacatcatcagtcccctcatggacggcgagaacaaggacgagagcatctcgaagttcatgcgcgatgccgacttcgtgcctgacacgaaggacatcatcccgctgctccaggagatgcagtcctcccatgaccagatggtcatcgtcgtcgaccgagtccggcggaacggctggcgtcataacgtcgaagatatcgtcgaggagattgtcggagagatcgaggatgagttcgaccccgataacaagtacctgacgaagctctccgatcgcgaatggcttgtcgatggccgcttctcggtggacgatgcagcagacctcggctggcctatccctgacaacgaggaatacgagaccgtggctggattcatcctggagcttgccgaccagctgccctcgcgggtgacgtctacacgaaggatgggtatacgttccgcgtgcagtccatgcgcggaaggagaatcgccctgctgcgtgtcacggcgcccgagcctgccaaggaggaagagcctgaagaggcaccctccgaagaggagaagaagcagccgaagaccacgaagaggactaaggtgcagaggtttcgctgtgtccaacatcatagagttccagaagatctcgatcggaccggagttcctgacggcccgtgtgcgcataggcgatggctatccggaatgacgaacgagacctggatgccacgacgagggtctggcgcctcatgccgcagattgcaagccatgcctgcgtgggcgacggcggcaagaccttccgcgatgttatgggcgaaccgaattcgcgcaccttctcgagcatgtagctgtcgagctcatggccaggacgaacctcggcgacgaatcagctatgggcgcacgaagctgtggaaggcgttgcccgtacctaccatgtgcagctcgtctgtccggatgatgtgctctgcgtgggagctctttcttctctgcctggatcctccgtgggccttctcaggcggcggcttccccgagccatctgatgcaatcgttcagggccttgtgaccatggtgaaacgcgtggacaaagaagagaaggagcgcgccgccttcgaccgtacggtccggacagcaggagcgtgcggaggcaaacgccttgcgaaggagcgcgccgagcgcgagccctggaccgtcgttccggacgatatggtcgaccagtgggccgagggcagggaagacctggattaggcttcttgcctgggcgggcctcaggcatcccgcagaagacatccatccccggcagaggtggcttcacccctctgtcggggattcttctggatatgccttccccagggcagtccatctgatgcgccagcagaatgtcctgtctgcatcctcacagcatcctgcccagggcagggagccttggcaggggataggcagctctaagagcgctcctgcaccctttggcttcttctgctccttctggcagggttcgcctcgcttagctatgataaggatgggtataatctgccagacagggcggcagtatgccgcgcgctttggaatgtctgcgcatggagtgcgcacctgcatggaaaggatttgacatgagcgagaagagcgcaggtcttggttttgttgtcggcagcatgcggggtgctgcgtaggtgcggtcgtgggccttctgctcgctccccgttccggtgccgagagccgtgccatggcggcagacgcaatgaatgatgcctgggatggtgcagtcattcctatgagcgtggattgcgtgtcgtctccgacaagatcaatgacttccgtccgcaggtcgatgcccacaccgatgagctccttgcaaagatcgaccttgcccgcgagcgcatggacccactccgcgacacgctgaacgacgctgtctccacgcttccgacacggtcacctctgctgcaagctcttttgcagataccgtgagctccgctgctgctctctctgcagctgcctccgatccggtgcacgtggatgtcgagtccgaggcgaagcctgccgagagtaggtcttggcaagctcatagtagggtacgtatcaagggcgcgccagtggctgcgcccctttttgtgaaagaggggaatccacgcatgcttcgtgtcggcaagcctacaggctccatgtctatgacaagaaggaagggcgctccggcaaggagaagctcaagagcctgggccgtgtgcacatgacggtgttcgcccgacgcaggaggcacgtcgtggggttcacgatcacgcagccgatatcgcaggcatggtgaagagccagacctcttcattgcctatgatgccttcgaggtgggcacttggcctcgttgccacgaagggcaaggagagcttcgacgatgcggcgcgcaagcgccttggcatcgattgggactcctgcatcatctggtgcggcatggatgccaaaccacggatggcaaggactcgctacatcgacacgtggcctatgacccagcgacaggcgaacgcagaccttctgtaggtgatggcggactctcccagaagcttgtcggcacagtcgaattccagtctctatgcttcgcggctacaaaaagggcttcatgctggtagatccagccgcagcagagcttgcactcaatggcggccttgctgccaaggcaggcgaggactttgcaaaggccaaggtggcaagcaaggaaggtgctgccaaggctggcaaggctgcgaccgaggcggtggacaggggctcgcatgagctcggacgcccatcagccgtaccgcgaaggccatggaagagtcgaaggaagagttcgagaaggcatcgggcacgcccaagaagaagccttccgccagaagggtgcatccggccagagcagcccgtctgtcggcaagcagctcggcaagatgggatcgtgttcggctccttcatggataatacaagaggcaagcaagtaggcctactcacgccaggccgctctaacacgcgtgctgcccaggctggagagaaatgcctatacccaagctcgcaccccgcacgaagaagatagtccgtggagtagggacggtcctgctcatcggcttcacggtcctgccaatgtggcggtggccaagttcggcaagaccctgaactcctgggtcagcaccgctatgtggatgtgagcgataccgaatacaacccgcatggcgcaggacagaagctcgccgaagagaggagacagaaggagctgtgctcctccaaaacaaggacaatgtcctgccattctccaaggatgtggacaaggtcaatgtcttcggctggagctccacccagtgggtgcttcaggatccggctctggccaggtggccggaaagacgaagggtctcctcgaggcactggtggattacggcatctcctacaacgaagctcacggacatgtacaagcgctatgcaagcgcccgtccgcgctctgccaatggttccctgaactcgtttgcggatgactactgccagctcgtggagccctccatccagaaccgctcctggtatacaaagggcatgctcgacaatgcgaagagctactccgatgccgctatcgtcgtgatctcccgcgtggcaggagagtccatcgactgccccgcacgcagtcgaaggtctccaataccggctatgtcacgaaagacacgaacagagctatctcgagctctcgacgcaggagctcgatctgtgacgtatgtgggtgcgaactatgacaaggtggtcgtgctcgtgaactccacgaacgcgatggagttcacgagcacgaccaccttgtcatagttcgcacccacatacgtcacaagatcgagctcctgcgtcgagagctcgagatagctcctttcgtgtcttcgtgacatagccggtattggagaccttcgactgcgtgccggggagtcgatggactctcctgccacgcgggagatcacgacgatagcggcacatcgagtagctcttcgcattgtcgagcatgccctttgtataccaggagcggttctggatggagggctccacgagctgcagtagtcatccgcaaacgagttcagggaaccattggcagcgcggacgggcgcttgcatagcgcttgtacatgtccgtgagctcttcgttgtagggatgccgtaatccacagtgcatcgaggagacccttcgtctttccggccacctggccagagccggatcctgaagccacccactgggtggagctccagccgaagacattgaccttgtccacatccttggagaatggcaggacattgtccttgttttggaggagcacagctccttcggtctccctcttcggcgagcttctcgcctgcgccatgcgcgcgtgtattcggtatcgctcacatccacatagtcggtgctgacccaggagttcagggtcttgccgaacttggccaccgccacattggcagcgaccgtgacgccgatgagcgaccgtccctactccacggactatcttcttcgtgcggggtgcgagcttgggtataggcatttctctccagccgggcagcacgcctgcccttagagcggcctggcgtgagtcaggcctacttgctgccttcttgtattcatccatgaaggggccgaacatcgatcccatcttgccgagctgcttgccgacagcacgggctgcctcctggccggatgcacccttttggcggaaggcttcttcttgggcgtgcccgatgccttctcgaactctgtccttcgactctccatggccttcgcggtacggctgatgggcgtccgagctcatgcgagccgcttgtccaccgcctcggtcgcagccttgccagccttggcagcaccttccttgctgccaccttggctttgccaaagtcctcgcctgcctggcagcaaggcgccattgagtgcaagtctctgctg

SEQ ID NO: 54 - DNA, 9880 bp, Unknown
  Metagenome-assembled genome
tcgaagggcacgggcatccgcccctcacggcaccacttccataccgtctggacattcaatccttctctttttgcccattcgcttgctctcatggataaatcataccatacgataacaagctattacaatcatttacctatactgctggtagccctgtaaagacatatgttagtagagggcctcccgcgctcagcgtgggaggcctttgtaatagctcgggtctacgtctgggtggaactactggcggttgcgaccataggcttgggccatgccgctccagggagtgacgtcctcaacaggggtctcatcccaggctttgaggatctcaggatccacgaactcgcggcgtacgataacctcgccgccgtaaaggtggaaccagtcggcggaggcgatcagataaccgtcttttccctgatccttgccccaggagttttcgatcctccaggctttcggagcgccattctcgttgagttcaacgccctcaaatgtcattgcatgtgtgagagaggtctcacgcatatcgatcattgaggcgcggtccatcttgaactcgacgttgaagaggccatcgaggtctataccgtcagtggagaggatgtacttgtagtcctcgatgtggcgcgggaactgctgcattacgtcgcaggagaagctgaccggcacaccggccttgagcgatgcgatggctgccttgtcgagctcctctgacttcacattgagcaggtggttcggcttgccgtcgacgacggagtcggtaagcgtcaggtggtaggcgtggccgtaggggcgggcgtctcccggcatggagaccaggtcgacatagtcgttcgggtcaaacggggcgtagtggctcgcgaactcgagtggggtgatatcgaaatcacgcaggatgcgcttgggcttgctatctttggcgtcctcgtgctcaggctttggggtgacctcctggatcttggattcttcagccttgcagttgggtcctacctcgacctcgaggtcgaatttcgcagggggctcgcctaagcagatagcgaggacacggtagacctcgtccagcatgtcgcccttttgggacttgaggagctcttcgctagcaccgtctttgtatgctttacgcaggatcccggcgtcacggtgaagtagacggttgagctgcgcgtccatctcagaggagttcttggaggctgcagtctcgggcattgcggattttgggaccaagccccacttggagattaagttcatcgcgaagctgtagtagccgccatcggacatcccattgtctaagatctcgcagacgctgcggtcgtcgtaggggaggtctttggtctcaatgatgcgttcgagcatcgcgttggctttctcaagcttgtcgtagaacatgccataggcctggctgaactcgaaggtgtcgacgtccagatagtccatcgcggcgtggcgggcgacgttgaaggcgctgaacatccagcagcggccactctggcgctggttggtgatgtcgccggtcttagagatggaaatcccgtaagtgtcgtggtaggtgcgcatcacggaggtgtcacgggcggcctgcataacgttggtggcggtcaccgcgttgcgggcgatgtggttggcgcggctctcctgaaactcttggttctgttgtgccgcccagtcgggatcaagtgctttccccatagttcttcgctcaaatcctttcgtatgccgaatgttttgttgttgtgcttaatctgaaagcgccagtgagcccatcggatcccacggctgtagcaccgtcggtttctcagtctcaaaaatatgtcgctcttcctcggtcaggtatttcttatcgacgacgacctgataaacgtactcgtcaaaccaggggttggtcagggtatcgaagccgttgcggccgtggtccttgccccaggagttctcgatcttccacagggtcggctgaccgtccgaatcgaacctcacgccttcgatcaccatcgcgtgggtcatcaggctctcgccgtagtcaaggcgcgtggccttgtcgaggcaggtctccaccgggaagccgaagagggaatcgacgtccactgcggcggtgtccatgataccgtcagtggtaaggtagctctgcataacgtcagagccgaaccagaccggcaggttgtccttgagctgggcgatcgcgacgcgcttgagctcttcggcttcgaggttcagatacttgacaccgccggcttccacgacgttgccgagtctgctcaccgtataggtgtgcatgaaaggcttgtctttggtgggggcagagatgagcgagatgtagtcgtcgaggttcatgccgacggccttgtcaaagaactcctgcggggtgaaggtaccactcaggacaagcttgtcgtccttgtcgtgcaggcgcacctcaaaggacgcaggaggctcacctaaacaggtgacgagaatgtggtagacgtcctcgagcatggccttcttctgagcgcggagatcgtccgctgatttgccctgttcggctgcgtcgcgtagctgcttggcggcgccgcgcaggtagcgggtgaggtacatgtcgagctcacgggtgttcttggagcaggcggtctcaggcatagcctctttggggacgacgccgtacttctttaccaaagccttgaacatgtcccactggccaccgtcgccgatcgggtcggtgaggaggtaggagactaagcgaccgtcgaggggctccttaacggtgtcgataatgttctctaagaaccaattgctcttctcgagcttgtcccagaagagaggataggcctgtgagagctcaaaggtcttgaggttgaacttcttgatggagcgatagcgcatggtgttcagtgatgcgaacatccagcagcggccggagtgcatctggtcagtgcgctcgccctgggtgaggtcgatatcgaagtcaagggagttctttgccacagcctccgggacgcgtgcggcggcacggataccttgtgaggttacggcattcttcgccacgatatcggcgcgctcggagaagaagctgtctttcgacctctccagatcctgcgcgctgattgacgtatcaggtgtcatagtgatcctttctataattgacctctacaagcatatcagacaagaggcttaaaataccggtgagtcaacaagcccacagcttgcggtatgcttaagagtccgctttgattgttgctgtaaggatctgtcctatgactatgccgaaaacgctttcccctggcctgttgcctgcctatgccatgcgggtgctctccgctcttgaagatgcaggctgggaagcctggattgtcggtggttgggtcagggatgccctgcgaggggacccggcgcacgatgtggacatggcatcaaacgcaccctggaagaaaagcgaacaagcactacgtgaagcaggcatcgacgtgcatgagaccgggactgcccacggaaccatcaccgcggtggtcgacgataaaccgatcgagatcacgacctaccgcactgaaagcacctactcagacttccggcatccggattcggtcacttttgtcgacacgatcgagcaagacctctcaaggcgtgattttacaattaacgcgatggcctggcatccgatacggggactcaaagacccctttggagggagaaaagaccttgcagcggggattatccgtgccgtgggggatccacagaagcggttccacgaggatgccctcagaatccttagggcggtacggtttgccgctcgctacagctttgtgatcgatccggagacgcagcaagcacttgaggaatgctccggtgagcttgccctcatcgcctcagaacgtatcggacaggaactgaacaggatccttgagagcaaacgattgggatgggccctgaagtacgagcacatcgtgctgcgtgcggcagtgtctgagcttgccaaactctcgaaacagcagtgggaggtgctctgtgaagaggcctccctcatagaagctctcgcaggagggctctgccctcagacgcttcgttgggctgccctgttctctcagaatacggtcaaagaggcgcagaatgcgctcaagcggatggcacagcggactgaagtggtggcgggtgtcgaggcactcctcatggagaatgaagctgatgcagacctgcttgaaagaaaatcagtgacgcgtgagaaggtgctcaacctggtcagtgagcttgaacggatgtcaaagggatccggcttcccgctgagttttcaactggttgagctgtggcaggcgcgctcgattgtggagcgctggacggatgaacgccgaaaaaatattgccaccataaagacactgctcactgggctgtgtgtagagaagcttccgctgaagccggctgagcttgtcctctctgggtgtgaagcgatggagctcctgaagcttgaacccggacctaaggtcggtaatgttatgaatgagattctccatcaggtgacggccggagctgtttcgaacaatcacgacgaactggtcagcttcgttcgcaatcatgctgcagagctgacagattagttgagatacttgatcagcaggtagtcgatctgagggtcgtctcccacctggtaaatatgctggctgatgcgcttaaagccttttttgcggtagaagtgttgggcagggatattgtgctcgtagacgccgagccacatggcggatttgtattttgcgcgggcaatggactcggctttatcgtagagcaggttccccaagccctggtgttgatagggggcatccagatagatacgttccaactctagtgcattcctggcgatgtgctctgtttgggccgatcccacattcactttgaggtagccggcaacggcactattgacgagcagaaagaaaaatttgctctccggattttcaatttccttacgcaagacgttggtatcgtatttggtatcgaggaagcgggccatatcatccggagcggtcaccgcatcgaaggtcctcttgaaggtgacgcgggagatcctccgaagcggtgcaatatcgtcagccgtgaccgctctgatctccgtcttcgtgacttaagccccctaagtctcaaggtctaaaagaaaccccgctttgagcggggttgtacgtttggtagcccgtagcaggttcgaactgctgatctccgccttgagagggcggcgtcctagaccgctagacgaacgggccatatggctgagatagagagagtcgaactcccattgacggaaccagaatccgctgtcctaccattagacgatatctcaatgcactactcatgcgccttttcaggtgcggcttagtaatataactgaggggggagatttgtgcaagcgacgatttgtataatatcgaaaattctgcgcgagagccgtccttcatcacattctccccatagtctcacccgaagttttcggtcttttctgatttttatccgatgggaacccctacgggtcataatttaagacacttacagtgtgcttgatagcaagagcaccacgatatgagaggagtcgtgaccgatgccgaacgcgcgcaagcgggcacacgtcaatcaaaggccgaggagaaatacgtacagatccccatcccctcagaagatcggtgcggatgagaacaagagccgtgccgccaaaggcatgctctttatcgttgcagtcgtgggcatctatgtcctctaccttgtgattagcgggcagatgggcacgtttctcgattcgatgcaccacgtctcaaccccgtggatcattggggcaatcatctgctactgcctctactacgtggcaggcgtctcttcctatgcggtggcggtatggctcgaccatgactctccggttggcatccgtgacctgatgagcgtggaggcctccggtgctttcttcggcaacctgaccccagcgcagatcggatcggctcctgcacagatcctgcgtctcaccaatgcgggcttggatgcaggtgaggcgacgggtacccagctgacccgtgcgcttatgctccaaatagcttcagttacctacagcctcatcgtcctgctgatcggattcatttcattccgcgccacctacggcaatctgatcttcctggcgctcgtcgcctgggtgatcggctttctgatgatctttgctcagatcgcagtgtgcgtctttccgaaccaagtgatgaaattcggtaacgctgcagtgaagaccttaagcaagcggggttggctcaagaactactcgactgcctacaacttcgtgaacaatgaggtaggggagctctctgcagccttccagcgcgcgacgcagtcccaccagggtctcttcgttacactcgttatcgatttcattcagctgactctgctctacatgattccttggttcatcgcgaatgcctttggatgtgacatcaatccgatcgtctccctcgagctctgtgccctggtccagatggtcggtgcggcagtgcccctgccgggcggtaccggcggcgtcgacttggcttggaacatcttctttggtcctacctttgggagcctgacgatggcaggattcatcatgtggcgtttcatagcctacatcggtccgatcttcttggcgatcccgtttctcaacctgcattcccactcaacccagtcgctctatcagcgctggaacgacatcacacacggcgtgaagtcaaaggaatccccgtttaagtagtctgagtgacgcaaactagggaaacgatgattaattcgcctcgatgaggtagctggggccacacgctgtatgacatcggctcaaaatgtctcgaaccacgcagtgcccatatccacatagatgcctatctgtcttctggatatggtatagctacatccacacattccagcatatccaaaaggaagatatggacagataagatgagctttgaagaccttaaatcctaaggtctgaagagaaagaccaggcgagaggcacacctggagcgaatggatgcaatcgttgtgtgggatagctggattgcactggtagataccagctaccactgacaggctcttgtcaggcatgtgcgcgctgcaaagacaaagctttaggatgtatcctgctttaggtcatgtttgctctcttaagacgagggaacctaaggatgctatcctggattgccactcctggcagcgcttctgtgcacgcagacctcatgcaggcgcaggtgccagatgcaacgacgagcgcgaagatgcgccatagccttaaagcgagagggactcggcaaagcttgtgctttgcgcctggacttagaagcttgaaaaggcagggatcacgatgcaaggtggctccatggtggatgtgaccttcacctgggccctaaagcttaacgaagaacaaagaccatgcgcgcgacccttaaagcgcaccagtccaagaaagggagagcctggcgtatcggatacaaggcgcatatcggcgtggatgccgcaggtggccttgtgcatgctgtagagacgatcgcttagaatgtatctgacatatcctgtggcacatgcactcataagggaagatgacaggttctgctatgcagactttaggctatataggtatagcgaagcgcccttaaggacgcataaagacccacacctctcatctgtgcgctaaagcgttgcaaggaagccttcgactagagagggccttgcctgtgcgctcttggccgagaagggcatcgagtccaggaaggcatccggccgcttaaaggtagagcatcccttccttatcgtgaagcggcacttcgatccccttaaggaagcgctactaggggatagagaagaactcctgtatgctcaagtctgcctcgcccttgcaaaccttgccatgtgcatcttctgccggcaggctgcttagcctggctcccagaatcgcttgatctgtcttggagccttattgcggtgcatggggcaggatagatgtaaggatagtggctcctgcacgtgctggataggcatccttccctgcctttcccgcataccggcctagaaaagtcgtgtggtcggtcccctttagcacgtcatggggcattaatcatcgtttccctagaaatgcagtctgtatttgtggcagagctgacaggcggtgggggtggcggcgaggccaccccgggcggtttccctcagggattccggtaaggattgtcctgtctcacgcattgcgtcgactacctcgtcgaaggggatagggccacacacgtttgcctgagcgagctgcgcggcattgaaggcgattgcgatgccggcggcattacgctgctggcagggatattccactaggcccatcacagggtcacagactaacccctccaaattcgtgatcgcgatcgaggcggcgttcaaagcttgctgaggggttccaccttggagctcaatgagtcccgcagctgccattgcggcagcggtacccacctcagcctgacagcctccttcggcacctgcgatcgaggcattctgagcgatcagaaggccgatagcagcggcacaccagagcgcacgggcaagtgctccgtcatcaacttcaagcgtctcctgagccgcaagcaggacgccggggacgaccccggcggcacccgcagtcggagccgcaacaatcacgcccatcgaggcagagcgttcaatcgttgccatcgcgtatgccatcgagcgcctctgtgtcgcgctgatgaacggcgcaggggtttccgcgacgcgcttggcttccccgtagagaaagcctcccagggaatgctcaggctgctcaagggcctcatgggtttcggcgcgcatcgtatcgatgatgttcttcatcagctgatcggggattttcttgctggagcgcagcttctgttcccgcagccgcatcattccggcaatgctcatctgtttgttgcggcaaagctccataagccgattggcgcttgcaaagtcatacttgaggttgaccctaggcttaaggggcattgtgccagggatattgacgaggctcgcgaactgcacgtgaggcacgtcttcacaggcagccaccacctcctgcgaagccggctcatcggtctcaaagatggtatgcgcttcacctccgggctgctttctgaaggtgcgcattgtcgcgatgttgaggtgctcctttgccaagattgccgtcaaagcagagagtacgcctggggtatcggtgtgcgccacgaagagggtcgggtagtccccggtgatcttcacgacgaccccattgatttcagagatcgagatgcggcccccgcctagggattcgccgcacacttccaggttcctgccggtagtggtatgcatcgcgagggacaccgtgttggggtggggtttggccccgtctcgtccttcgtggatcttaaaggtgaggcctgctcgtatcgccaagtccagcgaatccttcacccgggtatcgtccggtgcaagacccaacagccctgcaatgagcgctcttacggtgccgtgcccgagatgcgttctggcgaaggagttgtagaggatgatatcgactgactgtaagtaagggagcacctgccagtgagcgggcggttagggcgatacgcaccgcccctgcggtatgggaagaggaggggccgaccatagtgggccgacgatctcaaatgcagaggtgtgcataactcagtgtcctttcatgtgtgttgaattccttccaagcctatgggacagtgtgtgccttgtctaggattgttcggccaacataagatcgctatgaaaaagcccggtacaccgagatataccaggctttaaaacaatgctgtagtcgttgcttattgggcaagcggcatcgcgttgtcgatgcgggcaagggcacagggcttgctgagcagctccagggactcacccatcggaggggagacct
